United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 48

SEQ ID NO: 222166 - protein, 299 aa, Glycine max
  Coding DNA Sequence Number=SeqID_105388
MAKAITNEEKGLKNFGIDKKIQKIMNEQQKKKTRKQSQREKEKDELIAREHKTKKWYEQSDLNETDDEEEENVQSVLQKRKVMAQVAPTPKRTKVAKPARASKEVVIPSTIPRHVKTRATKANPKIVTKMQLHWLGLGTQRVCPSTKVTLAVAWRNLQMSKVKKSTQNSIPRDLYEKHRRDPSHEVEPPKRLHILKATKIKIIVDKDVDNYFVINHLLSFPTIQHETIYDLAKIDKQELVAHVTKLHDAQKAKKKSQIKEEEERVVTDIAQVQAVTFYVEASTKPSQHSQPPPPPQVQD

SEQ ID NO: 222167 - protein, 244 aa, Glycine max
  Coding DNA Sequence Number=SeqID_105389
  Gene Ontology: Mol. function=RNA-directed DNA polymerase activity; Cellular component=intracellular; Biological process=RNA-dependent DNA replication
MAKSTLDQLSYQGPPMRRSGVVVKAFDGSRKSVIGEVDLPITIGLFVFQITFQVMDIQVAYSCLLGRPWIHEAGAVTSTLHQKLKFVRNGRLITVSGEEALLVSHLSAFSFIGADETEGTSFQGLTVEGKKPEKNEVSFATWKSAQKVVQEGTGVGWGKVVQLIESKNREGLGFASSAGSATNSVGSSSITSTFCSAGFINNSPEANAVLEDVPEERVLAFVTPGKLVRNWDAVDVPSVVHASK

SEQ ID NO: 222168 - protein, 1260 aa, Glycine max
  Coding DNA Sequence Number=SeqID_105390
  Gene Ontology: Mol. function=DNA binding; Cellular component=oxygen evolving complex; Biological process=DNA integration
  Homolog annotation: Hit_ID=Q1SS72; Match level="QueryCoverage=99%, HitCoverage=86%, E-value=0.0, Identity=45%"; Hit description =Integrase, catalytic region
  Pfam annotation: Domain name=rve; Domain location=582-742; Score =155.6; E_value=1.3e-43; Accession=PF00665.16; Description=Integrase core domain
  Pfam annotation: Domain name=zf-CCHC; Domain location=246-263; Score =9.3; E_value=0.029; Accession=PF00098.13; Description=Zinc knuckle
  Pfam annotation: Domain name=zf-CCHC; Domain location=282-299; Score =12.8; E_value=0.0078; Accession=PF00098.13; Description=Zinc knuckle
  Pfam module annotation: Pfam domain module=RVT_2::Retrotrans _gag::rve::zf-CCHC::zf-CCHC; Domain location=945-1200::77-192::582 -742::246-263::282-299
MNEASINSAESYLYLHPSENPAIALVSPVLDSTNYHSWSRSMVTALSAKNKVEFIDGSAPEPLKTDRTYGAWRRCNNMVVSWLVHSVATSIRQSILWMDKAEEIWRDLKSRYSQGDLLRISDLQQEASTMKQGTLSVTEYFTRLRIIWDEIENFRPDSICSCNIRCSCSAFTIIAQRKLEDRAMQFLRGLNDQYTNIRSHVLLMDPIPAISKIFSYVVQQERQLLGNTGPSINFEPKDVSINAAKTICDFCGRVGHVESVCYKKHGIPATYDGRNKSNNGRKTCTHCGKIGHTVDVCYRKHGYPPGYKPYGGKTTVNNIMAVEGRTTDDHAQQHESQEIVHFSPEQYKALLALIQQPQAGNSTTNQPKQVASMSSSTINTSLNPGTSPSTHRYPTSWILDSGATDHVTCSLHNLHSYTKIDPITVKLPNGHHVHATHSGTVHFSSNLILHDVLYIPTFTFNLISISKLVSSNNYELIFSSTSCVLQDTNNHVKIGIVEARHGLYHLIPNQIPTKAANSIITHPQCNTIPIDLWHFRMGHPSTERLQCMRNYYSLSRNDTNFVCNTCHYAKHKKMPFYSSKSHALHSFDLLHMDIWGPCSKLSMHGHKYFLTIVDDHSRFTWVYLMKTKAETRHIITNFIAFIETQYDGRIKIIRSDNGIEFFMHDYYVSKGIIHQTTCVETPEQNGIVERKHQHLLNVTRSLLFQASLPPTFWCYALPHAAYLINRIPTPFLHNISPYEKLHKHPCDISNIRVFGCLCYINTLKANRQKFDPRGHPCIFIGFKAHTKGYLVYDLHSHDVAVSRNVTFYENHFPQLPETQPSNRNNSAPSPIPFFGKELHPPEEKQIPQTSKPAHPPCNDHLREQAPSQSRRSTRSKRSPAYLQDYHRSLASSTSTASMVVRYPLSSVLSYSRLSPTHRNFVMTISSAIEPASYVEASRHDCWIKAMTAELQALHMNNTWRLMPLPPHKTAIGCRWIYKIKYRAVGSIERYKARLVAKGYTQTEGLDYLDTFSPVAKLTSVRVLLALAALNKWHLRQLDVNNAFLHGELEEEVYMQVPPGLPVDNPKLVCRLQRSLYGLKQASRQWFTKLSSFLTSHDFQRSDSDHSLFLRIIGSTITILLVYVDDIILTGNSLTEIQAITTLLDQEFRIKDLGNLKFFLGLEIARTSKGIHLCQRKYVLDILSESGMLGCKPHSTPMDYSVKLQKSSGNPLPNESSSSYRRLIGKLIYLTNTRPDIAYAVQQLSQYMSAPTTAHLQAAFR

SEQ ID NO: 222169 - protein, 171 aa, Glycine max
  Coding DNA Sequence Number=SeqID_105391
  Gene Ontology: Mol. function=DNA binding; Cellular component =mitochondrion; Biological process=DNA integration
  Homolog annotation: Hit_ID=Q2HRM8; Match level="QueryCoverage=94%, HitCoverage=13%, E-value=2e-51, Identity=61%"; Hit description =Polynucleotidyl transferase, Ribonuclease H fold
  Subcellular localization annotation: CTP_CleavageSite=48; ConfidenceScore=5.46e-01
TGTPQLRAFSDSDWAGCKDSRKSTTGFLVYLGSSLVSWQSKKQSTVSRSSSEAEYRALASTTCELQWLTYLLQDLRATFVQPATLYCDNQSAIQIATNPVFHERTKHIEIDCHLVRNKVTSGFIKLLPVSSSLQLADIFTKPLTPVVFQHLCNKLGMINIHSQLEGGVLTV

SEQ ID NO: 222170 - protein, 346 aa, Glycine max
  Coding DNA Sequence Number=SeqID_105392
  Gene Ontology: Mol. function=oxidoreductase activity; Cellular component=vacuole; Biological process=response to oxidative stress
  Homolog annotation: Hit_ID=Q9XFI8; Match level="QueryCoverage=92%, HitCoverage=93%, E-value=1e-131, Identity=71%"; Hit description =Peroxidase
  Pfam annotation: Domain name=peroxidase; Domain location=54-291; Score=354.0; E_value=2.5e-103; Accession=PF00141.13; Description =Peroxidase
MATPPNSFCSLFFIYSILLSSFFLAYEAQAYPPVVNGLSYSFYSQTCPKLESIVRNHLEKEFTQASWQAAALLVVFFHDCFVQGCDGSLLLDGNPGERDHPLNRGISLKVLRTIDDLRNVVHNECGRIVSCADITVLAARDAVYLSGGPNFAVPLGRRDSLNFSFEEVNNLPLPYNITSVTLQTFASKNLDVTNVVALVGAHTLGRAHCHTFYNRLSPLDPNMDKTLAKILNTTCPSTYSRNTANLDIRTPKVFDNKYYINLMNRQGLFTSDQDLFTDKRTKGLVEAFAHDQTLFFEKFVDGFIRMSQLDVLTGNQGEIRAKCNVINNKRPIVTSINVDEMVQLIY

SEQ ID NO: 222171 - protein, 317 aa, Glycine max
  Coding DNA Sequence Number=SeqID_105393
  Gene Ontology: Mol. function=calpain activity; Cellular component =intracellular; Biological process=proteolysis
  Homolog annotation: Hit_ID=Q1T2S5; Match level="QueryCoverage=93%, HitCoverage=96%, E-value=4e-60, Identity=41%"; Hit description =Cyclin-like F-box; F-box protein interaction domain; Galactose oxidase, central
  Pfam annotation: Domain name=F-box; Domain location=9-56; Score=36.5; E_value=9.3e-08; Accession=PF00646.23; Description=F-box domain
MRKDNLRGVRSVFLPQELIIEILLRLPVKSLVRFKCVCKLWLSLISDPHFAISHFEQAAIHNERLVLLAPCAREFRSIDFNASLHDNSASAALKLDFLPPKPYYVRILGVHKQVPRSPIVSDMDVRFFTFLYGFGYDPSTHDYLVVQASNNPSSDDYATRVEFFSLGANAWKEIEVVFDLMERSFSEIPLPVDFDIEYFYDYNFCQLGILGECLSICVVGYYCSTEIWVMKEYKVQSSWTKTIVVCVDDIPNRYFSQVCCTKSGDIVGITGTTGLVKCNDKGQLQEHRSYCNGPKGYQVTVYTESLLSLPSGSKLEE

SEQ ID NO: 222172 - protein, 224 aa, Glycine max
  Coding DNA Sequence Number=SeqID_105394
  Gene Ontology: Mol. function=oxidoreductase activity; Cellular component=vacuole; Biological process=response to oxidative stress
  Homolog annotation: Hit_ID=Q9XFI8; Match level="QueryCoverage=89%, HitCoverage=58%, E-value=1e-112, Identity=100%"; Hit description =Peroxidase
  Pfam annotation: Domain name=peroxidase; Domain location=4-168; Score= 139.7; E_value=8e-39; Accession=PF00141.13; Description=Peroxidase
MEIMMESLSSTLKCRDGSANLSTGGPDYAVPLGRRDGLSFSTSGTSDLPKPFNTTGVTLDAFAAKNFDVTDVVALSGAHTFGRAHCGTFFNRLSPLDPNMDKTLAKQLQSTCPDANSGNTANLDIRTPTVFDNKYYLDLMNRQGVFTSDQDLLNDKRTKGLVNAFALNQTLFFEKFVDATIKLSQLDVLTGNQGEIRGKCNVVNARKSLLTSVVEEVVQLVDQF

SEQ ID NO: 222173 - protein, 157 aa, Glycine max
  Coding DNA Sequence Number=SeqID_105395
MPRLSEFMLILKQGSPSSLGEDLSETPSWLSISNCSLKQGEHRWMKLSKPDQEFSDVIRCEFYENAYHPLEGEANVLEWYNIIYGIHIPYNARAINTYLAESAPKPGTYFVRILNTRVRDPKGWGFQKREKIIDHDSMNFGKKRMTTERKIDGRWHN

SEQ ID NO: 222174 - protein, 125 aa, Glycine max
  Coding DNA Sequence Number=SeqID_105396
MDQVQRQSFSKATEVWMTPLPKREDKSGPNNRGVRGDLRMLDRRKEDIPLFWEWSSGNTEEVLGGEGRNSGKPRRVDIIHGCISITSVWDSTILNVDGLVDLAAIDAFLVYHHSKESLIIVVLAN

SEQ ID NO: 222175 - protein, 215 aa, Glycine max
  Coding DNA Sequence Number=SeqID_105397
MEHKRNEAAAIPTINNKKDAKNTFPKDSFILGRWVNFQSLEEEIFHEKDDNLPNARKPDLYVQTYPQLFVQHGHAQTGFGVGRSFLTSVKALSAKEHKKKLAEDGKIVALERKLFEEISDEVIFESLKTLFVEEVQKQSAEKATMMDIDREAVPETIIVEMDELERFQSTTEHVTGFLSLNSFQRQVRMEATIVPEDMDPIEKEVLEEAHALAYY

SEQ ID NO: 222176 - protein, 260 aa, Glycine max
  Coding DNA Sequence Number=SeqID_105398
  Gene Ontology: Mol. function=RNA-directed DNA polymerase activity; Cellular component=intracellular; Biological process=RNA-dependent DNA replication
MAQHQRRLNPVMKEEVRREVLKLLEVRMIYPISNNSWVSLYRWFQRNMEILTMQHGKITFPFLSWIERLFGQAFYCFLDEKYIEIFMDDFSIFGDLFDTCLSNLELVLKKCVETNLVLNWPKCHFMVTEGIVLGHKISTRGFEVDKVKIDVIERLPPPGDAKAGKVLNGVQLNYATTEKEMLAIVYALENFRLYLVGSKIIVYNDHSSGLFTIKELKNYRAIELQDLATQKNWIVNGKRLKIYLSGDIERLITVMHLSDS

SEQ ID NO: 222177 - protein, 81 aa, Glycine max
  Coding DNA Sequence Number=SeqID_105399
  Homolog annotation: Hit_ID=Q1STZ2; Match level="QueryCoverage=65%, HitCoverage=11%, E-value=9e-07, Identity=44%"; Hit description=IMP dehydrogenase/GMP reductase
MDQVQCQAFRKTYGKIWDLAMIEVSIEAITSLTQYYDQPLRCFTFGDFQLVPTVEEFEGILGCLLGGRNLYLFSGLYPSMA

SEQ ID NO: 222178 - protein, 59 aa, Glycine max
  Coding DNA Sequence Number=SeqID_105400
MSSIRTLLSLVVTLDLEVEKEPIWFEAGSKIVNYLESSWVGYQCLEKGYLQRVLIGGGF

SEQ ID NO: 222179 - protein, 40 aa, Glycine max
  Coding DNA Sequence Number=SeqID_105401
MEEELHQFTKNDVWTLIPKFENKNIIGTRWAFENKLDEQK

SEQ ID NO: 222180 - protein, 68 aa, Glycine max
  Coding DNA Sequence Number=SeqID_105402
  Gene Ontology: Mol. function=ATP-dependent helicase activity
  Homolog annotation: Hit_ID=Q1S896; Match level="QueryCoverage=60%, HitCoverage=9%, E-value=4e-11, Identity=83%"; Hit description =Helicase, C-terminal
MNDDDDVVVVGWLVEQRDCHVSSLVLNEVDRLLNEDFEESLNEILQMIPRDWRIFLFSATMTKKVRVN

SEQ ID NO: 222181 - protein, 219 aa, Glycine max
  Coding DNA Sequence Number=SeqID_105403
  Gene Ontology: Mol. function=DNA binding
  Homolog annotation: Hit_ID=Q1SFS3; Match level="QueryCoverage=96%, HitCoverage=41%, E-value=2e-76, Identity=66%"; Hit description =Lambda repressor-like, DNA-binding
  Pfam annotation: Domain name=DUF1723; Domain location=48-97; Score =12.3; E_value=0.018; Accession=PF08330.1; Description=Protein of unknown function (DUF1723)
MDIPLRSTRKYLFKKTDLLRLRELASLVSDPVDFQAHHGKLLRILRVDIEEGCLETLVQFYDPLYHCFTFPDYQLVPTLEEYSYLVGLPVPDKIPFHGFEPTPKPSDIAAALHLKTSIIQANLTSKGGLQGLPTHFLYQQASIFAEAASTLAFHSILALLIYGLLLFPNIDNFIDINAIKILLTKNPVPTLLADTYHSIHDRTQAGRGTISCCAPLLYL

SEQ ID NO: 222182 - protein, 72 aa, Glycine max
  Coding DNA Sequence Number=SeqID_105404
MQRWPRTARGYATGKGWGPGSADAGEKRWTPEIVAATEVVVVHLHLAAVGPPPAAAVPDLAFVPALAYNIFL

SEQ ID NO: 222183 - protein, 56 aa, Glycine max
  Coding DNA Sequence Number=SeqID_105405
MKTVQVEASIPAPSLLRLRTLSEQSEEKLEESQETARNAAVTVERHVSLLRGILRG

SEQ ID NO: 222184 - protein, 145 aa, Glycine max
  Coding DNA Sequence Number=SeqID_105406
MHPKNSTTWLIHIIKGSIKEDLFDTIREKLFLKAKVGDPILGIISIKIDNPSISPSNQGPNLYERTTKLEDTLTQFMQVSLSNHKSTELAIKKLEVQVGQLPKQLDERPIGSFVAYTKKNPKEEYKAVLTRSHRRENIKREERDE

SEQ ID NO: 222185 - protein, 186 aa, Glycine max
  Coding DNA Sequence Number=SeqID_105407
MPMMTLAKRMALFMQITEKHGGNLCKALKGFLEEVCMILVTTSIPSEEELDLAINTPQDDSPGASNQNPLSQSSASPVSPRRKSLGQRMKEAYKAWKKKNAGASSSQQKDVPKGANDPDLLNEDPAITERKAKEREAYHERICRDYRNIERVIRISVILPDKLRIARIFSKREKLEVELALEYDEN

SEQ ID NO: 222186 - protein, 258 aa, Glycine max
  Coding DNA Sequence Number=SeqID_105408
  Homolog annotation: Hit_ID=Q2QPI8; Match level="QueryCoverage=18%, HitCoverage=6%, E-value=1e-12, Identity=63%"; Hit description=PHD -finger family protein, expressed
  Pfam annotation: Domain name=DUF822; Domain location=84-223; Score =36.3; E_value=1.1e-07; Accession=PF05687.4; Description=Plant protein of unknown function (DUF822)
MITRFSRVLHAAPDTPNAFIHDVSGLYDFLADTHRNDAIIQFPIPKVLLSPSPPLDIVRIGIGLLLACSGSGGSENDFGQSNIGGNESGETFMEGEREQLEEKESIGVKIYFGLRAQGNYNLTKRYNNNEVLKALYAEAGWTDEEDETTYCKCYIGCILSDFSCVACLSRILQEMLLERSKVKPIEAIVEFASVEKWKEVRKFRRCYCAKVVARSTIGIASEVGVKIEICFIGIHGLYHFLQLKHFVLPIEAIKKIKI

SEQ ID NO: 222187 - protein, 99 aa, Glycine max
  Coding DNA Sequence Number=SeqID_105409
MGERQILGKKHKEIEEIWLEVLERIHVTRLKEFLFKENKLIYVSFGDDLEELGDKFILYLIALGVVSCKGPKDCDKSTFTNYPRIFDGFLYDSNCAANV

SEQ ID NO: 222188 - protein, 68 aa, Glycine max
  Coding DNA Sequence Number=SeqID_105410
MRIVSKHTGTNPNLKEGNGFFVSSDPELKRKKRMKAYNMLTVEGELKTSVRNNFKWIKNKFSDIRYGV

SEQ ID NO: 222189 - protein, 199 aa, Glycine max
  Coding DNA Sequence Number=SeqID_105411
  Homolog annotation: Hit_ID=Q00M75; Match level="QueryCoverage=18%, HitCoverage=6%, E-value=6e-10, Identity=89%"; Hit description=PPR -repeat containing protein
MSFRISYSIAQRLFAMRRYGGGMLYAALPLHMQRGCFQIRTHDQQVTKAQLYRCTRARPHVVSDIIRKKKIVTRSRSKGHQFDCKPSWVNLGCSGSKAHSIELVTQPGPATWSRFDRGILMEACLRNFYGMFHKNMPNEYSKNMPKKYSKNMPKGRKTTHISSIAKLTPMSKYTKIQKKVPTTKTTQNALKYKAKTLYY

SEQ ID NO: 222190 - protein, 55 aa, Glycine max
  Coding DNA Sequence Number=SeqID_105412
MAARGGHRWSWVVKKEISLSDLVSLNGSPLSSFSVQIFTQHNFLYTMARSAQFPL

SEQ ID NO: 222191 - protein, 74 aa, Glycine max
  Coding DNA Sequence Number=SeqID_105413
  Homolog annotation: Hit_ID=Q86ZY9; Match level="QueryCoverage=57%, HitCoverage=11%, E-value=3e-08, Identity=65%"; Hit description=Alpha- tubulin
MDKSLEVREEEWREKERGSTKFVPQKSIFLVGDELFGVEKLTIGVIDFVDDGGFEIDEDGVRDMLVESGGHRIF

SEQ ID NO: 222192 - protein, 136 aa, Glycine max
  Coding DNA Sequence Number=SeqID_105414
  Gene Ontology: Mol. function=metal ion binding; Biological process =ubiquitin cycle
  Homolog annotation: Hit_ID=Q8RUJ8; Match level="QueryCoverage=50%, HitCoverage=16%, E-value=4e-22, Identity=63%"; Hit description =Putative hydroxyproline-rich glycoprotein
  Pfam annotation: Domain name=zf-C3HC4; Domain location=81-119; Score =8.9; E_value=0.019; Accession=PF00097.15; Description=Zinc finger, C3HC4 type (RING finger)
MYRTVKNTNKLVASSGGSILGLKFLDPLAELLVSGMILKAGAETEDETSGDSLLDASPHMQITQGNSSTTNFDDNDPRNECVICMTEPKDTTVLPCRHMCMRNECANALQHQFNKCPKCRQPIEELIEIKMNNGDQ

SEQ ID NO: 222193 - protein, 154 aa, Glycine max
  Coding DNA Sequence Number=SeqID_105415
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-18, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=14; ConfidenceScore=5.67e-01
MWSPLKARACSPLMARTRSPLKVRACSSLKARTCSPLKRRTWSPLKARVCSPLKVMTYTPLKARTCSPLKVRACSLMMVRTCSPLKVRACSPTEVRTCSPLKARACSPLKVRARSPLKVRKCIPLMVKACNPLKARTCSPLKVRPCSPFKGEDV

SEQ ID NO: 222194 - protein, 107 aa, Glycine max
  Coding DNA Sequence Number=SeqID_105416
PTNVSNLHGDEDDDDDDDYLVSNSYVEESLDEDDSLDGISDTHDEVADMIQPVYKELKIHFGMMLCIITISTRVILMRKTFVVWRCHRVLMLDKNYMLAWILILKMR

SEQ ID NO: 222195 - protein, 229 aa, Glycine max
  Coding DNA Sequence Number=SeqID_105417
  Gene Ontology: Mol. function=binding; Cellular component=clathrin coat of trans-Golgi network vesicle; Biological process =intracellular protein transport
  Homolog annotation: Hit_ID=Q9XFS0; Match level="QueryCoverage=46%, HitCoverage=12%, E-value=4e-34, Identity=68%"; Hit description=Gamma- adaptin 2
  Pfam annotation: Domain name=Alpha_adaptinC2; Domain location=87-200; Score=112.9; E_value=9.1e-31; Accession=PF02883.10; Description =Adaptin C-terminal domain
  Subcellular localization annotation: CTP_CleavageSite=60; ConfidenceScore=5.53e-01
MTLFDPFAGQASKSGNDVLLDLLSIGSPSVESSSSTVDILSSNSSNKAPVSSLDGLSSLSLSTKTTSNAAPMMDLLDGFAPIPPTENNGPVYPSVTAFESSSLRLTFNFSKQPGNPQTTVIQATFMNLSSNTYTDFVFQAAVPKFLQLHLDPASSNTLPANGSITQSLKITNSQHGKNVDHWHFAAKQLVYALFLYLILSAAKLLIICVWGLLSDHYFSDRSSKPTMIF

SEQ ID NO: 222196 - protein, 318 aa, Glycine max
  Coding DNA Sequence Number=SeqID_105418
  Gene Ontology: Mol. function=binding; Cellular component=clathrin coat of trans-Golgi network vesicle; Biological process =intracellular protein transport
  Homolog annotation: Hit_ID=Q9XFS0; Match level="QueryCoverage=79%, HitCoverage=30%, E-value=1e-108, Identity=76%"; Hit description =Gamma-adaptin 2
  Pfam annotation: Domain name=Adaptin_N; Domain location=14-317; Score= -86.3; E_value=6.1e-05; Accession=PF01602.10; Description=Adaptin N terminal region
MIRAIRACKTAAEERAVVRKECAAIRAAINENDNDYRHRNLAKLMFIHMLGYPTHFGQMECLKLIASPGFPEKRIGYLGLMLLLDERQEVLMLVTNSLKQYPVFSQRNICSAEMARDLAPEVERLLQFRDPNIRKKAALCSIRIIKKVPDLAENFINPATSLLREKHHGVLITGVQLCTDLCKISTEALEHIRKKCTDGLVRTLKDLANSPYSPEYDIAGITDPFLHIRLLKLLRVLGEGNADASDTMNDILAQCSCCDDWVICNFCMALLCMNLRCFITRLCAGKLWAKGGMLKLWEKKGVLKFHIVVGSRDQNGTC

SEQ ID NO: 222197 - protein, 337 aa, Glycine max
  Coding DNA Sequence Number=SeqID_105419
  Homolog annotation: Hit_ID=Q6YWQ3; Match level="QueryCoverage=98%, HitCoverage=64%, E-value=3e-84, Identity=52%"; Hit description =Putative NHL repeat-containing protein
MAWVTTIAGGKWSRGGGHVDGPSEEAKFSNDFDVVYVGSSCSLLVIDRGNQAIREIQLHFDDCAYQYENGFPLGIAVLIGAGFFGYMLALLQRRLGTIVASQDAEGAAMSGISPSPYQKPLNSARPPLIPSEDESDKQEESFFGSIGKLLTNAGASVVEIMGALFPGFRKNPPQSYEFQSPPLFQQPQKQVNAWPVQESFVIPDEDEPPSIDPRTPTPRKTYAFMSKDAEKMQQLWQSRAFYSGWDGDLQQQQQLKHQQQQQQQQLKHHRHQYHSSVPHTYYEQSHEETNEIVFGAVQEQDGKKGTVVIKPVDYGQSVYDHHYIRPRISSMGHINKY

SEQ ID NO: 222198 - protein, 227 aa, Glycine max
  Coding DNA Sequence Number=SeqID_105420
SLNTFLETPVVLAEGESLPAYSRYYRMPTDIREIEAALCIPGGGCVLNAEGHPGNILRKDLTTLAQVWSVLSYSNLAPTSHTSDLTVDRARLIFSLVSQIDMNVGALISGQITSMAQSNSSRLGFPAVITTLCRSRGVASDNLVFERLSPVINLAYIRKNYWNPDDLTVIIRGARRARARPAEAPSTFAAPPPARTSATPSTPPSARTFHLKFVDHVFSSFSDVFLK

SEQ ID NO: 222199 - protein, 79 aa, Glycine max
  Coding DNA Sequence Number=SeqID_105421
  Pfam annotation: Domain name=zf-CCHC; Domain location=9-26; Score =16.7; E_value=0.0017; Accession=PF00098.13; Description=Zinc knuckle
MFPKEVTTLRCYKCNQLGYIKANCPSNEQWPEKKSHEERRTKKAYIDWDDNDSSEKSENEEINLLTKDYESEEDITQRD

SEQ ID NO: 222200 - protein, 536 aa, Glycine max
  Coding DNA Sequence Number=SeqID_105422
  Gene Ontology: Mol. function=transferase activity, transferring glycosyl groups; Cellular component=integral to membrane; Biological process=metabolic process
  Homolog annotation: Hit_ID=Q8W3P8; Match level="QueryCoverage=85%, HitCoverage=96%, E-value=0.0, Identity=73%"; Hit description=ABA -glucosyltransferase
  Pfam annotation: Domain name=UDPGT; Domain location=69-530; Score= -106.5; E_value=2.9e-05; Accession=PF00201.9; Description=UDP -glucoronosyl and UDP-glucosyl transferase
MENFEVDANRGQYRTTNHDYRLAFTKATRVTQQDMSEIPNHVYNFTAFDDILNVTASPGYLIDVIGEITEIVQWDLDRGGHQIPMIDAARVFASHGAKSTILATPSNALHFQNSITRDQQTGLPVAIHTFSADIPDTDMSAVGPFIDSSALLEPLRQLLLRHPPDCIVVDMFHRWAPDIVDELGIARIVFTGHGCFPRCVTENIINHVTLENLSSDLEPFVVPNLPHHIEMTRSQVPIFLRSPSPFPDRMRQLEEKSFGIVTNSFYDLEPDYADYLKKGTKAWIIGPVSLCNRTAEDKTERGKTPTIDEQKCLNWLNSKKPNSVLYVSFGSLARLPSEQLKEIAYGLEASEQSFIWVVRNIHNNPSENKENGSGNFLPEGFEQRMKEKDKGLVLRGWAPQLLILEHVAIKGFMTHCGWNSTLESVCAGVPMITWPLSAEQFSNEKLITDVLKIGVQVGSREWWSWNSEWKDLVGREKVESAVRKLMVESEEAEEMTTRAKEIADKARRAVEKGGTSYADAEALIQELIARRLARQD

SEQ ID NO: 222201 - protein, 210 aa, Glycine max
  Coding DNA Sequence Number=SeqID_105423
MERKKQDRVMQFLKGLNDQFSNVRSNVLMMDPLPVDRCFKKNGFPQNYGFKGGKSNQSGFGKGNSSGKGSKLCTYCGFINQTDDECYKKHGYPPAHKYHKSQSSNINNMNVLKEEDMQNLKRIGTVDMVKGLSRLKMLTLKPLKEYAPSFITASIPVVSASVSAFSSLFQDSLKTKPCLKTKCFQDMQGSGNRLPGSVIDYQKTGLRNSC

SEQ ID NO: 222202 - protein, 319 aa, Glycine max
  Coding DNA Sequence Number=SeqID_105424
  Gene Ontology: Mol. function=transferase activity, transferring glycosyl groups; Cellular component=integral to membrane; Biological process=metabolic process
  Homolog annotation: Hit_ID=Q8W3P8; Match level="QueryCoverage=86%, HitCoverage=63%, E-value=8e-80, Identity=52%"; Hit description=ABA -glucosyltransferase
MAPKIDSIKIELFFPFLEGGHQIPMIDAVRVFASHGAKSTILTTPSNSLFFHNSIMRRGHQIPMIDATRVFASHGAKSTILATPSNSLHFQNSISRDQKTSLPVPIHTFSIDIPDANMPTVSPFIYSSALLEPHRHLVILHPPNCIIVDMFHCRAHEISDKLGIMSIVFNGHECFPCCITENIRNHVMLENLSSNSEPFVVPNLPHRIEITSLNIVTNNFYDLELDYADYVKKGKKTFVGPVSLCNKSTVDKSITGRPLIINEQKCLNWLTSKKPNSVLYVSFGSIARLPPEHLKEISYGLEASEQSFIWVVRNIHNNP

SEQ ID NO: 222203 - protein, 109 aa, Glycine max
  Coding DNA Sequence Number=SeqID_105425
  Gene Ontology: Mol. function=catalytic activity; Biological process =metabolic process
  Homolog annotation: Hit_ID=Q1STD6; Match level="QueryCoverage=53%, HitCoverage=26%, E-value=5e-23, Identity=89%"; Hit description=CBS
MLGVNEINFFLYGKGYVQTFNELQKLLSKTNGQVVGDLMTPTPLVVHESTSLEEAARLLLETKYRRLPVVDDDGKLARRYYILFFMQSLITDIYELYTWKYRGMGNILS

SEQ ID NO: 222204 - protein, 308 aa, Glycine max
  Coding DNA Sequence Number=SeqID_105426
  Gene Ontology: Mol. function=chromatin binding; Cellular component =chromatin; Biological process=chromatin assembly or disassembly
  Homolog annotation: Hit_ID=Q1SAV4; Match level="QueryCoverage=85%, HitCoverage=82%, E-value=1e-57, Identity=41%"; Hit description =Integrase, catalytic region
  Pfam annotation: Domain name=rve; Domain location=14-177; Score=68.3; E_value=2.5e-17; Accession=PF00665.16; Description=Integrase core domain
MTRKPAWLLSPLPVPTRPWEDLSLDFIVGLSSYKGNTTILVVVDRFSKGIHLGLLPSQYIAYQVATLFLDILAKLHGMPQSLVSDRDPLFISKFWQELFKLSGTKLRLSLACHPQSDGQTEVMNRIIEQFLRAFVHHRPSSWETTDNPSVYHRLFLSGGSGYITHHTGGDWVMVKLRPQRQLSVTSPNKTKLVKHSYGPLKVLEHIGIVAYKLLLSKDSRIHPIFHCSLLKPFRHDVGTKPSPLPLPRKHSNNRPIITPLIILNTRWVDTYNGLCLQDNVIFKGAGSDRLVNMHEAQHRRPQRKVTPL

SEQ ID NO: 222205 - protein, 385 aa, Glycine max
  Coding DNA Sequence Number=SeqID_105427
  Gene Ontology: Mol. function=RNA-directed DNA polymerase activity; Cellular component=chromatin; Biological process=chromatin assembly or disassembly
MAESTRYKSNLDHLEDVIAKLTATQASMSTKLDDLHQKLAVMESIHHSPVSSSTHFLASSISLIIGLMPPFLLSYFILGLSLEIRWEVQALQPLSLSQATALARLQEEKFCDLRHLTHPCAYSPCSFDPRSPQPNISPTLPLLPPPPLLSTPPKPSIPFKCLSHEEITIHRENGLCFNCDEQFNPSHHCSSKLFLLIADDDELLSEEMPLIEAFPVAQEPDDPPPAQISFHAISGHMALETLCVIGFIFDQKVLILVDRGSTHNFIQECLVTTLGLHAQSTPPLHVMIGNGTEIECLQICKHSLGLVFTDYTDLTMKFKHHNRIIELHGERDDTIREINHHQLKRMVQTDGVSAFFHIRLMDPELPSNQQTQPLTQDPTIISLLH

SEQ ID NO: 222206 - protein, 231 aa, Glycine max
  Coding DNA Sequence Number=SeqID_105428
  Gene Ontology: Mol. function=RNA-directed DNA polymerase activity; Cellular component=chromatin; Biological process=chromatin assembly or disassembly
MPDPKAFVSRVKGLEKLEMNQSGYYGSISFDEASIKTCETQKSPQGFKGGGSWPLLNGRYLVGNGLNTGSKKPNPNVEGGLRMSIAKAKGHYMEFVMPFVSAECGFMYIVLAHKYLVIPLQQIESDDTITQHGFDLSLNLMLLKIGVSVGSNINGKGVWEKINGVGHIAGWGELRVHEANVEKSTNTICLNHPFELMVIDLANGVITFTMQFDDPIVVLEFHSQVCVVRKD

SEQ ID NO: 222207 - protein, 170 aa, Glycine max
  Coding DNA Sequence Number=SeqID_105429
MSIPTMLVLPYPAQGHVNPLMTLSQKLVEHGCKPSFLIHLSVFYNFILPLSSFMANLRARTNNGISTNHVEIPIYISNGVELKPIQKEKSDIATYYETEAAGNNGRLKQHEGDLTTKSMVVTVVDEGDLTSKSMTVFLPILDLTIRRARRTRWGPHGGRNSKLKVKVKNE

SEQ ID NO: 222208 - protein, 148 aa, Glycine max
  Coding DNA Sequence Number=SeqID_105430
  Gene Ontology: Mol. function=hydrolase activity
  Homolog annotation: Hit_ID=Q4FCX5; Match level="QueryCoverage=57%, HitCoverage=19%, E-value=5e-29, Identity=55%"; Hit description=N -acylethanolamine amidohydrolase
MSTCNFTPFGGGQRLCPGLDLDRLEASIFLHHFVSQFRWQAEEDTIVNFPTIIMKKRMSVMWFNDVHSTEISNKCDEALNLLSKAHGCEMIEIVIPELLQMRTAHVVSIGSECLCSLNPDCEDGPRSMYYHLDIFKKVNVIVTPTTSC

SEQ ID NO: 222209 - protein, 619 aa, Glycine max
  Coding DNA Sequence Number=SeqID_105431
  Gene Ontology: Mol. function=zinc ion binding; Cellular component =endoplasmic reticulum; Biological process=ubiquitin cycle
  Homolog annotation: Hit_ID=Q1STD2; Match level="QueryCoverage=99%, HitCoverage=55%, E-value=0.0, Identity=90%"; Hit description=Zinc finger, RING-type; RINGv
MGRLYGFASIAETIPSLFRQFLAAMRHLMTMVKVAFLLVIELGVFPLMCGWWLDVCTIQMFGKTMVHRVQFFSASPLASSLVHWVVGIVYMLLISIFVSLLRGVLRNGVLYFLRDPADPNYNPFRDLIDDPVHKHARRVLLSVAVYGSLIVMLVFLPVKHAMRMAPSIFPLDISVSDPFTEIPADMLLFQICIPFAIEHFKLRTTIKSLLRYWFTAVGWALGLTDFLLPKPDESVNQENGNGEPARQERLQIVQAGVHDQGLVPFAGDDLNRAIITVEEMNAEEDYDNDEQSDSDSYAFVLRIVLLLVIAWMTLLVFNSALIVVPISLGRTLFNSIPRLPITHGIKCNDLYAFIIGSYVIWTAVAGVRYSIEQIRKRRSSVLFGQIWKWCGILVKSSALLSIWIFVIPVLIGLLFELLVIVPMRVPVDESPVFLLYQDWALGLIFLKIWTRLVMLDHMMPLVDESWRVKFERVREDGFSRLQGLWVLREIVLPIIMKLLTALCVPYVLAKGVFPVLGYPLVINSAVYRFAWLGCLSFSFVCFCAKRFHVWFTNLHNSIRDDRYLIGRRLHNFGEHAEKANVAETNSGEKDTILLGTGLNQQDREADVGLRLRHVNQQVG

SEQ ID NO: 222210 - protein, 110 aa, Glycine max
  Coding DNA Sequence Number=SeqID_105432
  Homolog annotation: Hit_ID=Q1SIZ3; Match level="QueryCoverage=35%, HitCoverage=24%, E-value=1e-10, Identity=84%"; Hit description =KNOX1; KNOX2
MIYRQAAKIVTEWYGHSLPFAPSQHIILFSKVMTKWPHFLLTFVYELLNLLLVEDVVAAAGSTLGAGKVALVSSLSCECMLFMKAIDFYCGSIIASLSLPSAKQYASCIW

SEQ ID NO: 222211 - protein, 679 aa, Glycine max
  Coding DNA Sequence Number=SeqID_105433
  Gene Ontology: Mol. function=zinc ion binding; Cellular component =endoplasmic reticulum; Biological process=ubiquitin cycle
  Homolog annotation: Hit_ID=Q1STD2; Match level="QueryCoverage=99%, HitCoverage=60%, E-value=0.0, Identity=81%"; Hit description=Zinc finger, RING-type; RINGv
  Pfam annotation: Domain name=zf-C3HC4; Domain location=78-124; Score =71.2; E_value=3.2e-18; Accession=PF00097.15; Description=Zinc finger, C3HC4 type (RING finger)
  Subcellular localization annotation: CTP_CleavageSite=44; ConfidenceScore=5.55e-01
MEIAHEPSPSLDGSPFAAAETLANSPSSSSSSPSSSSSSASSPRGAKGKEVESTASGTATSPAPAKYDDEDEEEEDVCRICRNPGDAENPLRYPCACSGSIKFVHQDCLLQWLNHSNARQCEVCKHAFSFSPVYAENAPARLPFQEFVVGMAMKACHVLQFFLRLSFVLSVWLLIIPFITFWIWRLAFVRSLGEAQRLFLSHLSTAVILTDCLHGFLLSASIVFIFLGATSLRDYFRHLREIGGQDADREDEVDRNGARIARRPPGQANRNINNGDGNGEDAGGVQGIAGAGQVIRRNAENVAARWEMQAARLEAHVEQMFDGLDDADGAEDVPFDELVGMQGPVFHLVENAFTVLASNMIFLGVVIFVPFSLGRIILHYLSWFFSTASGPVLSAVAPLADTSLSLANITLKNALTAVKNMSSETQENGSIGQVAEMLKANASEMSEMSNITSASAVILKGVSIGTSRISDVTTLAIGYVFILTLIFCYFGIVALIRYTKGEPLTMGRFYGIASIAETIPSLFRQFLAAMRHLMTMVKVAFLLVIELGVFPLMCGWWLDVCTIQMFGKTMVHRVQFFSASPLASSLVHWVVGIVYMLQISIFVSLLRGVLRNGVLYFLRDPADPNYNPFRDLIDDPVHKHARRVLLSVAVYGSLIVMLVFLPVKHAMRMAPSIFPLDIS

SEQ ID NO: 222212 - protein, 1018 aa, Glycine max
  Coding DNA Sequence Number=SeqID_105434
  Gene Ontology: Mol. function=protein transporter activity; Cellular component=cytoplasm; Biological process=intracellular protein transport
  Homolog annotation: Hit_ID=Q1STD0; Match level="QueryCoverage=96%, HitCoverage=97%, E-value=0.0, Identity=67%"; Hit description =Prefoldin
  Pfam annotation: Domain name=DUF869; Domain location=67-892; Score =57.0; E_value=5e-16; Accession=PF05911.2; Description=Plant protein of unknown function (DUF869)
MNHKPWLWRKKSMEKTILAVGKVVSSSKTIEEEAHKLPTNKETGLERSSKSLNEKLATVLLDSHSGDDPLAKQAQKPQQEIRGNDKTKQEVESVEDLEEEASAETVTPADATLEEPLQPPSSVQVEQEQKLSGATAKISTEHEKIQRDLEEKLRETSKRLDDLTAENTHIANALLTKEKSIGDLVKCKQEADAEFSTLMARLDTTEKENSFLRYEFHVLEKELEIRKEEMDYSRQYADVSHKQYLESSQKASKLEAECQRLRLLLQKRSPGSAGLGNMKNEVGVARIRKSNPSRELMYKNNDARNSSNVSEKSFGLMTKRLQDLDEENKALKRILTTKNSELEYSRLMYAETASRLSQAEILLRKISENQRSMELARCYPTSNELPLMSNYDIYSDDEAISSGSWANALMSELEHLRTSEAKIHKSSRATEVSDISFLDDFAEMEKGAIVSIDTPKRGYFSDVSGRELVSVKQDHLGISERKQEIQFKHTTTEKSFDWLQIVLNAMSKEKHISKRSLHELFDDIKIALDCVNHPTACKSDTEAESKQHFNSNLRKSVHRIVNLIEGIAPKSFMCNNCPDCLEEIKHSDISQSPTPKDYFVHVFQWKVSDLNPLLHQLVHTCKDLLTGKADFENFIEEVAFALDWSINNSVTSTNAAIARDKIKKQFSSHLSQNQSKTDVEDKQSSRLPSFAYPDEQCELFNTQNDQCDLLEEIRKLKYDLRSTKTAKKDLEEKLLSVTDESQNLAKQCQEAQNNIKGLESEIEALKESKATLEDQIEKQKIINEDLDTQLTIAQTKLNDIFQKFSSLEVELEDKKNSCEDLEATCLELQLQLESIAKKESPTYGKYEVEKIYQTGWEITTASSKLAECQETILNLRKQLKALASSNEVAIFDKVVSTTNTMANPTQKKNLIKRSSLRNQMQAEDEAKGGMHKSVQTEETKSDKDVQRPPLLQSETEKSLPSPKSLTSEQHDRSKTTGSLAIVPDSGGTCFYLVLEMIEVGVETQSEREVWCCKYSWCK

SEQ ID NO: 222213 - protein, 86 aa, Glycine max
  Coding DNA Sequence Number=SeqID_105435
MLKGSLSKLDWLSEAHPLGEGANSLSEYKTLENVKSESSTLSTQPARPFKELRRGYGLVDLEIFCVVINEGGILISAADFIIVGVE

SEQ ID NO: 222214 - protein, 76 aa, Glycine max
  Coding DNA Sequence Number=SeqID_105436
MDILVRMRINSSLITSMTKVMTKVIKRVLADQHHLRCNITNLRDLTLTIYHTTLINIISFSNKIMYNHQPMHSRLA

SEQ ID NO: 222215 - protein, 94 aa, Glycine max
  Coding DNA Sequence Number=SeqID_105437
MARSGSSWWLLVAVGGGGGGFRVWGKEGVENHIFHIVGRIYYIRLPLSETFVLSIISRLIGIAISELVSLRELFFIDGSALSELVSLSKLFQCR

SEQ ID NO: 222216 - protein, 1075 aa, Glycine max
  Coding DNA Sequence Number=SeqID_105438
  Gene Ontology: Mol. function=transmembrane receptor activity; Cellular component=membrane; Biological process=defense response
  Homolog annotation: Hit_ID=Q2HUN2; Match level="QueryCoverage=99%, HitCoverage=95%, E-value=0.0, Identity=45%"; Hit description=TIR; Disease resistance protein
  Pfam annotation: Domain name=ATP_bind_1; Domain location=223-387; Score=-73.0; E_value=0.1; Accession=PF03029.7; Description=Conserved hypothetical ATP binding prot
  Pfam annotation: Domain name=LRR_1; Domain location=547-580; Score =1.4; E_value=1.5e+02; Accession=PF00560.23; Description=Leucine Rich Repeat
  Pfam annotation: Domain name=LRR_1; Domain location=605-626; Score =1.5; E_value=1.5e+02; Accession=PF00560.23; Description=Leucine Rich Repeat
  Pfam annotation: Domain name=LRR_1; Domain location=628-649; Score =9.0; E_value=6; Accession=PF00560.23; Description=Leucine Rich Repeat
  Pfam annotation: Domain name=LRR_1; Domain location=651-673; Score =10.4; E_value=3.2; Accession=PF00560.23; Description=Leucine Rich Repeat
  Pfam annotation: Domain name=LRR_1; Domain location=675-696; Score =8.8; E_value=6.5; Accession=PF00560.23; Description=Leucine Rich Repeat
  Pfam annotation: Domain name=LRR_1; Domain location=698-717; Score =4.3; E_value=45; Accession=PF00560.23; Description=Leucine Rich Repeat
  Pfam annotation: Domain name=LRR_1; Domain location=719-740; Score =10.1; E_value=3.7; Accession=PF00560.23; Description=Leucine Rich Repeat
  Pfam annotation: Domain name=LRR_1; Domain location=742-761; Score =4.3; E_value=44; Accession=PF00560.23; Description=Leucine Rich Repeat
  Pfam annotation: Domain name=LRR_1; Domain location=795-817; Score =11.5; E_value=2; Accession=PF00560.23; Description=Leucine Rich Repeat
  Pfam annotation: Domain name=LRR_1; Domain location=819-840; Score =12.3; E_value=1.4; Accession=PF00560.23; Description=Leucine Rich Repeat
  Pfam annotation: Domain name=LRR_1; Domain location=842-863; Score =10.4; E_value=3.3; Accession=PF00560.23; Description=Leucine Rich Repeat
  Pfam annotation: Domain name=LRR_3; Domain location=605-624; Score =38.4; E_value=2.4e-08; Accession=PF07725.3; Description=Leucine Rich Repeat
  Pfam annotation: Domain name=NACHT; Domain location=219-371; Score= -23.2; E_value=0.0037; Accession=PF05729.3; Description=NACHT domain
  Pfam annotation: Domain name=NB-ARC; Domain location=181-474; Score =143.0; E_value=7.8e-40; Accession=PF00931.13; Description=NB-ARC domain
  Pfam annotation: Domain name=TIR; Domain location=24-156; Score =152.5; E_value=1.1e-42; Accession=PF01582.10; Description=TIR domain
  Pfam module annotation: Pfam domain module=ATP_bind_1::LRR_1::LRR _1::LRR_1::LRR_1::LRR_1::LRR_1::LRR_1::LRR_1::LRR_1::LRR_1::LRR _1::LRR_3::NACHT::NB-ARC::TIR; Domain location=223-387::547-580::605 -626::628-649::651-673::...
  Pfam module annotation: Domain location=675-696::698-717::719 -740::742-761::795-817::819-840::842-863::605-624::219-371::181 -474::24-156
MANQQIINHASSSSCVASLKRYDVFLSFRGEDTRKIITSHLYHALFQAELATYIDYRLQKGDEISQALIEAIEESQVSVIIFSEKYATSKWCLDEITKIIECKEGQGQVVIPVFYKIDPSHIRKQQGSFKQAFVEHEQDLKITTDRVQKWREALTKAANLAGWDFQTYRTEAEFIKDIVKDVLLKLNLIYPIELKGLIGIEGNYTRIESLLKIDSRKVRVIGIWGMGGIGKTTLATALYAKLFSRFEGHCFLGNVREQAEKQGLDFLRTKLFSELLPGENHLHENMPKVEYHFITRRLKRKKVFLVLDDVASSEQLEDLIDDFNCFGPGSRVIVTTRDKHIFSYVDEIYEVKELNDLDSLQLFCLNAFREKHPKNGFEELSESVIAYCKGNPLALKVLGARLRSRSEQAWYCELRKLQKIPNVKIHNVLKLSFDDLDHTEQEIFLDIACFFKGEYRDHIISLLEACNFFPAIGIEVLADKSLITISPEDTIEMHDLIQEMGWNIVHQESIKDPGKRSRLWDPEEVFDVLKYNRGTEAIEGIILDLSKIEDLHLSFDSFTKMTNWSSKGKIYLPKNGLKSLSDKLRHLQWHGYCLESLPSTFSAKFLVELVMPYSNLQKLWDGVQNLVNLKDIDLRYCENLVEVPDLSKATNLEDLSLSQCKSLRQVHPSILSLPKLQSLDLEGCIEIQSLQSDVHLESLQDLRLSNCSSLKEFSVMSVELRRLWLDGTHIQELPASIWGCTKLKFIDVQGCDNLDGFGDKLSYDPRTTCFNSLVLSGCKQLNASNLDFILVGMRSLTSLELENCFNLRTLPDSIGLLSSLKLLKLSRSNVESLPASIENLVKLRRLYLDHCMKLVSLPELPESLWLLSAVNCASLVTNFTQLNIPFQLKQGLEDLPQSVFLPGDHVPERFSFHAEGASVTIPHLPLSDLLCGLIFCVFLSQSPPHGKYVYVDCFIYKNSQRIDGRGARLHDQNLILDHVFLWFVDIKQFGDDSLLRRLQKGEACDPSNISFEFLVEDEDGEWSTKNIKGCGIYPIYVPGHGYSSKQKGLELGIEDSSRDIVELEPDSSNDIDELQ

SEQ ID NO: 222217 - protein, 286 aa, Glycine max
  Coding DNA Sequence Number=SeqID_105439
  Gene Ontology: Mol. function=nucleic acid binding; Biological process= RNA-dependent DNA replication
  Homolog annotation: Hit_ID=Q2HRL0; Match level="QueryCoverage=40%, HitCoverage=21%, E-value=5e-29, Identity=46%"; Hit description=RNA -processing protein, HAT helix
MAPPEMESEIHDEDEDGDLANSKQGPANGSEMVAQETLIEDQDGIGRKLWVDVISGNRNPAKGRVMQYVAPKVVDGEIDVKIEDEDVAPELKFWETTLILYVLGGDISMHMLKNFMEKAWNFVSLSDMYYHDDGYFMLRFKSHADMDAVLMKGPYTIRNMPLILQEWRPDFDLKKDMLSTIPIWVKLPKLPLHLWGETSLNKIGSAIEIPLVTDECTTHRLRVSYARILVEVDITQKMLDEITITDNKGLKRKQPIEYEWRPKFCEKCQTIGHQCDGAAKHKIWKS

SEQ ID NO: 222218 - protein, 350 aa, Glycine max
  Coding DNA Sequence Number=SeqID_105440
MAAILKGFGKRVPARLDPDLLVWVRDVRSKNLRCWKITEMVLKIKNQARGEPSYTVEAENDGKHEIDVANEDPDPPMEENEQMKTNKQNMDCNNHLFGYQTEEVPMEMVATPRSSVHRKEKKEGGWVGVTQGELIVRLDRPCPKEANSAKGSSQYNHKGSNALFHDELESEGVHMLDPGVGGGCRISLTKSSSWQQPQAVHLEDKEKLYKRRGEIFDHCEIIKALEHWNVQTLEVLQVRHCIQGRNPVFFLIRYQFSVNFHDNFTTFIPSMTTVINWQMQARGEEWEKGALMEDSTSEINVIKENCSSSNEVTVVVLQAHADVKAVVILKDGGIKIAFDDVEIRWLPNLS

SEQ ID NO: 222219 - protein, 255 aa, Glycine max
  Coding DNA Sequence Number=SeqID_105441
  Gene Ontology: Mol. function=transcription regulator activity; Cellular component=nucleus; Biological process=regulation of transcription
  Homolog annotation: Hit_ID=Q1SLX1; Match level="QueryCoverage=100%, HitCoverage=88%, E-value=5e-33, Identity=37%"; Hit description=Helix- loop-helix DNA-binding
  Pfam annotation: Domain name=HLH; Domain location=77-135; Score=33.2; E_value=9.1e-07; Accession=PF00010.16; Description=Helix-loop-helix DNA-binding domain
MTLLTVEDQSLHDMNFLWENHSWDPSNSDNSGESKENMKSLDQVEEKDEALMNKKRNRDQGNITSGEGKGEKCRESDHEMHIWTERERRKKMRNMFASLHALLPHLPSKIGLQGFNTADKSTVVDEAVAYIKNLEKTLEKLEKQKQERVQCVSTFGCEPSMFVTGQGSSNNNISNAIIGTTSNALSFPVAFDKTWASANLVLNIFGDEAQFSICTAHKPGLMTTIGFVLEKYKIEVITANISCIGYGNACMIQAH

SEQ ID NO: 222220 - protein, 382 aa, Glycine max
  Coding DNA Sequence Number=SeqID_105442
  Gene Ontology: Mol. function=metal ion binding; Cellular component =integral to membrane; Biological process=ubiquitin cycle
  Homolog annotation: Hit_ID=Q8GW38; Match level="QueryCoverage=80%, HitCoverage=80%, E-value=2e-78, Identity=55%"; Hit description=RING -H2 finger protein ATL1D
  Pfam annotation: Domain name=zf-C3HC4; Domain location=149-190; Score= 33.3; E_value=8.7e-07; Accession=PF00097.15; Description=Zinc finger, C3HC4 type (RING finger)
  Subcellular localization annotation: CTP_CleavageSite=48; ConfidenceScore=5.71e-01
MYRVHSKILKSNGAITNPPIFARYSSSSSSPSVPYVSNYQKQTAPSPTSSSGNRISPAILVIIVILAVVFFILGFLHLLVRFLIKQRSSSNSSISQSNRYPDMSESDAYQRQLQQLFHLHDSGLDQAFIDALPVFFYKEIIGLKEPFDCAVCLCEFLEQDKLRLLPMCNHAFHIECIDTWLLSNSTCPLCRGTLYSPGFAFENSVFDFESQLKEDGVSGSGGVGSVNKTTESYIVNGKRVFSVRLGNFRSTNNQDVVVERGEGESSSVNLDVRRCYSMGSFQYIVADSDLRVALGPSSGSMRQLLKGRAATNGSSFLDGDAVEGKKINIARKGESFSVSKIWQCSRKDKLTGSSDAHFHNSTVTSTLPWMNKVRVTELVIVP

SEQ ID NO: 222221 - protein, 806 aa, Glycine max
  Coding DNA Sequence Number=SeqID_105443
  Gene Ontology: Mol. function=protein binding; Cellular component =integral to membrane; Biological process=protein amino acid phosphorylation
  Homolog annotation: Hit_ID=Q9C905; Match level="QueryCoverage=91%, HitCoverage=87%, E-value=1e-114, Identity=33%"; Hit description =Putative disease resistance protein; 46848-50365
  Pfam annotation: Domain name=LRR_1; Domain location=115-137; Score =12.5; E_value=1.3; Accession=PF00560.23; Description=Leucine Rich Repeat
  Pfam annotation: Domain name=LRR_1; Domain location=139-162; Score =0.2; E_value=2.6e+02; Accession=PF00560.23; Description=Leucine Rich Repeat
  Pfam annotation: Domain name=LRR_1; Domain location=16-39; Score=7.9; E_value=9.5; Accession=PF00560.23; Description=Leucine Rich Repeat
  Pfam annotation: Domain name=LRR_1; Domain location=191-212; Score =1.4; E_value=1.6e+02; Accession=PF00560.23; Description=Leucine Rich Repeat
  Pfam annotation: Domain name=LRR_1; Domain location=266-289; Score =11.0; E_value=2.5; Accession=PF00560.23; Description=Leucine Rich Repeat
  Pfam annotation: Domain name=LRR_1; Domain location=292-314; Score =19.1; E_value=0.016; Accession=PF00560.23; Description=Leucine Rich Repeat
  Pfam annotation: Domain name=LRR_1; Domain location=316-338; Score =16.6; E_value=0.087; Accession=PF00560.23; Description=Leucine Rich Repeat
  Pfam annotation: Domain name=LRR_1; Domain location=341-361; Score =2.4; E_value=1e+02; Accession=PF00560.23; Description=Leucine Rich Repeat
  Pfam annotation: Domain name=LRR_1; Domain location=362-384; Score =11.9; E_value=1.7; Accession=PF00560.23; Description=Leucine Rich Repeat
  Pfam annotation: Domain name=LRR_1; Domain location=385-407; Score =11.6; E_value=1.9; Accession=PF00560.23; Description=Leucine Rich Repeat
  Pfam annotation: Domain name=LRR_1; Domain location=409-431; Score =12.5; E_value=1.3; Accession=PF00560.23; Description=Leucine Rich Repeat
  Pfam annotation: Domain name=LRR_1; Domain location=41-64; Score=2.2; E_value=1.1e+02; Accession=PF00560.23; Description=Leucine Rich Repeat
  Pfam annotation: Domain name=LRR_1; Domain location=433-454; Score =14.3; E_value=0.45; Accession=PF00560.23; Description=Leucine Rich Repeat
  Pfam annotation: Domain name=LRR_1; Domain location=455-477; Score =12.2; E_value=1.5; Accession=PF00560.23; Description=Leucine Rich Repeat
  Pfam annotation: Domain name=LRR_1; Domain location=479-501; Score =10.6; E_value=3; Accession=PF00560.23; Description=Leucine Rich Repeat
  Pfam annotation: Domain name=LRR_1; Domain location=505-527; Score =9.3; E_value=5.2; Accession=PF00560.23; Description=Leucine Rich Repeat
  Pfam annotation: Domain name=LRR_1; Domain location=529-551; Score =15.5; E_value=0.2; Accession=PF00560.23; Description=Leucine Rich Repeat
  Pfam annotation: Domain name=LRR_1; Domain location=606-628; Score =9.9; E_value=4.1; Accession=PF00560.23; Description=Leucine Rich Repeat
  Pfam annotation: Domain name=LRR_1; Domain location=630-652; Score =14.6; E_value=0.35; Accession=PF00560.23; Description=Leucine Rich Repeat
  Pfam annotation: Domain name=LRR_1; Domain location=654-676; Score =15.9; E_value=0.15; Accession=PF00560.23; Description=Leucine Rich Repeat
  Pfam annotation: Domain name=LRR_1; Domain location=66-89; Score =14.6; E_value=0.37; Accession=PF00560.23; Description=Leucine Rich Repeat
  Pfam annotation: Domain name=LRR_1; Domain location=678-699; Score =6.0; E_value=21; Accession=PF00560.23; Description=Leucine Rich Repeat
  Pfam annotation: Domain name=LRR_1; Domain location=91-113; Score =19.2; E_value=0.015; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1; Domain location=...
  Pfam module annotation: Domain location=115-137::139-162::16-39::191 -212::266-289::292-314::316-338::341-361::362-384::385-407::409 -431::41-64::433-454::455-477::479-501::505-527::529-551::606 -628::630-652::654-676::66-89::678-699::91-113
MIDGSKLRNSLRAFSSVRMLSMSENEFKGTIVAGDFHDLSNLEHLTMDYSNNLKNEFFKSIGELTSLKVLSLRYCNINDTLPPADWSKLKKIEELDLSGNEFEGPLPSSFVNMTSLRELEISHNHFIGNFDSNIASLTSLEYFGFTENQFEVPVSFSTFANHSKIKLIDGGGNRFILDSQHSLPTWIPKFQLQELSVSSTTETKSLPLPNFLLYQNSLISLDFSSWKLEGDFPYWLLENNTKMTEALFRNCSFTGTFQLPMRSLPNLSKIDVSDNIIVGQIPSNNISSIYPNLQFLNLSRNNIQGSIPRELGQMNSLDSLDLSDNHLSREIPKDIFGVGHRLNFLKLSNNKLEGPILNIPNGLETLLLNDNRLTGRLPSNIFNASIISLDVSNNHLMGKIPSLVKNFSGLRQLFLFNNHFEGSIPLELAKLEDLNYLDLSKNNLTGSVPSFVNPSLRFIHLSNNHLRGLPKRMFNGTSSLVTLDLSYNEITNSVQDIIQELKYTRLNILLLKGNHFIGDIPKQLCQLIHLSILDLSHNNFSGAIPNCLGKMSFENKDPERFLERLSGWGSTGQNKIFPSQLPNVEEKVNFTSKKRTDTYTRSILAYMSGIDLSHNKLNGNIPFDLGNLTRIRALNLSHNDLIGQIPATFSNLVQTESLDLSFNKLSGQIPPQLSKLTSLEVFSVAHNNLSGTTPEWKGQFSTFENSSYEGNPFLCGPPLSKSCNPPPSIIPNDSHTHVDDGSLVDMYVFYVSFAVSFSAALLATAIALYINPYCRRAWFYYMELVCSNCYYFIVDSFSRFSNFRNM

SEQ ID NO: 222222 - protein, 132 aa, Glycine max
  Coding DNA Sequence Number=SeqID_105444
MKLCSQELDSLAAKEGDIFYKKKDYTLTQHNHLLLPNFDYETDCQDLTNTWNKPKNQNSTYYATILQDCRQMLANSQHILIVHSKKEANCVAHRLSRLAFTTSERYWMEDVSSQLSFDVQHDLGTIFVPDTS

SEQ ID NO: 222223 - protein, 117 aa, Glycine max
  Coding DNA Sequence Number=SeqID_105445
  Homolog annotation: Hit_ID=Q1SAV3; Match level="QueryCoverage=51%, HitCoverage=10%, E-value=7e-12, Identity=54%"; Hit description =Cyclin-like F-box; F-box protein interaction domain; Galactose oxidase, central
  Pfam annotation: Domain name=F-box; Domain location=7-54; Score=40.3; E_value=6.6e-09; Accession=PF00646.23; Description=F-box domain
MRSEKKPWSPLLCDELIEEILSRLPVKPLIQFKCVCKGWNSLMSDPYFIKLHLSKSAAKDDLEHLQLMKNVCLGSIPEIHMESCDATIWSVHVMGCTVGLAKYQKDTVFVSGTRRQG

SEQ ID NO: 222224 - protein, 107 aa, Glycine max
  Coding DNA Sequence Number=SeqID_105446
  Gene Ontology: Mol. function=protein binding
  Homolog annotation: Hit_ID=Q8H609; Match level="QueryCoverage=90%, HitCoverage=17%, E-value=4e-10, Identity=38%"; Hit description =Putative disease resistance protein Cf-2.1
  Pfam annotation: Domain name=LRRNT_2; Domain location=25-55; Score =13.7; E_value=0.032; Accession=PF08263.3; Description=Leucine rich repeat N-terminal domain
MKSSVVGVCWLILVLLEAMCCEGCWKEERDALLVLNSGFSLEGPDCCQWEGVKCNSSTGRLTQLILRTDIAWLPEPYINYSHFVVFKDLNNLDLSWNAISGCVGNQG

SEQ ID NO: 222225 - protein, 181 aa, Glycine max
  Coding DNA Sequence Number=SeqID_105447
  Gene Ontology: Mol. function=oxidoreductase activity; Cellular component=cytosol; Biological process=electron transport
  Homolog annotation: Hit_ID=Q8ZPM0; Match level="QueryCoverage=97%, HitCoverage=47%, E-value=7e-73, Identity=71%"; Hit description =Putative oxidoreductase
MKGPGSGIRFDLGPHVLDQALQLFGPPVAINVDMAELRPGAQTTDYFHAVLTYPTRRVVLHASMLVAAESARFVVHGTRGSYVKYGLDPQEDRLKAGERPPREEWGYDMRNGTLTLAEGDVMVEKELLTLPGNYPAYYAAIRDAIAGNGANPVTAEEAIQVMELIELGLQSAEKRQTLSLK

SEQ ID NO: 222226 - protein, 1347 aa, Glycine max
  Coding DNA Sequence Number=SeqID_105448
  Gene Ontology: Mol. function=RNA-directed DNA polymerase activity; Cellular component=chromatin; Biological process=chromatin assembly or disassembly
  Pfam annotation: Domain name=Chromo; Domain location=1298-1346; Score= 23.4; E_value=0.00078; Accession=PF00385.14; Description='chromo' (CHRromatin Organisation MOdifier
  Pfam annotation: Domain name=RVP_2; Domain location=316-449; Score= -22.1; E_value=5.3e-05; Accession=PF08284.2; Description=Retroviral aspartyl protease
  Pfam annotation: Domain name=RnaseH; Domain location=779-898; Score= -18.4; E_value=0.003; Accession=PF00075.14; Description=RNase H
  Pfam annotation: Domain name=rve; Domain location=1033-1189; Score =123.0; E_value=8.2e-34; Accession=PF00665.16; Description=Integrase core domain
  Pfam annotation: Domain name=zf-H2C2; Domain location=974-1015; Score= 13.2; E_value=0.0064; Accession=PF09337.1; Description=His(2)-Cys(2) zinc finger
  Pfam module annotation: Pfam domain module=Chromo::RVP_2::RVT _1::Retrotrans_gag::RnaseH::rve::zf-H2C2; Domain location=1298 -1346::316-449::574-876::95-185::779-898::1033-1189::974-1015
MAEHATRRTTSDHLEEAITTLAAKHSELASRVDAMCERFSSVPPHQHPSSSSRMHQRPPVKLDVPRFDGHDPLGWIFKISQFFDYQATLEEDRITVASFYLDGAALSWFQWMYRNGFITTWQALLHAIETRLAPSIYDDPRGALFKLVQRGSVTEYMTEFERLANRIVGLSLSDLLSCFISGLSPEIRREVQAFQPVSLPHATSLARFQEDKINDRRKNSRSLPLVPQTTPSQPSFPPQHPRPKTPFIQRTPEEMMHRREKGLCYNCDEKWSSSHRCKGRVLLFIADSDEPLLPNTNLDDTLPPPLTETAPAYDPTPLQTHISLHAIAGVPATDTFRLYGVINHACVTILIDSGSTHNFIQPRVAKFLNLTMEETTALRVMVGNGSVMECRQLCPATTILIQSHPFTVTLRVLPLSGADVVLGVEWLRTLGPIITDYTTFTMAFTYMGQPITLHADVSSDTNPTSAHQLKRSLHTHSISGLFHLSLLPVTQPDLESEPPHPISAINTLLLKYQALFQQPTALPPPRQHDHHINLIPSALPVNVRPYRYPHSQKNEIEKQVTSLLESGLIQPSRSPFSSPVLLVKKKDGTWHMCVDYRALNAITVKDRFPIPTIEELLDELGSASWFSKLDLRQGFHQILMANDDVPKTSFRTHNGHFEYRVMPFGLCNAPSTFQAAMNALLNPFLRKFAAAQYYLKRSKCFIGQRQLDYLGHVVSGKGVQPDPSKVQAIIDWPTPRSPKDLRSFLGLTGFYRKVPVHLRLSQNRMTTAPILALPNFNLPFILETDASGSAIGAVLQQHGHPIAYFSKPLCPRLQHASAYVRELHAITAAVRRWRQYLLGHRFTIYTDHRSLRELMSQVVQTPEQQFYLVKLLGFDYEIQYKAGTSNIVADSLSRIDCSSQAQCLILSVPHHEFMIQLKDSLKASTEFQQQREAILAYPEQYPDFSVSDDLILFRGVIWLDSKNPFIQSLLHEYHATPIGGHFGIKKTLHRLQSSFHWPSMAKDVRAFIRNCIVCQQVKHLTRKPAGLLQPIPIPNGVWEDLSMDFVTHLPSSHGFTTILVVVDRFTKGVHLGALPTQFTAFKVASLFMDMVCKLHGFPRSIISDRDPVFISSFWRELFRLQGTTLRMSTAYHPQSDGQTEVMNRTVEQYLRSFVHHRPEDWYKFLALAEWSYNTSQHSGTELTPYEATYGKPPPSVPSYVLGSSNNDAAAVVTQTRAEVHATLQHKLIKAQATMKQYADKQRRDVQYEVGQLVYVKLRPYRQLSVRQGRSNKLTKRYFGPFCILERIGQVAYRLQLPPGPLTILDSRLDTSVSPPIRSVLVQWEGLPPEDSTWESGRTFATIPTLRT

SEQ ID NO: 222227 - protein, 42 aa, Glycine max
  Coding DNA Sequence Number=SeqID_105449
MNAAENDDCVISNDMVGLMLLLQPVACPWRRVGVEENIRETR

SEQ ID NO: 222228 - protein, 112 aa, Glycine max
  Coding DNA Sequence Number=SeqID_105450
MAEDQGSHAIDFHLGNHLLVSSNSDNSGESKNNMKPLNQQNEEGEALVNKKRNREIASENEKDNITSDEGLDGKHPESNNEMFDDLRGLLPQLPSEIKEIAVGTWVKVNSFK

SEQ ID NO: 222229 - protein, 148 aa, Glycine max
  Coding DNA Sequence Number=SeqID_105451
  Gene Ontology: Mol. function=transcription regulator activity; Cellular component=nucleus; Biological process=regulation of transcription
  Homolog annotation: Hit_ID=Q1SLX1; Match level="QueryCoverage=97%, HitCoverage=55%, E-value=5e-15, Identity=35%"; Hit description=Helix- loop-helix DNA-binding
  Pfam annotation: Domain name=ACT; Domain location=74-138; Score=14.4; E_value=0.054; Accession=PF01842.15; Description=ACT domain
ADEATVIKVAANYIKGLEESRKRLGKITKRMFPYVFKEIMGTSDTILINGKKKLEFDKVWTSSNMVLNIHANWAQFTVCSAYKPHLLNTITSVLERHNIEVIAANVSFNHNENGKTCMILVHAKQVSDENSAEETYKDASGEIFSLIS

SEQ ID NO: 222230 - protein, 127 aa, Glycine max
  Coding DNA Sequence Number=SeqID_105452
  Gene Ontology: Mol. function=transcription regulator activity; Cellular component=nucleus; Biological process=regulation of transcription
  Homolog annotation: Hit_ID=Q1SLX1; Match level="QueryCoverage=95%, HitCoverage=54%, E-value=2e-09, Identity=33%"; Hit description=Helix- loop-helix DNA-binding
MDKATIIDEVVKYIKFLEETCKKLEKQKQERAQYVLKEVMATSNAVSITTGKKQDILPTIISVLEKPTIISVLEKHNIEVITTSISSNDNVNGNTSMILVHAKQALDADSTEETFKKVAEEIMPWIA

SEQ ID NO: 222231 - protein, 168 aa, Glycine max
  Coding DNA Sequence Number=SeqID_105453
MDTMSYIDFKELINSLGDPRKALSRELKPLNSDSDILQLAKDVSGFNVVEVYVDQGVDEVVAIDGVEAEVKAVVEGEVEAMVEGEVEAEGQVEGEVGVQGDMGAKVQVDEQGLVEIQVQAQHEVGVEGEMEVVVEAVVASDVEDDVEVKQDDDISDYSEVSDNDFEEN

SEQ ID NO: 222232 - protein, 190 aa, Glycine max
  Coding DNA Sequence Number=SeqID_105454
MVSSQGRNTWTVDDLVSYVEKIIILSEEQERITELVSHGPATEHQFAAQEFHMLLSSVETQGIARRREAVEAEPYLYLQMVERCHGMYYTPPTFSQYPTQMYQYPFEGHQSDTSTSEHSLGGVAETYPNFSWPTMTHSQQHDAPIPTPNALLGLLMDAVYVVLKNIIINNFKNKLIMDSYDFIEEHKLNT

SEQ ID NO: 222233 - protein, 80 aa, Glycine max
  Coding DNA Sequence Number=SeqID_105455
MEQRNIPNRHREGTGPATAPLSAPYLTPPTRVVACMAPNLESNPGWGLGILVKPNMPLVGPTFAALKSYSCEHQLIASSF

SEQ ID NO: 222234 - protein, 383 aa, Glycine max
  Coding DNA Sequence Number=SeqID_105456
  Gene Ontology: Mol. function=ubiquitin-protein ligase activity; Cellular component=ubiquitin ligase complex; Biological process =protein ubiquitination
  Homolog annotation: Hit_ID=Q10PB1; Match level="QueryCoverage=93%, HitCoverage=87%, E-value=4e-51, Identity=38%"; Hit description=U-box domain containing protein, expressed
  Pfam annotation: Domain name=U-box; Domain location=13-87; Score =84.0; E_value=4.7e-22; Accession=PF04564.6; Description=U-box domain
MPGSLEPLDLGVHIPYHFRCPISLELMRDPVTVCTGQTYDRASIEAWVSTGNSTCPVTRATLTDFTLIPNHTLRRLIQEWCVANRAFGVERIPTPKQPADPALVRSLLNQASSGSAPAHLRLSSIRRLRQLARDSDKNRSLIASHNVRQILLPIVFNNGSDELKNESLALLVMFPLGESECASLASDSVKIGYLSRMLTHNSFDVRVNSAALIEIVVAGTHSPELRAEPDLAPARAQDRDQGLVRALFGEEYAAEGGGRRHAGGSSRPARGLREVRRGEGAGHGGAALPDSGGMRGVRRTRADGADAGEDNSENLRPCDGVRRRSAALAVFGIGAVPARGGGGGRADSASASRAERLHGESEEEGADAAEASSGFVAARFHRK

SEQ ID NO: 222235 - protein, 55 aa, Glycine max
  Coding DNA Sequence Number=SeqID_105457
  Subcellular localization annotation: CTP_CleavageSite=25; ConfidenceScore=5.00e-01
MAKPSTSALSELSTRLVLSSNSLTRAKRENGVKRDVKIRKPFLSLIFTKLKESAE

SEQ ID NO: 222236 - protein, 625 aa, Glycine max
  Coding DNA Sequence Number=SeqID_105458
  Gene Ontology: Mol. function=protein binding
  Homolog annotation: Hit_ID=Q6L3I4; Match level="QueryCoverage=86%, HitCoverage=93%, E-value=1e-154, Identity=53%"; Hit description =Kelch repeat-containing F-box family protein, putative
  Pfam annotation: Domain name=F-box; Domain location=277-324; Score =23.1; E_value=0.001; Accession=PF00646.23; Description=F-box domain
  Pfam annotation: Domain name=Kelch_1; Domain location=364-406; Score =4.5; E_value=1.2; Accession=PF01344.15; Description=Kelch motif
  Pfam annotation: Domain name=Kelch_1; Domain location=408-454; Score =45.0; E_value=2.6e-10; Accession=PF01344.15; Description=Kelch motif
  Pfam annotation: Domain name=Kelch_1; Domain location=456-503; Score =45.2; E_value=2.2e-10; Accession=PF01344.15; Description=Kelch motif
  Pfam annotation: Domain name=Kelch_2; Domain location=355-406; Score =9.7; E_value=2; Accession=PF07646.5; Description=Kelch motif
  Pfam annotation: Domain name=Kelch_2; Domain location=408-454; Score =20.5; E_value=0.0061; Accession=PF07646.5; Description=Kelch motif
  Pfam annotation: Domain name=Kelch_2; Domain location=456-503; Score =23.8; E_value=0.00063; Accession=PF07646.5; Description=Kelch motif
  Pfam annotation: Domain name=Kelch_2; Domain location=517-557; Score =3.7; E_value=12; Accession=PF07646.5; Description=Kelch motif
  Pfam module annotation: Pfam domain module=F-box::Kelch_1::Kelch _1::Kelch_1::Kelch_2::Kelch_2::Kelch_2::Kelch_2; Domain location=277 -324::364-406::408-454::456-503::355-406::408-454::456-503::517-557
MESKSNGAETYPKRSGFHPSLSVLHVPSPAQPLNHRGVRNGGLCSKFEIFVACIGMLDSFLHWLLILHWWIEGCVVPGSFFFCCGDMLDGRSCVVPRLFSGTCQAENEWSYMKCLLELDIKNGKRPMGIDDVEEDEPHQPRKCTKKLDSCHRVEMARISFQRQSIEAKDSVVVPPLDQETIEPLSVCQGVVGEEGALTDRLLCEKEHEGDGDLMDFGDHQSDKQQQAQPGDLSDFGVRLFDEDQLQHDDNLLNLSEQQSEGRQQQHHHGGDSSDSSSLLPRMNRDSSITCLSRCSRSDYGSLASLNRSFRNIIRSGELYQWRRLNGIMEHWIYFSCALLEWEAYDPIRQRWMHLPRMASNECFMCSDKESLAAGTELLVFGRELRSHVTYRYSLLTNSWTSGTRMNAPRCLFGSASLGEIAILAGGCDSEGHILDSAELYNSETQTWETLPRMKKPRKMSSGVFMDGKFYVIGGIGGSDSKLLTCGEEYNLQTRTWTEIPNMSPGRSSRGPEMPATAEAPPLVAVVNDELYAADYADMEVKKYDKERNVWFTIGRLPERAVSMNGWGLAFRACGDKLIVIGGPRTHGEGFIELNSWVPSEGPPRWDLLARKRSGNFVYNCAVMGC

SEQ ID NO: 222237 - protein, 190 aa, Glycine max
  Coding DNA Sequence Number=SeqID_105459
LFVLQIAKRNVYTDNHSGISARQRDSKVSMTDLVSAEDDVNLRVLFVLQIAKKNVYTDNHSGISTRQRDSKVGMTDLVSVEDDVNLRVSTGLSAAIDEGRRRRPKKNVYTDNHSGISARQRDSKVSMTNLVSAEDDIAQESFESADNHLGISARQCDSSVSMTELVKVTDKSEALAPTYPPMRNSDLRSS

SEQ ID NO: 222238 - protein, 154 aa, Glycine max
  Coding DNA Sequence Number=SeqID_105460
  Subcellular localization annotation: CTP_CleavageSite=33; ConfidenceScore=5.04e-01
MGGYVGARASLWSTAPPLVAMTQELVARGDTLRLSAPRHSVTPKAAGPMIRGDTLRLSAPFCHPEAAGPMTSRDKIWSFCTLVSSRGDGPDDTRRYLTVIRTLLSSRGGGPDDTRRYLTVIRTLFSSRGGGPDDKQRQNLVILHPCVIQRRRAR

SEQ ID NO: 222239 - protein, 33 aa, Glycine max
  Coding DNA Sequence Number=SeqID_105461
LQTCIGHTSALHDQYYMCAVITGQPGPCGLARN

SEQ ID NO: 222240 - protein, 265 aa, Glycine max
  Coding DNA Sequence Number=SeqID_105462
  Gene Ontology: Mol. function=2,4-dihydroxyhept-2-ene-1,7-dioate aldolase activity; Cellular component=mitochondrion; Biological process=aromatic compound catabolic process
  Homolog annotation: Hit_ID=Q47098; Match level="QueryCoverage=89%, HitCoverage=90%, E-value=1e-120, Identity=90%"; Hit description=2,4 -dihydroxyhept-2-ene-1,7-dioic acid aldolase
  Pfam annotation: Domain name=HpcH_HpaI; Domain location=15-242; Score= 384.8; E_value=1.3e-112; Accession=PF03328.5; Description=HpcHHpaI aldolase family
MQNAFKTALKAGKPQIGLWLGLTSSYSAELLAGAGFDWLLIDAEHAPNTVQTVLTQLQAIAPYPSQPVVRPSWNDPVQIKQLLDVGAQTLLVPMVQNAEEARLAVRSTRYPPAGIRGVGSALARASRWNRIPDYLHQANDAMCVLVQIETREALKNLPQILDVDGVDGVFIGPADLSADMGFAGNPQHPEVQAAIEQAIVQILSAGKAPGILMANEQQAKRYLELGALFVAVGVDTTLLARSAEALAARFIDHPVTSVNNNKSVY

SEQ ID NO: 222241 - protein, 162 aa, Glycine max
  Coding DNA Sequence Number=SeqID_105463
  Gene Ontology: Mol. function=peptidyl-prolyl cis-trans isomerase activity; Cellular component=periplasmic space; Biological process =protein folding
  Homolog annotation: Hit_ID=Q5MG89; Match level="QueryCoverage=87%, HitCoverage=57%, E-value=2e-66, Identity=85%"; Hit description =Putative cyclophilin type peptidyl-prolyl cis-trans isomerase
  Pfam annotation: Domain name=Pro_isomerase; Domain location=18-160; Score=31.2; E_value=1.8e-09; Accession=PF00160.11; Description =Cyclophilin type peptidyl-prolyl cis-
MEKISVIYVLGMSGNWNQTKYGDIEFGFYPTVAPKTVDHIYKLVRLGGYNTNHFFRVDKGFVAQVADVTNGRSAPMNEEQRREAVKTVVGEFTEVKHVRGILSMGRYDDPDSASSSFSILLGDAPHLDGKYAIFGKVTKGDETLTKLEQLPTRKEGIFVMVY

SEQ ID NO: 222242 - protein, 323 aa, Glycine max
  Coding DNA Sequence Number=SeqID_105464
  Gene Ontology: Mol. function=kinase activity; Biological process =protein amino acid phosphorylation
  Homolog annotation: Hit_ID=Q1STE7; Match level="QueryCoverage=69%, HitCoverage=71%, E-value=1e-84, Identity=68%"; Hit description =Uncharacterized plant-specific domain 01627
  Pfam annotation: Domain name=DUF579; Domain location=60-306; Score =406.6; E_value=3.7e-119; Accession=PF04669.4; Description=Protein of unknown function (DUF579)
  Subcellular localization annotation: CTP_CleavageSite=26; ConfidenceScore=5.52e-01
MKNNNNNTKLILLHPSLHKQTLTPTTAAAASTLFSSHRNLWLFFFFLLFSTLLFTWTIISTTISSATSTTSSTVTSPLSPSVTKALLHYAAAANSSAKPMSPAEISAVSSTLLRLPPRPNLLILGLTHESLLWAALNHRGGRTVFLDENEYAISKFESSNPGVEAYDIQFTTKVSEYPKLLSQAQSQAHGECRPVQNLLFSECKLAINDLPNHIYTVAWDVILVDGPKGYFQAAPGRMAPIFTAAVLARSKKFGQTHVFVHDYGREVERVFSEEFLCKENLVELVDSLGHFVVKSEAHDGESAVFCKNLSALRSSKVVGDEEE

SEQ ID NO: 222243 - protein, 325 aa, Glycine max
  Coding DNA Sequence Number=SeqID_105465
  Gene Ontology: Mol. function=transferase activity, transferring hexosyl groups; Cellular component=integral to membrane; Biological process=metabolic process
  Homolog annotation: Hit_ID=Q1STE3; Match level="QueryCoverage=93%, HitCoverage=77%, E-value=1e-103, Identity=57%"; Hit description=UDP -glucuronosyl/UDP-glucosyltransferase
MESSEYHTLHIFFFPFFAHGHVIPTLDMAKLFAEKGVKATIVTTPLNAPFISKAIGKSKTKHNRIHIQTIELPCAEAVLPDSCENTDSITSQDLFESFCMATCFLQEPFEQLIEKQHPDCIVADMFFPWATDSAAKFGIPRLVFHGYSFISLCATSCMELYKSHNDAESSSFVIPNLPGEIRIEMTMLPPYSKNHSRNVLGRKAWHIGPLSLCNKDNEEKAHRGKEASIDEHECLKWLDTKKPNSVVYLCFGSAVKLSDSQLREIAMGLEASGQQFIWVAGKTKEQKGEKWLPEGFEKRMEVKGLIVRINVSCEKRHVTYVGTNK

SEQ ID NO: 222244 - protein, 486 aa, Glycine max
  Coding DNA Sequence Number=SeqID_105466
  Gene Ontology: Mol. function=transferase activity, transferring hexosyl groups; Cellular component=integral to membrane; Biological process=metabolic process
  Homolog annotation: Hit_ID=Q1STE0; Match level="QueryCoverage=91%, HitCoverage=91%, E-value=1e-156, Identity=61%"; Hit description =Aldehyde dehydrogenase
  Pfam annotation: Domain name=UDPGT; Domain location=1-452; Score= -91.3; E_value=5.1e-06; Accession=PF00201.9; Description=UDP -glucoronosyl and UDP-glucosyl transferase
MAKLFAEKGVKATIVTTPLNAPFFSKAIGNSKTNGNKIHIETIEFPCAEAGLPVGCENVDSIPSPNLFQAFIMATGLLQEPLEQLLLKQRPDCIVADFFFPWTTDSAAKFGIPRLVFHGTGFFSSCATTCMGLYEPYNDVSSDSESFVIPNLPGEIKMTRMQLPPFFKGKEKTGLAKLLVEARESESRCYGVVVNSFYELEKVYADHFRNVLGRKAWHIGPLFLCNKDTEEKVHRGKEASIDEHECLKWLDNKKPGSVVYVCFGSVAKFSDSQLREIAIGLEASGQQFIWVVKKSREEKGEKWLPDGFEKRMEGKGLIIRGWAPQVLILEHEAIGAFVTHCGWNSTLEAVTAGVPMVTWPIAAEQFFNEKLLSEVLKIGVPVGAKKWLRLEGDSITWDAVEKAVKRIMIEEEAIEMRNRTKVLSQLAKQAVEGGGSSDSDLKALIEEGEWHLRNQGEAKKSTAKGKEVADRRDESLSVALLALIDV

SEQ ID NO: 222245 - protein, 371 aa, Glycine max
  Coding DNA Sequence Number=SeqID_105467
  Gene Ontology: Mol. function=RNA-directed DNA polymerase activity; Cellular component=chromatin; Biological process=chromatin assembly or disassembly
  Pfam annotation: Domain name=zf-H2C2; Domain location=125-166; Score =11.6; E_value=0.01; Accession=PF09337.1; Description=His(2)-Cys(2) zinc finger
MGSNSSRRRYKRCLIGLFPLSLGLYMGSLALLACHNNFVADALSRIHEPATEAFWILNFPHFQFLNDLERELSNMVEFVTLLKAVRDKPHDHLDFRIQDELLLYKGHIWVNKSNSFILLLLEEYHKSPLGDHMGLAKTLSHLQHNFFWNGMKQDVREYILRCSNYQHTKYVTQKPFGLLQTIPPPFSPWEDMALDFITGMPNYQGATVILLVVDHFSKGAHFDMLPTNFIVHRVAWLFIEMKKLQRAQEQMKKTTDAHRMDASFAVGDWVYVKLCFYCQTFLSSTTYQKLGRVYYGPYQIKETIGSVAYKLAPFDSAKIHLEDWVELQTTYHLEDKVLLEAVENDSTQNQMRDFKPKRISKRLGRIYPLGY

SEQ ID NO: 222246 - protein, 192 aa, Glycine max
  Coding DNA Sequence Number=SeqID_105468
  Gene Ontology: Mol. function=RNA-directed DNA polymerase activity; Cellular component=chromatin; Biological process=RNA-dependent DNA replication
MSSDHRPLHIFFFPFLAHGHIIPTVDMAKLFAAKGIKATIITTPINAPLISKAIGNSKTLTHNNEIHIQTIKFPSVEFCVDYRALNTIIVEDRFLFPTINELLDDLGHATWFSKVDLAQGFHQICMAKANISKTAFCTHQGHYEYVVLSFSLCNPPSMFQATMKTCFGPSFANSSWCFLTTFWCIAAISTNT

SEQ ID NO: 222247 - protein, 372 aa, Glycine max
  Coding DNA Sequence Number=SeqID_105469
  Gene Ontology: Mol. function=structural constituent of ribosome; Cellular component=intracellular; Biological process=translation
MDLFSGYTSHEAINSTCSSNLCHENYHDDSNNSETKIEAEEDFFKYSEDEELKTEGLEEITNAIKFKQECSHQNESNGSEPEAKFNEDCSETVTITNCAGNLGLDEEEEKEKLRLVFKFRYQTWKCCETFDSVNTDNVKASESTNKHEFLSSKSFSSFLDEPCVCSEYFPLENDSVDESERNFEPESCERRCVDAAVELKTVPSVEQADEHLVENLNNNVLFEKISADNNFLSEDDFICESTESNSMISSIGDEFLSDTDFGTTTNVHTLGNHDEENAVLTKEDLNFEGEKRSESFDAEDRDTTMVRIRRLEEETIMQDIENIKLKGNCFQDRHGMNLLHSSTGSDLEDSYRFDAQWEHQDLIEQLKIELNK

SEQ ID NO: 222248 - protein, 368 aa, Glycine max
  Coding DNA Sequence Number=SeqID_105470
  Gene Ontology: Mol. function=DNA binding; Cellular component=nucleus; Biological process=regulation of transcription
  Homolog annotation: Hit_ID=Q6Z538; Match level="QueryCoverage=53%, HitCoverage=52%, E-value=1e-75, Identity=68%"; Hit description =Putative NAC domain protein
  Pfam annotation: Domain name=NAM; Domain location=13-140; Score =285.1; E_value=1.4e-82; Accession=PF02365.6; Description=No apical meristem (NAM) protein
MEERNEMERIDDVMPGFRFHPTDEELVDFYLKRKIQQKSLPIELIKQVDIYKYDPWDLPKLAGTGEKEWYFYCPRDRKYRNSARPNRVTRAGFWKATGTDRPIYSSEGKCIGLKKSLVFYRGRAAKGMKTDWMMHEFRLPCISDSSPPKKLSDKSLPPSDSWAICRIFKKANSFSMAQKALSLPWISQLPGGMVSDMFTQGLNCHNIESPAIQFCGDKQDELHQVSNNAINTNFTASDIPTYKPINNSTASKSPVSDGDLAADNFIFYTGPTKCCSTLLDATNSMLSHPNPDYIAFEEPNQQHYSGFSINLPQDMQQNMSTETGTTGFPFSLSPPYDAAWKASSVAWDSPPCPSDMSLPIPLINATLN

SEQ ID NO: 222249 - protein, 135 aa, Glycine max
  Coding DNA Sequence Number=SeqID_105471
  Gene Ontology: Mol. function=calmodulin binding; Cellular component =integral to membrane; Biological process=cell death
  Homolog annotation: Hit_ID=O49914; Match level="QueryCoverage=77%, HitCoverage=20%, E-value=8e-21, Identity=46%"; Hit description=MLO protein homolog 1
  Pfam annotation: Domain name=Mlo; Domain location=4-133; Score= -369.2; E_value=0.057; Accession=PF03094.6; Description=Mlo family
MDIGKERSLEETPTWAVSVFCFFFLMISLIIEGGLHKLSEILRKGKGKSLGKALTKTKTEMMKFGFMSFILTISEVPISKICISKGVANSFLPCKDVVGFTGSATRTSTSGLDVAPATNESTIEVNYCEAKVRLI

SEQ ID NO: 222250 - protein, 272 aa, Glycine max
  Coding DNA Sequence Number=SeqID_105472
  Homolog annotation: Hit_ID=Q8W4M7; Match level="QueryCoverage=29%, HitCoverage=10%, E-value=1e-17, Identity=57%"; Hit description=DNA repair helicase UVH6
MPSDLFPMPSLHLLLDAKGHCLLKMPTGTGKTITLLSLITSYILSKPHSSLKLLYCTCTVHEMEKTLAELCLLHDYQLRHISPTTKILALSLSSSFLSLPYEFQVEIPARVPSARERKCKTFMKGGEEDDVARTLFETSAFGLVLILLMLSMPGRNRELQGLARAMVKRWETSAIQKLPSNELFLIHVMKHYCFEELRPIADAYGLLMHRNGPLHLEFPLHQGLDTAAGVWLDRNGILYSSRSNKGHDYDPSLEIMRVVVMHFKIFLAKPQI

SEQ ID NO: 222251 - protein, 94 aa, Glycine max
  Coding DNA Sequence Number=SeqID_105473
  Gene Ontology: Mol. function=DNA binding; Cellular component=nucleus; Biological process=response to brassinosteroid stimulus
  Homolog annotation: Hit_ID=Q1SMX5; Match level="QueryCoverage=73%, HitCoverage=69%, E-value=8e-18, Identity=64%"; Hit description=ZF-HD homeobox protein Cys/His-rich dimerisation region
  Pfam annotation: Domain name=ZF-HD_dimer; Domain location=18-86; Score=107.5; E_value=3.9e-29; Accession=PF04770.3; Description=ZF-HD protein dimerisation region
MRKRQVVVRREEPQRSGVRAVKYGECQKNHAANVGGYAVDGCREFMASGSGSGGGSGGGEGTSAALTCAACGCHRNFHKRQEAEVLLDEAVGSV

SEQ ID NO: 222252 - protein, 350 aa, Glycine max
  Coding DNA Sequence Number=SeqID_105474
  Gene Ontology: Mol. function=RNA-directed DNA polymerase activity; Cellular component=nucleus; Biological process=RNA-dependent DNA replication
  Homolog annotation: Hit_ID=Q1SQP0; Match level="QueryCoverage=79%, HitCoverage=69%, E-value=3e-33, Identity=30%"; Hit description=RNA -directed DNA polymerase
MGWLFEKILEGDNEVLIANFEKKGGEGSNMGVWEHKESKEFHTNGVFPMGTNASFVTFIPKVVDPQDFGDFRPISLVGCMYKRFLLHSVLVANEVLDEAKRKKGKCWVFKVDYEKAYDLVSWTFLLYMLWRLGFCERWIKGLRQKDPLVPFLFTIVGGGSSGLVREAFSKNLFKGYFVGRDKVKVRKIPWVSWKTLCKPKAHRGLGIRDVDVFNESLLAKGGGALESFKLVEGLEKVGSGAITKFWLARWMGDECLALKYPRLFLTSSQQNANINQVSLVVDNVWKWNLQWRRQDFEWDGLQLRQLLDELNAQNILGFTICITTRGGIHRDVEAESAEESTMLWVKAFLG

SEQ ID NO: 222253 - protein, 403 aa, Glycine max
  Coding DNA Sequence Number=SeqID_105475
  Gene Ontology: Mol. function=calmodulin binding; Cellular component =integral to membrane; Biological process=cell death
  Homolog annotation: Hit_ID=Q5BMD0; Match level="QueryCoverage=72%, HitCoverage=50%, E-value=1e-82, Identity=50%"; Hit description=MLO1
  Pfam annotation: Domain name=Mlo; Domain location=1-319; Score=174.7; E_value=2.4e-49; Accession=PF03094.6; Description=Mlo family
MRKWKRWEDETQTLEYQIANDPRRFQYIGQTLIGKRHLKFWSYHSPLLWMVCFIRQFYGSVSKDDYFTLRNGFIAANISLGCNFNFKKFLCRTYDEDFEKVMGIRIWIWIFSILFIFFSAHEFYNYFWLPFIPLVVALLAGTKLQVIITKMCVDSCKEKPVIKGSLLVTPSDAHFWFHQPEWLLHLLKFILIQNSFQLAFFTWTWYEFGPRSCFNRKREDIGIRIVMGVAVQLFCGYVTLPLYALVTQMGSSMRREIFTEKVSRGLKNWHKRAKQSLSKKNSISNKHSDSLHSKECDNSVRASVDSVHTPDNVVLTSPPFHITSGEEEKGIAPTTKQEISIHSTTETIKTTDEEENPKIITRGTYDGEISFGSSWKNVGSSRGIGEIGSIIEDDAEKLPKLIP

SEQ ID NO: 222254 - protein, 89 aa, Glycine max
  Coding DNA Sequence Number=SeqID_105476
  Subcellular localization annotation: CTP_CleavageSite=33; ConfidenceScore=5.18e-01
MRTVNTSADKGKDESLLKKGFLTSKARLVPFSRLARVSGFWLSEPGALSTRRDKLLAGRADDALSACWRGRFPSRFLLLAKRTAASLSG

SEQ ID NO: 222255 - protein, 63 aa, Glycine max
  Coding DNA Sequence Number=SeqID_105477
MVVHRQVTVVAVVGLAINCGPTEDNGTTIVGAIPGGTNGGTNHNHGRVTKNKHQPREKRCASS

SEQ ID NO: 222256 - protein, 56 aa, Glycine max
  Coding DNA Sequence Number=SeqID_105478
MHEGMHMTQMQSRNAGARGIVSFLDTTSRGSKVPQQGIKTEPICDAYAKDAMRECT

SEQ ID NO: 222257 - protein, 193 aa, Glycine max
  Coding DNA Sequence Number=SeqID_105479
  Homolog annotation: Hit_ID=Q8LJ95; Match level="QueryCoverage=38%, HitCoverage=11%, E-value=1e-11, Identity=50%"; Hit description=NBS -LRR resistance protein RGH1-like
MVGAFSQNIVTLTGLPMILLSESDLTNPLCGVSCYVLLSAPGWFFTDMGEKTAEEVGEDVIEELLKFNLIVPYGNGKCPLVNKFKINPGIRPEFEKYVSRDKQLHAGGQVLFLICWISYLNFGSKWLPERKDLLVLQLGRWQDLPSHHIEVGNEEFLKELRDHNRLKYLNLRGISRIYELSPSIAKLESLEIP

SEQ ID NO: 222258 - protein, 154 aa, Glycine max
  Coding DNA Sequence Number=SeqID_105480
  Gene Ontology: Mol. function=steroid hormone receptor activity; Cellular component=nucleus; Biological process=regulation of transcription, DNA-dependent
  Homolog annotation: Hit_ID=Q2HVI9; Match level="QueryCoverage=82%, HitCoverage=19%, E-value=9e-52, Identity=78%"; Hit description=Beta -lactamase, class A; SPX, N-terminal; Major facilitator superfamily MFS_1
DEDGEEENDNAEETKKPVTSIVVAYKLLTPSVKYAMEIILAESSLVTEYYFIWTTSNVSIFLACLGLTVLPVNIVVGNYISNMFEERQVLLTSEIMVCIGLLLSFHIMIPYSVTQYVGSALITFVSAEVLEGNPLKRSFKNMEVLHEQSPSIVE

SEQ ID NO: 222259 - protein, 75 aa, Glycine max
  Coding DNA Sequence Number=SeqID_105481
EPVQPIEVSSSEEDLEEDPEELPLEPAMDALDLPVDDEDPLPNVDSPEDIMSASEADSTEESGPRGTANSDDSSS

SEQ ID NO: 222260 - protein, 276 aa, Glycine max
  Coding DNA Sequence Number=SeqID_105482
  Homolog annotation: Hit_ID=Q2QNA4; Match level="QueryCoverage=84%, HitCoverage=85%, E-value=5e-23, Identity=32%"; Hit description =Expressed protein
MLIGQADHISESRSLKDQILGYSGSELSDDEEEDCLEQILYSASFEELASNYVKYDTVIWLAISLLLVLAWGIGLLMLLYLPIRRYVLQKDLSSRRLYVTCTEVVYKVSRPSFIPFWGTVTIERRVPLSLVIDIIIEQGCLQSIYGIHTFRVESIAHGKAAPVDELQVQGVSDPFVLRKMIVTEASKITQDVSTSGKHAGPSTDEENIARMPGATEGSVVLRSPSKSLKMVGSPHTSSLECRVAGGLLLNKLEEVNKSVKRLELLIEKLHASSSIN

SEQ ID NO: 222261 - protein, 260 aa, Glycine max
  Coding DNA Sequence Number=SeqID_105483
  Gene Ontology: Mol. function=transferase activity, transferring glycosyl groups; Cellular component=chloroplast; Biological process =biosynthetic process
  Homolog annotation: Hit_ID=Q6DW75; Match level="QueryCoverage=99%, HitCoverage=64%, E-value=1e-128, Identity=79%"; Hit description =Digalactosyldiacylglycerol synthase 2, chloroplast
MDKKEHIAIFTTASLPWLTGTAVNPLFRAAYLAKSGERDVTLVIPWLSLKDQGLVYPNNIKFASPSEHEKYIRQWLEERVGFTCGFSIQFYPGKFSRDKRSILAVGDISEIIPDKVADIAVLEEPEHLTWYHHGKRWKTKFRLVIRLSAATQDYTGSIICNVHGVNPKFLEIGKKKREQQQKGEQAFTKGAYFIGKMIWSKGYKELLQLLKDHQKELSALEVDLFGSGEDSNEVQKAAEKLELAVSVHPARDHADARFHE

SEQ ID NO: 222262 - protein, 82 aa, Glycine max
  Coding DNA Sequence Number=SeqID_105484
MGGGGGDHGHGHGHGDFRNKVWSMSGGPYCRPKHWKRNTAIAMFGVVLICIPIAMKSAELEHFDPSLIWPGSDRLQARPNLA

SEQ ID NO: 222263 - protein, 109 aa, Glycine max
  Coding DNA Sequence Number=SeqID_105485
MPRQAQGDAHQAADAPPPPRQADPTGSLGMERYLQHLVRQQAANHCGQGSAPFACPTPEQFEVEVAWPGDWPEAQAGEEPAGSPGEADESHMDEEMTDLLGFLGGSGAT

SEQ ID NO: 222264 - protein, 88 aa, Glycine max
  Coding DNA Sequence Number=SeqID_105486
MAGGNRQKKSSSGFFSMFNIFSSRKPRGGYYDAPDSWRRVWPSDDDKGNWGVAEPNIDMKAEAFIAKYKKRVSESALYQLDPAAAENA

SEQ ID NO: 222265 - protein, 198 aa, Glycine max
  Coding DNA Sequence Number=SeqID_105487
  Homolog annotation: Hit_ID=UPI00006BE059; Match level="QueryCoverage =82%, HitCoverage=64%, E-value=6e-31, Identity=42%"; Hit description =conserved hypothetical protein YoxB
MYLNNNAEKIEAIKHLNLGSINKPTEIPKSLLIGCEKNLSIYYAPFDHVNNKAKVVIVGITPGFTQLKNAYASLQNNLRSGKTIDESLAKVKSDASFSGSMRSNLIEMLNYVGIHEWLGIPSTAQLFSTRSDLLHSTSCLKNPVFVGGANYNGTPNMLKSNFLRDHIYENFAQEAKNVNDAIFIPLGPKPSEALEHLA

SEQ ID NO: 222266 - protein, 65 aa, Glycine max
  Coding DNA Sequence Number=SeqID_105488
  Gene Ontology: Mol. function=oxidoreductase activity; Biological process=metabolic process
  Homolog annotation: Hit_ID=Q2HVK5; Match level="QueryCoverage=96%, HitCoverage=22%, E-value=1e-15, Identity=67%"; Hit description=Short- chain dehydrogenase/reductase SDR
MPEVKLRYAVVTWANKGIGLETVNQLASSGVKVLLTARDEDRGHEAIERLKECGLSDLVIFTSLM

SEQ ID NO: 222267 - protein, 219 aa, Glycine max
  Coding DNA Sequence Number=SeqID_105489
  Gene Ontology: Mol. function=oxidoreductase activity; Biological process=metabolic process
  Homolog annotation: Hit_ID=Q2HVK6; Match level="QueryCoverage=81%, HitCoverage=94%, E-value=3e-52, Identity=46%"; Hit description=Short- chain dehydrogenase/reductase SDR
  Pfam annotation: Domain name=adh_short; Domain location=32-152; Score= -56.3; E_value=0.028; Accession=PF00106.15; Description=short chain dehydrogenase
MGWDSFAPVCHCHQPTTKKFVRVKKNEAVEKMYAVVTRANKGIGLETVKVLDSNVIKVVLTARYEDKGHEAIERLKECGLSNLVIYHQLDVTDSASIASLVDFVKSQFGKLDILESVISDVNLDEVNIANEWAKGVLDDVENLTEERIALNSYTRFLAKKHPNMCINSVCPGFVKTDINRNTGIYSIDQGAANVVKFALLPDGSPSGLFYIGKNCQTSE

SEQ ID NO: 222268 - protein, 80 aa, Glycine max
  Coding DNA Sequence Number=SeqID_105490
  Gene Ontology: Mol. function=protein binding; Cellular component =ribonucleoprotein complex; Biological process=mRNA metabolic process
  Homolog annotation: Hit_ID=Q8LCS5; Match level="QueryCoverage=93%, HitCoverage=83%, E-value=7e-33, Identity=89%"; Hit description=U6 snRNA-associated Sm-like protein
  Pfam annotation: Domain name=LSM; Domain location=17-78; Score=52.6; E_value=1.3e-12; Accession=PF01423.12; Description=LSM domain
MSGTEKAGSGTTKTPADFLKSIRGRPVVVKLNSGVDYRGILACLDGYMNIAMEQTEEYVNGQLKNKYGDAFIRGNNGTDV

SEQ ID NO: 222269 - protein, 87 aa, Glycine max
  Coding DNA Sequence Number=SeqID_105491
MGEQDSGEGDVEGLKQAEWNQAFTGNQCDVLENEKCIVKDVSNDIVVKDLCRYGFMSQEDIDACSQLELDMQVSPLAKLAFSKFHNP

SEQ ID NO: 222270 - protein, 90 aa, Glycine max
  Coding DNA Sequence Number=SeqID_105492
  Gene Ontology: Mol. function=oxidoreductase activity; Cellular component=cytosol; Biological process=metabolic process
  Homolog annotation: Hit_ID=Q2HVK7; Match level="QueryCoverage=98%, HitCoverage=30%, E-value=5e-32, Identity=78%"; Hit description=Short- chain dehydrogenase/reductase SDR
MGEEAKRYAVVTGANKGIGFGMCKKLASSGIVVVLTARDEKNGFKAVEKLKEFGLSDLLVFHQLDVDDPASVSALADFIKTEFGKLDILV

SEQ ID NO: 222271 - protein, 93 aa, Glycine max
  Coding DNA Sequence Number=SeqID_105493
MNKDTERITLTQIQSTWGQIHLKQHQEEEAHTVGCGRRRRGMQSLENLVAMRCLAAKAKEEVEAEVGTPSAAGCCYATKLCSRCSGGGNGLSL

SEQ ID NO: 222272 - protein, 722 aa, Glycine max
  Coding DNA Sequence Number=SeqID_105494
  Homolog annotation: Hit_ID=UPI0000E21FBE; Match level="QueryCoverage =22%, HitCoverage=19%, E-value=2e-09, Identity=27%"; Hit description =PREDICTED: testis expressed sequence 10 isoform 3
  Pfam annotation: Domain name=HEAT; Domain location=106-142; Score =15.0; E_value=0.27; Accession=PF02985.12; Description=HEAT repeat
  Pfam annotation: Domain name=HEAT; Domain location=26-58; Score=1.8; E_value=26; Accession=PF02985.12; Description=HEAT repeat
  Pfam module annotation: Pfam domain module=HEAT::HEAT; Domain location=106-142::26-58
MSSTAIVLPEQSLAAEKAGLAVNKKGLTLKELLQQTSHHNPKVRRDALIGIKDLFTRYPAEQKLHKYAAVEKLRERIGDDDKVVRKSLYDLFKVVILPCCKEDNQELIVSLLMPYIFNAMTHLVVDVRMMAFDFLDLILEFYPPSFSPSYAEKIFQNYEDILVRNQYYLQDKGKLKDALAGLVRCLSLLPWNKEETDLHNKDATGQRVLHAFEVDVSMSSNGFSCIIKNLKDLVPVLINSFLEFIPLVHSMESLEGKSFGCMISILHSIYLIVRSIAYGTDKDSESPSSQGGPDAAVWDVNISSAFLKKLFPRFPLNPVDHLSEKDCDRLFDLNMIVAKIFFELNEWTSLPPNLLETFLEFFENALLGKFCRATQSGKAVWEECLVQLLSFIPKFLSRGASSWTSRLLQAFTQTFRESKPGSLLKLACVSAIEDMLTPIESMLSIETSNPENLELQDALLAWIRELPLLLIQLGDKHPTCSQVVLRLQLRIGQCSLLNSSLVCMYDNTQYSLLDFYCTCQGGQICYGPFLRLPRESQELSLCSLYYFSYLDLPILKSIACCCLSADLDPYVLFRIIEVLHSAYRDGHIKIADYLSVFITLVLRFKVSPEIGSAGFKSDPLCQTLKSMTTVLCSYMAQMGDNSLVLQIVEKVIIDQIPQKPSLDNSCSLLRMLVTVDSKPTRLSEQSIIILGQHLSEYLMDAVQRYQHHPFNRSENSFRKMST

SEQ ID NO: 222273 - protein, 185 aa, Glycine max
  Coding DNA Sequence Number=SeqID_105495
  Gene Ontology: Mol. function=phosphomannomutase activity; Cellular component=cytoplasm; Biological process=mannose biosynthetic process
  Homolog annotation: Hit_ID=Q2HVK8; Match level="QueryCoverage=93%, HitCoverage=64%, E-value=3e-83, Identity=86%"; Hit description=HAD -superfamily hydrolase subfamily IIB
  Pfam annotation: Domain name=PMM; Domain location=1-184; Score=328.6; E_value=1.1e-95; Accession=PF03332.4; Description=Eukaryotic phosphomannomutase
MTSCELPSFQSLKSFLGEEKLKEFINFTLHYIADLDIPIKRGTFMEFRSGMLNVSPIGRNCSQEERDEFEKYDKVYNFTLKVCNLSSQVHNIRPKMVSVLREKFAHLNLTFSIGGQISFDVFPQGWDKTYCLRYLDGFNEIHFFGDKTYKGGNDHEIYESERTIGHTVTSPDDTVKQCKSLFLEN

SEQ ID NO: 222274 - protein, 71 aa, Glycine max
  Coding DNA Sequence Number=SeqID_105496
MFVFNGALKGLDDTPQSKSKVVVARWIVVKMSTIILGSFKNNWETVLEQNDDWYSTLHLVFGVDFVATTLA

SEQ ID NO: 222275 - protein, 166 aa, Glycine max
  Coding DNA Sequence Number=SeqID_105497
  Gene Ontology: Mol. function=DNA binding; Cellular component=plasma membrane; Biological process=cell-cell signaling
  Homolog annotation: Hit_ID=Q1T3L8; Match level="QueryCoverage=78%, HitCoverage=98%, E-value=3e-30, Identity=54%"; Hit description =Remorin, C-terminal region
  Pfam annotation: Domain name=Remorin_C; Domain location=52-163; Score= 160.3; E_value=5e-45; Accession=PF03763.4; Description=Remorin, C -terminal region
MPELQSKPETALAPAPVAAEVPSNDAVAKKASETEESKATVVASENIALAEVEKEKKLSYVKAWEESEKAKAENRAQKQLSAIAAWENSKKATLEAELKKIEEQLEKKKAEHGERMKNKVALVHKEAGEKRAMIEANRCEEVLKTEEVAAKYRATGTTPKKTIGCF

SEQ ID NO: 222276 - protein, 219 aa, Glycine max
  Coding DNA Sequence Number=SeqID_105498
  Gene Ontology: Mol. function=zinc ion binding; Cellular component =intracellular; Biological process=multicellular organismal development
  Homolog annotation: Hit_ID=Q1T3L7; Match level="QueryCoverage=82%, HitCoverage=85%, E-value=1e-92, Identity=86%"; Hit description=LIM, zinc-binding; Zinc finger, RING-type
  Pfam annotation: Domain name=LIM; Domain location=10-67; Score=57.9; E_value=3.2e-14; Accession=PF00412.12; Description=LIM domain
  Pfam annotation: Domain name=LIM; Domain location=106-163; Score =59.0; E_value=1.5e-14; Accession=PF00412.12; Description=LIM domain
  Pfam module annotation: Pfam domain module=LIM::LIM; Domain location =10-67::106-163
MSFTGTTDKCKACDKTVYVVDMLTLEGIPYHKNCFRCSHCKGCLTMSTYSSMDGVLYCKPHFEQLFKESGNFSKNFQTAKSSDKQNETHKTPNRLSSMFSGTLDKCSVCSKTVYPLEKMTLEGECYHKNCFRCAHAGCHLTHSSYAALDGVLYCRHHFQQLFMEKGNYHHVLQSANHKKNATQSPAEPAEPAAEGEEEPPKPEESDSEKHTEEKPQNEA

SEQ ID NO: 222277 - protein, 547 aa, Glycine max
  Coding DNA Sequence Number=SeqID_105499
  Gene Ontology: Mol. function=protein serine/threonine kinase activity; Cellular component=chromosome, telomeric region; Biological process=protein amino acid phosphorylation
  Homolog annotation: Hit_ID=Q2HRF6; Match level="QueryCoverage=77%, HitCoverage=81%, E-value=0.0, Identity=74%"; Hit description =Tyrosine protein kinase, active site
  Pfam annotation: Domain name=RIO1; Domain location=192-352; Score =271.3; E_value=1.9e-78; Accession=PF01163.12; Description=RIO1 family
MAAPGTEEAVSCVSNSTHSAMENDDEHKLHNHTEQVQEQEQEENEEEEEVWSSSDSEIGEALDWLDSKEEAEGSSFSLTLWRPNAHGGHHHHSSTLQPLANRNQKFSHHIRASPLEEWEGRMNVGMSNSVTTAIRGSVRDMAIGKTKTTEKADRATVEQAIDPRTRMVLFKMLNRGVFHDINGCISTGKEANVYHATKSDTQELAIKVYKTSVLVFKDRDRYVQGDFRFRNGYCKHNPRKMVKTWAEKEMRNLMRLKAAGIRCPTPYLLRLHVLVMEFIGKSGWAAPRLKDAALSLDKLREGYVEGHLYIIDVSQAVDPEHPHALDFLREDCVHVSDFFKKHGVAVMTIRELFEFIVDASITDDAVDSYLEEVQQKILARDVSAEDEIADSVFVQSYIPKTLEDVKNAEEDVQRITSGKDTKDLYYQTITGLKHALSLTQTSQQKTQQQKSSPTKDSPVISDDKSNLLEDDAEGQSGKDEDDESDSEEDSCSESEVEDPADIKAARKEARKENKKKVKEEKREARKTKVPKAVKKRKKKLAKAKKTR

SEQ ID NO: 222278 - protein, 149 aa, Glycine max
  Coding DNA Sequence Number=SeqID_105500
MTLSSWQNKLNKYFMFKTLVMKGDKWFYTEKQLVLMLKIMIHTLILMKMATPPSSPPPPPPTATSQSPSTSKWTRKDTRLRSLATRPVGAKRHVVDVTYENWKQVPTAQKDLIWEDIQAEFDIPEASDLKTKKKILQTVGSGGDNLSLI

SEQ ID NO: 222279 - protein, 81 aa, Glycine max
  Coding DNA Sequence Number=SeqID_105501
MKETSNTGLQALRVVNVISFQVKASSVISEADQVQKGIVDLVTVHNISKLVIGAIPENISSETLIILLLASSLMIFIVGDY

SEQ ID NO: 222280 - protein, 79 aa, Glycine max
  Coding DNA Sequence Number=SeqID_105502
MKNFPSFFFKTKHPNKMIEIKEGPQEEMKDARKKKDPLIGSKDLRKEELKETTMVGLEIPMRARIKETKEKFRDYQHII

SEQ ID NO: 222281 - protein, 260 aa, Glycine max
  Coding DNA Sequence Number=SeqID_105503
MTKHQRSTKRDLSYWEYVDALHSVQNSNFLVKHSASSSDQGIPRRTMPMLDQFHLCIHDSIENIVDIKADGNCGYRAIDALLDMGEDSWSLVTMDKWMNITDMGYVIASRAHANRRREWRVPSRRATWQWCRHLQWHFAGAWTRQSNWRVEGAEFLGCRQQRLFPRGLQSATLQEVASFNGVLVGQKRQHQQRFALPELLKSPLPVDHSREKKKRKEKLIGAVFEQKRRRSVAVVFVFEQKRRRSVAVVFVFEQTSSFFY

SEQ ID NO: 222282 - protein, 186 aa, Glycine max
  Coding DNA Sequence Number=SeqID_105504
  Gene Ontology: Mol. function=DNA binding; Cellular component=nucleus
  Homolog annotation: Hit_ID=Q1SVI1; Match level="QueryCoverage=99%, HitCoverage=57%, E-value=1e-33, Identity=40%"; Hit description=HMG-I and HMG-Y, DNA-binding
  Pfam annotation: Domain name=DUF296; Domain location=9-117; Score =159.4; E_value=9.1e-45; Accession=PF03479.5; Description=Domain of unknown function (DUF296)
  Subcellular localization annotation: CTP_CleavageSite=29; ConfidenceScore=5.22e-01
MSGSAGMGFTPHIINIASGEGPRVVCILSANGAVSTVTLRQPSTSGGTVTYEGRFEIVCLSGSYLVTENGGSRTRTGGSSVSLASPDGRVIGGGVGGVLIASSPVQVVVGSFLWGGSKTKNKKKESSEGAEVAVESDHQGVHNPVSLNSISQNQNLPPTPPSLSPWSTSRPLDMRNSHVDIDLMRG

SEQ ID NO: 222283 - protein, 997 aa, Glycine max
  Coding DNA Sequence Number=SeqID_105505
  Homolog annotation: Hit_ID=Q9STK7; Match level="QueryCoverage=44%, HitCoverage=89%, E-value=1e-115, Identity=46%"; Hit description =Cytochrome P450 71A26
  Pfam annotation: Domain name=LRR_1; Domain location=753-775; Score =3.5; E_value=64; Accession=PF00560.23; Description=Leucine Rich Repeat
  Pfam annotation: Domain name=LRR_1; Domain location=777-799; Score =13.2; E_value=0.97; Accession=PF00560.23; Description=Leucine Rich Repeat
  Pfam annotation: Domain name=LRR_1; Domain location=801-823; Score =9.3; E_value=5.2; Accession=PF00560.23; Description=Leucine Rich Repeat
  Pfam annotation: Domain name=p450; Domain location=44-507; Score =373.3; E_value=3.7e-109; Accession=PF00067.12; Description =Cytochrome P450
  Pfam module annotation: Pfam domain module=LRR_1::LRR_1::LRR_1::p450; Domain location=753-775::777-799::801-823::44-507
  Subcellular localization annotation: CTP_CleavageSite=70; ConfidenceScore=5.21e-01
MSNFLNGTTSLWFFLFMLALFTTIANLLLSKLNTKSNLAKKNSPPSPPKLPIIGNLYQFGTLTHRTLQSLAQTYGPLMLLHFGKVPVLVISNAEAAREVLKTQDHVFSNRPKLKMYEIFLYGFRGVASAPYGPYWRQVKSISVLHLLSPKKVQSFREVREEELVAMIEKVRLSCCSSASLMKVLNLTNLLTQVTNDIVCRCVIGRRCDESEVRGPISEMEELLGASVLGDYIPWLHWLGRVNGVYGRAERVAKKLDEFYDRVVEEHVSKRGRDDKHYVNDFVDILLSIQATDFQNDQTFVKSLIMDMLAAGTDTILAVIEWAMTELLRHPNAMQKLQDEVRSVVATGEEDRTHITEDDLNDMPYLKAVIKETLRLHPATPVLIPRESMQDTKVMGYDIAAGTQVLVNAWAISVDPSYWDQPLEFQPERHLNSSIDIKGHDFQFIPFGAGRRGCPGIAFAMLLNELVLANIVHQFDWAVPGGLLGEKALDLSETTGLSLTWELNKIKEVFMRVKKNEDELLDTLTEIDGHLRKLDRKMLDEDMDGICKRIRDCAHKLLPMDAFDDSLHPSSSSVQHKNHLLDQDLYLLQKRYRELKYHPPSLCLMYLVIFPKDAVLKKSYTIYRWIGDGYIGKTKEKTAEEVGEEVIDELLKLNMIVPYGNTKCPLVHKFQIHPHIHPLLESSFSPYKKNAHHLGYYLGLTRLVLEKQKVMLGDGVACVFKNASMQLGRWQDSPSHHIEVGSQEFLKELRDQEFLLYLSLRGISRISELPPSITQLRNLQILDLKACHNLETLPNDISSMERLTRLILSQCYLLDDMPKGIETLTNLRVLKGFVIGNPKKTPCTISDLANLKELRRLSIHIGIEAVIKDGEFESLEELSALKHLKISWGMSRYSDIKIILPSSLKKLHLEGFPGQNIPEWLMPDKLARGFKQLKIIGGKLQSMNHDNDVNKWGIEILHLKYLKHLKVDLTNLQQLFPLLKYAEIKQVSNHSYIEWSAD

SEQ ID NO: 222284 - protein, 228 aa, Glycine max
  Coding DNA Sequence Number=SeqID_105506
  Homolog annotation: Hit_ID=Q1T3M2; Match level="QueryCoverage=72%, HitCoverage=87%, E-value=1e-83, Identity=82%"; Hit description =Barwin-related endoglucanase
  Pfam annotation: Domain name=DPBB_1; Domain location=145-225; Score= -8.8; E_value=0.1; Accession=PF03330.8; Description=Rare lipoprotein A (RlpA)-like double
MYLIKRPLYIQIKSPYPSIKHLNLTISIQQREETRKFRDKMKRFWSNASIILLATLILSSCFYSEAQKCHPSGRIRGKKAPPGQCNQENDSDCCKEGKMYTTYECSPPMSSHTKAYLTLNSFEKGGDGGGPSECDNQYHSDDTPVVALSTGWFDHKRRCLHNITISGNGRSVVAMVVDQCDSRKGCDADHDYQPPCPNNIVDASRAVWKALGVPKNDWGGFDITWSDA

SEQ ID NO: 222285 - protein, 347 aa, Glycine max
  Coding DNA Sequence Number=SeqID_105507
  Gene Ontology: Cellular component=endoplasmic reticulum
  Homolog annotation: Hit_ID=Q2HRE8; Match level="QueryCoverage=98%, HitCoverage=89%, E-value=1e-130, Identity=62%"; Hit description =Lipopolysaccharide-modifying protein
  Pfam annotation: Domain name=DUF821; Domain location=21-347; Score =447.3; E_value=2e-131; Accession=PF05686.3; Description=Arabidopsis thaliana protein of unknown function (DUF821)
MTYTCPKDYYPTKFAQDQDSSTASTCPEYFKWIHEDLKPWKRTGITREMMERGRNVSYFRLVIIQGKAYAKKYADSYETRDVFTVWGILQLLRLYPGDIPDLELLLETGDKPMVDKEQSQGPPPPIFHYCGHKNAYDIVFPDWIFRGWADLAIKLDESNKKIKWKDRLPYAIWKGKTWVSHKRNDLTKCNASDQHDSYAQIHPLHWDKEIAQGFQNTKLDDQCIQRYKIYVEGIAWSVIENYILAYDSMTLFIEPIYYDFFTRSLVPRKQYYWPISSKNQSMCNDIKYVVEWGSANPDKAKAIGKAGTNFIKENLKMKFVYDYMFYLLTEYARLLTFEPTIPVGVTR

SEQ ID NO: 222286 - protein, 64 aa, Glycine max
  Coding DNA Sequence Number=SeqID_105508
MDTVKISHGIGNMAKLILIQLGQSSHTELAFEIKMTSSAEHHAIEFSFGMKGMHQDLISARNMA

SEQ ID NO: 222287 - protein, 188 aa, Glycine max
  Coding DNA Sequence Number=SeqID_105509
  Homolog annotation: Hit_ID=Q1SVG4; Match level="QueryCoverage=98%, HitCoverage=56%, E-value=1e-89, Identity=82%"; Hit description =Barwin-related endoglucanase
  Pfam annotation: Domain name=DPBB_1; Domain location=105-185; Score= -8.7; E_value=0.097; Accession=PF03330.8; Description=Rare lipoprotein A (RlpA)-like double
MKRFISNASFILLATLILSSCSYSEPQKCRPSGRIRGKKAPPGQCNQENDSDCCEEGKMYTTYECSPPMSSHTKAYLTLNSFEKGGDGGGPSECDNQYHSDDTPVVALSTGWFDHKRRCLHNITISGNGRSVVAMVVDQCDSRKGCDADHDYQPPCPNNIVDASMAVWKALGVPKNEWGGFDITWSDA

SEQ ID NO: 222288 - protein, 990 aa, Glycine max
  Coding DNA Sequence Number=SeqID_105510
  Gene Ontology: Mol. function=transferase activity; Cellular component= integral to membrane; Biological process=response to oxidative stress
  Homolog annotation: Hit_ID=Q2HRE0; Match level="QueryCoverage=99%, HitCoverage=99%, E-value=0.0, Identity=66%"; Hit description=C2
  Pfam annotation: Domain name=C2; Domain location=276-356; Score=99.9; E_value=7.8e-27; Accession=PF00168.20; Description=C2 domain
  Pfam annotation: Domain name=C2; Domain location=441-520; Score=66.1; E_value=1.1e-16; Accession=PF00168.20; Description=C2 domain
  Pfam annotation: Domain name=C2; Domain location=582-672; Score=61.6; E_value=2.5e-15; Accession=PF00168.20; Description=C2 domain
  Pfam annotation: Domain name=C2; Domain location=6-91; Score=87.0; E _value=5.9e-23; Accession=PF00168.20; Description=C2 domain
  Pfam annotation: Domain name=PRT_C; Domain location=835-990; Score =357.0; E_value=3.1e-104; Accession=PF08372.1; Description=Plant phosphoribosyltransferase C-terminal
  Pfam module annotation: Pfam domain module=C2::C2::C2::C2::PRT_C; Domain location=276-356::441-520::582-672::6-91::835-990
MNNLKLGVEVVSAHDLVPKDGQGSSSTYVELHFDGQRFRTTTKDKDLSPFWNESFYFTITDPSKLPSLTLEACIYHYNKGNCSKVLLGKVRLTGTSFVPYSDAVLLHYPLEKKNIFSRSKGEIGLKVFVTDDPSLRSSNPIPAVESFFNTDQNENLTQDQTPPPVSFTDSILNSVSRKKTETRHTFHNIAKSSSEQKQQSKPAADANPSVTFGIHEMKSSQAPPKVVQAFAGPQEFSVKETSPTLGGGKVVGGRVIRGSMPATSSSYDLVESMKYIFVRVVKARDLPSMDMTGSLDPYVEVKVGNFKGTTNHFEKNQNPEWNKVFAFAKDNQQSFILQVTVKDKDKISDDVVGTVTFSDLHDIPERIPPDSPLAPQWYRIENKNGEKRGELMLAVWRGTQADEAFQDAWHSDAVVSPDGSTISNYAQIRSKVYMSPRLWYVRVKVIEAQDLVSSDKSKVPDVYVKVHIGNQIIKTKPLRDMNPQWNHEALFVAAEPFEEPLVFTVEERSANKDETIGNSMSSAMEDQAKKKEKEKEKDKFYSRIRVIAFLDGGYHVLDESTYYSSDLRPTTRQLWKKPIGVLELGILNADVLPIPTKNRDGRGTADTYCVAKYAHKWVRTRTIVNNLNPKFHEQYTWEVHDTATVLTLGVFDNAQITNSSNGNKDSKIGKVRIRISTLEAGRVYTHSYPLLSVQNSGLKKNGEVHLAIRFSCTSMANMMALYLKPHLPKMHYTKPLNIMDQERLRLQAVLIVASRLGRAEPPLRKEVVEYMSDSESHLWSMRRSKANFNRLKEVFSGLLAFGTWFGQIATWKNPFVTVLLHILYLMLVCFPELILPTVFLYMFVIGMWKWRFRPRYPPHMDASLSCAYVTSPEDFDEEMDTFPTTKSFDIVRWRYDRLRSLAGKVQSVVGQIATQGERIHALINWRDPRATSIFMVFCLVTAIVLYVTPPQMLFILSGFYLMRHPMLRGKTPGAPINFFRRLPALTDSML

SEQ ID NO: 222289 - protein, 156 aa, Glycine max
  Coding DNA Sequence Number=SeqID_105511
MDFSTNLGSSLQKLRTWRFLSWIETEASEARHCQQIPKGESPNKELVEKAVEVKKEVEEVLKSANLKIVGVMERSVIMNEIDRVVNEEDLKGKIKELESEIAQGSNSEDMGKDGGVKREYSCCIVVSTLKEKIERLREDLESSSKDVYVKQLSVQS

SEQ ID NO: 222290 - protein, 281 aa, Glycine max
  Coding DNA Sequence Number=SeqID_105512
  Homolog annotation: Hit_ID=Q1T2D5; Match level="QueryCoverage=34%, HitCoverage=8%, E-value=1e-12, Identity=44%"; Hit description=Chromo
  Subcellular localization annotation: CTP_CleavageSite=22; ConfidenceScore=5.31e-01
RGHGGGRISANFSSCKHASPAACTNVSGCKAWTSRRISGESPEMKQLRMKGGGSPIIRFAKSSNSDRGELSIAGHPLEPRKCSSLHIKRSNCETIAFRGAVIFKVEVGLGLAEGLGKKSLGIGIVRMGVWHGDKDNESTKIVRTLVSRARVRGLAPPEIREKQSTKKEKEASGSQFQARRFGKDLQKLLFWQFSSNEVVKSSQPPQQHWCWSHHLTGPFSTIVVVVDDDDVVVVAADGGGGDGYVDMVADDVDVEPYASAHIVVALVETHDSSSTLALNPS

SEQ ID NO: 222291 - protein, 379 aa, Glycine max
  Coding DNA Sequence Number=SeqID_105513
MEVLPCSGVQYAGGSDCSQSSSGTMFVNQGESGGQAKLEDDRLNDSLQTEGPQIERQGQTQQNICEPLINIACQCGGASCCDCQVEGQKESISFRDVEDDGINEPCLAFENLVSIADTNESESPNGSREVELSFSEPTWLKGDEPVALWVKWRGSWQAGIKCAKVDWPLSTLKAKPTHDRKKYFVIFFPHTRNYSWADMLLVRSIYEFPQPIAYKTHQAGLKMVKDLTVARRFIMQKLTIGVLSIVDQLHPNALLETARDVMVWKEFAMETSRCNSYSDFGRMLLELQNEVPCRLRQFFGCNTVGQLHLVPIGFKLKSNMVSEPIGEVLGSPASTASILRSIVKHYTDADWIQHSSYSWAERCQNANSAESVELLKEYS

SEQ ID NO: 222292 - protein, 98 aa, Glycine max
  Coding DNA Sequence Number=SeqID_105514
MGRQQTCLVEDPPTAVEELNEEEQQPPVEEGVTDVESFSGRPHDTSILRDFENHMRIWDGEEHPELKLSSHGRKMAKFGRSTLEIEGLVAASGRSRVP

SEQ ID NO: 222293 - protein, 283 aa, Glycine max
  Coding DNA Sequence Number=SeqID_105515
  Pfam annotation: Domain name=PT; Domain location=234-276; Score=11.0; E_value=0.041; Accession=PF04886.3; Description=PT repeat
MVLFGIGQIGCSPNELAKNSPYVSSEIDIAFARDSTILTPEPLVDYPAPYEIPPTDSAEPPSLDNSPSDGLAEYIELYSTLLEYFDLPRYGAVTNGRTDSSSALRTTLNSIIDRRGGKGYGIDVIVIAIKCYPLEVKSHNCYMLEKYQNNNPILQRGPKERPYTQVTCKITRLEATPRLHGMRNTEKFNPSSYLRRNLVLKTKCLSALCPYHYSYQKLKTKITESIVPKRATYETTNSPARKPTNSGTREPTNSRTQEPTNQEPRLCLKPTKQRTHQPEVNIL

SEQ ID NO: 222294 - protein, 47 aa, Glycine max
  Coding DNA Sequence Number=SeqID_105516
MEHARPEKWCEARCRAPSLLGWGAVWVASKGLRMVIGIVDVEPARKI

SEQ ID NO: 222295 - protein, 142 aa, Glycine max
  Coding DNA Sequence Number=SeqID_105517
MEEAYQRHLTVTATVVLNLGFAYFDLTQSTNLMSQDTLLEPPLSLSFLPLLKLGVGTSSLGATTSAGVFSARTGGELTGIGPSGELIGTGAGGKLTRVTIGGVAVGGLAAGGVVAGGVATGAGAAALDGGDATVGDEAGGVA

SEQ ID NO: 222296 - protein, 181 aa, Glycine max
  Coding DNA Sequence Number=SeqID_105518
  Homolog annotation: Hit_ID=Q2QXT7; Match level="QueryCoverage=39%, HitCoverage=13%, E-value=1e-19, Identity=60%"; Hit description =Expressed protein
MRKEKIPHQAPFAIQAAQLLGRAIGAGLFAITPAGERGMCCKAIKLGKILAVGNGFDKEDKPSKVEGGAKNQTEKEIILPPPPPIKKNPLHSIEKQGPAVARAEDDDIFVGEGVDYDIPGKDLSQSPVSEDMEESPRNKEKPSYFTEPTYGPVQPSMVPQGWQETVNMIRKRFLTPVSSLS

SEQ ID NO: 222297 - protein, 111 aa, Glycine max
  Coding DNA Sequence Number=SeqID_105519
MDKSLKVREDEWRERERGGTKFMPQMSISVVPTYPSAGWQREAQGCVFQGGKTCRVTTNVYSRKASKKKSKAGLRTLRIKGSAVVFTHREGISTPCVRHKGRQPLIKSAKS

SEQ ID NO: 222298 - protein, 237 aa, Glycine max
  Coding DNA Sequence Number=SeqID_105520
  Gene Ontology: Mol. function=transporter activity; Cellular component= membrane; Biological process=transport
  Homolog annotation: Hit_ID=UPI00005F7E5E; Match level="QueryCoverage =98%, HitCoverage=68%, E-value=8e-75, Identity=63%"; Hit description =COG1172: Ribose/xylose/arabinose/galactoside ABC-type transport systems, permease components
  Pfam annotation: Domain name=BPD_transp_2; Domain location=60-237; Score=-16.5; E_value=0.00076; Accession=PF02653.6; Description =Branched-chain amino acid transport system  permease component
MSNVKVTAPQATEQSSFFGNLRHKLPKDTGIFVVMLGIALIFEIAGWYVRDQSFLLNTNRLVLIVLQVAIIGIIAVGVTQVIITTGIDLSSGSVIALTAVVAASLAQTSDSLSPMYPSLVNLPAAIPIVAGIGVGLLCGVVNGVLITKTGIPPFIATLGMMVSARGLAQYYTQGNPISFLSDGFTSIGQGAMPVIIFLVVAFLFHIALKHTRYGKYVYAIGGNMTSAKVSGINVNNT

SEQ ID NO: 222299 - protein, 592 aa, Glycine max
  Coding DNA Sequence Number=SeqID_105521
  Gene Ontology: Mol. function=histone-lysine N-methyltransferase activity; Cellular component=intracellular; Biological process =chromatin modification
  Homolog annotation: Hit_ID=Q6YV15; Match level="QueryCoverage=70%, HitCoverage=36%, E-value=2e-90, Identity=41%"; Hit description =Putative SET domain protein SDG117
  Pfam annotation: Domain name=zf-C2H2; Domain location=436-459; Score =7.1; E_value=1.8; Accession=PF00096.16; Description=Zinc finger, C2H2 type
  Pfam annotation: Domain name=zf-C2H2; Domain location=470-493; Score =20.5; E_value=0.0062; Accession=PF00096.16; Description=Zinc finger, C2H2 type
  Pfam annotation: Domain name=zf-C2H2; Domain location=504-527; Score =4.1; E_value=3.8; Accession=PF00096.16; Description=Zinc finger, C2H2 type
  Pfam module annotation: Pfam domain module=zf-C2H2::zf-C2H2::zf-C2H2; Domain location=436-459::470-493::504-527
MTSDGLFQVSLQVGRKRPKLEVRRADTHATLVETNGSDQPITLKTDPGFYRNQDTLNTLESETSTLKDIKEVPVATDLPSNLTNKWNEIVVEATDSEILHGNGTQSTPMNEMAGKKVVEPGAKNRQCIAYVEAKGRQCVRLANNGEVYCCAHLSSQFLGNSGKAEKPVSVDTPMCGGTTVLGTKCKHHALPGSSFCKKHRPHAETNEISNLTHNTLKRKHKENHIGSGGLISKGMVLINAESSLQVEPVPAIDGNSFLERSNLDERPALSGNDQIAMEALHCIGSPPYDDKDPCLEAPKRYILYCEKHLPSWLKCARNGKSRIISKEVFTEILRDCCSWKQKVHLHKACELFYRLVKSILSQRSPVSKEVQFQQALTEASKDTSVGEFLTKLVHSEKERIKLIWGFNDDIDVSSLLDGLPLVPSTDNDSFDNENVIKCKICCAKFPDDQTLGNHWMDNHKKEAQWLFRGYACAICLDSFTNKKLLETHVQERHHVQFVEQCLLLQCIPCGSHFGNMEQLWLHVLSVHPVEFKPLKAPEQPLPCEDTSEKLEQGNSAFLENNSKNPGGLRSCSYGPQSRYQPLYKKECLLLYA

SEQ ID NO: 222300 - protein, 99 aa, Glycine max
  Coding DNA Sequence Number=SeqID_105522
  Gene Ontology: Mol. function=histone-lysine N-methyltransferase activity; Cellular component=nucleus; Biological process=chromatin modification
  Homolog annotation: Hit_ID=O64827; Match level="QueryCoverage=90%, HitCoverage=54%, E-value=3e-25, Identity=54%"; Hit description =Histone-lysine N-methyltransferase SUVR5 (EC 2.1.1.43) (Suppressor of variegation ...
  Homolog annotation: Hit description=3-9-related protein 5) (Su(var)3 -9-related protein 5)
  Pfam annotation: Domain name=SET; Domain location=1-99; Score=45.7; E_ value=1.6e-10; Accession=PF00856.18; Description=SET domain
GWALRAGEAILRGTFVCEYIGEVLDTREAQNRRKRLIEGQAHYVIDTTRFGNVSRFINNSCSPNLVSYQVLVESMDCERAHIGLYANRDVRTLLYMTFP

SEQ ID NO: 222301 - protein, 97 aa, Glycine max
  Coding DNA Sequence Number=SeqID_105523
  Gene Ontology: Mol. function=serine-type endopeptidase inhibitor activity; Cellular component=extracellular region
  Homolog annotation: Hit_ID=P81705; Match level="QueryCoverage=45%, HitCoverage=73%, E-value=1e-17, Identity=77%"; Hit description =Bowman-Birk type proteinase inhibitor
MEMKKLVLVKDPSSLQVTITTSNRQPQHAVMHVLAPNQFLPYVIVTILGKHATQLATFASVRHHILLSVVVWIKPPSAMTNVTPLKTKLTQNEHVFQ

SEQ ID NO: 222302 - protein, 61 aa, Glycine max
  Coding DNA Sequence Number=SeqID_105524
  Homolog annotation: Hit_ID=Q9AXI6; Match level="QueryCoverage=91%, HitCoverage=43%, E-value=5e-13, Identity=50%"; Hit description =Suspensor-specific protein
MLNITFWELGLTMNGFILVAFHRQERHHFFVTLHGKVPLTPLICASQIKIPVANLPIGKSN

SEQ ID NO: 222303 - protein, 721 aa, Glycine max
  Coding DNA Sequence Number=SeqID_105525
  Gene Ontology: Mol. function=beta-amylase activity; Biological process=polysaccharide catabolic process
  Homolog annotation: Hit_ID=Q0WU61; Match level="QueryCoverage=82%, HitCoverage=85%, E-value=0.0, Identity=62%"; Hit description =Putative beta-amylase
  Pfam annotation: Domain name=DUF822; Domain location=80-243; Score =195.0; E_value=1.8e-55; Accession=PF05687.4; Description=Plant protein of unknown function (DUF822)
  Pfam annotation: Domain name=Glyco_hydro_14; Domain location=270-688; Score=362.2; E_value=8.4e-106; Accession=PF01373.8; Description =Glycosyl hydrolase family 14
  Pfam module annotation: Pfam domain module=DUF822::Glyco_hydro_14; Domain location=80-243::270-688
MATDMQRLVGTSEDDEEMGMDVKDEDDEDDDYEENGGEQGNASVSGMVEIDDGNGIGTATGDNRFQQHQQFQEQVGTPGGGTRRSRPLEEKERTKLRERRRRAITARILAGLRRHGNYNLRVRADINDVIAALAREAGWVVLPDGSTFPSRSQGQKPAGGNSTIVTSSSSLAASQQTPSASLRGVASGYRSPLEYNACQTKGVFMPTPSPYDLSSSSRSQTSMVGDGEAQRDNRPLIAGSMDNADDKQIADLPPRLPERDLAGTPYVPVYVMLSLGVINIKCELVDPDGLLKQLRVLKSVHVDGVMVDCWWGIVEAHAPQEYNWNGYKRLFQMVRELKLKLQVVISFHECGGNFGDDVCIPLPHWVAEIGRSNPDIFFTDKEGRHNPECLSWGIDKERVLRGRTAVEVYFDFMRSFRVEFDEYFEDGFISMIEIGLGPCGELRYPSCPVKHGWRYPGVGEFQCYDQYMLKSLRKAAEVRGHSIWARGPDNAGTYNSQPHETGFFCDGGDYDGFYGRFFLSWYSQVLVDHGNRVLSLAKLAFEGSCIAAKLSGIYWWYKTASHAAELTAGYYNPCNRDGYAAIMTMLKTIGVSLNIPCVDLHTFNQQHEGFPETFADPEGIVWQLLNAGWDVDLPVTGQNGFPCLNRVGYNKVLDNAKPMNDPDGRLFSSFTYLRLSPLLMEQQNFVEFERFVKRMHGEAVLDLQNRRNRIVICCGTYLLVE

SEQ ID NO: 222304 - protein, 413 aa, Glycine max
  Coding DNA Sequence Number=SeqID_105526
  Gene Ontology: Mol. function=acyl-CoA thioesterase activity; Cellular component=mitochondrion; Biological process=acyl-CoA metabolic process
  Homolog annotation: Hit_ID=Q5FYU1; Match level="QueryCoverage=99%, HitCoverage=100%, E-value=1e-133, Identity=55%"; Hit description =Acyl-coA thioesterase
  Pfam annotation: Domain name=Acyl_CoA_thio; Domain location=148-248; Score=52.7; E_value=1.2e-12; Accession=PF02551.5; Description=Acyl -CoA thioesterase
  Pfam annotation: Domain name=Acyl_CoA_thio; Domain location=266-398; Score=85.3; E_value=1.8e-22; Accession=PF02551.5; Description=Acyl -CoA thioesterase
  Pfam annotation: Domain name=cNMP_binding; Domain location=33-126; Score=32.0; E_value=2.1e-06; Accession=PF00027.19; Description =Cyclic nucleotide-binding domain
  Pfam module annotation: Pfam domain module=Acyl_CoA_thio::Acyl_CoA _thio::cNMP_binding; Domain location=148-248::266-398::33-126
MAKEDVFEFLGNVPLLQRLPGSSVRKISELVILKHYEPGEYVVREGERGDGLYFIWEGELSDLQAEVVGSVNADDDNHPEFQLKRFDYFGFGLSNEVHHADVVALTKLSCLVLPHEHSALLQPKSIWSAEKSHDTCSLVEHILHLDPIEVDIFRGITPPDAPTFGKVFGGQIVGQALAAASKSVDCRKVVHSLHVYFLLVGDFNIPIIYQVKRLRDGKSFATRKVDAIQKGNVIFTLLASFHLLSLEELREQRLTDPRLPRTYRNKVATIEFIPWPIEIRFCEPKISTNQTKSPPSLRYWFRARGKLSDDQALHRCVVAYTSDLIFLQVSLNPNRRKGRKARAVSLDHSMWFHRPLRADDWILFVIFSPTANNARGYVTGQMFNQKGEHLVSVVQEGVMREVISAKSAIKSNL

SEQ ID NO: 222305 - protein, 271 aa, Glycine max
  Coding DNA Sequence Number=SeqID_105527
  Gene Ontology: Mol. function=protein binding
  Homolog annotation: Hit_ID=Q75KA7; Match level="QueryCoverage=78%, HitCoverage=38%, E-value=1e-40, Identity=44%"; Hit description =Expressed protein
MAEIRLTRVEQGQTKIKNVPIAVTPEGFWCCPSPVVFQKSLKTQNPLNKHKPSSPPPPKTGVQKKPVAVPVSVSVSERRTASSAPSRLVLSDEKQCSTAPERPPPTTTSVAAAERAPRQKIESLPKKVAIEFGEPGTCDMKVVLLGKQGFCVKLSVHRDVLTQKSGFFSEKLSEQSGLSCLQIADCEDVEIYVETVGLMYCKEMKQRLMKQSVSRILRILKVLIVLTSLLLFNSGLKRGGASITQVGQTLIETKNKTDFEELYAGLFCQHM

SEQ ID NO: 222306 - protein, 2314 aa, Glycine max
  Coding DNA Sequence Number=SeqID_105528
  Homolog annotation: Hit_ID=Q2HTJ2; Match level="QueryCoverage=99%, HitCoverage=100%, E-value=0.0, Identity=73%"; Hit description=2-oxo acid dehydrogenase, lipoyl-binding site
  Subcellular localization annotation: CTP_CleavageSite=40; ConfidenceScore=5.28e-01
MQRYHAGSCTSAVNNSAIGGPSTRDIGRTDSSSLPANFPVSSRRQPPLAPYKLKCDKEPLNSRLGPPDYHPQTPNCPEETLTREYLQSGYRDTVEGLEESREISLTQVQNFGKTVVLSCKEAIRKRLRAINESRVRKRKWALRAMKAGQVYGVALSGSQLAKPGVFPEQRPCPEDFRKKWIETTKSSSSAASTSSGPLTKTSNLGILTVFIKFLLNLYLQKHEFNLAGRSVQVWMEIEHVHMLNTPVQAIAIHDFRRAIGLSQQHKRLRSLADLVPHVRRKSLLEVLIRNNVPLLRATWFIKVSYLNLVRLGSASIPSGTADKTQLSCSELWTKDVIEYLQTLLDEFFSKNTSHFTPHNRDQSPQVPYTASLQHRSDQLLSVADGEEPSLHFRWWYIVRLLQWHHAEGLLLPSLIIDWVLRQLQEKQLLEIWQLLLPIVYGFLEIVVLSQTYVHTLAGVALRIIRDPAPGGSDLVDNSRRAYTTSALIEMLRYLIFAASETFVALDCFPLPSSVVSHTINDGNFVLKATEAAGKIINSSEDVVCLFRSKGFDAQFQSLAFDHVISCIQERVEDLTKAVSPGYPGQCLAKASQALDKSLVLGDIHGAYKFLFEDLCDETVSEGWVAKVSHCLRDFRNAPPCDVKFTGRKDLSQVHIAIRLLKVKLRDMQISPKQKSGSTRGHGVSYLAKCSSLQSNQNFVNNAFKIKSSSRNLDQNICSSAIFESPGPLHDIIVCWIDQHMVHKGEGFKRLHLYIVELIRAGIFYPLAYVRQLIVSGIMDMNVNVVDLERQKRHCRILKQLPGKFVRGALVESGISEGPWLTEALRVYLNERRLILRGSLWENHDNANNVNISSLKRKHCTTSTKDRASTVSIDPWKSIFSNKISSKNAKDDNCVEELKTFISTLLQLPKSLTNLSTTGLDESQGSVRKPIGSHNKIDLVEATPGCEECRKSKRQKLSEERSSFVQAPSLVLSDDEDTWWVKKGLKSSEPLKVDQPLKSTKQVTKTRQKTVRKTQSLAQLAASRIEGSQGASTSHVCGNKVSCPHHRTAMDGDTTRSVDGIRSGHCEDIVSIGRALKQLRFVERKEVTLWLMTVFRELIEESEKDVGKVSQFGRPFATVDDKSSIRWKLGEDELSALLYLMDVSDDLVSAVKFLVWLLPKVYISPNSTIHSGRNVENQACDVGEAFLLSSLRRYENILTAADLLPEALSSIMHRAAAIIAASNGRVSGSGALTFARYLLKKYGNVVSVIEWEKSFKSTCDKRLASELESGRSVDGELGLPLGVPAGVEDPDDFFRQKITGGRFPSRVGSGMRDVVQRNVEEAFLDLFGKDRKLFAAGTPKGPAFEKWDNGYQIAKQIVMGLIDCIRQTGGAAQEGDPSLVTSAVSAIVGSVGPTLAKLPDFSAGSNHSNMSLATSSLNYAKCILRMHITCLCLLKEALGERQSRVFEIALAMEASTALAGVFAPSKASRAQFQMSPETHDTGTISNDAANNSSKIVVARTTKISAAVSALVVGAIICGVTSLERIVTILRLKEGLDVVQFVRSTRSNSNGNARSVGAFKVDSSVEVHVHWFRLLVGNCRTICEGLVVDLLGEPSIVALSRMQHILPLTLVFPPAYSIFAFVIWRPFVMNANVAVREDMNQLYQSLTMAISDAIKHLPFRDVCLRECQGLYDLMAADTSDAEFATLLELNGSDMHSKSLAFVPLRARHFLNAMIDCKMPHSIYTKDEGSRNSGHGESKIDFTDSESTLRDKLVDVLDALQPAKFHWQWVELRLLLNEQALIEKLKTHDMSLADAIQLSSPSSEKGTASENENNFIEIILTRLLVRPDAAPLFSELVHLFGKSLEDSMLLQAKWFLAGQDVLFGRKTIKQRLINIAETKRFSVKTQFSEPWGWCTPCKDPVAVKGDKMKVDSMPLEEGEVAEEGMDVKRSIKGFSQVVDSESSTSKQQHGTERALLELILPCIDQSSDESRNSFASDLIKQLNYIEQQIALVTRGPSKPMASTPVTEGQTNKVNNRKAIRGGSPGLARRPTPAPDSSPLSPAALRASISLRVQLLMRFLPILCTDGDSSVWSVRYTLASVLLRLLGSRVVHEDVTVKAMYYTPLRREAESHAEAAFVDSSVEGLFDHLLLILHGLLSSSPPSWLRSKSVSKTTNEPTREFSGFEREPLEALQNHLDNMQLPDTIRWRIQAAMPVLPPSIRCSFSCQLPTVPASALASLQPSTTNSGFNSSCSTVPQRNLVSSSRTTASGRSKLQDNDSDVDPWTLLEDGAGSCSSASNTAIIGSGDRVNIRAASWLKGAVRVRRTDLSYVGAVDEDS

SEQ ID NO: 222307 - protein, 974 aa, Glycine max
  Coding DNA Sequence Number=SeqID_105529
  Homolog annotation: Hit_ID=Q10T01; Match level="QueryCoverage=93%, HitCoverage=99%, E-value=3e-38, Identity=24%"; Hit description =Expressed protein
MAKRSQRFPVNYEKDQSGCMWGFISIFDFRHARFTRKLIADRRHGSKHAVAAALTKNKFEVLSNLDEEYEGNIDRVESKRLIPATDADKLSVKKLIEEEMIIDQDEIKDQGNADVESKQSRLGHEDPPKKESKRKKKSRKKSRDMDSHDLNSAATLKSEFSHKQHSRQQSKDNLDLDKIMNDFCHVEAACSMMNDNDGKIDAQSNQKHAISENLANAIHEFANQMRLNGKDLPEDGQFLSSRELMEALQVISSDKQLFLKLLQDPNSHLLKYIQELESAQGRGGKECSSVVSSNCSEQELVNLKETREISNRKHRNFFRKRVKSQPKDSTNENGKTEFSNRIVILKPALTGMQISESGNNLASSLDSHDIAQYRNPSVRVGSHFSLTEIKRKLKHAMGKERHGNPELIPRKLPVERQNKVPRGKCKDNAGMRSPNKDHFFIEKIARPMFDVVKGNKTGTLKDSELNVEHESGIPNQSVSNIYIEARKHLCEMLDNADESTNISSRQMPKTLGRILSLPEYNFSPLESPGRDLEHHSVTAQARFSSSDKTREISEDNLSPKPATCIGLADQEINKSEKQSNICDESSNNKVQEIKTVSNLSHDVDHVDTSEARYPVRDEIVTEGNVESAKEKNDLELSLNPNGFITGKDQNIDISEIPDGAGCSERLNQDITEENQPSSPPPSPHFSVTKKIEELENGTDVSERPSPVSVLDTSFSDDDFCPGHSRCEPVKLPVQARQIQFEEHDCSPPEQFDRGKYCFEESELIYDYIKAVLHASGLTTDQLLMKCLSSDKILDPSLFDQVEYFSNLLCHDQKLLFDSINEVLMEICQHYFGASPWVSFVNPSTRLTPSMKRVTLKVWEGVCWHILPLPPPRTLEQIVRKDMARRGTWMDLGLDAETIGFEMGEDILGELMEDTILSLYNVNKDTKNKSQEVNEEPVAIASCKSEKLSLFTMTNRQSNSFIQCDSLHPVKAKGV

SEQ ID NO: 222308 - protein, 103 aa, Glycine max
  Coding DNA Sequence Number=SeqID_105530
MTLQGQGVTGRGSGLRELKKERKKHRKRKRRKKSKAEVLPNSNRGSFPTLFLSLALYPVQQSKGGNFIEQFVGGRCNPIPQGHWIENSKKIRPEKQEKALGFS

SEQ ID NO: 222309 - protein, 60 aa, Glycine max
  Coding DNA Sequence Number=SeqID_105531
  Gene Ontology: Mol. function=RNA polymerase II transcription factor activity; Cellular component=transcription factor TFIID complex; Biological process=transcription initiation from RNA polymerase II promoter
  Homolog annotation: Hit_ID=P28147; Match level="QueryCoverage=90%, HitCoverage=27%, E-value=8e-21, Identity=87%"; Hit description=TATA -box-binding protein 1
MAEQALEGSQPVDLTKHPSGIVPTLQNIVSTVNLDCKLELKSIALQARNAEYNPKASFAC

SEQ ID NO: 222310 - protein, 78 aa, Glycine max
  Coding DNA Sequence Number=SeqID_105532
MDFWRKVWNYRFKPQDSCFIWKNYLHAHLMEVDEERRSLFVVRLNIIWLAPKKLVFRNEDFDVDNIAYTIKAQVVFQA

SEQ ID NO: 222311 - protein, 158 aa, Glycine max
  Coding DNA Sequence Number=SeqID_105533
  Gene Ontology: Mol. function=transporter activity; Cellular component= integral to membrane; Biological process=transport
  Homolog annotation: Hit_ID=Q66A58; Match level="QueryCoverage=99%, HitCoverage=53%, E-value=2e-58, Identity=68%"; Hit description=ABC peptide transporter, permease subunit sapC
MIGFYGVIALLLLSLFGSLLAPYALDQQFLGYQLLPPSWSRYGNVSFFLGTDDLGRDILSRLLTGTAATFGSALAVTLAAAFCGVILGVFAGVTHGLRSAVLNHILDTLLSIPSLLLAIVVVAFIGPKLEHAMLAVWLALLPRMVRTIYSAVHDDKQK

SEQ ID NO: 222312 - protein, 56 aa, Glycine max
  Coding DNA Sequence Number=SeqID_105534
MESQIHPQIALLFIASFPKDPKLQDNHHSKRFELDDHEDTDLLQMIAGLSSTLNLI

SEQ ID NO: 222313 - protein, 477 aa, Glycine max
  Coding DNA Sequence Number=SeqID_105535
  Gene Ontology: Mol. function=ubiquitin-protein ligase activity; Cellular component=ubiquitin ligase complex; Biological process =protein amino acid phosphorylation
  Homolog annotation: Hit_ID=Q2HTK4; Match level="QueryCoverage=98%, HitCoverage=44%, E-value=1e-114, Identity=53%"; Hit description =Protein kinase; U box
MAVVSPVPATTQRMGSVRLLSDAGGEILEEPNPRVVDQPIYVAVTKEVKESKLNLIWAIQTSGGKRICILYVHVRATMIPLLGGKFPASTLKEEQVEAYWEEERQGMHGILDEYLCICQRMGVRAEKLHIEMDSIEKGILELISQHGIRKLVMGAASDKYYNRKIDDDIARNIKDGSILRMMDLKSKKAVSVCKQAPASCHIQFVCKGHLIHTSNQCIAPSMHSGLSSNASIAHRNLIATTVLLPPASFLPASLPGGASSPAQPDLQIPHQKQPHTLDRSSDEGNAEVASPLVQQVPNSLKSLRSLSITLGQDCQANITNPALELFRRVRSANDGHGASFMAVSSPEDTEGLSTPRDRMGTEVSSDESDRLSRMSPSGLSTCSDSAVELALTPSLINESSENALELTLSHLIIEDLHHSSPPSTLDGGMDDTIYDQLEQARAEAENATLNAYQETVRRMKAEKDAFEAIRKMIMFMM

SEQ ID NO: 222314 - protein, 53 aa, Glycine max
  Coding DNA Sequence Number=SeqID_105536
MTLWQGTYWVRTSNLPLGSLEVHARCPSLPPCRAMRLCKRSFTKRVKNLKWVA

SEQ ID NO: 222315 - protein, 293 aa, Glycine max
  Coding DNA Sequence Number=SeqID_105537
  Gene Ontology: Mol. function=zinc ion binding; Cellular component =intracellular; Biological process=regulation of transcription, DNA -dependent
  Homolog annotation: Hit_ID=O82256; Match level="QueryCoverage=44%, HitCoverage=34%, E-value=8e-28, Identity=51%"; Hit description=Zinc finger protein CONSTANS-LIKE 13
  Pfam annotation: Domain name=zf-B_box; Domain location=25-71; Score =23.4; E_value=0.00043; Accession=PF00643.14; Description=B-box zinc finger
ADSAKLCFFCDRKVHFPNQLFSKHKRAQLCDACGDSPASVLCSAENSVLCQNCDCGKQKHLVSEAHQRRPLEGFSGCPSVTELLTILGLSEKSLLSNEGTSQIDDDLSDLHVWSAPSINGLEDLITTTASSQKVIVDSMGGKRCTLKILEYCNDFDMFQDIVIESETDPRNQIVPSDTSPLRDYGDIVSAEDGSFTITVTHANFNNQGKPSNSFNAENLSPTPKATPYELTSHERDSALLRYREKKKSRSATKTKDSSCMMVKELLCTANASEYYAEKPQLRAFYKEPKVQNR

SEQ ID NO: 222316 - protein, 371 aa, Glycine max
  Coding DNA Sequence Number=SeqID_105538
  Gene Ontology: Mol. function=protein binding; Cellular component =nucleus; Biological process=multicellular organismal development
  Homolog annotation: Hit_ID=Q570C0; Match level="QueryCoverage=99%, HitCoverage=62%, E-value=1e-176, Identity=80%"; Hit description =TRANSPORT INHIBITOR RESPONSE 1 protein
TLRLNRAVPLDRLATLLRGAPQLVELGTGAYTTEMRPEVFTNLAEAFSGCKQLKGLSGFWDVLPSYLPAVYPICSNLTSLNLSYATIQSPDLIKLVGQCESLQRLWVLDYIEDAGLEVIAASCKDLRELRVFPSDPFGLEPNVALTEQGLVSVSEGCTKLQSVLYFCRQMSNAALDTIARSRPNMTRFRLCIIEPRAPDYLTHQPLDAGFGAIVEHCKDLQRLSLSGLLTDRVFEYIGTYGKKLEMLSVAFAGDSDLGLHHVLSGCDNLRKLEIRDCPFGDKALLANAAKLETMRSLWMSSCLVSYGACKLLGQKMPRLNVEVIDERGPPDSRPESSPVEKLYIYRTVSGPRLDMPGYVWRMQDDSALRIS

SEQ ID NO: 222317 - protein, 343 aa, Glycine max
  Coding DNA Sequence Number=SeqID_105539
  Gene Ontology: Mol. function=drug transporter activity; Cellular component=membrane; Biological process=multidrug transport
  Homolog annotation: Hit_ID=O82775; Match level="QueryCoverage=94%, HitCoverage=93%, E-value=4e-42, Identity=38%"; Hit description =Expressed protein
MADNEDGGDKTSRGNEWEVVSLTASTYAAAPGPDEVEMKDDGKEDVYGQDEGETSHALFMSRHFVFPPSQHENLPVEPDYGEIHDDFGDKDVASEETPEEVTIPSGKDEENLTLPGLEVAEEFEGMRYFDEKINRLSVRGKQFEEGTTLPAFGLTEKGESMYDPAKYTSFEGETAIGGVTAYGESIVDPEATEMEYQGSNVSPDLSLSKNLSKDNEYNTSDLPCGAWWKRRAASLYAHAKEANAFWSVFIAATVMGLVMLGQRWQHERALQLKWQISINDEYVMTPDKIQWWLYSESVMNDIEDCSMSLARSRVLAPIYRLKDVIVGGNRRGSLIRRSSSGES

SEQ ID NO: 222318 - protein, 66 aa, Glycine max
  Coding DNA Sequence Number=SeqID_105540
MTWTAGDEMTEIIRGGDGEDKGFEFPNERSCSVSSKEVVVVVRKEATLFVLEKKKPLPLSEKEQRR

SEQ ID NO: 222319 - protein, 341 aa, Glycine max
  Coding DNA Sequence Number=SeqID_105541
  Gene Ontology: Mol. function=ligase activity
  Homolog annotation: Hit_ID=Q2HTK9; Match level="QueryCoverage=86%, HitCoverage=91%, E-value=1e-101, Identity=69%"; Hit description=SKP1 component
  Pfam annotation: Domain name=Skp1; Domain location=77-159; Score =43.9; E_value=5.6e-10; Accession=PF01466.9; Description=Skp1 family, dimerisation domain
  Pfam annotation: Domain name=Skp1_POZ; Domain location=3-68; Score =22.9; E_value=0.00038; Accession=PF03931.5; Description=Skp1 family, tetramerisation domain
  Pfam module annotation: Pfam domain module=Skp1::Skp1_POZ; Domain location=77-159::3-68
MKPYIWLETSDGSIQQVEQEIAMYCPLICQEIIQKGMGSSKNCAICLPQRVSPATLSLILDYCHFHQVPGRSNKERKSYDEKFIRMDTKRLCELTSAADSLQLKPLVDLTSRALARIIEGKSPEEIREIFHLPDDLTEVSGACENSEEKLEPLKNTTDDPRIRLLNRLYAKKRKELKERERLKNVEAEEEHVDERSVDDLLSFINGNDGDPKGVKTSKNKKKNRRKKEQQQKNSSLKEASEVNKEVNGQNIRHQSAEADRIAETSNSHTEDVFAHREFDDGDIDDGIDPALKEKIDRWGCIVNACLFQISAIYMLIIVARVGYNIELPILTALKLYKPVSY

SEQ ID NO: 222320 - protein, 588 aa, Glycine max
  Coding DNA Sequence Number=SeqID_105542
  Gene Ontology: Mol. function=identical protein binding; Cellular component=nucleus; Biological process=DNA replication initiation
  Homolog annotation: Hit_ID=Q1SMU2; Match level="QueryCoverage=91%, HitCoverage=99%, E-value=0.0, Identity=75%"; Hit description=AAA ATPase
  Pfam annotation: Domain name=Arch_ATPase; Domain location=72-279; Score=-89.4; E_value=0.02; Accession=PF01637.9; Description=Archaeal ATPase
MDEDKTQQLPRRMTRSSASSSPSTSNNIVAAKVTSLEPLTINDLLVGGDPISLDDIISSFPGRSSQILEVVRHLGPLNSPMLPLFVYGSSSTGKTSIILQLFRHLNRPIVFSSCRTCYNQNILFESILNQLLLHRKNAANGYLNAKRCERPSDFVNFLREALTNVISNLKEKSEKLISNEMTQGKIGNMIYLVFDNFQLVREWDKSSTILPLLFNLYDLLNTPEVGLIFISSTSPDTFYSNMGYVEPIPIYFPDYTEEDIRQILLRNQVNQKLYSSFLDVSLKSFCGITKQIDDLSAALKPLYEKYCEPLSDKGKGVAPNQEMKRRLLAHINPHIASSLNEIFKVSSLSSTEVETRKEEKWKGNLRRLEQSKELVSLDFHISTSAKYLLISAFLASRNPATLDASLFDSKGGSDNRKRKRKPSEKAQERKETLEQELLMKGPGTFPLERLLAIFQCLVSVAEEPSDEEEQNNDGLGVEGGNGGLMSDILLQLSSLCNSNFIFKGRSCPIEGSTRYRSTISEDLALKVARSLEFPLSKVYTTSTMPYCYQHEMAGIPYECLKQNQRYRMDNCEHGGSWDGWTEHFTMDN

SEQ ID NO: 222321 - protein, 125 aa, Glycine max
  Coding DNA Sequence Number=SeqID_105543
MEAISKRFEKLDVKTKGSQKKQMTKQQRPAKRDSSYRENVDALHSMQNSNYLVKHCASSSKQPKPKRKMPMLDQFHPCIHDFIENIVDVKVDAEWRRKKDDWRHHIKDKMSQEQAHHHRKPWITA

SEQ ID NO: 222322 - protein, 147 aa, Glycine max
  Coding DNA Sequence Number=SeqID_105544
  Homolog annotation: Hit_ID=O82790; Match level="QueryCoverage=98%, HitCoverage=69%, E-value=4e-32, Identity=45%"; Hit description =Expressed protein
MVSEGLTVEDILENWFKLKPIIMEEWNENREELIDLFGKVRDDWLYSSKQSQGRSVKEASENARTPRADTTVKILCFQRPFYLIYPLLSFVEDRLAILKNVVKEPELDNWNLYLVNWGFNTQKEREEAEANPRIQVIELSDFSSKLK

SEQ ID NO: 222323 - protein, 250 aa, Glycine max
  Coding DNA Sequence Number=SeqID_105545
  Gene Ontology: Mol. function=structural molecule activity; Cellular component=vesicle membrane; Biological process=gas vesicle organization and biogenesis
  Homolog annotation: Hit_ID=O82790; Match level="QueryCoverage=99%, HitCoverage=100%, E-value=4e-86, Identity=59%"; Hit description =Expressed protein
MGELYAMESSAIAAEKALSLLSRLAAKVRWPGLFDGVDSATEDWIIDQMHTFLCKVAEGLTVEGILENWSKLKPIIMEEWDEKRNDLIDLFGKVRDEWLEQDFATWIGANRLYPGVSDALKFASSRVYIVTTKQYPNPLFLLFQSHFADALLQELAGVAIPPERIFGLGTGPKVEVLKQLQKKPEHQGLTLHFVEDRLATLKNVIQEPELDQWNLYLGNWGYNTRKEREGAAAIPRIHVLGLSDFSKKLK

SEQ ID NO: 222324 - protein, 119 aa, Glycine max
  Coding DNA Sequence Number=SeqID_105546
  Homolog annotation: Hit_ID=O82812; Match level="QueryCoverage=62%, HitCoverage=37%, E-value=4e-07, Identity=41%"; Hit description =Expressed protein
MTTMSGPHRSTARPWPELDESDDGSGVALHHLLLDLRGIELGDIGGRERGFGFLAPFSPRVVLLVVEHVVQLVGDVNLALSGEGKMGICGREEEKEKESGDWLEGHGGREDQMRNDALS

SEQ ID NO: 222325 - protein, 105 aa, Glycine max
  Coding DNA Sequence Number=SeqID_105547
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=18%, E-value=1e-51, Identity=76%"; Hit description =Photosystem I P700 chlorophyll a apoprotein A1
GPDTTTWIWNLHADAHDFDSHTNDLEEISRKVFSAHFGQLSIIFLWLSGMYFHGARFSNYEAWLSDPTHIRPSAQIWRASGITSELQLYCTAIGALVFAALMLFA

SEQ ID NO: 222326 - protein, 138 aa, Glycine max
  Coding DNA Sequence Number=SeqID_105548
  Gene Ontology: Mol. function=nucleic acid binding
MPQKCKDVDIFTIFTFADAMLDLGASINVMPTFFYKSLKLGDLRPTKVVIRLANRSTVQPLGVLEDLLVKVNGFVFLEDFYILDMEDDSSRYEISVALAAGAEFQEVDVVVDVVVSTNEIVVASQPPLPSILQPPSLD

SEQ ID NO: 222327 - protein, 78 aa, Glycine max
  Coding DNA Sequence Number=SeqID_105549
MRLSVLSARRDNVLAEQAGRALGEHISDLSSSRISQPIKQVVCLAKRMPLTERICLAERVINYLNLLFFGLKLSWIHH

SEQ ID NO: 222328 - protein, 697 aa, Glycine max
  Coding DNA Sequence Number=SeqID_105550
  Gene Ontology: Mol. function=GTPase activity; Cellular component =intracellular; Biological process=small GTPase mediated signal transduction
  Homolog annotation: Hit_ID=Q5VQ69; Match level="QueryCoverage=90%, HitCoverage=92%, E-value=0.0, Identity=77%"; Hit description =Putative GTP-binding membrane protein LepA
  Pfam annotation: Domain name=ATP_bind_1; Domain location=46-260; Score=-71.5; E_value=0.078; Accession=PF03029.7; Description =Conserved hypothetical ATP binding prot
  Pfam annotation: Domain name=EFG_C; Domain location=477-565; Score =92.7; E_value=1.1e-24; Accession=PF00679.14; Description=Elongation factor G C-terminus
  Pfam annotation: Domain name=GTP_EFTU; Domain location=70-262; Score =231.0; E_value=2.6e-66; Accession=PF00009.17; Description=Elongation factor Tu GTP binding domain
  Pfam annotation: Domain name=GTP_EFTU_D2; Domain location=283-353; Score=27.0; E_value=6.5e-05; Accession=PF03144.15; Description =Elongation factor Tu domain 2
  Pfam annotation: Domain name=LepA_C; Domain location=589-697; Score =262.8; E_value=6.8e-76; Accession=PF06421.3; Description=GTP-binding protein LepA C-terminus
  Pfam annotation: Domain name=MMR_HSR1; Domain location=73-212; Score =12.3; E_value=7.5e-05; Accession=PF01926.13; Description=GTPase of unknown function
  Pfam module annotation: Pfam domain module=ATP_bind_1::EFG_C::GTP _EFTU::GTP_EFTU_D2::LepA_C::MMR_HSR1; Domain location=46-260::477 -565::70-262::283-353::589-697::73-212
  Subcellular localization annotation: CTP_CleavageSite=47; ConfidenceScore=5.61e-01
MGYLSKASKTLRQSNYLSLLCNSNFNFNPLTNRITHERFSVTRALLCSQTRQNSTTREKSTIDLSQYPKELVRNFSIIAHVDHGKSTLADRLLELTGTIKKGHGQPQYLDKLQVERERGITVKAQTATMFYKHGVNGDDCSDGKESPKFLLNLIDTPGHVDFSYEVSRSLAACQGVLLVVDAAQGVQAQTVANFYLAFESNLTIVPVINKIDQPTADPDRVKAQLKSMFDLDPSDVLLTSAKTGEGLQQILPAVIERIPAPPGRSDSPLRMLLLDSYYDEYKGVICHVAVVDGVLRKGDKISSAATGQSYEASDIGIMHPELTPTGILLTGQVGYVVSGMRSTKEARVGDTIYHTRSTVEPLPGFKPAKHMVFSGLYPADGSDFEALNHAIERLTCNDASVSIAKETSTALGLGFRCGFLGLLHMDVFHQRLEQEYGAHVISTVPTVPYIFEFHDGSKLEVQNPASLPSNPKHKVTACWEPTVLATIIIPSEYVGPVITLVSERRGQQLEYSFIDSQRVFMKYRLPLREIVVDFYNELKSITSGYASFDYEDSDHSYLPWFIDDVLCYVEFGTNICYQQADMVKLDILLNGQPVDAMATIVHSAKAYRVGRELTEKLKGVLDRQMFEVNIQAAIGSKIIARETISAMRKNVLAKCYGGDITRKRKLLEKQKEGKKRMKRVGSVDIPQEAFHELLKVS

SEQ ID NO: 222329 - protein, 877 aa, Glycine max
  Coding DNA Sequence Number=SeqID_105551
  Gene Ontology: Mol. function=nucleoside-triphosphatase activity; Cellular component=membrane; Biological process=defense response
  Homolog annotation: Hit_ID=Q8H6S3; Match level="QueryCoverage=96%, HitCoverage=97%, E-value=1e-131, Identity=35%"; Hit description=NBS -LRR type disease resistance protein
  Pfam annotation: Domain name=LRR_1; Domain location=532-554; Score =3.7; E_value=58; Accession=PF00560.23; Description=Leucine Rich Repeat
  Pfam annotation: Domain name=LRR_1; Domain location=556-577; Score =10.1; E_value=3.7; Accession=PF00560.23; Description=Leucine Rich Repeat
  Pfam annotation: Domain name=LRR_1; Domain location=737-757; Score =5.0; E_value=34; Accession=PF00560.23; Description=Leucine Rich Repeat
  Pfam annotation: Domain name=LRR_1; Domain location=759-782; Score =9.7; E_value=4.4; Accession=PF00560.23; Description=Leucine Rich Repeat
  Pfam annotation: Domain name=LRR_1; Domain location=788-811; Score =3.1; E_value=75; Accession=PF00560.23; Description=Leucine Rich Repeat
  Pfam annotation: Domain name=NB-ARC; Domain location=134-435; Score =336.5; E_value=4.5e-98; Accession=PF00931.13; Description=NB-ARC domain
  Pfam module annotation: Pfam domain module=LRR_1::LRR_1::LRR_1::LRR _1::LRR_1::NB-ARC; Domain location=532-554::556-577::737-757::759 -782::788-811::134-435
MMDFIGPVLELIIRMWDCCACVREFEENLSCLRDIASDLRGVWIDVSVRVEVAEAQYLRRLNEVNDWLDKVEAMQREVEAIQQKVSQVQETHSRCLGSFCPGNFPTSCWMGRVIAQKIGEIRELIDKGHFDVVAQEMPHALVDEIPLEATVGLESTFDELGACFDDNHVGVIGLYGMGGVGKTTLLKKFNNEFLPTAFYDVVVWVVVSKEADVGNVQQSILEKLKVPDGKWVGKAINERAIVLYNILKRKKFVLLLDDLWERIDLLKLGIPLPDTNNGSKVIFTTRSMEVCRYMEANRCIKVECLAPKAAFELFKEKVGEETLNSHPEIFHLAQIMAKGCEGLPLALITVGRPMARKSLPEWKRAIRTLKNYPSKFSGMVKDVYCLLEFSYDSLPSAIHKSCFLYCSIFPEDYDIREDELIQLWIGEGLLAEFGDDVYEARNQGEEIIASLKFACLLEDSERENRIKMHDVIRDMALWLACDHGSNTRFLVKDGASSSSAEAYNPAKWKEVEIVSLWGPSIQTFSGKPDCSNLSTMIVRNTELTNFPNEIFLTANTLGVLDLSGTDIQELPRELQKLKKLRCLLLNYICNRIVFPRSLISSLLSLQVFSKLPWEDQCILPDLREPEETVLLQELECLEFLQDISIALFCFSSMQVLQKSPKLQRFIRLRVISHFNSMPHVILFSLLRKMQHLEVLSISISSSPSLVSDMKKESPSHDSMSECIPMSSKLTEHNYTVNLRELSLEGCGMFNLNWLTCAPSLQLLRLYNCPSLEEVIGEEFGHAVNVFSSLEIVDLDSLPKLRSICSQVLRFPCLKEICVADCPRLLKLPFDSSSARNSLKHINGQKNWWRNLKWEDEATRDLFRSKYVPFRSKIRRKN

SEQ ID NO: 222330 - protein, 246 aa, Glycine max
  Coding DNA Sequence Number=SeqID_105552
MDTSALNSSSPPLDLYNLFTTTIEASLNSPSNTILNPPCSIFSKKLTHRQLKLCAQTHLPSPLPPPTPFFHNPFSSSPSPTKSSPPPSIFSKKLTHRQLKLFAQTHLPSPLPPPTPFFHNPFSSSPSPTKSSPPPPKPQQPQSQPHSTPPLEKHPSSKYPSSTTKPDEGHVLLRSLSRATTTRRTRSCGFIAWDLSRTMGPTIVMVVHGPFGEEGGDDFHFLRHSTPSPPMNTSRLFCIIKPKPHF

SEQ ID NO: 222331 - protein, 58 aa, Glycine max
  Coding DNA Sequence Number=SeqID_105553
MTKIEMYRRKRKLTGRINLNPFQDNGLDTVVGAAVVNGDVEAVVWQLAMFTAYDFERQ

SEQ ID NO: 222332 - protein, 1741 aa, Glycine max
  Coding DNA Sequence Number=SeqID_105554
  Gene Ontology: Mol. function=nucleic acid binding; Cellular component= nucleus; Biological process=regulation of transcription, DNA-dependent
  Homolog annotation: Hit_ID=Q1SMW2; Match level="QueryCoverage=99%, HitCoverage=78%, E-value=0.0, Identity=69%"; Hit description=SNF2 -related; HMG-I and HMG-Y, DNA-binding; Bromodomain; ATP-requiring DNA helicase RecQ
  Pfam annotation: Domain name=DEAD; Domain location=966-1138; Score= -19.7; E_value=0.00026; Accession=PF00270.19; Description=DEADDEAH box helicase
  Pfam annotation: Domain name=Helicase_C; Domain location=1333-1412; Score=89.3; E_value=1.2e-23; Accession=PF00271.21; Description =Helicase conserved C-terminal domain
  Pfam annotation: Domain name=QLQ; Domain location=417-454; Score =44.2; E_value=4.4e-10; Accession=PF08880.1; Description=QLQ
  Pfam annotation: Domain name=ResIII; Domain location=962-1132; Score=- 31.8; E_value=0.021; Accession=PF04851.6; Description=Type III restriction enzyme, res subunit
  Pfam annotation: Domain name=SNF2_N; Domain location=968-1281; Score =356.3; E_value=4.9e-104; Accession=PF00176.13; Description=SNF2 family N-terminal domain
  Pfam module annotation: Pfam domain module=DEAD::Helicase _C::QLQ::ResIII::SNF2_N; Domain location=966-1138::1333-1412::417 -454::962-1132::968-1281
MQSFQQQLLRKPEGSEAFLAYQAGLQGVFGSNNFPSSSMQLPQQSRKFVDLAQHGSNQIQGVEQQMLNPAQAAYFQYALQASQQKSALEMQSQQQPKMGMLGPSSVKDQEMRMGNLKMQDLMSMPAVNQAQASSSRNSSEHFTRGEKRVEQGQQLAPDQKSEGNSSSQGAVGNLMSGNIIRPVQDLATQQSIPNSMNNQIAMAAQLRAMQAWAHERNIDLSHPANANLMAQLIPLMQSRMVQQPKANDTNLGSLSSPIPVSNQQVTSPAVASESSAHAHSSSDVSAQSGSAKARQTAPPSHLSPPISAGIASSSSDMAALQFSLHGRDAQGSLKQSVLTVNGMPSVHPQQSSANMNLGADHPLNAKSSSSGSEPVKMQYIRQLNQSASQAGGLTNEGGSGNHTKTQGGPSQMPQQRNGFTKQQLHVLKAQILAFRRLKKAEGALPQELLRAIIPPPLDLQVQQPIHSEGAQNQEKSAGNIVAEQPRQNEVNAKESQPISSINGKISSKQEVFVRDENSPVTAVHLQPTPPVTKESAGQEEQQSVACAPKSDQESEHGIGRNELVLDKGKAVAAPQASVTDAMQLNKPAQASTVSQPKDVGSTRKYHGPLFDFPFFTRKHDSFGSSMMINNNNLSLAYDVKELLFEEGMEVLGKRRTESLKKIEGLLAVNLERKRIRPDLVLRLQIEEKKLRLLDLQARLRDEIDQQQQEIMAMPDRPYRKFVRLCERQRMELARQVQASQRALREKQLKSIFQWRKKLLETHWAIRDARTARNRGVAKYHERMLREFSKRKDDDRNKRMEALKNNDVDRYREMLLEQQTSIEGDAAERYAVLSTFLSQTEEYLHKLGSKITAAKNQQEVEEAAKAAAAAARLQACFIISPLIKRKRKIQWPGRKPLFLCAFFLGLSEEEVRVAAACAGEEVMIRNRFMEMNAPKDSSSVSKYYSLAHAVSEKVVCQPSMLRAGTLRDYQLVGLQWMLSLYNNKLNGILADEMGLGKTVQVMALIAYLMEFKGNYGPHLIIVPNAVMVNWKLLFTMQSELHTWLPSVSCIFYAGGKDYRSKLYSQEIMAMKFNVLVTTYEFIMYDRARLSKIDWKYIIIDEAQRMKDRDSVLARDLDRYRCQRRLLLTGTPLQNDLKELWSLLNLLLPEVFDNKKAFNDWFSKPFQKEGPTQNTEDDWLETEKKVIIIHRLHQILEPFMLRRRVEDVEGSLPPKVSIVLRCKMSAVQSAIYDWVKSTGTLRLDPEGENSKIQKNPHYQAKEYKTLNNRCMELRKTCNHPSLNYPLLSELSTNSIVKSCGKLWILDRILIKLQRTGHRVLLFSTMTKLLDLLEDYLNWRRLVYRRIDGTTSLDDRESAIMDFNSPDSDCFIFLLSIRAAGRGLNLQSADTVVIYDPDPNPKNEEQAVARAHRIGQKREVRVIYMEAVVDKISSHQKEDEVRSGGTVDMEDELVGKDRYIGSIESLIRNNIQQYKIDMADEVINAGRFDQRTTHEERRLTLETLLHDEERYQENVHDVPSLQEVNRMIARSEEEVELFDQMDEELDWPEDVMQHDEVPEWLRANTREEKGRPKGKKHPNYKELEDENGEYSEASSEDRNEDSAQGEIGEFEDDVCSGADGNRLEEDGLTSDAGYEIARSSENARNNHVVEEAGSSGSSSDSQRLTKTVSPSVSSKKFGSLSALDSRPGSISKIMGDELEEGEIAVSGDSHMDHQQSGSWIHDRDEGEDEQVLQQPKIKRKRSLR

SEQ ID NO: 222333 - protein, 157 aa, Glycine max
  Coding DNA Sequence Number=SeqID_105555
MDSSKDNSIISCIELLGAPEPGARRAGARPAELPSTSAAPTPTSTLVAPSVPVVEPSGSIPSMEQFTEMVAWCRNMPFCGRARRGSRVRFPKEERCTESPQTFICGKCWKNQRKPVEKKIPSSGVVFTLEEGISTSHVDKSGALAPTYPPSKRKSDL

SEQ ID NO: 222334 - protein, 227 aa, Glycine max
  Coding DNA Sequence Number=SeqID_105556
  Gene Ontology: Mol. function=small conjugating protein ligase activity; Cellular component=cytoplasm; Biological process=protein modification process
  Homolog annotation: Hit_ID=Q9SPB9; Match level="QueryCoverage=93%, HitCoverage=93%, E-value=7e-72, Identity=66%"; Hit description =Ubiquitin carrier protein 4
  Pfam annotation: Domain name=UQ_con; Domain location=17-165; Score =162.5; E_value=1.1e-45; Accession=PF00179.16; Description=Ubiquitin -conjugating enzyme
MGSLPDSGSSLSFVFRRMMSDYKVEMINDGMQEFYVQFHGPNDSPYHGGVWKVRVELPDAYPYKSPSIGFINKIYHPNVDEIYKNNCVGVSGLIIWDDINFRSGSVCLDVINQTWSPMFDLVNVFEVFLPQLLLYPNPSDPLNGEAAALMMRDRPSYEQRVKETIKVYFLFNSQLTDVSLASMSEYCEKYAKPEDIGEATEEKSSDEEMSEDEYDSSDEQVVGKADP

SEQ ID NO: 222335 - protein, 686 aa, Glycine max
  Coding DNA Sequence Number=SeqID_105557
  Gene Ontology: Mol. function=DNA binding; Cellular component =intracellular
  Homolog annotation: Hit_ID=Q2HUC6; Match level="QueryCoverage=98%, HitCoverage=97%, E-value=0.0, Identity=53%"; Hit description=ELM2; AT-rich interaction region; Homeodomain-related
  Pfam annotation: Domain name=ARID; Domain location=1-78; Score=8.2; E_ value=2.4e-05; Accession=PF01388.11; Description=ARIDBRIGHT DNA binding domain
  Pfam annotation: Domain name=ELM2; Domain location=478-533; Score =11.9; E_value=0.014; Accession=PF01448.14; Description=ELM2 domain
  Pfam annotation: Domain name=Myb_DNA-binding; Domain location=578 -628; Score=27.8; E_value=3.8e-05; Accession=PF00249.21; Description =Myb-like DNA-binding domain
  Pfam module annotation: Pfam domain module=ARID::ELM2::Myb_DNA -binding; Domain location=1-78::478-533::578-628
MMSNGDPLDLYKLFMVVKEKGGYDAVCKNKLWDLVGEEYGLGVKVGSSVELAYSKHLSSLEACLKNVADGKLPECGLVDDRVKFHKHLMEAQAESLLDDSGEKEVGDGLERRACCCPDGRKLGGSNRVKGVKPESNVAELERVYEYLDGTKSCVSDSVKGKKSDYNGDEFDNVCDFLDGRELCGTNRVKGMSPESNGDKKVQSEGLVDLDMLDHGTDEHIIRNLCSLNTERDILEEFDGGKILTVDASDAESNMPRLSDGSKSCDNDDDDDSDDVLILDPSGVDKEIFGRKRKRESKSEMLSWITSIAKNPCDPTVGSIPEKSKWKSYSSQEIWKQALLFREAVFLKKDFETISEQLSWQKTSLLEKKDGWRMRNYSRSGILAHRRSGVFPCHYRGQKMHPSMYDDRVGAIYNLRQRLKCDKRVLFGKATSEGVSSASSGGTHGYLERTPSSRAEDCAEKQLPDSCTARSSLDICARVPIPLGPNHQAEVPEWTDITYEVDSKWLGTQIWPLKTVNSKHHLFERDPIGEGRQDSCSCRVQGSVECVRFHIAKKRAKVKLELGEAFHQWNLHKVGEEIGGSWTEKEEKKFKDVVKSNPASLEKCFWDHLFKTFPKKSREDLVSYYFNVFLLQRRAYQNRHTPDNIDSDDDESECTPLRKVFGHHPPKARSFTLLSPKKATFKRENNK

SEQ ID NO: 222336 - protein, 334 aa, Glycine max
  Coding DNA Sequence Number=SeqID_105558
  Gene Ontology: Mol. function=nucleic acid binding
  Homolog annotation: Hit_ID=Q1SMW2; Match level="QueryCoverage=99%, HitCoverage=14%, E-value=1e-115, Identity=69%"; Hit description=SNF2- related; HMG-I and HMG-Y, DNA-binding; Bromodomain; ATP-requiring DNA helicase RecQ
MVMNTPEKVGRGSISIQMDLQLMALRRLKSSREDFFACLFSCKNVISKLQRRIDKEGHQIVPLLTDLWKRIENSGHAGGSGNSLLDLHKIDQRIDRMDYSGVMELVFDVQFMLRGAMHFYGYSYEVRTEARKVHDLFFDILKIAFPDTDFVEARGALSFSSQVPAGTAASSPRQVTVGPSKRHRVTNDAETDPCPSQKPSQSGSTTNGENTRFKGHLPQKNSRTGSGSAREQPQQDNPPLLAHPGQLVVCKKKRNERDKSLGKGRTGSTGPVSPPSAAIRSPGSGSTPKDARLAQQGRVSQPSQHSNGSAGSVGWANPVKRLRTDSGKRRPSHM

SEQ ID NO: 222337 - protein, 102 aa, Glycine max
  Coding DNA Sequence Number=SeqID_105559
  Homolog annotation: Hit_ID=Q1SV95; Match level="QueryCoverage=29%, HitCoverage=16%, E-value=4e-07, Identity=83%"; Hit description=RNA -binding region RNP-1
MELSWPVLISESRYPDELSIEYIHVSFEDTWGEKFVKVRLRTSKKCSELSKYGRSMPRHGSEDRSKWFKDILWEEKMKTAYEQGRLMLLQNLDPSLSSSEVQ

SEQ ID NO: 222338 - protein, 39 aa, Glycine max
  Coding DNA Sequence Number=SeqID_105560
MDDMFNSLINLITSKEEARRLALRITSRKILVQNNTKLG

SEQ ID NO: 222339 - protein, 150 aa, Glycine max
  Coding DNA Sequence Number=SeqID_105561
  Homolog annotation: Hit_ID=Q9FHN3; Match level="QueryCoverage=47%, HitCoverage=41%, E-value=1e-12, Identity=52%"; Hit description =Arabidopsis thaliana genomic DNA, chromosome 5, TAC clone:K17N15
MQHRNLTSGRPSGTDGSDYSYRMVVDSRYQLVAKGKKRLSLYFITEAVLLLIGVTLTYLPGIEADAPNTVAYSSVIVSVVSLIIGNIGRRRSRSGLLRFYAAVSSIAMLLLIASLAQQHLLLKVNMSVFDRRFYKKNFINYQERNMAAKK

SEQ ID NO: 222340 - protein, 588 aa, Glycine max
  Coding DNA Sequence Number=SeqID_105562
  Gene Ontology: Mol. function=DNA topoisomerase (ATP-hydrolyzing) activity; Cellular component=chromosome; Biological process=DNA topological change
  Homolog annotation: Hit_ID=Q1SV94; Match level="QueryCoverage=90%, HitCoverage=75%, E-value=0.0, Identity=77%"; Hit description =Spectrin repeat
  Pfam annotation: Domain name=DUF632; Domain location=130-459; Score =404.8; E_value=1.2e-118; Accession=PF04782.3; Description=Protein of unknown function (DUF632)
MPAGVMHHHHRSPIPLSIAEEDEEEEATPKQAKKTAGSPPEMKTPPPPPPESKGMAWDYFFMVENMPGPSLSAEDDNDSHIHDDDGEGKMENVVEDEVEPKTPEKVQEHENVNVHEEHDDEISEAKKHIEHSKTAPAEFRRAIKVVPSVTLMQILNVLDDHFLKASEGAQEVTKMLEATRLHYHSNFADNRGHIDHSARVMRVITWNRSFRGVSNGDAAKDDIDSEEYETHATVLDKLLAWEKKLYEEVKQGELMKFEYQRKVAILNKQKKRGASAESLEKTKAAVSHLHTRYIVDMQSMDSTVSEVNHIRDAQLYPKLVALIIEMANMWENMCIHHDSQLKIVTDLKSLDISQAPKETTKHHYDRTVQLEKVIQEWHLQFEKLVTQQKHYIKALNSWLKLNLIPIESNLKEKISSPPKAQNPPIQALLHAWHDYVDKLPDELAKSAISSFVAVIKTIILQQEEEMKLKERCEETRKEYFKKKQAFEEWYQKHLMRRGPDEAEHERGEEVNANNPVSERQFVVESLKKRLEEEIESHQKHCVQVREKSLQSLKTRLPELFRALSDYAHACADAYEKLKLITQSRGGEA

SEQ ID NO: 222341 - protein, 520 aa, Glycine max
  Coding DNA Sequence Number=SeqID_105563
  Gene Ontology: Mol. function=drug transporter activity; Cellular component=membrane; Biological process=multidrug transport
  Homolog annotation: Hit_ID=UPI000034F09A; Match level="QueryCoverage =89%, HitCoverage=86%, E-value=0.0, Identity=67%"; Hit description =antiporter/ drug transporter/ transporter
  Pfam annotation: Domain name=MatE; Domain location=279-442; Score =141.9; E_value=1.7e-39; Accession=PF01554.9; Description=MatE
  Pfam annotation: Domain name=MatE; Domain location=60-220; Score =151.6; E_value=2e-42; Accession=PF01554.9; Description=MatE
  Pfam module annotation: Pfam domain module=MatE::MatE; Domain location=279-442::60-220
METPLMFNSDLNSTGTTELQYAPEGLVDTNGGDYTEMSGLADFKNVFSVESVKLWTIAAPIAFSILCNYAVNSFTTIFVGHLGDLELSSVSLSLSVVSNFSFGFLLGMASALETLCGQAFGAGQVEMLGVYMQRSWLILLGACICLTPIYIYAEPILLLLGQEPEIAELAGVFTIQSIPQMFSLAINFPTQKFLQAQTKVGFLAWVGFGAFIFHIILLWILLKVLALGTTGAAVAYSTTAWVIALAQTAYVIGWCKDGWRGFSWLAFKDLWAFVKLSVASAVMLCLEVWYFMILIVLTGHLDNAVIAVGSLSICMTINGFEGMLFIGINAAISVRVSNELGSGRPRAAKYSVIVTIIESLVIGLICAAIILITKDHFAIIFTESKEMIKAVSKLAGLLGLTMILNSVQPVISGVAVGGGWQALVAYINLFCYYIMGLPLGFLLGYKLGYRVEGIWVGMICGTILQTLILLYIVYKTNWNKEGKFSATSHTLISFKPRDGCIEMAEVDFISLNEYFFIYSQ

SEQ ID NO: 222342 - protein, 102 aa, Glycine max
  Coding DNA Sequence Number=SeqID_105564
MIYSMWLRQNFQELPIDVDDVVIAQHARAHIMMLIGRCLMPETSGARMHDMGHEDEEEDDDNNNNNNNNDNGDDDNHGDAHGAAPNFKNRCDLPQEKEVGRG

SEQ ID NO: 222343 - protein, 163 aa, Glycine max
  Coding DNA Sequence Number=SeqID_105565
MESALFFSFIFVFCFLCLALLVLLFVCLFFIFYGVVEALTINEKSIFLKRSLQTSRREGEKNRRRARQHGVQWGHLGQLLQGVDRAEQDSTTAVEREQTCATAEIAQPSAAPEVTVISNSNSASPTQASQRLSSAPGVNLVEIIGPILMPLMLQPLIKEKKFG

SEQ ID NO: 222344 - protein, 746 aa, Glycine max
  Coding DNA Sequence Number=SeqID_105566
  Homolog annotation: Hit_ID=UPI00006A21E6; Match level="QueryCoverage =42%, HitCoverage=40%, E-value=2e-18, Identity=24%"; Hit description =UPI00006A21E6 related cluster
MDGINGLDVEQCFPMQKNITMKLTNNQISPGVWYIGLFNGIGPTRTQSKMIIRGPSYSFIANISVEACTNSMMRGDFCNSSVYPLSCAASVVSNALEAKVNKSMLENLVTCKSNFEAFCVHEGVPNFFSLDIMNVAEEIIITATNIRFNVTGSNDISLMCFVRHGAMPSVTSNDYSIDISKSPLVIHSPLIGRWYISIVPVNLTKTQDNNVRVCYSVESQVPQCPLGKAGPNCTMDSYLLQCLSLGSSLIGFFTGINFFLRSWRFKLLYAQCLQKRFKNLFRKYYLLPNWILKHYFFLTFVRRGSTPFESYYLPVVGGVSYDSANFPLEPLLENSSYIGEPDNVWTYFLLDIPRGAAGGNIHIQLSSDMKISYEVYARFGGLPSLDSWDYYYANKTRRSDPSVFFTLYDSSDAKVNFYIMYAREGTWGIGLRHLNTSSDSMKGLTSMSISLERCPKRCSSHGECKFSFDASGLTSYSFCSCDRNHGGFDCSIEIVTHQGHVRQSIFLIVSNAAAILPAYWALRKKALAEWVLYTSSGISSGLYHACDVGTWCALNYNVLQFMDFWLSFMAVISTFIYLATIDEVLKRAIHTAVAILTALMAATKATRSSNVILVIVIGALGLFIGWLIEISTKYRSLSFSIGISFNFSQCFQTIKRWIYNLAKTLLRRYHWAFALAGFLALAMAAISWTLETSETYWFWHSIWHITIYTSSFFFLCSKANIEDTENQLPTNGNYELTHQDSLPRTG

SEQ ID NO: 222345 - protein, 45 aa, Glycine max
  Coding DNA Sequence Number=SeqID_105567
MAWTSIKGPKNRLSTKKWRRKWQASSTLFARADWPFIKFESKTNS

SEQ ID NO: 222346 - protein, 89 aa, Glycine max
  Coding DNA Sequence Number=SeqID_105568
MEYGEWDTLVRELGWPNFSWPAMTPSQQHDFPIPTPNVPLGTQWNVPGAIPDMEELLAVDLRHQFSTEADQVEAGGHRGKRNSDRQARR

SEQ ID NO: 222347 - protein, 488 aa, Glycine max
  Coding DNA Sequence Number=SeqID_105569
  Gene Ontology: Mol. function=chitin binding; Cellular component =extracellular region; Biological process=chitin metabolic process
  Homolog annotation: Hit_ID=UPI00006A17C9; Match level="QueryCoverage =81%, HitCoverage=100%, E-value=2e-48, Identity=28%"; Hit description= UPI00006A17C9 related cluster
GLHILTFKGLHLLDFRGLHVLALRGLHILAFRGLQVLSFKGLQALAFRGLDVLAFGGVHVLDFRGLHVLALSGLHVLPLRGLHVLALRGGLHVLTFRGLHVLAFKGLHILPFRGLHVLAFRGLRALALRGQHILTFRGLHTLTFKGLHVLAFRGLHVLDFRGLHVLASRGLHALSFRGLHILIFRGLHLLYFRGLHVLALRGLHILAFRGLQVLSFRGLCALALRGLHVLVFRGLHALAFRGLDVLAISRVHVLDSKGLHVLALSGLHVLALRGLHIIALRGLHVLAFRGLHVLDFRGLHVLAFRGLYILAFRGLHVLTFRGLYVLAFTGLHILAFRELKWFSFISSWAIPFDLGGGPTMRAQPKEEAIAQLLCIPGQDFAQTVGEAPQQPGDGQQWVIDTPPPPPESTSAHLQRLKHCLRHMVHQQMANHRGSSPRSDPGRAPLKRVPVRPHKPTQALTNTNSRVQNISSVSRPSRDGHSSDRDRGS

SEQ ID NO: 222348 - protein, 116 aa, Glycine max
  Coding DNA Sequence Number=SeqID_105570
  Gene Ontology: Mol. function=calcium ion binding; Cellular component =integral to membrane; Biological process=multicellular organismal development
  Homolog annotation: Hit_ID=Q9NR61; Match level="QueryCoverage=69%, HitCoverage=34%, E-value=4e-11, Identity=35%"; Hit description=Delta- like protein 4 precursor
  Pfam annotation: Domain name=EGF; Domain location=11-47; Score=39.9; E_value=9e-09; Accession=PF00008.17; Description=EGF-like domain
  Pfam annotation: Domain name=EGF; Domain location=54-85; Score=5.8; E_ value=2.3; Accession=PF00008.17; Description=EGF-like domain
  Pfam module annotation: Pfam domain module=EGF::EGF; Domain location =11-47::54-85
GTFCDEEMTMCDGTNSFWCEHGATCEEIVQGEKYSCKCPPGFAGEHCEHSGASCGQTFCFHNAECLAEAGDVCQCPSEWKGSADCSLPTTPTGSTLPSSFHKLQPSLDAVEMKRVI

SEQ ID NO: 222349 - protein, 57 aa, Glycine max
  Coding DNA Sequence Number=SeqID_105571
MGRGTSTREALSAAVLADRASLPGVTKDGVRRGAVRRVGLAQPDASVCCAYTNSHGR

SEQ ID NO: 222350 - protein, 127 aa, Glycine max
  Coding DNA Sequence Number=SeqID_105572
  Homolog annotation: Hit_ID=Q1SUH7; Match level="QueryCoverage=47%, HitCoverage=3%, E-value=7e-14, Identity=65%"; Hit description =WW/Rsp5/WWP; Synaptojanin, N-terminal; Galactose-binding like
MGVTCIVIKLINARRINRTTGALRHGAKLGFDLFKPQGEALDFVTNGSRFACRSTTLTRVILGYAALGNMALLLIAASVRITKGRGRGRSMHQRERARATTWWHDGGRGQLRKRRTRGASNRGDNKA

SEQ ID NO: 222351 - protein, 638 aa, Glycine max
  Coding DNA Sequence Number=SeqID_105573
  Homolog annotation: Hit_ID=Q2HUD0; Match level="QueryCoverage=99%, HitCoverage=51%, E-value=0.0, Identity=79%"; Hit description=WD40 -like
  Pfam annotation: Domain name=RIC1; Domain location=127-407; Score =551.1; E_value=1.1e-162; Accession=PF07064.4; Description=RIC1
MVMDVYLDYMLLTYRPFDVHIFHVKLFGELTPSGNPDLQLSAVRELSIMTAKSHPAAMRFIPDQFPRESISNISVSSDSLTREPARCLILRANGELSLLDLDDGRERNLTDSVELFWVTCGQSEDKTNLIEEVSWLDYGHRGMQVWYPSPGANSFKQEDFLQLDPELEFDREVYPLGLLPNAGVVVGVSQRMSFPASAEFPCFEPSPQAQTILHCLLRHLLQRDKIEEALRLAELSAEKPHFSHCLEWLLFTVFEAEISRPNVNKNQISVVNHAKRSLLEKTCDLIRNFPEYLDVVVSVARKTDGRHWADLFTAAGRSTELFEECFQRRWYRTAACYILVIAKLEGPAVSQYCALRLLQATLDESLYELAGELVRFLLRSGREYDQASNDSDKLSPRFLGYFLFRSSEQKQSLDKSTSFKEQSAHVTSVKNILENHASYLMSGKELSKLVAFVKGTQFDLVVLILIPEYLQRERYGSARLENFASGLELISQKLQMGTLQSRLDADFLLSHMCSVKFKEWIVVLATLLRRSEPLCICKGKAAYNIPPPYLRIAKSLWTMGSYSCVVLFDLFRHDVRLWKAYSTTLEVICLDVIVSLNEQNMMFLSVFYEQSHPAFTEYQDLLEDLEESLSSVANVEGK

SEQ ID NO: 222352 - protein, 575 aa, Glycine max
  Coding DNA Sequence Number=SeqID_105574
  Gene Ontology: Mol. function=calcium ion binding; Cellular component =mitochondrion; Biological process=protein amino acid phosphorylation
  Homolog annotation: Hit_ID=Q1SMD3; Match level="QueryCoverage=88%, HitCoverage=93%, E-value=0.0, Identity=51%"; Hit description=TonB box, N-terminal; Tetratricopeptide-like helical
  Pfam annotation: Domain name=PPR; Domain location=101-135; Score =27.4; E_value=4.9e-05; Accession=PF01535.11; Description=PPR repeat
  Pfam annotation: Domain name=PPR; Domain location=136-170; Score =17.4; E_value=0.05; Accession=PF01535.11; Description=PPR repeat
  Pfam annotation: Domain name=PPR; Domain location=171-205; Score =32.2; E_value=1.8e-06; Accession=PF01535.11; Description=PPR repeat
  Pfam annotation: Domain name=PPR; Domain location=206-240; Score =46.4; E_value=9.8e-11; Accession=PF01535.11; Description=PPR repeat
  Pfam annotation: Domain name=PPR; Domain location=241-275; Score =41.8; E_value=2.4e-09; Accession=PF01535.11; Description=PPR repeat
  Pfam annotation: Domain name=PPR; Domain location=276-310; Score =49.1; E_value=1.5e-11; Accession=PF01535.11; Description=PPR repeat
  Pfam annotation: Domain name=PPR; Domain location=311-345; Score =34.8; E_value=3e-07; Accession=PF01535.11; Description=PPR repeat
  Pfam annotation: Domain name=PPR; Domain location=346-380; Score =47.9; E_value=3.5e-11; Accession=PF01535.11; Description=PPR repeat
  Pfam annotation: Domain name=PPR; Domain location=381-415; Score =41.8; E_value=2.4e-09; Accession=PF01535.11; Description=PPR repeat
  Pfam annotation: Domain name=PPR; Domain location=416-450; Score =50.3; E_value=6.5e-12; Accession=PF01535.11; Description=PPR repeat
  Pfam annotation: Domain name=PPR; Domain location=451-485; Score =33.1; E_value=9.8e-07; Accession=PF01535.11; Description=PPR repeat
  Pfam annotation: Domain name=PPR; Domain location=486-520; Score =51.1; E_value=3.6e-12; Accession=PF01535.11; Description=PPR repeat
  Pfam annotation: Domain name=PPR; Domain location=521-555; Score =17.1; E_value=0.064; Accession=PF01535.11; Description=PPR repeat
  Pfam annotation: Domain name=PPR; Domain location=66-100; Score=7.6; E_value=0.95; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=101 -135::136-170::171-205::206-240::241-275::276-310::311-345::346 -380::381-415::416-450::...
  Pfam module annotation: Domain location=451-485::486-520::521-555::66- 100
  Subcellular localization annotation: CTP_CleavageSite=12; ConfidenceScore=5.48e-01
MSFSFSLSRRLSSSLSHSIPNFPPFLPNPTFPFYFHSQPPSIHDVVHDAVSQFNGMLLMRNTPSIIEFGKILGSLVKMKHFPTAISLSKQMEVKGIEPDLVTLSILINCFCHLGQMAFSFSVLGKILKLGYQPNTIILTTLMKGLCLKGEVKKSLHFHDKVVAQGFQMNQVSYGTLLNGLCKIGETRCAIKLLRMIEDRSTRPDVVMYNTIIDGLCKDKLVNEAYDFYTEMNSRGIFPDVITYSTLICGFCLAGQLMGAFSLLNEMTLKNINPDVYTYTILIDALCKEGKLKEAKNLLGVMTKEGVKPNVVTYSTLMDGYCLVGEVHNAKQIFHAMVQTEVNPSVCSYNIMINGLCKGKSVDEAMNLLREMLHKNVVPNTVTYNSLIDGLCKSGRITSALDLMKELHHRGQPADVITYTSLLDGLCKNQNLDKAIALFMKMKERGIQPNKYTYTALIDGLCKGARLKNAQKLFQHILVKGCCIDVYTYNVMIGGLCKEGMLDEALAMKSKMEDNGCIPDAVTFEIIIRSLFEKDENDKAEKLLHEMIAKGLLHFRNFHGERSPVTNKVIVNFHGE

SEQ ID NO: 222353 - protein, 54 aa, Glycine max
  Coding DNA Sequence Number=SeqID_105575
MVTIACYNNRHYVVGRRSSLVDRVNYSQPWKTMSRQHWVHAIVIAIVDIWVVGI

SEQ ID NO: 222354 - protein, 234 aa, Glycine max
  Coding DNA Sequence Number=SeqID_105576
  Gene Ontology: Mol. function=transferase activity, transferring glycosyl groups; Cellular component=membrane
  Homolog annotation: Hit_ID=Q9FN55; Match level="QueryCoverage=90%, HitCoverage=40%, E-value=1e-79, Identity=64%"; Hit description =Arabidopsis thaliana genomic DNA, chromosome 5, P1 clone:MYC6
  Pfam annotation: Domain name=DUF604; Domain location=18-211; Score =297.2; E_value=3.1e-86; Accession=PF04646.3; Description=Protein of unknown function, DUF604
MPDGMHLSCDICYIILASYSFILFDVYGNVFGLLAAHPITPLVSMHHLDVVEPIFPNVDRVEALKRLIGPMKLDSYGLMQQSICYDKARHWTISVSWGYAVQIFRGIFLARDMEIPARTFLNWYRRGDYTSFPFNTRPFSRNSCQKPFVFYLSNATFGGVGDETMSEYIRVQPNPDCKWKMPDPTQIQVIKVHKKPDPHLWDKSPRRNCCRVQPSKKDGTLVIDVGECRKDDCS

SEQ ID NO: 222355 - protein, 75 aa, Glycine max
  Coding DNA Sequence Number=SeqID_105577
MQVEFTLNNIGRLNFFDMNLIDSYNLSMTIELWARTGLKNYTAMGAKRATIIGNASLTWFGFKLSEGQTYYYEYL

SEQ ID NO: 222356 - protein, 635 aa, Glycine max
  Coding DNA Sequence Number=SeqID_105578
  Gene Ontology: Mol. function=ubiquitin-protein ligase activity; Cellular component=ubiquitin ligase complex; Biological process =protein ubiquitination
  Homolog annotation: Hit_ID=Q681N2; Match level="QueryCoverage=93%, HitCoverage=89%, E-value=0.0, Identity=61%"; Hit description=Arm repeat containing protein
  Pfam annotation: Domain name=Arm; Domain location=385-425; Score =53.6; E_value=6.8e-13; Accession=PF00514.13; Description =Armadillobeta-catenin-like repeat
  Pfam annotation: Domain name=Arm; Domain location=426-466; Score =22.2; E_value=0.0019; Accession=PF00514.13; Description =Armadillobeta-catenin-like repeat
  Pfam annotation: Domain name=Arm; Domain location=467-507; Score =32.0; E_value=2.2e-06; Accession=PF00514.13; Description =Armadillobeta-catenin-like repeat
  Pfam annotation: Domain name=Arm; Domain location=508-548; Score =21.6; E_value=0.0028; Accession=PF00514.13; Description =Armadillobeta-catenin-like repeat
  Pfam annotation: Domain name=Arm; Domain location=549-589; Score =25.3; E_value=0.00022; Accession=PF00514.13; Description =Armadillobeta-catenin-like repeat
  Pfam annotation: Domain name=U-box; Domain location=262-335; Score =107.1; E_value=5.3e-29; Accession=PF04564.6; Description=U-box domain
  Pfam module annotation: Pfam domain module=Arm::Arm::Arm::Arm::Arm::U- box; Domain location=385-425::426-466::467-507::508-548::549-589::262- 335
MARTEEERVVGNESSSDEKNDLVEEIQQVIESVVQFGDYRRTQRKESHNLVRRFKLMLPLLEELRDLPQPFPEIGVAWLTKLKDALLLAKDLLKLCSQGSKIHLSLETEAVMITFRKVYEKLSQAFDGVPFDELGISDEVKEQLDLMHVQLRRARRRTDTQDIELAMDMMVVFSDDDDRNADSAIIERLAKKLELHSVEDLNIETLAIRNLAAERKGQQTESTQKIIDLLNKFKRIAGMEETSVLDDPVVSKMLERCTSLVIPHEFLCPITLEIMTDPVIVTSGQTYERESIEKWFQSNHNTCPKTRQPLEHLSLAPNCALKSLIEEWCENNNFKLPKKYNSSGKESCPIDSKEEIPALVESLSSIHLEEQRKAVEKIRMLSKENPENRVLVADHGGIPPLVQLLSYPDSKIQEHAVTALLNLSIDEGNKSLISTEGAIPAIIEVLENGSCVAKENSAAALFSLSMLDEIKEIVGQSNGFPPLVDLLRNGTIRGKKDAVTALFNLCINHANKGRAIRAGIVTPLLQLLKDTNLGMIDEALSILLLLVSNSEARQEIGQLSFIETLVDFMREGSPKNKECAASVLLELCSSNSSFTLAALQFGVYEYLMEIKQNGTNRAQRKAIAILDLISRSEQI

SEQ ID NO: 222357 - protein, 179 aa, Glycine max
  Coding DNA Sequence Number=SeqID_105579
  Pfam annotation: Domain name=GRP; Domain location=1-89; Score=-7.5; E_ value=0.00041; Accession=PF07172.2; Description=Glycine rich protein family
MVMMMVLVAMTLEILVVVVMALTEEATPMVPMVSAVIMVVVMTSNGGNRGASSSGGGDNDDGGGSDNNVGKNGGGTHYVSSGGGSSNMVAKMMAVTIVVAVLVLAVNGGDDEGSINCGDNDNVNDGNNDTNSDIDDSYDGGSGGDKKKCDGQIWEMPLETKPNFTKSFFLVLKINVKVF

SEQ ID NO: 222358 - protein, 109 aa, Glycine max
  Coding DNA Sequence Number=SeqID_105580
  Pfam annotation: Domain name=RRM_1; Domain location=19-86; Score=4.4; E_value=0.056; Accession=PF00076.12; Description=RNA recognition motif. (a.k.a. RRM, R
MFSERQKHGWRGTRRITSLYFSRFPEEYLESNLSNVFSRWGKVCDLFIAKKGFRFGFVRYEGDHNEKELEWNLDQKIVNGGNKMHVNAPRYRKMNGKEYQNMERIEGTH

SEQ ID NO: 222359 - protein, 143 aa, Glycine max
  Coding DNA Sequence Number=SeqID_105581
MASLGLHPADVYRQFHHPPPLPSLASHSEPQRDVSNLHDDEDDDDDYVVSNSYVEESIDEDNSVDGISNIDDEVTDMIQLVTIVHPREGVEGIQNPFWNDALHYNNINWSHPDEEDICGLEMLSSFNVGQELYVGMNFDSKDA

SEQ ID NO: 222360 - protein, 101 aa, Glycine max
  Coding DNA Sequence Number=SeqID_105582
MESGDMRGYRIVTRTFCQPGANEPVDAQRLTSSSAPFGHPGTTSFFSRRPNAFKPDDARDSSLMGGDDQVRWHREVSWLSRFIAFKDTEVLLTLLMPFLSF

SEQ ID NO: 222361 - protein, 249 aa, Glycine max
  Coding DNA Sequence Number=SeqID_105583
MARGGTRCDGFDEEAIAQLLCIPGQDFARTAAGRRVQIMRTNMTTLTQIWMTLLLSNIQPSDHNSDLPLPKCQLVYAVLTRMSIHVAQLIADAIYLFAGMAPTRHPLDPDKSNRALGFPALITGLCQSFGVPVAPSKVIRPPITRAFIEKYCTQRPAQGDSPQAADTPPPHQAGPAGRPTTGAHVQTHDCLLPAEPQPAEPGAEVAWPGDWPEAQAGEAPAEAPGEADEAREDEEMTDLLDFLGGSGAT

SEQ ID NO: 222362 - protein, 64 aa, Glycine max
  Coding DNA Sequence Number=SeqID_105584
LSNWTKRASTAKHSFSALSAIEEFGRASISRLHAKREISALSAASAFSQAKCKTGSKPNFTYPR

SEQ ID NO: 222363 - protein, 340 aa, Glycine max
  Coding DNA Sequence Number=SeqID_105585
  Gene Ontology: Mol. function=protein serine/threonine kinase activity; Cellular component=nucleus; Biological process=protein amino acid phosphorylation
  Homolog annotation: Hit_ID=Q40353; Match level="QueryCoverage=99%, HitCoverage=99%, E-value=1e-167, Identity=78%"; Hit description =Mitogen-activated protein kinase homolog MMK2
  Pfam annotation: Domain name=Pkinase; Domain location=39-292; Score =218.7; E_value=1.3e-62; Accession=PF00069.15; Description=Protein kinase domain
  Pfam annotation: Domain name=Pkinase_Tyr; Domain location=39-292; Score=-48.6; E_value=1.7e-09; Accession=PF07714.7; Description =Protein tyrosine kinase
  Pfam module annotation: Pfam domain module=Pkinase::Pkinase_Tyr; Domain location=39-292::39-292
MALESAPASADIRGVHTHGGGYVQYNIYGNLFEVSRKYVPPIRPVGRGAYGIVCAAVNAETHEEVAIKKVIALKDIIRPPQRYNFNDVYIVYELMDTDLHQIIQSNQQLTDDHCRLLRGLKYVHSANVLHRDLKPSNLLLNANCDLKIADFGLARTTSETDFMTEYVVTRWYRAPELLLNCSEYTAAIDIWSVGCILGEIITRQPLFLGKDYVHQLRLITELIGSPDDTSLGFLRSDNARRYVRQLPQYPRQQFAARFPSMSPGAVDLLEKMLVFDPNRRITVEEALCHPYLAPLHDINEEPACVRPFSFDFEQPSFTEEDIKELIWRESVLFNPDPPIY

SEQ ID NO: 222364 - protein, 452 aa, Glycine max
  Coding DNA Sequence Number=SeqID_105586
  Gene Ontology: Mol. function=protein serine/threonine kinase activity; Cellular component=membrane; Biological process=protein amino acid phosphorylation
  Homolog annotation: Hit_ID=Q10SE3; Match level="QueryCoverage=99%, HitCoverage=88%, E-value=1e-144, Identity=58%"; Hit description =Protein kinase domain containing protein, expressed
  Pfam annotation: Domain name=Pkinase; Domain location=172-443; Score =135.1; E_value=1.9e-37; Accession=PF00069.15; Description=Protein kinase domain
  Pfam annotation: Domain name=Pkinase_Tyr; Domain location=172-443; Score=124.5; E_value=2.9e-34; Accession=PF07714.7; Description =Protein tyrosine kinase
  Pfam module annotation: Pfam domain module=Pkinase::Pkinase_Tyr; Domain location=172-443::172-443
  Subcellular localization annotation: CTP_CleavageSite=65; ConfidenceScore=5.01e-01
MSIFDGAFMNTQLSKHTSIFGLRLWVVIGILIGVFIVFTLFLLSLCLVSRRNRRRSVAVPGYKVTGDADAAKDIHTIVHLPGPHMLRPVAPEIHVEMGKKTEHRVVVQCDGVSSEESKVTVGSGCETTSSFGSGSVGGLGLGSGPGLGPEVSHLGWGRWYTLRELEDATGGLSPENVVGEGGYGIVYHGVLNDGTKIAVKNLLNNKGQAEKEFKIEVEAIGRVRHKNLVRLLGYCVEGAYRMLVYEYVDNGNLEQWLHGDVGAVSPLTWNIRMNIILGTARGLAYLHEGLEPKVVHRDVKSSNILIDRQWNSKVSDFGLAKLLCSENSYVTTRVMGTFGYVAPEYACTGMLTEKSDIYSFGILIMEIITGRSPVDYSRPQGEVNLIEWLKTMVGNRKSEEVVDPKLPEMPFSKALKRALLIALRCVDPDATKRPKMGHVIHMLEADDLLFHT

SEQ ID NO: 222365 - protein, 82 aa, Glycine max
  Coding DNA Sequence Number=SeqID_105587
  Homolog annotation: Hit_ID=Q2HRI0; Match level="QueryCoverage=92%, HitCoverage=31%, E-value=6e-10, Identity=56%"; Hit description =Immunoglobulin/major histocompatibility complex; 2OG-Fe(II) oxygenase
IKDHGIQTQSELPVVDFTNKNLKPGTDAWVSASQVVRGALEDHGGFLALYDKKQNGGKPLKSLYSAILGNDLGFLYMNLWVS

SEQ ID NO: 222366 - protein, 319 aa, Glycine max
  Coding DNA Sequence Number=SeqID_105588
  Gene Ontology: Mol. function=metalloendopeptidase activity; Cellular component=membrane; Biological process=proteolysis
  Homolog annotation: Hit_ID=Q6EPN8; Match level="QueryCoverage=99%, HitCoverage=71%, E-value=1e-111, Identity=61%"; Hit description =Putative Ste24p
  Pfam annotation: Domain name=Peptidase_M48; Domain location=123-316; Score=122.6; E_value=1.1e-33; Accession=PF01435.8; Description =Peptidase family M48
ITDLPFSLYSTFVIEARHGFNKQTPWLFFRDMLKGIFLSVIIGPPIVAAIIVIVQKGGPYLAIYLWVFTFGLSIVMMTLYPVLIAPLFNKFTPINNCWVKAVNIISKLTGLGWLPDGQLREKIEKLASSLNYPLKKLFVVDGSTRSSHSNLNSSGIDYRTQSTYTAGSHAYMYGFFKNKRIVLYDTLIQQCKDDEEIVAVIAHELGHWKLNHTVYTFVAMQILTLLQFGGYTLVRNSADLYRSFGFDTQPVLIGLIIFQADGFAKKLGYASGLRGGLVKLQEENLSAMNTDPWYSAYHYSHPPLVERLAVLDEPDKKED

SEQ ID NO: 222367 - protein, 151 aa, Glycine max
  Coding DNA Sequence Number=SeqID_105589
  Gene Ontology: Mol. function=RNA-directed DNA polymerase activity; Biological process=RNA-dependent DNA replication
MEKLLHLISRAVEVGDCKSITVGRNGTKILHLMFADDLLLFGQVKEKQMQCMHDIIVDFEDMLGEDQALKLKESTVISCRKNNYCQIWHLVYPGVHYDEYNHPQNGVERNSEDGNGFHLGDSNGQRKFHVVNSNSMIKSKSIGGIPIVLLI

SEQ ID NO: 222368 - protein, 40 aa, Glycine max
  Coding DNA Sequence Number=SeqID_105590
MGLSPLQKCTAAIHNAYRGGNRPDRPTGAYDLTYIKPGMN

SEQ ID NO: 222369 - protein, 103 aa, Glycine max
  Coding DNA Sequence Number=SeqID_105591
ESHPQRHPVDPEKSNRALGFPALVTGLCSPIGCPFPPGKVTSSYGSHLQDTQWTRRSPTGSWSCQALITGLCQFYGVPVTSSKGIRPLTNQAFIKKYCVPRQA

SEQ ID NO: 222370 - protein, 394 aa, Glycine max
  Coding DNA Sequence Number=SeqID_105592
  Gene Ontology: Mol. function=oxidoreductase activity, acting on the CH-OH group of donors, NAD or NADP as acceptor; Cellular component =nucleus
  Homolog annotation: Hit_ID=Q84JM5; Match level="QueryCoverage=85%, HitCoverage=52%, E-value=1e-101, Identity=57%"; Hit description =Angustifolia
MSPVITFHIKSGYESYNSCDSNHTENDNQGERFPLNAKATFPSSHVHFLGEWKIVLESVKEMPNVLILPRSADYSEEVWMEIREKAISILQTFFIDGIIPKNAMSDVEEESEVDNESEQSDQQYNGNALQIIVREQTDDVHVSPDNSQKKISTQMKESSSQHQVSSLSQSTSARSEGRRSRSGKKAKKRHTRHKSQQKHEDPSALEKEGTSQRDDTAMSGTDQALSSSSEDSRNRKTPIESMQEPTGAQVIKSSLRLSGNCTELLKDGYIIALYARDCSALHVSRQRVKGGGWIMDSMSNVSKRDPAAQFLIIFRSKDTIGLRSLAAGGKLLQINRRMEFVFASHSFDVWENWTLEGSLQECRLVNCRNPSAVLDVRVEILATVGEDGVTRWLE

SEQ ID NO: 222371 - protein, 48 aa, Glycine max
  Coding DNA Sequence Number=SeqID_105593
MEEKCGIARMKHHFARIKENVSACTSIHDEVREISLKLLDKEEANNQE

SEQ ID NO: 222372 - protein, 213 aa, Glycine max
  Coding DNA Sequence Number=SeqID_105594
  Gene Ontology: Mol. function=DNA binding; Cellular component=nucleus; Biological process=regulation of transcription, DNA-dependent
  Homolog annotation: Hit_ID=Q0PJI6; Match level="QueryCoverage=82%, HitCoverage=58%, E-value=6e-46, Identity=54%"; Hit description=MYB transcription factor MYB133
MAQVNMYLPLVQREKLLIHTHKRLLKIVSVANFISAPTISQVARPFQSSSALSESSNIYRPDSSSVLRTPVSSVPLPSWDDMVVVIQQANPFSYCYSSSNESTPRGWPSSKESDQGKSIIVMPDFAQVYRFIGSVFDPNATNHLQTLKQMNPINVKTVLLSMRNLSTNLRSPEFENERRLLSLYNANLEKGKSGSHHRNQPLSDRSESAVLYA

SEQ ID NO: 222373 - protein, 969 aa, Glycine max
  Coding DNA Sequence Number=SeqID_105595
MLLKIGREVQVVCQCIVLVDVLNIVHPLPPEVIAFHGEYMENGKLDLQDDLIKIVILNLNWIQVFTLDQQEYAYSGKRFGNQLRRSWQGPEHDGLLGSGSFPRPSGYTPGLAALKFRANDNYQLNRSNEPYHPPRPYKAPHSRRETNDSLNDETFGSLECTSEDRAEEERKRRASFELMRKEQHKAFQEKHKLNPDKNNDDFDITSLADNDEKRVVNRSNEYVEPNVTLSVLSNDEKSSSLSQTPSAARPLVPPGFASAKLERNLATKTSLNTHSTEVGQPAPGDTGGNHVFSINSDNKEGKLLTKQVNNDQQNLQNTNLNISINYEKENILNLPSILDIADIKIGMGDQLRKRSALSVVLEASDDNEFINLNAEVKGKEAVGAFSPDNSNSILYKLFGNASTLDRDKSTSIVEQPDQKADETWSPHAFQSSKFAHWFVEEEKKPVDDLTHRPNDLLSLIVGGEKGGLQTSNVETPQPIAANFAFLNSEPTGEHMTSNVAHTTIDNSELLYKSDKPEVLAAVLTCEDLEQSILSQVGENGSSRPQPIQDKDFDAKSEQLTPVDNHASHHLLSLLQKGTSHNDMELSSILDSSDKVPNTEGVTTGNVLDNPGEANVDVSNSSKTLTLETLFGSAFMKELQSVGAPLSVQRGSVGSAGPDVSESLLFPFPTSDNVHPPTGELTLNRHGSGVLPSEQTNHPKSNRFEEQWLGYGDSQGDGNSSLLQSEISKASGFKGPRDIHLPEEDSLITASDPLQNFLSAGNLVKTDLSQDTTVDITRKLAALNPAFRDDRLVTRNQEGLAFPRGPYDMREPGIPYQNLNVQRSPQIHPQLNHGGPMFNQLDSHPPHISSYMKLPTPEGMVHHDSPPNHQFPGNMLRPPFRQPNSGLAGPGFDPPVHHSMLQQQMHMQGNLPPPHLLRGFPRGAPMPSHASNPMTGFMQEPNPMQGQGFPFSGHQHPTFGGPGMQYKVEI

SEQ ID NO: 222374 - protein, 157 aa, Glycine max
  Coding DNA Sequence Number=SeqID_105596
  Gene Ontology: Mol. function=nucleoside-triphosphatase activity; Biological process=response to DNA damage stimulus
  Homolog annotation: Hit_ID=Q5D892; Match level="QueryCoverage=90%, HitCoverage=12%, E-value=1e-61, Identity=82%"; Hit description =Meiotic recombination protein MER3
MKSNPLAQVRFLAVSATIPNIEDLAKWLEVPDQGIKRFGEEMRPVKLTTKVFGYAPAKNDFLFEKRLQNYIFDILMQYSRGKSALVFCSTRKGAQEAAQRLSQIVMTFGQSNPFIKNREQQDRLREASLSCSDKQMQSYILYGGMKGIYILFWDLAK

SEQ ID NO: 222375 - protein, 775 aa, Glycine max
  Coding DNA Sequence Number=SeqID_105597
  Gene Ontology: Mol. function=nucleoside-triphosphatase activity; Cellular component=membrane; Biological process=response to DNA damage stimulus
  Homolog annotation: Hit_ID=Q5D892; Match level="QueryCoverage=85%, HitCoverage=52%, E-value=1e-174, Identity=51%"; Hit description =Meiotic recombination protein MER3
  Pfam annotation: Domain name=HHH; Domain location=295-324; Score =15.1; E_value=0.038; Accession=PF00633.13; Description=Helix-hairpin- helix motif
  Pfam annotation: Domain name=Sec63; Domain location=119-457; Score= -89.8; E_value=0.00016; Accession=PF02889.7; Description=Sec63 domain
  Pfam module annotation: Pfam domain module=HHH::Sec63; Domain location=295-324::119-457
MFAYHRLLSCVTEHLLAEIVQLTVSDITKAIEWLKRSYLYVRMKKASDPGYQLVLFISLPSHLMQFFMHNQNPMNYAIKKGISGDRLEKHVQDICVRKVNELSQNDMVWVDEDGFLLRPLDPGRLMTKYYLRFDTMKQIMRTPENCSLEDALHVVCCAEEIACADIFCELFLIHNVLTSKLDTILHWENEGIQLRRNEKKLLNEINADKDGRLRFHILGDKRKKKKRIQTREEKIFILANDCLTGDPSVHDLSLIQDMNSICSNGCRIAKCLKDYFVYKRNYKGTVNSALLAKSLGQKLWDDSPYLLKQLPGIGMVTAKALHSMGVRSFEELADADPRRIELVTGRKYPFGNHIKDSLLSLPPKVDVTLAEIESHIQGNSKLVVTLARISQSGQSVKRHYADMIVGSEEDNTILFHEKISPYSATIFVPIAQGKQTIKVDFIFEEYIGIDVHQKLSFTRESNSIVLLKRNKKQASCPPPEEIYVIEDDNITVPRLPTKELCKLNEDRDSIPSFDLLDESFEEGVRAFGVVEDECKSITEKTVFDHIREKAKNFSLLSAYDNIHFPSLEVLLSRNHAREKRPDHRHEVVVLDDEDRPEVPQRNDVNLQVELRKAEQDDIKFYLNDHCTTGSSNIVDTGVFLPEPEAITHEKSTEETVFDHIRRKSKDFPPINKLNCAESIIHKTELFSKINPSPPSSLSDAFGVARETNSLEVTDNMLTSYMKTAAEVEKYTSSIQFFNVRRREKGLQIPEAFQRVVRSSVALLETLKKRSIVQVK

SEQ ID NO: 222376 - protein, 37 aa, Glycine max
  Coding DNA Sequence Number=SeqID_105598
MIARILEFTFNGHFKVMIPEAMDMQCVPRLDPPSEDS

SEQ ID NO: 222377 - protein, 273 aa, Glycine max
  Coding DNA Sequence Number=SeqID_105599
  Gene Ontology: Mol. function=protein serine/threonine kinase activity; Cellular component=membrane; Biological process=protein amino acid phosphorylation
  Homolog annotation: Hit_ID=Q9FNE1; Match level="QueryCoverage=55%, HitCoverage=22%, E-value=5e-29, Identity=46%"; Hit description =Receptor-like serine/threonine kinase
MATATISTTNATMVSMVMPTIMTMSFIRQQIDIGIHDSVTHKPKSFKVKAKKSNLMYMSSSTLRVRGHHGLGYMAPEYLIRGQLTDKADVYGYGVLVLEIVSGRRNNAFREDAGSLLVNEFNNFCLKKIILLAPGLETIPIKHFNRSVDPDLGDDFPPTEASRVLQIGLLFTQASASLRPSMSQVVYMLSNSNVDVPTPNQPPFLNTGMLDSDSSIKSYSTNSFISNALKKIGSPIAILKVPVTVITLASLAFVCNLWQDHDFEGLHRVTTAI

SEQ ID NO: 222378 - protein, 431 aa, Glycine max
  Coding DNA Sequence Number=SeqID_105600
  Gene Ontology: Mol. function=RNA-directed DNA polymerase activity; Cellular component=exocyst; Biological process=RNA-dependent DNA replication
MKITNLCFADDLLLFSRGDIGSVQIMLDKFNTFLRSMGLHVNPSKCNIYCGSVDINVKEQLLLISGFKEGKMPFRYLGIPLSSKKLNIKHYQVLIDKIVGRITHWSAGLLSYAGRVQLIQSVIFATINFWMQCLPLPKFVIMRINAICRSFLWIGNSNISRKSPIAWEKVCSPKINGGLNIINLAIWNKISILKLLWNVCNKSDNLWIKWLHTYYIRGQSIWSMVLKKSHSWIMSSMMKLRPLLLQYQSRMQDVFKMKKIYLALFEESEKMSWRTLMCNNLARPRALFCLWQACHFRLASKDRLIKFGLNVDANCAFCSSMESHEHLFFGCIELKTIWTAVLNWLQIIHMPSTWSEELNWITRKCKGKGWRAMLLKCAFTETIYHIWAYRNHRVFGGNVNNRKVEDSIINTIIYRVWDRKRYRRYIAELMT

SEQ ID NO: 222379 - protein, 94 aa, Glycine max
  Coding DNA Sequence Number=SeqID_105601
  Gene Ontology: Mol. function=catalytic activity; Biological process =metabolic process
  Homolog annotation: Hit_ID=Q01CB8; Match level="QueryCoverage=89%, HitCoverage=26%, E-value=2e-08, Identity=36%"; Hit description =Homology to unknown gene
MTTYTTTPDHNIQLTTQGMTQALRVGEHLRHVIGNDDCFPNWRVQFYVSPYTCTQSMLHELKRCFLKKRIIDVTEESRIREKDFRNFHVKERMN

SEQ ID NO: 222380 - protein, 177 aa, Glycine max
  Coding DNA Sequence Number=SeqID_105602
  Gene Ontology: Mol. function=protein-tyrosine kinase activity; Biological process=protein amino acid phosphorylation
  Homolog annotation: Hit_ID=Q9FIL1; Match level="QueryCoverage=89%, HitCoverage=32%, E-value=1e-64, Identity=75%"; Hit description =Protein kinase-like protein
MKNKNMIFTAFTFVLLQALDLIRGKNFLMLMDSALEGHFSKDDGTELVRLASRCLQYEARERPNAKSLVASLLSLQKETEVPSYVLMGLQQETASSAKQLSLTPFGEACLRLDLTAIHEILEKTGYKDDEGIANELSFQLWTSQMQETLNLKKHGDTAFRAKDFVTAIDCYTQSCND

SEQ ID NO: 222381 - protein, 145 aa, Glycine max
  Coding DNA Sequence Number=SeqID_105603
  Subcellular localization annotation: CTP_CleavageSite=72; ConfidenceScore=5.07e-01
MGTLPYYCTLDPLPLSSSSKLKPMFIFVHALPHLLALFPNSPPNYNANPRLLTEVCMLLSDMTLWVIRCLVSAVLAAALYQEYEEHFKILGLGLCLIEHVDCERMENTKNLPHLHVFVISIKCVVFFMLKSHMQRWQDEARNEVN

SEQ ID NO: 222382 - protein, 775 aa, Glycine max
  Coding DNA Sequence Number=SeqID_105604
  Gene Ontology: Mol. function=protein binding; Cellular component =nucleus; Biological process=protein ubiquitination
  Homolog annotation: Hit_ID=Q9ZPI8; Match level="QueryCoverage=23%, HitCoverage=40%, E-value=4e-28, Identity=38%"; Hit description =Polygalacturonase
  Pfam annotation: Domain name=F-box; Domain location=300-347; Score =38.9; E_value=1.8e-08; Accession=PF00646.23; Description=F-box domain
  Pfam annotation: Domain name=Glyco_hydro_28; Domain location=1-188; Score=-133.8; E_value=0.017; Accession=PF00295.8; Description =Glycosyl hydrolases family 28
  Pfam annotation: Domain name=WD40; Domain location=387-425; Score =26.8; E_value=7.5e-05; Accession=PF00400.22; Description=WD domain, G-beta repeat
  Pfam annotation: Domain name=WD40; Domain location=429-465; Score =5.5; E_value=8.4; Accession=PF00400.22; Description=WD domain, G -beta repeat
  Pfam annotation: Domain name=WD40; Domain location=482-518; Score =35.6; E_value=1.8e-07; Accession=PF00400.22; Description=WD domain, G-beta repeat
  Pfam annotation: Domain name=WD40; Domain location=522-556; Score =13.7; E_value=0.66; Accession=PF00400.22; Description=WD domain, G -beta repeat
  Pfam annotation: Domain name=WD40; Domain location=561-599; Score =18.7; E_value=0.021; Accession=PF00400.22; Description=WD domain, G -beta repeat
  Pfam annotation: Domain name=WD40; Domain location=609-645; Score =17.1; E_value=0.062; Accession=PF00400.22; Description=WD domain, G -beta repeat
  Pfam annotation: Domain name=WD40; Domain location=673-709; Score =11.7; E_value=1.6; Accession=PF00400.22; Description=WD domain, G -beta repeat
  Pfam module annotation: Pfam domain module=F-box::Glyco_hydro _28::WD40::WD40::WD40::WD40::WD40::WD40::WD40; Domain location=300 -347::1-188::387-425::429-465::482-518::522-556::561-599::609 -645::673-709
MEICLISLPFGHVFSVGSLGKKGTCETAEHVHVNNCNFKGADNGMRIKTWPGGCGYARNIKFEHIVLTNTKNPIIIDQDYENVQNEDKKQTSEVQISGVTYRYVNGFEVRTLQPFVVSGVRHASVSVSDTDTTPVNGTSNSETAIILNCGAGAGCTDIFMDVVNITSTSSGSNVHASCNNAHGVAASTSPPLSTLLIHRVGSSFFMAFECPNGTEVSQSLAHFVANPGIGIVESNLQLCPKSFTEGIATSKFVPDTKPESGKGVKLKGASKINSKKGIKAPVSALNQSSIPGDVVFNCGLSITDLPPALISEILNCLDPKDLGVVSCVSPILQRVASEHHAWKQFYCERWGLPAASLAVGSGVVDDDKSWRELFVEREFRSKTFMGRYSIDVLYGHTEAVRTVFLLASAKLIFTSGYDSVVRMWDMENGLSIASSRPLGCTIRAVAADRKLLVAGGTDGFIHCWRAVEDLPHSFEFRATQNQNTEVRLWGHEGPITSLALDLTRIYSGSWDTTVRVWDRHSMKCTAVLRHSDWVWALVPHDTTVASTSGSDVYVWDTDSGTLVTIVHNAHVGNTYALARSHTGDFLFTGGEDGAIHMYEIVNDGYESKAWHVAVWVPHSAAVYSLAFEFPWLVSASSDGKLALIDVRKLLKISKRALGKRVSKVKHLGGDIVEPPQRMLHGFKSNLFSVDIGAERIVCGGEEGVVRIWNFTEALEIERRARALRGIRLDNRMRRRKLQTELSNKSGRSDQCSVAAKKNAVTCIWPKRGMSGKLKA

SEQ ID NO: 222383 - protein, 639 aa, Glycine max
  Coding DNA Sequence Number=SeqID_105605
  Gene Ontology: Mol. function=protein binding; Cellular component =integral to membrane; Biological process=protein amino acid phosphorylation
  Homolog annotation: Hit_ID=Q4VSU4; Match level="QueryCoverage=94%, HitCoverage=87%, E-value=1e-117, Identity=35%"; Hit description=Hcr9- OR2B
  Pfam annotation: Domain name=LRR_1; Domain location=114-136; Score =7.3; E_value=12; Accession=PF00560.23; Description=Leucine Rich Repeat
  Pfam annotation: Domain name=LRR_1; Domain location=138-159; Score =13.1; E_value=1; Accession=PF00560.23; Description=Leucine Rich Repeat
  Pfam annotation: Domain name=LRR_1; Domain location=160-174; Score =4.6; E_value=39; Accession=PF00560.23; Description=Leucine Rich Repeat
  Pfam annotation: Domain name=LRR_1; Domain location=177-199; Score =9.6; E_value=4.5; Accession=PF00560.23; Description=Leucine Rich Repeat
  Pfam annotation: Domain name=LRR_1; Domain location=18-40; Score=7.8; E_value=10; Accession=PF00560.23; Description=Leucine Rich Repeat
  Pfam annotation: Domain name=LRR_1; Domain location=206-225; Score =7.8; E_value=10; Accession=PF00560.23; Description=Leucine Rich Repeat
  Pfam annotation: Domain name=LRR_1; Domain location=227-250; Score =4.8; E_value=36; Accession=PF00560.23; Description=Leucine Rich Repeat
  Pfam annotation: Domain name=LRR_1; Domain location=251-274; Score =15.0; E_value=0.28; Accession=PF00560.23; Description=Leucine Rich Repeat
  Pfam annotation: Domain name=LRR_1; Domain location=275-297; Score =11.1; E_value=2.4; Accession=PF00560.23; Description=Leucine Rich Repeat
  Pfam annotation: Domain name=LRR_1; Domain location=299-318; Score =5.4; E_value=27; Accession=PF00560.23; Description=Leucine Rich Repeat
  Pfam annotation: Domain name=LRR_1; Domain location=323-345; Score =5.8; E_value=24; Accession=PF00560.23; Description=Leucine Rich Repeat
  Pfam annotation: Domain name=LRR_1; Domain location=347-369; Score =17.1; E_value=0.065; Accession=PF00560.23; Description=Leucine Rich Repeat
  Pfam annotation: Domain name=LRR_1; Domain location=371-392; Score =2.8; E_value=86; Accession=PF00560.23; Description=Leucine Rich Repeat
  Pfam annotation: Domain name=LRR_1; Domain location=397-420; Score =16.0; E_value=0.14; Accession=PF00560.23; Description=Leucine Rich Repeat
  Pfam annotation: Domain name=LRR_1; Domain location=42-63; Score=6.4; E_value=18; Accession=PF00560.23; Description=Leucine Rich Repeat
  Pfam annotation: Domain name=LRR_1; Domain location=463-485; Score =2.1; E_value=1.1e+02; Accession=PF00560.23; Description=Leucine Rich Repeat
  Pfam annotation: Domain name=LRR_1; Domain location=487-509; Score =18.6; E_value=0.023; Accession=PF00560.23; Description=Leucine Rich Repeat
  Pfam annotation: Domain name=LRR_1; Domain location=511-533; Score =19.5; E_value=0.013; Accession=PF00560.23; Description=Leucine Rich Repeat
  Pfam annotation: Domain name=LRR_1; Domain location=535-557; Score =8.0; E_value=8.9; Accession=PF00560.23; Description=Leucine Rich Repeat
  Pfam annotation: Domain name=LRR_1; Domain location=66-88; Score=7.2; E_value=13; Accession=PF00560.23; Description=Leucine Rich Repeat
  Pfam annotation: Domain name=LRR_1; Domain location=90-112; Score =8.2; E_value=8.2; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1; Domain location=114-136::...
  Pfam module annotation: Domain location=138-159::160-174::177-199::18- 40::206-225::227-250::251-274::275-297::299-318::323-345::347 -369::371-392::397-420::42-63::463-485::487-509::511-533::535-557::66- 88::90-112
MSYIRESSLSLLTNLSSSLISLSLSFTELQGNLSSDILSLPNLQQLDLSFNKDLGGELPKSNWSTPLSYLDLSKTAFSGNISDSIAHLESLNEIYLGSCNFDGLIPSSLFNLTQFSFIDLSFNKLVGPIPYWCYSLPSLLWLDLNNNHLTGSIGEFSSYSLEFLSLSNNKLQAPLEDLVALDLSHNSIRGSIPQWFHEKLLHSWKNISYIDLSFNKLQGDLPIPPNGIHYFLVSNNELTGNIPSAMCNASSLKILNLAHNNLTGPIPSAMCNASSLLILNLAQNNLTGHIPQCLGTFPSLWALDLQKNNLYGNIPANFSKGNALETIKLNGNQLDGQLPRCLAHCTNLEVLDLADNNIKDTFPHWLESLQELQVLSLRSNKFHGVITCFGAKHPFLRLRIFDVSNNNFSGSLPASYIKNFRGMMSVNDNQTGSKYMGNQYFYNDSVVVVMKGQYMELQRILTIFTTIDLSNNMFEGELLKVLGELHSLKGLNLSHNAITGTIPRSFGNLRNLEWLDLSWNQLKGEIPVSLINLNFLAVLNLSQNQFEGIIPTGGQFNTFGNDSYAGNPMLCGFPLSKSCNKDEDWPPHSTFHIEESGFGWKAVAVGYACGFLFGMLLGYNVFMTGKPQWLARLVGCVLN

SEQ ID NO: 222384 - protein, 636 aa, Glycine max
  Coding DNA Sequence Number=SeqID_105606
  Gene Ontology: Mol. function=ubiquitin thiolesterase activity; Cellular component=nucleus; Biological process=ubiquitin-dependent protein catabolic process
  Homolog annotation: Hit_ID=Q2QQM3; Match level="QueryCoverage=99%, HitCoverage=56%, E-value=0.0, Identity=83%"; Hit description =Ubiquitin-specific protease 12, putative, expressed
  Pfam annotation: Domain name=UCH; Domain location=66-390; Score =253.0; E_value=6.1e-73; Accession=PF00443.19; Description=Ubiquitin carboxyl-terminal hydrolase
MWTICPYTQHQFNARESDWGFTSFMPLGELYDPSRGYLVNDTLVVEAEVLVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRENGKYLSPDADRNVRNLYTLHSVLVHSGGVHGGHYYAFIRPTLSEQWYKFDDERVTKEDTKRALEEQYGGEEELPQTNPGFNNTPFKFTKYSNAYMLVYIREADKDKVICNVDEKDIAEHLRERLKKEQEEKEHKKKEKAEAHLYTIIKVARDEDLAEQIGKDIYFDLVDHDKVRSFRVQKQTSFNLFKEEVAKEFGIPVQFQRFWLWAKRQNHTYRPNRPLTHMEEAQSVGQLREVSNKVHNAELKLFLEVELGLDVCPIAPPDKTKDDILLFFKLYDPEKEELRYAGRLFVKSTGKPSEILTRLNKMAGYDPDEEIGLYEEIKFEPNVMCEPIDKKLTFRASQ

SEQ ID NO: 222385 - protein, 224 aa, Glycine max
  Coding DNA Sequence Number=SeqID_105607
MDRARLIYGLVTHMDMNIGALISGQISSTTQSNSSRLEFPALITALCKAKGVTSDSLTYESLSQAINLAYIKKNCWNLGDLTVNIKGTRKARTRPADVPSSSTPSAPSTFATLKPAPQGPSTHSSQHFESMLQSLFLGQTMQDVVLQRPIMSVEQFLEKLADPPTPVNEMPADPPTPILEIPEDPATPVLGLTTTPPVTPVLHFTDEKDTQDQDIQQQDQSQEF

SEQ ID NO: 222386 - protein, 66 aa, Glycine max
  Coding DNA Sequence Number=SeqID_105608
MDDTLEVRESVSKQIDCRFMSLANWIPDLRRQCPVGFIRTINIKFVGQKARGFPGSRILMVNPFCG

SEQ ID NO: 222387 - protein, 58 aa, Glycine max
  Coding DNA Sequence Number=SeqID_105609
MARSMMKGKRMPYYFWGEATSTAIIFGSLLSYPNFVRGPLLGGMQLVFGHFEVLGTHH

SEQ ID NO: 222388 - protein, 79 aa, Glycine max
  Coding DNA Sequence Number=SeqID_105610
MKIGGDIGGGCNTNDGGSDDVVVAAAAMMVVVANGNDISGGGGLDEGDISGGEDVGGGGSDEGIVSNGGGQGCQTHDST

SEQ ID NO: 222389 - protein, 128 aa, Glycine max
  Coding DNA Sequence Number=SeqID_105611
MKNDTIFCVSNIICGLPYFCVDLSKKGSRQKPFGEEGLSKKHKDLETLHELKGPMTRSKAKFLQEQIAKRIKDGLLIKAMVFESDSDPPSPRSAKLMASLAKHMDKLQRNVEWRMGRDLMRYKEALKS

SEQ ID NO: 222390 - protein, 68 aa, Glycine max
  Coding DNA Sequence Number=SeqID_105612
MADDGTQWKAKILPYKHAVEAYGTAMADLPSQIIYGAPYKVQAMILDVVSSSVVAFGYNRRFVCGDDI

SEQ ID NO: 222391 - protein, 88 aa, Glycine max
  Coding DNA Sequence Number=SeqID_105613
  Gene Ontology: Mol. function=acyltransferase activity; Cellular component=integral to membrane; Biological process=metabolic process
  Homolog annotation: Hit_ID=Q7XEP2; Match level="QueryCoverage=80%, HitCoverage=13%, E-value=1e-15, Identity=55%"; Hit description =Acyltransferase family protein, expressed
MALSTFPTVNKCTSIGREQHTVVADMDGTLLIGRSSFPYFALVAFEAGGVLRLLFYVLASPIAALLYYFISESAGIQDFRVFGFPIGH

SEQ ID NO: 222392 - protein, 238 aa, Glycine max
  Coding DNA Sequence Number=SeqID_105614
  Gene Ontology: Mol. function=RNA-directed DNA polymerase activity; Cellular component=chromatin; Biological process=chromatin assembly or disassembly
  Subcellular localization annotation: CTP_CleavageSite=100; ConfidenceScore=5.26e-01
SPPGGEKSGRSCAVSPVPIGPTRQLAILGFDVSSPCSSSGMRRKNHEAQRWPLVNFLSQLKHNPHSLRLASSSGLNRLTDLCGALGVSPPEDGPSRWHAPASTAKELGIHAGSRYSLTESFWVNLKRSPVGSSYRDWAKRASMACKKPDHVSGVEWYSKNWVILNTQLEGSEPSNLGTADEEEGEGSGSRIRGLGPPEQGIEKLHFIASRRQPLTAKESWIASRTLLTWLQAQLHLAT

SEQ ID NO: 222393 - protein, 378 aa, Glycine max
  Coding DNA Sequence Number=SeqID_105615
  Gene Ontology: Mol. function=acyltransferase activity; Cellular component=integral to membrane; Biological process=metabolic process
  Homolog annotation: Hit_ID=Q7XEP2; Match level="QueryCoverage=95%, HitCoverage=68%, E-value=1e-145, Identity=71%"; Hit description =Acyltransferase family protein, expressed
  Pfam annotation: Domain name=Acyltransferase; Domain location=161 -275; Score=36.0; E_value=1.3e-07; Accession=PF01553.11; Description =Acyltransferase
MVEPFLKEFLGADMVLGTEIASYKGRATGLVCKPGILVGKKKANALKKAFGEEKPDIGLGDRQTDAPFMALCKEGYIVPPKLEVKSVSTDKLPKPIIFHDGRLVQKPTPLIALLTILWIPIAFPLACLRIAAGSLLPMHMVYYAFWALGVHVIIKGTPPPKVTKSNPNPNNNNSGVLFICSHRTLLDPIFLSAALGRPIPAVTYSVSRLSEIISPIKTVRLSRDRATDAAMIKKLLQEGDLAICPEGTTCREPFLLRFSALFAELTDELVPVAMVNRMSMFHGTTARGWKGMDPFYFFMNPSPTYEVTFLNKLPKELTCAIGKSSHDVANYIQRVIAATLSYECTGFTRKDKYRALAGNDGVVVEKGHVLKANKVMGC

SEQ ID NO: 222394 - protein, 368 aa, Glycine max
  Coding DNA Sequence Number=SeqID_105616
  Gene Ontology: Mol. function=potassium ion transporter activity; Cellular component=integral to membrane; Biological process =potassium ion transport
  Homolog annotation: Hit_ID=O22397; Match level="QueryCoverage=57%, HitCoverage=37%, E-value=3e-72, Identity=54%"; Hit description =Potassium transporter 1
  Pfam annotation: Domain name=K_trans; Domain location=1-362; Score= -66.3; E_value=1.3e-18; Accession=PF02705.7; Description=K+ potassium transporter
MAEEARIILLSPKIYSVKHVFLRVFSAVSGVQVKIKGLHENYVVIISCVILMVLFSIQHHGTHRVAFMFAPLLATWLLCISGIGVYNRFYWNRHIYRALSPLYMLKFLRATGIEGRMSLGGVVLSITETVFWPVFVVATLAAIVRSQAVISATFSIVSQCCALNCFPPVKIVHTSSRIYGQIYAPEVNWILMCLCLAVPIGLRDIDMMGHACGLATTTIMFVTTCLMTLVMLVVTITHQSHLCPLPLTVQPITWNYDHCLYLYPTPHTIVLGDRSSYATVTRSITKNPNSNLEKLQILIASKGKSLSQTVVNALMQKRNALRTEQLGIRWASSSRRGGMIVLRKVAIPKPINLPVLRVTKEVVIVVII

SEQ ID NO: 222395 - protein, 589 aa, Glycine max
  Coding DNA Sequence Number=SeqID_105617
  Gene Ontology: Mol. function=RNA-directed DNA polymerase activity; Cellular component=chromatin; Biological process=chromatin assembly or disassembly
  Pfam annotation: Domain name=zf-H2C2; Domain location=312-349; Score =4.1; E_value=0.1; Accession=PF09337.1; Description=His(2)-Cys(2) zinc finger
MASEDVSKTTFRMHHGHYEFMVMPFGLCNAPSSFQATMNTTFGPYLRKFIIVFFDDILIYSRTFPDHLEHLKTTFQTLTDNSFVLKLSKCSFATQQVEYLGFYHRFIKGYATLAAPLTTLLTKDHFQWTSEADQAFSKLKKALCQAPVLGSPDFDSLFVVETNASGIGMGAILSQHHHPFAFFSKPFCSKLLRASTYMRELAAITMAVKKWWQYLLGHCFVILTDHRSLKELMAQAVQTLEQQVYLARLMGYDYTIHYRVGKANMAADALSRLPDPPQGQFFVLTIPNWSYLVTTADPITADNFAELPSTPTSGHIGVMKTLARVHENFVWASMKQDVHRYVTSCTTYQQTKYDHRQPPRLLCPLPIPERPWEDLSLDFIKGLPSYRGNSVILVIVDRFSKGVHLEWSYNTSTHLATGISPYEITFGKKPPSLPQYLERTLNVEDIRQSRKEAIQSTTKNEEIRGPTALRCELQRRRPSAGQATTSQANFNYRRGVLQTCKKIGSVAYQLNLPPTSRIHPVFHYSLLNPYHSSTNEVPLDLPALFEDNQPFITPLTILDAKWKTTTSGKKLLVLVQWAGLFPEDTLWKQ

SEQ ID NO: 222396 - protein, 255 aa, Glycine max
  Coding DNA Sequence Number=SeqID_105618
  Gene Ontology: Mol. function=nucleic acid binding; Cellular component= nucleus; Biological process=DNA integration
MGLTWFASSRNQYMDYNRFNLNQCPKNELEREQMRSIPYASIVGSLMYAQVCTRTDIAFVVGMLGRYQSNPGIEHWTTAKKLLRYLQGTKGYKLTYQRFDNLEVVGYSDLDFVGCVDSRKSTSGYIFMMANGAISWRSAKQSLVATSTMEAEFISLFEATSQGIWLKSFMAGLQVIDSVPRLLKIYYDNLAAAFLAKNNKSGSRSKHIDIKYLAMREHVKENEIIIENISTKLMIANPLTKGMQTKSFKDHVKSM

SEQ ID NO: 222397 - protein, 148 aa, Glycine max
  Coding DNA Sequence Number=SeqID_105619
  Gene Ontology: Mol. function=nucleic acid binding; Biological process= DNA integration
MGENYKQWKEHVLFHLGVADLDYALRKDEPIELMDSSTSEEIALYKRWERSNRLSNMFIKTRISASMRGSILKCQKVKNFMKAIDDQFEGSEKALASTLMSKFSSMRLIGVEEWRLAPEIGEGDLTVTQDKGKKERKEKNHIPAITKI

SEQ ID NO: 222398 - protein, 80 aa, Glycine max
  Coding DNA Sequence Number=SeqID_105620
MTVRCEEDFMVKLEGENVKLQKVEGKRKRRKKHGVHGSVWEWRMEDVTIHCSSLKNLIFTKLSPPYILRRFSRTVIEGAS

SEQ ID NO: 222399 - protein, 76 aa, Glycine max
  Coding DNA Sequence Number=SeqID_105621
  Subcellular localization annotation: CTP_CleavageSite=39; ConfidenceScore=5.33e-01
MVASQEQLASQGTGAPTEMVRKSERSTPLQNQQGVRRVRAKAKVISPSTRVTRSKGKTKSEGNSHSMGQQGTYCKK

SEQ ID NO: 222400 - protein, 65 aa, Glycine max
  Coding DNA Sequence Number=SeqID_105622
  Homolog annotation: Hit_ID=O98997; Match level="QueryCoverage=53%, HitCoverage=7%, E-value=7e-07, Identity=71%"; Hit description =Ribulose bisphosphate carboxylase/oxygenase activase, chloroplast precursor
MALQLNLNASGAGVLAPNSAFFGSSLKNVIASRVPNTKIPYDYISTGLRHYNGGKLKIIRKNYPF

SEQ ID NO: 222401 - protein, 529 aa, Glycine max
  Coding DNA Sequence Number=SeqID_105623
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=99%, HitCoverage=74%, E-value=1e-162, Identity=55%"; Hit description =Subtilisin-like protease C1
  Pfam annotation: Domain name=PA; Domain location=171-243; Score=15.7; E_value=0.0078; Accession=PF02225.12; Description=PA domain
  Pfam annotation: Domain name=Peptidase_S8; Domain location=5-372; Score=13.1; E_value=1.8e-07; Accession=PF00082.12; Description =Subtilase family
  Pfam module annotation: Pfam domain module=PA::Peptidase_S8; Domain location=171-243::5-372
MDGSFGEDDIISPRDSNGHGTHCASTAAGNSVESTSFFGLASGTARGGVPSARIAVYKPCWSSGCDDADILQAFDEAIADDVDVISISLGPVSVDHRNYFEDVFAIGAFHAMKKGILTSHSAGNEGPELSTMSVYAPWLLSVAASTTDRKLFTLVQLGDGTVYEGVSVNTFDLKNESYPLIYAGDAPNITGGFNRSISRSLGLASGAAGILLRSLASKDVANTFALPAVHLSSNDGALIHSYINLTGNPTATIFKSNEGKDSLAPYIASFSSRGPNPITPNILKPDLAAPGVDILAAWSPISPVAGVKGDERNGNYNIISGTSMACPHVTAAAAYIKSFHPDWSPATIKSALMTTATPMSIALNPEAEFAYGAGQINPIKALNPGLVYDANEIDYVKFLCGQGYDTKKLRSITADNSSCTQANNGTVWDLNLPSFALSMNTPTFFSRVFHRTVTNVGSATSKYKARVIAPPSLLNIIVEPEVLSFSFVGQKKSFTLRIEGRINVGIVSSSLVWDDGTSQVRSPIVVYSE

SEQ ID NO: 222402 - protein, 243 aa, Glycine max
  Coding DNA Sequence Number=SeqID_105624
  Gene Ontology: Mol. function=RNA-directed DNA polymerase activity; Cellular component=intracellular; Biological process=RNA-dependent DNA replication
MGEEQRKVVKEEVNKLPNDKWRMSNDYTDLNKACPKDAYCLPSIDRLVDGLFGFQVLSFLDTYSGYNQIRMHPSDEEKTTFITEDANFCYMVDDMAVKFQSISQHVADLEEGIEANPNKCTIILEMRIPTNIQEVQKLNGRLASLSRFLLKLAEKAKQFYKVLKKTESFLWDENCERAFLAFKKIIAIPSVLSQPRPGAPLLLYLSIADEAISSHPSYKRKGSTSSLSISPITCSMTPRSTTK

SEQ ID NO: 222403 - protein, 336 aa, Glycine max
  Coding DNA Sequence Number=SeqID_105625
MKSLLSRAHYPDLGPSCSWTSASLGFRPLLEVSSHGSMSNSLPRLEITQTEGGHKIHVASGLDSFACKAEEWTDVRVDSVGGDLESLEVFLVQYINRTALVDNTMKFAMMMETTIRSSWLAGLMPLKSLFVKKTFLGLARLSPIGKATSGGVDYTSDVLGGLALVWLVPLVRLVQVSLGVYFALVTLLSGLVDFILGLLHKLSVNLSRNNVRSIEWNTTSGLTKVVEVMRWDLLVAFCTLNSSTRVSKLSMDIGLPVLGRHPNVVVPSYRSTLSGFHPKVMPISIMQSTKECRRIVRPARCGGIARHPGNVLNKPPAGHGQPLSLSTPPYGIAPSS

SEQ ID NO: 222404 - protein, 37 aa, Glycine max
  Coding DNA Sequence Number=SeqID_105626
MANDTYAKARCPNPSQTIPSFILQRACKTHGPPLLPQ

SEQ ID NO: 222405 - protein, 163 aa, Glycine max
  Coding DNA Sequence Number=SeqID_105627
MLLAVGGIHWGHDIGTLLHACHSSWMAYNGDLVGCLCAHAVSDMLAEVELQVGGIPCSWNCFAIRLLQSVRSIVEVGCDPEWAFLVRAKLSRSGIFSGITSDSPYEVARLKGSWCLTPVKAQGQGVVQGFDGCVSVPETKATRKGKNGHFLEFSDPKLAQNSI

SEQ ID NO: 222406 - protein, 69 aa, Glycine max
  Coding DNA Sequence Number=SeqID_105628
MISLSLWHLLLVLSCVLLLTQTYSEDDQKTYIVYMGDHPKGVIQSAESLHISMVQNILGRLFNCIFIYV

SEQ ID NO: 222407 - protein, 292 aa, Glycine max
  Coding DNA Sequence Number=SeqID_105629
  Gene Ontology: Mol. function=serine-type endopeptidase activity; Cellular component=cytoplasm; Biological process=negative regulation of enzyme activity
  Homolog annotation: Hit_ID=Q39547; Match level="QueryCoverage=97%, HitCoverage=39%, E-value=3e-98, Identity=59%"; Hit description =Cucumisin precursor
  Pfam annotation: Domain name=Peptidase_S8; Domain location=57-286; Score=-71.9; E_value=0.0063; Accession=PF00082.12; Description =Subtilase family
  Pfam annotation: Domain name=Subtilisin_N; Domain location=5-54; Score=39.1; E_value=1.5e-08; Accession=PF05922.7; Description =Subtilisin N-terminal Region
  Pfam module annotation: Pfam domain module=Peptidase_S8::Subtilisin _N; Domain location=57-286::5-54
MASISSKFAPDALLHSYKKSFNGFVVKLTEEEAVRMAELDGVVSVFPNKKNELHTTRSWDFIGLSQNVKRTSIESDIIVGVIDSGIWPESDSFDDEGFGPPPQKWKGTCHNFTCNNKIIGAKYFRMDGSYEKNDIISPRDTIGHGTHCASTAAGNSVIESTSFFGLASGTARGGVPSARIAVYKSCWSSGCDDADILQAFDEAIEDGVDIISISLGPREVEYSDYFNDVFAIGAFHAMKKGILTSISAGNSGPEFYTISKNAPWSLSVAASTIDRKFFTRVQLGDGTIYEVI

SEQ ID NO: 222408 - protein, 236 aa, Glycine max
  Coding DNA Sequence Number=SeqID_105630
  Gene Ontology: Mol. function=nucleic acid binding; Biological process= DNA integration
  Homolog annotation: Hit_ID=Q1S7C5; Match level="QueryCoverage=99%, HitCoverage=21%, E-value=5e-24, Identity=32%"; Hit description =Integrase, catalytic region
NGVVERKHKHVVEIALTMLSQAFMSLEYWDHVVTSVVYLINCLPSSSDQEAILSLSHKGNKCLAEDGRMYISKDILLIFSTHPPGVTPSILDNHTPIGQMDNDSSCTISSSVGADFVSDVDSQSTSTSTPTVVSPTPTVLVKPVNTHLMCTQAKDGVVKPRLQPTIFLAHVKPKSTKSAISSPQWLAAMKIEYEALMKNGTWSLQVFLLIDLLWVANEFFESRKILMALSINTKLD

SEQ ID NO: 222409 - protein, 241 aa, Glycine max
  Coding DNA Sequence Number=SeqID_105631
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=99%, HitCoverage=32%, E-value=4e-78, Identity=63%"; Hit description =Subtilisin-like protease C1
DPTATIFKSNEGKDSFAPYIASFSSRGPNAITPNILKPDLAAPGVDILAAWSPIVPPSNVKGDKRIANYTIQSGTSMACPHATAAAAYIKSFHPNWSPAAIKSALMTTATPMSVALDPEAEFAYGAGQIHPIKALNPGLVYDASEIDYVNFLCEQGYDTKKLRSITNDNSSCTQPSDGIGWDLNLPSFAVAVNTSTSFSGVVFHRTVTNVGFATSTYKARVTIPSSFLKFKVEPDVLSFSF

SEQ ID NO: 222410 - protein, 95 aa, Glycine max
  Coding DNA Sequence Number=SeqID_105632
  Subcellular localization annotation: CTP_CleavageSite=36; ConfidenceScore=5.56e-01
MSAIVFSIQSLNNIWMMPIRKCSIGVIRRCFFFKPRSFTFPGRSPLAFFSISAGESCFSAEEMCDRCLPVRLLFQTSIGLLSWPRSVCIVFDQCR

SEQ ID NO: 222411 - protein, 193 aa, Glycine max
  Coding DNA Sequence Number=SeqID_105633
MTIICLCVSSGPPPLDDKRCRMTIICLRVSSAPPPVDHKRRRMTIIYLCVPSDMIVSGRQKVSGMTIICLRVSSGPPPLDDKRRRMTIICLCVPSDTIVSGWEKVSGMTIICLRMSSGPPPLDDKRRRMTIICLCVPSDTIVSGWQKPLDDKRRRMTIICLCVPLDTIVSGWEKVSGITIICLCVPLDTIVSE

SEQ ID NO: 222412 - protein, 184 aa, Glycine max
  Coding DNA Sequence Number=SeqID_105634
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q6A727; Match level="QueryCoverage=41%, HitCoverage=14%, E-value=4e-31, Identity=89%"; Hit description =Propionyl-CoA carboxylase beta chain
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSMVITTVLDEDTFLEIHELFAPNVICGFGRIEGRAIGIVANQPMINAGTLDIDASEKAARFVRTCDSFIKLIDTVDLEGGPGTSFCSL

SEQ ID NO: 222413 - protein, 46 aa, Glycine max; identical to SEQ ID NO: 136952
  Coding DNA Sequence Number=SeqID_105635

SEQ ID NO: 222414 - protein, 72 aa, Glycine max
  Coding DNA Sequence Number=SeqID_105636
MGDSAKVVIKQDMKGRRHKYGFNNNEREKAQKKRVVDDETADKHQLDEHQERLRKKFALEEGRIFAANEQVS

SEQ ID NO: 222415 - protein, 116 aa, Glycine max
  Coding DNA Sequence Number=SeqID_105637
  Homolog annotation: Hit_ID=Q2RXF7; Match level="QueryCoverage=95%, HitCoverage=93%, E-value=2e-29, Identity=51%"; Hit description=SH3 domain protein
  Pfam annotation: Domain name=SH3_2; Domain location=2-61; Score=5.2; E_value=0.26; Accession=PF07653.7; Description=Variant SH3 domain
  Pfam annotation: Domain name=SH3_2; Domain location=65-115; Score =14.9; E_value=0.013; Accession=PF07653.7; Description=Variant SH3 domain
  Pfam module annotation: Pfam domain module=SH3_2::SH3_2; Domain location=2-61::65-115
MNYIVTTAHRSEFPHPITLRRGQALVVGERYEGPEGWDDWFLCEAEGQQPGFVPAPVIGRTAQGDAFATEDYCARELDVDPGQVLRGQRTLNGWAWCVPETGEPGWVPLEKLRAMR

SEQ ID NO: 222416 - protein, 544 aa, Glycine max
  Coding DNA Sequence Number=SeqID_105638
  Gene Ontology: Mol. function=ATP-dependent DNA helicase activity; Cellular component=chromosome; Biological process=DNA unwinding during replication
  Homolog annotation: Hit_ID=UPI000068066B; Match level="QueryCoverage =97%, HitCoverage=57%, E-value=1e-130, Identity=47%"; Hit description= similar to Superfamily I DNA and RNA helicases
  Pfam annotation: Domain name=UvrD-helicase; Domain location=67-492; Score=-127.6; E_value=6.5e-07; Accession=PF00580.11; Description =UvrDREP helicase
  Pfam annotation: Domain name=zf-C4_Topoisom; Domain location=504-543; Score=5.8; E_value=0.042; Accession=PF01396.10; Description =Topoisomerase DNA binding C4 zinc finger
  Pfam module annotation: Pfam domain module=UvrD-helicase::zf-C4 _Topoisom; Domain location=67-492::504-543
MPYIRTLQGERVKSLEECVIADWLFYNGVTYDYERRYEFDTATDTHRQYRPDFYYPDAGLYHEHFALDADGQPPAHFAHYAEGMHWKRQQHAARGTALVETTSFGLRSGHALQDLAERLDGSGVELDPNPDRELPEQGAKPMPDADLIGLMRTFIAHAKSNCLTLDDMAERLRQMPEDQFKERHRRFLEIASPVFQAWDKALADEHGIDFEDMLNMAAGLLEQGRYESPYELVMADEFQDASRARARLCRALVSKPGRYLFAVGDDWQSINRFAGADVSVMTGFREWMGHGQVLKLEQTFRCPQALCDASSRFISRNPAQIAKAVRSTTPAMGPVLQAFQMNRREELQDGVRQYLTKLHHQLLSGAVPQGRNGRVTVFILGRYRADRSAMPSDWKTAFGSTMDVEFLTAHRSKGREADYVILPGMVHRGFPSLRADDPVLSLAMPDGDTYPLSEERRLFYVALTRARRSVAMFTLQGKHSPFLDELVKDGAVEVTAISGAAIHEERCPVCKVGVFVDRNGPHGAFRSCSSYPLCHNKPRGGRRG

SEQ ID NO: 222417 - protein, 311 aa, Glycine max
  Coding DNA Sequence Number=SeqID_105639
  Gene Ontology: Mol. function=carbon-carbon lyase activity; Biological process=aromatic compound metabolic process
  Homolog annotation: Hit_ID=Q8UGM2; Match level="QueryCoverage=72%, HitCoverage=84%, E-value=7e-99, Identity=84%"; Hit description =Aldolase
  Pfam annotation: Domain name=HpcH_HpaI; Domain location=1-213; Score =260.0; E_value=5e-75; Accession=PF03328.5; Description=HpcHHpaI aldolase family
IAGTAGFDWLVIDGEHGPNDLRSIIDQLRALATSAAEPVVRVPVGESWMIKQLLDAGARTLLVPMVDSAAQAEALVSAMHYPPRGIRGMGAAVARASAFNTITDYADSASASVCLLVQAETRAAIEDLDNILAVDGVDGVFIGPADLAADMGYLGRIDEAAVQAVIEAAIVKIVAAGKAAGILTFNETYNRRYLELGASFVAVGADVTEFANTLRALSARYKGGPALLRRNTFLAGGEITAIDEGGADDALDCLVSVDAVIPCKIRQCRLKVVAEPHIRPLHSCRFYQCIKARRANPPCLDLMPVRHQRQR

SEQ ID NO: 222418 - protein, 106 aa, Glycine max
  Coding DNA Sequence Number=SeqID_105640
MHNHGSIGPVRENAFGGKLGSGAKESSAQKILVGNQEEDRFMCHKPWFPFFSFLLVTILLIVNKSSFLGDPSIPSSEGKGKNSYPRSRFMADELRFWLKRLVEGRT

SEQ ID NO: 222419 - protein, 345 aa, Glycine max
  Coding DNA Sequence Number=SeqID_105641
  Homolog annotation: Hit_ID=Q1SKD7; Match level="QueryCoverage=32%, HitCoverage=28%, E-value=9e-08, Identity=30%"; Hit description =Ankyrin
MALRKLPSKRSRKETAEEGSSTAPQADTDFDRHQFRSAEHQQCFEAIKGWSFLKERRVQLRDDEFLDFQEEIAHRRWAPLVTPMAKFDPEIVKEFYANAWPTEEGVRDICSWVRGQWIPFDADTLSHCPAIVHTGARFHPDRYRETGADHAHQHDHPYPDMDDVATHQHSAQQPQHARGHLPVSVGLCHPDTGTAPMRHPMDPERSNRALRFPALIMGLCQFCGVPVALRKVIWPPITRAFIEKYCTPGRCRAMHHSSLGRPATGSRCATITPGVHLNPLAEAANHSGQVWLNKSFYQYTLRQQGWDSRPYTWPTPEQFEAAGTSRGGDEAQDDQDMADLIDFLL

SEQ ID NO: 222420 - protein, 54 aa, Glycine max
  Coding DNA Sequence Number=SeqID_105642
MVVVNQLDQHERPCMGYSGNQIFLSQKVNGNKQISIFLVGPGVCYLVRSPKAND

SEQ ID NO: 222421 - protein, 184 aa, Glycine max
  Coding DNA Sequence Number=SeqID_105643
MGISFRANLGVRGLREPILEKISNKLASWKHKQFSLGRRVYLLNSMLTSLSLFYLSLFKIPRKMPICKVREHRGLGVLGSKYAGWRELGMEGGKIYQSIWWSLKLGCGVQNHEKYAVEEEEGEPNGGFSVKSTYSYLYDEKYDSQEVDIFETLWKLKVPPKVVFVEWLGPFGGIGMHLDLGAKT

SEQ ID NO: 222422 - protein, 58 aa, Glycine max
  Coding DNA Sequence Number=SeqID_105644
MERGVGPKGTLPETVKGVCGSNDGGFRGNVHDELATSIEGHNGGCGRLRRSWQDEGCE

SEQ ID NO: 222423 - protein, 73 aa, Glycine max
  Coding DNA Sequence Number=SeqID_105645
MFRKVTIQLKLVEGDSAGTEPFLSQCIELFSSADNPICINELNITSLGIMEIPICLGGSISSTGSTLYMLMFS

SEQ ID NO: 222424 - protein, 956 aa, Glycine max
  Coding DNA Sequence Number=SeqID_105646
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9SU58; Match level="QueryCoverage=99%, HitCoverage=99%, E-value=0.0, Identity=80%"; Hit description=ATPase 4, plasma membrane-type
  Pfam annotation: Domain name=Cation_ATPase_N; Domain location=10-90; Score=108.9; E_value=1.5e-29; Accession=PF00690.16; Description =Cation transporterATPase, N-terminus
  Pfam annotation: Domain name=E1-E2_ATPase; Domain location=102-323; Score=307.6; E_value=2.2e-89; Accession=PF00122.10; Description=E1 -E2 ATPase
  Pfam annotation: Domain name=Hydrolase; Domain location=327-613; Score=74.5; E_value=3.3e-19; Accession=PF00702.16; Description =haloacid dehalogenase-like hydrolase
  Pfam module annotation: Pfam domain module=Cation_ATPase_N::E1-E2 _ATPase::Hydrolase; Domain location=10-90::102-323::327-613
MGDKSQVLEAVLKEAVDLENIPIEEVFENLRCSKEGLSSEAAEERLVIFGHNKLEEKKESKFLKFLGFMWNPLSWVMEAAAIMAIALANGGGKPPDWQDFVGIITLLIINSTISFIEENNAGNAAAALMARLAPKAKVLRDGRWNEQDASVLVPGDIVSIKLGDIIPADARLLEGDPLKIDQSALTGESLPVTKGPGDGVYSGSTCKQGEIEAVVIATGVHTFFGKAAHLVDTTNQVGHFQKVLTAIGNFCICSIAVGMVIEIIVMYPIQDREYRPGIDNLLVLLIGGIPIAMPTVLSVTMAIGSHRLSQQGAITKRMTAIEEMAGMDVLCSDKTGTLTLNKLTVDKNLIEVFAKGVDADTVVLMAAQASRLENQDAIDTAIVGMLADPKEARLGIQEVHFLPFNPTDKRTALTYIDRNGKMHRVSKGAPEQILNLAHNKSDIERRVHAVIDKFAERGLRSLAVAFQDVPDGRKESPGGPWQFIGLLPLFDPPRHDSAETIRRALNLGVNVKMITGDQLAIGKETGRRLGMGTNMYPSSALLGQDKDESISALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTNFFPRVFGVSTLEKTAHHDFRKLASAIYLQVSTISQALIFVTRSRGWSYVERPGILLVTAFVIAQLIATLIAVYANWSFAAIEGIGWGWAGVIWLYNIIFYIPLDPIKFLIRYALSGRAWELVIEQRIAFTRQKDFGKEQRELQWAHAQRTLHGLQPPDTKMFTERPHFNELNQMAEEAKRRAEIARLRELHTLKGHVESVLKLKGIDVDTIQQAYTV

SEQ ID NO: 222425 - protein, 580 aa, Glycine max
  Coding DNA Sequence Number=SeqID_105647
  Gene Ontology: Mol. function=protein serine/threonine kinase activity; Cellular component=integral to membrane; Biological process=protein amino acid phosphorylation
  Homolog annotation: Hit_ID=Q9FM23; Match level="QueryCoverage=95%, HitCoverage=99%, E-value=0.0, Identity=71%"; Hit description =Receptor-like protein kinase
  Pfam annotation: Domain name=LRRNT_2; Domain location=24-64; Score =49.8; E_value=9.2e-12; Accession=PF08263.3; Description=Leucine rich repeat N-terminal domain
  Pfam annotation: Domain name=LRR_1; Domain location=146-167; Score =14.4; E_value=0.43; Accession=PF00560.23; Description=Leucine Rich Repeat
  Pfam annotation: Domain name=LRR_1; Domain location=69-91; Score=2.6; E_value=92; Accession=PF00560.23; Description=Leucine Rich Repeat
  Pfam annotation: Domain name=LRR_1; Domain location=93-115; Score =6.1; E_value=20; Accession=PF00560.23; Description=Leucine Rich Repeat
  Pfam annotation: Domain name=Pkinase; Domain location=292-560; Score =157.2; E_value=4.2e-44; Accession=PF00069.15; Description=Protein kinase domain
  Pfam annotation: Domain name=Pkinase_Tyr; Domain location=292-560; Score=120.0; E_value=6.5e-33; Accession=PF07714.7; Description =Protein tyrosine kinase
  Pfam module annotation: Pfam domain module=LRRNT_2::LRR_1::LRR_1::LRR_ 1::Pkinase::Pkinase_Tyr; Domain location=24-64::146-167::69-91::93 -115::292-560::292-560
MGHAVLILVVVISSIVLCPSSLALTQDGLTLLEVKSTLNDTRNFLSNWRKSGETHCTWTGITCHPGEQRVRSINLPYMQLGGIISPSIGKLSRLHRLALHQNGLHGIIPNEISNCTELRALKFKYRDLSSNSLKGAIPSSIGRLTQLRVLNLSTNFFSGEIPDIGVLSTFGNNAFIGNLDLCGRQVQKPCRTSLGFPVVLPHAEIPDKRSSHYVKWVLVGAITIMGLALVMTLSLLWICLLSKKERAARRYIEVKDQINPESSRKNDGTKLITFHGDLPYTSLEIIEKLESLDEDDVVGSGGFGTVYRMVMNDCGTFAVKRIDRSREGSDQGFERELEILGSIKHINLVNLRGYCRLPSTKLLIYDYLAMGSLDDLLHENTEQSLNWSTRLKIALGSARGLTYLHHDCCPKIVHRDIKSSNILLDENMEPRVSDFGLAKLLVDEDAHVTTVVAGTFGYLAPEYLQSGRATEKSDVYSFGVLLLELVTGKRPTDPSFASRGVNVVGWMNTFLKENRLEDVVDKRCIDADLESVEVILELAASCTDANADERPSMNQVLQILEQEVMSPCPSDFYESQSDHC

SEQ ID NO: 222426 - protein, 224 aa, Glycine max
  Coding DNA Sequence Number=SeqID_105648
  Gene Ontology: Mol. function=oxidoreductase activity; Cellular component=mitochondrial envelope; Biological process=metabolic process
  Homolog annotation: Hit_ID=Q76KV8; Match level="QueryCoverage=97%, HitCoverage=78%, E-value=6e-63, Identity=58%"; Hit description=Short- chain alcohol dehydrogenase A
  Pfam annotation: Domain name=adh_short; Domain location=2-144; Score=- 7.8; E_value=1.8e-05; Accession=PF00106.15; Description=short chain dehydrogenase
MVVIADIQDDLGNLVAASIASHRCSYVRCDVTEEVQVKNLVDSTVNAHGQLDIMFSNAGILSSSDQTILDLNLSEYDRLLAVNARGMAACVKHAARAIVERRVRGSIVCTASVSASHGGLWRTDYVMSKHAVKGLVRAASAQLGVHGVRVNCVSPSGLATPLTRGAHAAMETHELQKQYAQSSWLKGIVLTPKHIADAVLFLACGDLEFVTGHDLVVDGCFHGA

SEQ ID NO: 222427 - protein, 103 aa, Glycine max
  Coding DNA Sequence Number=SeqID_105649
  Gene Ontology: Mol. function=voltage-gated ion-selective channel activity; Cellular component=mitochondrial outer membrane; Biological process=anion transport
  Homolog annotation: Hit_ID=Q4PKP6; Match level="QueryCoverage=98%, HitCoverage=36%, E-value=1e-14, Identity=45%"; Hit description =Mitochrondrial voltage-dependent anion-selective channel
HDNFQTLKGSCYFEVNPLTKTAIAAEVKYDLADDETTGVTVGAQHALFSWTLLKARLNNNGKVGGLIQQKFGTKFSITVAGEINLNEKAKEKFPKVGVSMALK

SEQ ID NO: 222428 - protein, 102 aa, Glycine max
  Coding DNA Sequence Number=SeqID_105650
MGGAEENDKHEGEVEKEHKKEKKEKAEDAGEESKEKKKEKKNKEGKEKKEKNPEDKKDPAILKQKLEKLDSKMQALQTKREEILKLLQEVEQGAANSSEATA

SEQ ID NO: 222429 - protein, 145 aa, Glycine max
  Coding DNA Sequence Number=SeqID_105651
  Gene Ontology: Mol. function=voltage-gated ion-selective channel activity; Cellular component=mitochondrial outer membrane; Biological process=anion transport
  Homolog annotation: Hit_ID=Q4PKP6; Match level="QueryCoverage=99%, HitCoverage=63%, E-value=2e-14, Identity=31%"; Hit description =Mitochrondrial voltage-dependent anion-selective channel
MSQGPGLYFDIGKKARDVLHKGYAQQPPIHFNYRFLNWNLDLSCQEELVHGLRGLFTCNIPDSGKLEIQHFSRFSGFSASIGLSGEAEKGYNPVANISGHIGTRILTLGANLACDLSGSSSARTTNNLNAGLSLNSPYLVAAATL

SEQ ID NO: 222430 - protein, 128 aa, Glycine max
  Coding DNA Sequence Number=SeqID_105652
  Homolog annotation: Hit_ID=Q9AY32; Match level="QueryCoverage=46%, HitCoverage=90%, E-value=2e-25, Identity=96%"; Hit description=RRNA intron-encoded homing endonuclease
LVVGPWVGSIGPPPVCTGRLVPFCRRCAPVLNWPGRASGADSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 222431 - protein, 488 aa, Glycine max
  Coding DNA Sequence Number=SeqID_105653
  Gene Ontology: Mol. function=amino acid transporter activity; Cellular component=integral to membrane; Biological process=amino acid transport
  Homolog annotation: Hit_ID=Q2QM92; Match level="QueryCoverage=97%, HitCoverage=79%, E-value=1e-135, Identity=54%"; Hit description =Amino acid permease family protein
  Pfam annotation: Domain name=AA_permease; Domain location=4-402; Score=-55.9; E_value=0.0003; Accession=PF00324.11; Description=Amino acid permease
MFYFYGSLLLFFEHMILWPQQVGGSFAYLRVELGDFVAFIASGNILLEYVIGGAAVARSWTSYFATLCNQPSDKFLIQVHGLAADYSQLDPIAVVVLVVIGFFAVFSTKGSSRFNYIASIVHVIVLIFIIVAGLTKAEAKNYSDFLPFGPRGIFQASAVLFFAYVGFDAVSTMAEETKNPGRDIPIGLIGSMACTTFLYCMLSVTLCLMQKFSDVDENAAFSVAFEAVGMSWAKYIVAFGALKGMTSVLLVGAVGQARYLTHIARTHLLPPWLAKVNERTGTPIYATVVMLSATAIVAFFTSLDILANLLSISTLFLFSLVALALLVRRYCARGVATQLNVVKFIVCIILIVGSSVASAVYWANTTKWVGYTIMVPLWFVGTVGIWLLVPLTKKPKIWGVPLVPFLPSASIGINIFLLGSLDKASFRRFGVWTAILLVYYLFVGLHASYDMAKIQKKQRLEAKTESKLDEENVAPSVTGSGTNNEDHI

SEQ ID NO: 222432 - protein, 48 aa, Glycine max
  Coding DNA Sequence Number=SeqID_105654
MKSITFWPKHRFRIKRPRQTQQHGFRIHLSLGLAWWTEKMKHVREEGG

SEQ ID NO: 222433 - protein, 123 aa, Glycine max
  Coding DNA Sequence Number=SeqID_105655
  Gene Ontology: Mol. function=amino acid transporter activity; Cellular component=integral to membrane; Biological process=amino acid transport
  Homolog annotation: Hit_ID=Q6AST6; Match level="QueryCoverage=98%, HitCoverage=68%, E-value=1e-37, Identity=64%"; Hit description =Cationic amino acid transporter, putative
MEGNDAEGVIKLESFQSAWNYGKALLETPCRLVDRVTGRSMDEVELKEVKKRSEHEMKKTLTWWDLIWFGMGSVIGSGIFVLTGFEVKNHVGPGVVLSYVISGISAMLSVFCYTEFAVEIPVA

SEQ ID NO: 222434 - protein, 60 aa, Glycine max
  Coding DNA Sequence Number=SeqID_105656
MASRAELPINEVKHSSGEWHGGTNVGNFVAAIKVEEPQNVKEEPKAIVISFDDELEALKG

SEQ ID NO: 222435 - protein, 114 aa, Glycine max
  Coding DNA Sequence Number=SeqID_105657
MCNTCHNFDECETCETHFKVQFLYLFFSEVQQAKRSRNKEKEEENQKKPKSSKALSAGCAQRARRQGAKRTTRAEREASRSASLRRPKPKFAPINKRVSLGKRTHFLRAQFSNF

SEQ ID NO: 222436 - protein, 1201 aa, Glycine max
  Coding DNA Sequence Number=SeqID_105658
  Gene Ontology: Mol. function=cellulose synthase (UDP-forming) activity; Cellular component=membrane; Biological process=cellulose biosynthetic process
  Homolog annotation: Hit_ID=O49323; Match level="QueryCoverage=80%, HitCoverage=94%, E-value=0.0, Identity=69%"; Hit description =Putative cellulose synthase
  Pfam annotation: Domain name=Cellulose_synt; Domain location=141-986; Score=1801.7; E_value=0; Accession=PF03552.5; Description=Cellulose synthase
  Subcellular localization annotation: CTP_CleavageSite=58; ConfidenceScore=5.37e-01
MTTRSSNSPHKSLYSSGGQQNDHSNYTVMMPLTPDNQPGTSDSKQDNVGGTTTRFATESQQRGGGGGGEPKMERRMSSVLSSVNNKSMLLRSQTQDFDHNRWLFETKGTYGIGNAFWQDDSNSFGDEGVSMSDFMDKPWKPLTRKIPISGAILSPYRLLVVVRIIVLAFFLTWRIRNPNYDALWLWGISIVCEIWFAFSWLLDILPKLNPINRTVDLTALHDKFDQPSASNPTGRSDLPGIDVFVSTADAEKEPPLVTANTILSILGVEYPIEKISCYISDDGGAILTFEAMAEAVKFAEVWVPFCRKHNIEPRNPDAYFNLKKDPTKNKKRPDFVKDRRWMKREYDEFKVRINGLPEVIRERSKMHNSKEEKKAKQLAKEKNGGTLPQDYTSDVPNATWMADGTHWPGTWYGPTADHSKGDHAGILQIMSKVPDHDPVLGHADEKTLDFTGVDIRVPMFAYVSREKRPGYDHNKKAGAMNAMVRASAILSNGPFILNLDCDHYFFNSLALREGMCFMMDRGGDRVCYIQFPQRFEGIDPSDRYANHNTVFFDGYISIRNVSNMTNKRGNMRALDGLQGPMYVGTGCMFRRYALYGFEPPRFIEHTGVFGRTKTKVNRNAPHARQSFDDDTQPLTSDSEMGYPQKFGSSTMFIESITVAEYNGRPLADHKSVKNGRPPGALIAPRPPLDAPTVAEAIAVISCWYEDQTEWGDRVGWIYGSVTEDVVTGYRMHNRGWRSIYCITKRDAFRGTAPINLTDRLHQVLRWATGSVEIFFSRNNAFFATRRLKFLQRISYLNVGIYPFTSVFLVVYCFIPALSLFSGQFIVNGLNPAFLIYLLLITICLTLLSLLEVKWSGIALEEWWRNEQFWVIGGTSAHLVAVVQGLLKVIAGIEISFTLTSKSAGDDELDEFADLYIVKWTSLFIMPLTILIVNLIALVMGILRTVYSVIPEWNKLLGGILSITIALLWITIDPPSDSIQAGNLESGTHTCMLLHPTLTSAHLTLALHPAVSSAICHNLLRDLRYLPQACRGHSLYCSLVDGVPDIFDAASDGRQGDEAVRVNRRGGVDDGFGDSGLVAKKGVGGKEMLLTYDVVKGSGMQTLVQGFVNVGVGVFLVCDLKEERGLLLWLCWRRRRRRFGEFGGEERLRAICPVCGKIAYQNPKMEYSTISIRTLSAGYLEIGESAVEGAIRETREEANADV

SEQ ID NO: 222437 - protein, 253 aa, Glycine max
  Coding DNA Sequence Number=SeqID_105659
MYRSLMKNLWLSKCYLAKPRWHPGRGKALLPDLKLSMIPGDSILWTLIYHTEFDEFKVELERHNLHKCLANLQDGSIDVAVVKEFYANLYTTEEQAPKQARVRGHLIKIDAGSLNECLHTPVVLEEGESLPTYSRFCRLRTNPQEIEARLCIPRKGFVLNAEGQPWKLLRKDLKTLAKTWSVFPYSNLAPTSHTSDLDMDRGRLVYGLVTNRDMNIRALILGQIYSIAQSNSSRLRFPALMTALCRARGVTSH

SEQ ID NO: 222438 - protein, 85 aa, Glycine max
  Coding DNA Sequence Number=SeqID_105660
MARIREEATKLRAARRYNTKVQPQAFQLGDLVCQIRGEARKDPRAGKLGPNWEGPFKVTTSLDNKAYKLQELDAKQFQEHGAQPI

SEQ ID NO: 222439 - protein, 203 aa, Glycine max
  Coding DNA Sequence Number=SeqID_105661
  Gene Ontology: Mol. function=RNA-directed DNA polymerase activity; Cellular component=mitochondrion; Biological process=RNA-dependent DNA replication
MAYGRSQYVYSPHGKGPRGSQTVKIVRKGARNVCKLLALSASLCEVKGVCLECWQVVAGTHHLCCKGSSPCMDTANSFVEFSHDIICLGSFNLVPPLLLDNSLEVPDLFSASQLGEQYLSNTISLVWYLLVTCLWTSHESVQHHSFLALTSLASFRLAMNASYSAWLFKALKLSLRAYSKVTLSRPSRMFPTPLPFILDAPLT

SEQ ID NO: 222440 - protein, 63 aa, Glycine max
  Coding DNA Sequence Number=SeqID_105662
AFSEELAKRAYPAKRVHLLRMNTHPLVEMPVAKRGGIAKPRWHQERGLESTTSLHHPPQLLSD

SEQ ID NO: 222441 - protein, 335 aa, Glycine max
  Coding DNA Sequence Number=SeqID_105663
  Gene Ontology: Mol. function=helicase activity; Biological process =protein amino acid phosphorylation
  Homolog annotation: Hit_ID=Q9ZQ61; Match level="QueryCoverage=86%, HitCoverage=27%, E-value=4e-40, Identity=33%"; Hit description =Putative helicase
  Pfam annotation: Domain name=DUF889; Domain location=65-307; Score =146.3; E_value=8e-41; Accession=PF05970.5; Description=Eukaryotic protein of unknown function (DUF889)
  Subcellular localization annotation: CTP_CleavageSite=29; ConfidenceScore=5.06e-01
MNATNRQIGGMFFLYGYGGTSKTFMWKTLAVALRSKALLLLPNGRTMHSKFGIPVPTLENSTCNIHQGIKHAQLLKAIKLIIWDEAPMAHKYCFKALDKTLNNIMLMSNSNNVPFGGKVVVFGDVGDGKVGTSDDRLYQIEILNELRITNFSNPIEVIVGHTYPGIQHNYKDEEFLKSRAILASKNEIVDQINDYILNIILGDEKEYLSCDSIDMIDAASSESYKAVTPEFLHSLKTSGMPNHKIRIKIDTPIMLIRNLDKAEGFCNETRLIVSRMANHVIEARIVTGKNIRSLVYLISKLHDESRLIQGVLMITKMMTKAQKSRSLHDNKGVQE

SEQ ID NO: 222442 - protein, 134 aa, Glycine max
  Coding DNA Sequence Number=SeqID_105664
MVMCNVKDNLCLVWAKIVGFMDNKPWWEIENGERLVNYDDNRYYHVELSAPLIPSCFADLFMQDPDSRVYPPQQVLRMFHSKEFLTVAQEPAPLAMLIDWIKKQKEDLGCEGFGGSRNNASQATLIWNEEFASS

SEQ ID NO: 222443 - protein, 304 aa, Glycine max
  Coding DNA Sequence Number=SeqID_105665
  Homolog annotation: Hit_ID=Q1T493; Match level="QueryCoverage=90%, HitCoverage=60%, E-value=2e-10, Identity=24%"; Hit description =Nucleic acid-binding, OB-fold, subgroup
  Pfam annotation: Domain name=Rep_fac-A_C; Domain location=99-215; Score=-70.3; E_value=0.095; Accession=PF08646.1; Description =Replication factor-A C terminal domain
MWSISRSPKSIVELILVDKKVRHVSGPVVLLLSLAKIKEAKGYCFIALIQQQSIIQCYGSQIFVNIDMKEILEFKDRSVSPNAQVKCFDELSQLKKECMCVTVATISKLLVANGWIYDGCPKCNKKVDGEGSSFVCVGCGNKSASTVAKECCALIKETIDELKQKMIDEDGVFDARDILEQLDRVLGKKLAFRFKVVPGNTRHSVSQLSDDDEFIKFVISKLPTLQHQDEALPSVSAMHEINYVGDSQCLSAITEFDPTLMGSITPPKHILPLSNSQVDEIPFEDLSSIQLSSTTLGKKHIKIE

SEQ ID NO: 222444 - protein, 96 aa, Glycine max
  Coding DNA Sequence Number=SeqID_105666
  Homolog annotation: Hit_ID=Q1SJW0; Match level="QueryCoverage=84%, HitCoverage=8%, E-value=3e-09, Identity=48%"; Hit description =Ubiquitin-associated
MWMIGVELINCSGLPDYGLQGKPIYKKENGAPTFGGSTSSAPSVLGNKTKLKTKSDHLLSDSVVTEKTYAFGIDDGPSSSSQRAGLQSAWIGNTGQ

SEQ ID NO: 222445 - protein, 294 aa, Glycine max
  Coding DNA Sequence Number=SeqID_105667
MANLWLSECCLAKPSVARAKHRLCGLSAICYSMHKAKPALLAKPLFEIKMASRKRKSTTSRPIAQYTDNILGWNILSERNVKLYHTEFDEFKVELERRNLHKCLANLRDGSIDMALVKEFYANLYTMEEQAPKQARVRGHLIKIDAGMLNEFLQTPVVLEEGESLPTYSRFYKLRTNHQEIKARLCIPRKGFVLNAEGQPWKILRKDLTTLAQTWSVFSYSNLAPTSQTSDLNIDRARLVYGLVTNMDMNIGALISGQISSIAQSNSSRLGFPALITAHAELEKLPLTVLPMRA

SEQ ID NO: 222446 - protein, 773 aa, Glycine max
  Coding DNA Sequence Number=SeqID_105668
  Gene Ontology: Mol. function=ionotropic glutamate receptor activity; Cellular component=membrane; Biological process=ion transport
  Homolog annotation: Hit_ID=Q5VMN1; Match level="QueryCoverage=91%, HitCoverage=83%, E-value=1e-108, Identity=31%"; Hit description =Putative Avr9/Cf-9 rapidly elicited protein
  Pfam annotation: Domain name=ANF_receptor; Domain location=83-412; Score=154.5; E_value=2.7e-43; Accession=PF01094.18; Description =Receptor family ligand binding region
  Pfam annotation: Domain name=Lig_chan; Domain location=580-773; Score= -4.5; E_value=1.3e-10; Accession=PF00060.17; Description=Ligand-gated ion channel
  Pfam annotation: Domain name=SBP_bac_3; Domain location=456-766; Score=-56.3; E_value=0.00024; Accession=PF00497.10; Description =Bacterial extracellular solute-binding proteins, family 3
  Pfam module annotation: Pfam domain module=ANF_receptor::Lig _chan::SBP_bac_3; Domain location=83-412::580-773::456-766
VTGGLRSDDGCTREWGCRGCEGVALVAHEVVMVARGSDVGGSWGGKESNIHVIILGITAANESSEVEGIIGAILDSSSRIGQEHSVAINLALEDFNIKNNLSFALHVRNSQGDPLLAAIAARDLIDNQKVQAIIGPQTWAETSLVAEVCTQKSIPLLSQADATPEWAMKKWPFLLQSSPSQIMQMKAIAEIVKSWKLYNITMICEDGDSSSIEVLSQLSGALKEVGTELSNVIAILPLVSSSLSQQLEKLREGQCRVLIVHLSFPLALHLFETAKRMDMMGEGNVWITTGTFTSLVYSLNASTISNMQGIIGVKSYIQSLWYQNANFYHRFRKNFSSENFEEFNYEPGIFAAQAYDVAWIVVDAMRKTNQKGGQLLLDKILLSNFTGLSGTIQFTDNKLTPAHTFQIINVIGRSYREIGFWSDGLGFSKSLEQSAFYSSTVKELGKVVNPTCAIRLRIGVPSTSTFKQYVNVIQEDSGNDTSFKFEGFAIDLFEETVKKLQGIYHVEYDYLPFNGTTYDELVKKVYWKEYDAVVGDVAIVSTRYEYVSFTQPYTDPGVVMIVPVKSKTGNRAWLFLKPFTKLMWVLILVIIVYNGFVVWLIERNHCAELKGPILHQTTTMLWLAFCSLFSVNGRVATVVWLFVALIITQTYTASLASMLTVEQFEPTVDSIQQLKNSNAMVGYDRGSYLKIYLQDVLGIKAENIKQFDSQKSYADALRNKEIAAAFLDIPEAKIFLAKNCKGFVQAGPTYKIGGYGFVLLQHFFHFFPVFVAE

SEQ ID NO: 222447 - protein, 1135 aa, Glycine max
  Coding DNA Sequence Number=SeqID_105669
  Gene Ontology: Mol. function=nucleic acid binding; Cellular component= beta-galactosidase complex; Biological process=DNA integration
  Homolog annotation: Hit_ID=Q1S0A6; Match level="QueryCoverage=96%, HitCoverage=97%, E-value=0.0, Identity=64%"; Hit description=Zinc finger, CCHC-type; Peptidase aspartic, catalytic; Polynucleotidyl transferase, Ribonuclease H fold
  Pfam annotation: Domain name=zf-CCHC; Domain location=269-286; Score =13.0; E_value=0.0072; Accession=PF00098.13; Description=Zinc knuckle
  Pfam module annotation: Pfam domain module=RVT_2::Retrotrans_gag::zf -CCHC; Domain location=657-912::96-202::269-286
MAEMSEKTEAEKKIDLVKKIPSPYDLNSSDNPGNLITKVQLKGENYGECSRALRTSLRARCKWGFVEGKFPQPKEGSPDLEDWWTVQSMLVSWVLNTIEPSLCSTISYQENIKDLWEDIKERFLVVNGPRIQQIKAELAECRQTKMNMVTYYGKLKSLWDELANYQQIPLCTYGGCKCDVGIKMEKQREEEKVHQFLMGLDDVLYGTVRSNLLATDPLPTLNRVYATLVQEERVRTISRGKEERGEVVGFSAQARGRTKGLAESKDRNMVCLNCNRTGHEAESCFQLIGYPEWWGDRSRGEEKANGRGKGRQRGGAAPSRGRNGGVRANATLTNGETSVAPTNANNALTGLSTEQWQTLVDFLNSQKGNINDKMTGKHSVWIVDTGASSHMTGNLKFLHGLREIAGCPIGLPDGKQVLATKEGTTILGGGLKIKNVLYVPKLNCNLISISQLIDEKNCIVHFTDTLCVMQDRTSKMLIGAEFPFAHTSKERNISSVVSPVVFPLLVGDNDSRSHDQIDIEEEVSPDNGVDMGPTVRGRTNDSDNEASEYSNPNNPSVDPPTLDLVAHNNVEELGRGHRIRMPSVKLHDYVTHIVQKLSPSPSPPSPQHNSGAPYPLIHYVNYDKFFVKHRRFIAALTMEHEPVHFFEAVKDAKWRLAMQQELEALESNGTWTLQPLPDGKKPLGCKWVYKMKHNSDGTIERYKARLVILGNHQVEGIDYTETFAPVVKMVTVRLVLVIAAAKKWEIHQMDVHNAFLHGDLHEDVYMKLPPGFRTSQPGLVCKLRKSLYGLKQAPRCWFAKLSFAFTNFGFQQSSSDHSLFTLLNHGVQLVVLVYVDDLIVCGNDSTTIQKFKVYLSKCFHMKDLGTLKYFLGVEVARNPSGIFLCQRKYTLDIIQETGLLGAKLVSTPLEQNHQLSLATRHLLDQPERYRRLVGRLIYLCFTRPELSYCVHLLSQFMQQPREKHWNAALRIVKYLKGSPGQGILLSSTAKFQLHGWCDSDWAGCPLTRRSTTGWFVFLGHSPISWKTKKQHTVSRSSAEAEYRSMATTTCELKWLKIFHECTKHIEVDCHFIRNEVLQGNVQPSYVPTSEQLADIMMQSYLARALDRRLQVEWAKDAREGPRVLMSLRVDFGPMD

SEQ ID NO: 222448 - protein, 681 aa, Glycine max
  Coding DNA Sequence Number=SeqID_105670
  Gene Ontology: Mol. function=ionotropic glutamate receptor activity; Cellular component=membrane; Biological process=ion transport
  Homolog annotation: Hit_ID=Q5VMN1; Match level="QueryCoverage=93%, HitCoverage=83%, E-value=2e-90, Identity=30%"; Hit description =Putative Avr9/Cf-9 rapidly elicited protein
  Pfam annotation: Domain name=ANF_receptor; Domain location=1-299; Score=101.3; E_value=2.8e-27; Accession=PF01094.18; Description =Receptor family ligand binding region
  Pfam annotation: Domain name=Lig_chan; Domain location=435-646; Score= -5.3; E_value=1.5e-10; Accession=PF00060.17; Description=Ligand-gated ion channel
  Pfam annotation: Domain name=SBP_bac_3; Domain location=343-604; Score=-35.3; E_value=9.8e-06; Accession=PF00497.10; Description =Bacterial extracellular solute-binding proteins, family 3
  Pfam module annotation: Pfam domain module=ANF_receptor::Lig _chan::SBP_bac_3; Domain location=1-299::435-646::343-604
MEYIFLAARDLIDNQKVQAIIGPQTWAETSLVAEVCTQKSIPFLSLADATPEWAMKKWPFLLQSSPRQIMQMKAIAEIVKSWKLYNVSMIYEDGDSSSTEVLSRLSEALTSVGTELSNVLTVPPLVSSSLSQQLEKLREGQCRVLIVHLSFPLALHLFETAKRMDMMGEGNVWITTGTFTSLVHSLNASTISNMQGVIGVKSYIPKLWHQYGNFYHRFRKKFSSENFEEFNYEPGIFATEAYDAATIVVDSMRKTNKKGGQFLLDKILRSNFTGLSGQIQFNGHERAPKHTFQIINVIGSSYREIGFWSDGLGFSKSLDPNASYSSSVKELGKVVNPTCDIRLRIGVPSMSIFKQYANVIQDHSENVTSFKGFAIDLFYETVKKLPYHLEYDYFAFNGTYDELVKQVYLKNYDAVVGDVTIVSTRYEYASFTQPFTDTGLVMVVPVKSKTGGRTWLFMKPFTKLMVAMVVWFFVALIITQIYTASLASMLIVEQFEPTVDSIQQLKNNNAIVGCDRGSYLQRYLQDALGINAENIKQFDSQESHANALRNKKIAAVFLDVPGAKIFLAKYCKGGSPLLPGVNQALLNISESGTLRDLENSMLASEKCKDIIDPGAETTSLSPASFMVLFILTGGTSTTALLIYIFSESYLWPGQRTMWSLMMAERPISDSVDDLLKAVAYY

SEQ ID NO: 222449 - protein, 100 aa, Glycine max
  Coding DNA Sequence Number=SeqID_105671
  Gene Ontology: Mol. function=oxidoreductase activity; Cellular component=cellulose and pectin-containing cell wall; Biological process=lignin catabolic process
  Homolog annotation: Hit_ID=O65449; Match level="QueryCoverage=71%, HitCoverage=13%, E-value=2e-21, Identity=69%"; Hit description =Pectinesterase like protein
MPPRRSQPHNLKGGSCAAHAPACPALLSKLEICIIAPIRIGRNASNLQKSWDVEVVSKLQWGMWCIVGDTIDNIPLLAIDIRARVCEHDGSTQFDQSTVV

SEQ ID NO: 222450 - protein, 64 aa, Glycine max
  Coding DNA Sequence Number=SeqID_105672
MGERWRQFMSDLTLKWALAADKESVDDTVCQKCAEKGTGHLEAKHYPPRVISWGLCIFRKEVDG

SEQ ID NO: 222451 - protein, 35 aa, Glycine max
  Coding DNA Sequence Number=SeqID_105673
MEPNYGDVWMSLLHAGDALTLLDAPGGGNRVVKEF

SEQ ID NO: 222452 - protein, 104 aa, Glycine max
  Coding DNA Sequence Number=SeqID_105674
  Subcellular localization annotation: CTP_CleavageSite=31; ConfidenceScore=5.49e-01
MALKVANYNKLPSPIVSPPSVPIGVAERPLSFMLVSPNARFSKGSVKTPYYSSQHTRDTMMETCLWDFYGGWIFELQWGPLMVIFHHGDAAEDKGKEVRGGAIH

SEQ ID NO: 222453 - protein, 109 aa, Glycine max
  Coding DNA Sequence Number=SeqID_105675
MTRWMTLKNHVLEDSRTQCSDRMIEGVTISTPEKETKASNTKTLCEYKPKRTLLLAKTRKPYSSMLERRIHGDPPIEYWNDLKSALRKRHIPSYYERELMDTKGLDMGV

SEQ ID NO: 222454 - protein, 354 aa, Glycine max
  Coding DNA Sequence Number=SeqID_105676
  Gene Ontology: Mol. function=RNA-directed DNA polymerase activity; Cellular component=chromatin; Biological process=chromatin assembly or disassembly
  Pfam annotation: Domain name=RnaseH; Domain location=75-196; Score= -29.1; E_value=0.03; Accession=PF00075.14; Description=RNase H
  Pfam annotation: Domain name=zf-H2C2; Domain location=272-313; Score =11.5; E_value=0.011; Accession=PF09337.1; Description=His(2)-Cys(2) zinc finger
  Pfam module annotation: Pfam domain module=RnaseH::zf-H2C2; Domain location=75-196::272-313
  Subcellular localization annotation: CTP_CleavageSite=52; ConfidenceScore=5.31e-01
MVQWPTPSSSKDLRSFLGLTGFYRKFIKNYSTMAAPLTSILSNDPFEWSSVAQSAFKQLKQAMSSAPVLALPDFNEPFVLETDASGSGMGAVLTQKGHPLAFFSKQFGPRMLHSSTYVRELHAIVSAVRKWRQYLLGHSFTILTDHKSLRELMSQVVQTPEQHYYLSKLLGFDYTIQYKTGSSNAVADALSRTNTEPSAAMLLLSMPHHDFMEDLKRTLHSNSEFQALLAKVRTQPEDHPDYRVHNDLLFFKNCIWINHDNPYIPTLMLEFHATPLGGHFGVTKTIHKLESSFFWSSLRKDVKRFIRECTVCQQTKTTTQRPAGLLQPLPIPFGAWEDISIDFITHLPQSHGYT

SEQ ID NO: 222455 - protein, 118 aa, Glycine max
  Coding DNA Sequence Number=SeqID_105677
MINFYIVLRLVFFVRHPGWGAPLPVLLAIRPYQFQGMILSLPWMVRPSAMPPFVVVLLAGEGVVEVSPNVPSSVLDKSKHDDGVGCQAGLPSALLTVHATALATVAAPAPQPNLSAPI

SEQ ID NO: 222456 - protein, 194 aa, Glycine max
  Coding DNA Sequence Number=SeqID_105678
MALGDMAARPGELLLQPELLGVQGILAYLACQFHLKEIQKYLHTRSDVEEGAQDLEGLHHGPTIRVKLRGGYIQVHKQSTPKVVQREYQTQNIKKTVVHKKEGWTTQHRPQKGKIFIPASLDDYLVGSLKPIDDRRGRWLHPPTKMRGASTNMARDHQPLRGRGLTIGGSMTCPPDPPGVTESNPRNHYRLYPW

SEQ ID NO: 222457 - protein, 229 aa, Glycine max
  Coding DNA Sequence Number=SeqID_105679
  Gene Ontology: Mol. function=RNA-directed DNA polymerase activity; Cellular component=chromatin; Biological process=chromatin assembly or disassembly
MVSVNVRPYRYPHFQKHEIELQVEMMLQKGLIQPSTSPISSPVILVRKHDGSWRFYVDYRALNVVTVKDRFLIPMIDELLDELGAACCFSKGVEPVASKVTSIQQWPVPQSTRALCSFLDLVGFYRTFIRGYATIAAPLVKATTVDPFQLMTPTHIAFDRLKEALSTALVLALPDFNKPFTLETNASGVGMDVVLSQQGHPIAFFSKPFTSNLLRSSTYVHELCAITMV

SEQ ID NO: 222458 - protein, 72 aa, Glycine max
  Coding DNA Sequence Number=SeqID_105680
MDRLGVVGKKEPDAVSLARTEEEPEAAARKLTEAAFSRGSADNITCIVVQFHHEKAELANPDKAEAASAQHE

SEQ ID NO: 222459 - protein, 48 aa, Glycine max
  Coding DNA Sequence Number=SeqID_105681
MAMIVAASVTHDSGGSKTLSQREIKALKILHQQRKNHLEPLTNGNISS

SEQ ID NO: 222460 - protein, 106 aa, Glycine max
  Coding DNA Sequence Number=SeqID_105682
MGCLLTKGVAVTGPGRLFIKNTCLHKVIHDLGKKIWTSKGEEKEAAKKEFIEALKLLEEQLGDKTYFGGDNIGTYYLFSKHQVFIFANPPSVNTQYEFNKLIIILL

SEQ ID NO: 222461 - protein, 272 aa, Glycine max
  Coding DNA Sequence Number=SeqID_105683
  Gene Ontology: Mol. function=2 iron, 2 sulfur cluster binding; Biological process=aromatic compound metabolic process
  Homolog annotation: Hit_ID=Q7WL43; Match level="QueryCoverage=75%, HitCoverage=48%, E-value=1e-113, Identity=88%"; Hit description =Putative iron-sulfur protein
  Pfam annotation: Domain name=Rieske; Domain location=48-166; Score =61.6; E_value=2.6e-15; Accession=PF00355.16; Description=Rieske [2Fe- 2S] domain
MCCKAIKLGNARVFPVTTLANWSSTAVAAALELVDPPGCRNSIIFKQSSLYVGHQKLVPEVGDWRTLAQENGGRVLVRNQQGVELISNVCRHRQALMLGGQAGDVTGHCNSHGSLKATGGNIVCPLHRWTYNNQGELLGAPQFETTPCMNLQKFRLRDCHGLLFEGPRDPAADMAPLFARPEFDFGDYVLDHVEVHQCNYNWKTFIEVYLEDYHVGPFHPGLGRFVTCDDLTWEFNDWYSLQKVGVHNASSLSIPSTSRGGPVPAFVPFSEG

SEQ ID NO: 222462 - protein, 266 aa, Glycine max
  Coding DNA Sequence Number=SeqID_105684
  Homolog annotation: Hit_ID=Q8ZPT9; Match level="QueryCoverage=35%, HitCoverage=20%, E-value=9e-30, Identity=72%"; Hit description =Kinase-like protein
MLAVMVAPTVGINPFDPVWIATLVGIVTLSSAGVAGVGGGATFAALIVLPAMGLPVTLVALLISIEPLIDMGRTALNVNGSMTAGSLTSRWLGMTDKKAAKPAVFFAVFCTFFRNHGANVRKTLSMANAAGSYRRRTLMRNVIASMLALTLIAPTVSFAHPYGWGPGPGPHWGGPGPRWGHPGPLRFLPEAATAVLIGGLTYYLLNGSYYQRQGDTYVVVQPPDGPPASAMRVLDYNGKRYYVQDGHYYQREISGSYIEVPRPYGL

SEQ ID NO: 222463 - protein, 131 aa, Glycine max
  Coding DNA Sequence Number=SeqID_105685
  Gene Ontology: Mol. function=2-C-methyl-D-erythritol 2,4 -cyclodiphosphate synthase activity; Biological process=terpenoid biosynthetic process
  Homolog annotation: Hit_ID=Q681X6; Match level="QueryCoverage=98%, HitCoverage=40%, E-value=3e-18, Identity=36%"; Hit description=MRNA, complete cds, clone: RAFL21-92-C23
MEQQDMADTTTLSYWLNWRFYLCAVCVLLSIVLSFLVIWKDKGSRKFRSGKGENQEDGTLSGDEAWKPFLKEIHPVCLLAFRVIAFSSLLASLVAKIHINGRAIFFYYTQWTFTLVTIYFGVWLVIFLGGL

SEQ ID NO: 222464 - protein, 297 aa, Glycine max
  Coding DNA Sequence Number=SeqID_105686
  Homolog annotation: Hit_ID=Q08112; Match level="QueryCoverage=23%, HitCoverage=46%, E-value=3e-25, Identity=81%"; Hit description=40S ribosomal protein S15-1
  Pfam annotation: Domain name=Ribosomal_S19; Domain location=169-250; Score=102.0; E_value=1.7e-27; Accession=PF00203.11; Description =Ribosomal protein S19
MAVNSNVKPAPNFDKDTHFNAQPYEELLSRLGIKHLITFVKHPQTNDYAEAANKKKSKRWPGSRKKLPSSASQEDITPKFGLAPFSLVVVSLDNEAYKLQELDGKEILRRTNILLVKSPKARQTQGLSLVNLAKPRTNVFLVNSPKDRQTQGMSLLVLTKPRTNVFLAESSKASQTQGSSLLRKVKREAPASEKPKPVRTHLCNMIIVPEINDSTIGVYHDKTFNQVEIKPEMIGHYFTEFSISYKPVKHGMSYQMRRITLVVPRRGQIQFQHNPKQAVCEIQITNSQHNRLMQEGK

SEQ ID NO: 222465 - protein, 34 aa, Glycine max
  Coding DNA Sequence Number=SeqID_105687
MESNDLHGGDFVEFLRLMNEGEPTKGTPTLKLLD

SEQ ID NO: 222466 - protein, 417 aa, Glycine max
  Coding DNA Sequence Number=SeqID_105688
MVRDFDILCSFFNIRPSVHVLMYFFQMKLIERRVASIIFPSTSNRTLKGIMSDFEWHPLVKQVEPVDDVLPPPTSVNEPSKGGGDPINARINYCQEETWRKGWGDQTTQEVKGSLYSLASSSSCPSSILPKTPNPRSPPSTPSIVQTTATTVNAYNPLAPPPLSTLVVSVSLPYTLVTFAPTPVVLASISSLAPPLLSVGLTKVQNSNGATKVFLQKSLAILEESENKHKEAMDIIASLERVKRPKVADVTVAFVEAIKSNHQLSFREFGHYKDALKENDDLAGEVKRSARERETLDVTMAEFARVIANLQAQLRDSELTTSNLQAKLKKFELEVAREKEANKELNDELIMFKKEPVQQHEKGFFKVVRYEGLFSKGLDLNLFDLFKDVKDGKLLDEDEITAIEESNGGEEDDRVDV

SEQ ID NO: 222467 - protein, 66 aa, Glycine max
  Coding DNA Sequence Number=SeqID_105689
MTIWKQRAKLVMATTRWVLKHPVYGIVILRLGMYTSPNYVLSSDDVPKGKLYKVPEFQQTLSTITK

SEQ ID NO: 222468 - protein, 121 aa, Glycine max
  Coding DNA Sequence Number=SeqID_105690
MGWGGFIPGFRNNLPEEPFRKAIPKCLFQKAIQEYLEVPKRIPLSLYEFIFIFTMLLTYLIVQMAHTKRLVLMVMMTMTGAIDQQCLNRGNQPVQVEPLKHIDQVHAVQEVEHAEHMQPMD

SEQ ID NO: 222469 - protein, 118 aa, Glycine max
  Coding DNA Sequence Number=SeqID_105691
MKERGGSRDLPIKPKEKGDEAGGRARVGRWGGGRCTARKGIGWIMREGEVRIGVSLRQNFLLLRHPDVAQCGAYRPWIFFINGVLCFLKINGSGMEKEERRLEMPLQGEDESRTSSPP

SEQ ID NO: 222470 - protein, 116 aa, Glycine max
  Coding DNA Sequence Number=SeqID_105692
  Subcellular localization annotation: CTP_CleavageSite=38; ConfidenceScore=5.38e-01
MNKGPIAKTDGPNSNVKTDGRSPNTICLGTKTPNTELRVVIVSSLFFDPLAASAALRVERSTEAVELRWRNLTTPAAVICNFGSEKCCYRRDGQVRRYDPWRSGRVPRCRAAIAHY

SEQ ID NO: 222471 - protein, 761 aa, Glycine max
  Coding DNA Sequence Number=SeqID_105693
  Gene Ontology: Mol. function=heat shock protein binding; Cellular component=integral to membrane; Biological process=protein folding
  Homolog annotation: Hit_ID=Q94H83; Match level="QueryCoverage=93%, HitCoverage=98%, E-value=1e-163, Identity=43%"; Hit description =Putative heat shock protein
  Pfam annotation: Domain name=DnaJ; Domain location=66-127; Score =103.9; E_value=4.9e-28; Accession=PF00226.21; Description=DnaJ domain
MECNKDEAARVKEIAERKFTEREYAGAKKFALKALNLFPALEGLSQLLTTLDVYICAENKIHGEMDWYGILGVYPYADEETVRKQYRKLALTLHPDKNKSPGAEGAFKLVSEAWSLLSDKVKRLAYNQNRRLEGFQDNAPNKNGYIKLNKNATSSMRTGNNDARAHPHPHTPSIPPPHTNAGTFWTICNKCKTHYEYLRTYLNQTLLCPNCKQAFVAIEKGPPPNVFKSSNWSSRQHHQKSSRQHSNVGRNHPVNPGRTGAVSQNLQSSGFSKPNFQWGPHSRMAGFVKKDGSSSVSAANVKQQSSETKRECEGVQSIAAWERNHMHKRSDVPFSNAEKPMKKMRTDDMYNTNHMTMRDGSSSLGHFYGSGKANVGAERIHVFSGTYKHYSTKELSLFELRNMLVDKAQTEIREKLLEWRSMAEARITNKDKGNERQKSTFNDKTTGPEKDSTINGNRHVDSDSIPVKSDDTEKEKAAYVTINVPDPDFHNFDLDRTENSFAEDQVWAAYDDDDGMPRYYARIHKVISTKPFRMRISWLNSRSNSELGPIDWVGAGFYKTCGDFRTGRHEITESLNSFSHKVRWTKGTRGVVRIFPGKGEVWALYRNWSPDWNENTPDEVIHKYDMVEVVEDFNEEEGLLVTPLVKVDGFRTVFHRRSHDQARKIPKVEIFQFSHQVPNYLLTGQEAHNAPKGCRELDPAATPLDLLQTTAEEALDNVGKSKEDTYPGSPENHAAGKGENASKPTREDMLDEDGKQVKYDR

SEQ ID NO: 222472 - protein, 83 aa, Glycine max
  Coding DNA Sequence Number=SeqID_105694
MVGQLAIPPFGAVGEARMFKPLNFSRLFWLTKSEAGLNGQGQPIFPSLNPSIVFYQATFDSKQIDRFVEEGAHRCIKCKSLPL

SEQ ID NO: 222473 - protein, 58 aa, Glycine max
  Coding DNA Sequence Number=SeqID_105695
MARIPDKIKSIDGSKETLKLAVRITDLWFVGTPNKSEQVEMVFVDSEGDQIHVVCKPD

SEQ ID NO: 222474 - protein, 186 aa, Glycine max
  Coding DNA Sequence Number=SeqID_105696
MKKAPHEIVVVIKRQVDAIVVSANMYDELYLVHDALKKVAVGGVFRTVVGEFYLPLLQKSSSALSSLLRCGLSILALALLGIKGYINFIVESDSLNVVNLISKGCDFHHPCATCIIKSIVIFLEELIPWPDNTFIFKAGIQAAEEHPVYIGLFLLSRCVDGNEVLICQMSVDPVEVAPLYLNWTAS

SEQ ID NO: 222475 - protein, 53 aa, Glycine max
  Coding DNA Sequence Number=SeqID_105697
MHFGQAIRIYRRQIHCRQCFDRNSNHSLSQMQNERWIMMGVNDKVGPIVPGRG

SEQ ID NO: 222476 - protein, 61 aa, Glycine max
  Coding DNA Sequence Number=SeqID_105698
MATHSAGTTSPSGNTPSWYGHVGLAHGAGETTIHVKFSFSGLQASALHCLGMQQHCLGMQS

SEQ ID NO: 222477 - protein, 196 aa, Glycine max
  Coding DNA Sequence Number=SeqID_105699
MDNRDTIEVPSFYHKQCVPEYPDFVQFRYDEATYQIRLRQHQQKVFFAEGLKHLRKDLGIFESMTINFFACDDKSTFDLHFTPSLDQQTCGRPRLSLREHVWTLEITQSILGAPKPLKLPPVAIRHVNACGQHMIILRRFGPPLQWHVVVLDIGIGENYVVQPWYQFLGDSDFSHGDEISFYYRRREKIWEVVIRH

SEQ ID NO: 222478 - protein, 72 aa, Glycine max
  Coding DNA Sequence Number=SeqID_105700
MEKMSLNSWQHSSEYWLFPKCRKSGCLKNKCCLQKKWWSGVVESWSIECWFCRLDVKRQLNHCECISGGGSR

SEQ ID NO: 222479 - protein, 68 aa, Glycine max
  Coding DNA Sequence Number=SeqID_105701
DSIWYFDSDCSKHMMGDKSKLSDFVSKDEEYIIKIDDSWLWHRMAAHINMPHLNHLVGKDFVIGLPKL

SEQ ID NO: 222480 - protein, 44 aa, Glycine max
  Coding DNA Sequence Number=SeqID_105702
MSAFQYSMQQRSETDSISNDRSYSVQLPVHSSLSLLAVSSTRLW

SEQ ID NO: 222481 - protein, 311 aa, Glycine max
  Coding DNA Sequence Number=SeqID_105703
  Gene Ontology: Mol. function=oxidoreductase activity
  Homolog annotation: Hit_ID=Q20Z18; Match level="QueryCoverage=99%, HitCoverage=99%, E-value=2e-68, Identity=47%"; Hit description =Alcohol dehydrogenase, zinc-binding
  Pfam annotation: Domain name=ADH_N; Domain location=25-100; Score= -9.0; E_value=0.0043; Accession=PF08240.2; Description=Alcohol dehydrogenase GroES-like domain
  Pfam annotation: Domain name=ADH_zinc_N; Domain location=131-272; Score=45.3; E_value=2e-10; Accession=PF00107.16; Description=Zinc -binding dehydrogenase
  Pfam module annotation: Pfam domain module=ADH_N::ADH_zinc_N; Domain location=25-100::131-272
MKAAIVSAAGEKPVWGDFPPPQADEQHVVVTVKAAAISQLAKARAAGAHYSAGSHYPFIAGIDGTGTLSNGDPVYFLAFSAPWGSMAQQTRVPAAAVVALPPTLDPLLAAAIANPGMSSWAALTRRAQFQAGETVLINGATGTSGGLAVRIARHLGAGKIIATGRNRAVLEQLRTQGADIILTLDELPGALPALMRQGIDVVLDYLWGQSALDIMHAAVAGGEKTVRFVQIGSLSGQEIALHSKLLRSSGLTLMGSGLGSVSDSELIACIGEMLNAAAESDFSIAFQQRPLSEVEQAWQQDDSRCRTVFTL

SEQ ID NO: 222482 - protein, 591 aa, Glycine max
  Coding DNA Sequence Number=SeqID_105704
  Homolog annotation: Hit_ID=Q9LSM1; Match level="QueryCoverage=99%, HitCoverage=100%, E-value=1e-74, Identity=42%"; Hit description =Arabidopsis thaliana genomic DNA, chromosome 5, TAC clone:K21L13
MALLGEGGRGYELARKLDTCGVWRTWLGDATYANFAPFLSSPSAWDSFITSTTHIPLQLRVRALLFDKATVSLSLNPNPNPNPISYLQRLNPIYLQLHADDVYFTLDADSKVLQTLPLHHSLSISFSVFTFCSFNLMQNQSKPSSSTGSRYVESQLPETWYNQVIEKYKANKNLVSGESRSPADMASYITYVTNHKKRRVAFKEDVTDHALQPNGGGSFVADDDCAVFPEIAYALNCVPDSALPLSDRVESSSNQKVKVLSVLDTLPPIAATRSSVMMERLGVRPEHGSVEHGGGLSRGKFGAEGNGKVIGPEQAAKLSQKAVARILLGVGFEGAMEGSVEDFSEVLSGRICKIGTNLRVLADSYKKQCSAIELLKMLLKTVGFSNFAPLVDVVKDGSKNNVHQSQQQVHGMQPQLQQQQQSSLRLPQQVQMQRQMHPQMQQMIHSQNMAFHQQQHQQQPQQQQLERMRRRAAAAATPRPAMDIDKERPVVQVKIENQDLPLDGNAFTSRHPQMQQFRQQQQIAAMSNFHPQSGTQFRQMGSLQIPSIQSPNISMVRAPPVKVEGFSELMGGDSTSKHDLEENRLTSPNGK

SEQ ID NO: 222483 - protein, 137 aa, Glycine max
  Coding DNA Sequence Number=SeqID_105705
  Homolog annotation: Hit_ID=Q8S9A7; Match level="QueryCoverage=43%, HitCoverage=12%, E-value=3e-11, Identity=50%"; Hit description =Glucosyltransferase-2
MDRAITGIPGIENVHSCRDLSSFCQGTESDIAFPMNSVVLETRESLRARALVLNTFEDLEECCPPTSSLEFLGLGELELRHVAVSFCIFGTTKVVDDMVNDLMAALTYKTVSSGGSSYVCMDHLFQYNNNVSTSQKN

SEQ ID NO: 222484 - protein, 67 aa, Glycine max
  Coding DNA Sequence Number=SeqID_105706
MKVQNAAIKAVKKDHHAAVKAAKNGKNKGAECCNEGSSTVSEVVTGQNTEDGIPDTMQKERLERKEG

SEQ ID NO: 222485 - protein, 68 aa, Glycine max
  Coding DNA Sequence Number=SeqID_105707
MRRGAAGGVSCKSVKRWGRREREGSLENGAKEAMKINQLKLLIPNVLKVLFHPSILKDRIMTWQTTNN

SEQ ID NO: 222486 - protein, 487 aa, Glycine max
  Coding DNA Sequence Number=SeqID_105708
  Gene Ontology: Mol. function=RNA-directed DNA polymerase activity; Biological process=RNA-dependent DNA replication
  Homolog annotation: Hit_ID=Q2HRL0; Match level="QueryCoverage=23%, HitCoverage=20%, E-value=6e-30, Identity=46%"; Hit description=RNA -processing protein, HAT helix
ERSKEVETPKDVLKGNQEVKRLWVDVISENRNPAKGRIMSYVAPKMVEGQIEIEIEDEDIESEIRYWENALILYVLGGDLSMNTIKNFMERNWNFVQLPDLYYHDDGYFLLRFKSHDDMEVVVMKGPYTIRSMPVVLKEWRPDFSLKQDMLRTIQIWIKLPKLPLYLWGERSLNKIGSAIGTPMVTDECTTHKLRVSYARMLVEVDITRKLVEEITIKDKDGRKMMQPIEYEWRPKFCDKCQKIGHQCGNRVKKKKWQPKPQQERKHEIPVEVSTPRKETTTSKANGDEGKTWIRTTEDDEETWTKVSKASKDTGFEWPPSLRSGTMIASWNVKGLNKAGKLREISSRLLELQPEIAILIETRVKENKATKVREKLRLNGNYLDNYTCHENGRLWIHWDLNRVDVKCASRTSQLIHCGVYDVTGNFKFWLTAIYASNALDRRKILWKDIKKIHETHQGAWCVVGDYNNVAKAQDRIGGKMVTAAVHN

SEQ ID NO: 222487 - protein, 245 aa, Glycine max
  Coding DNA Sequence Number=SeqID_105709
  Gene Ontology: Mol. function=protein serine/threonine kinase activity; Cellular component=cytoplasm; Biological process=protein amino acid phosphorylation
  Homolog annotation: Hit_ID=Q9LSM2; Match level="QueryCoverage=94%, HitCoverage=52%, E-value=5e-71, Identity=58%"; Hit description =Similarity to lectin-like protein kinase
  Pfam annotation: Domain name=Pkinase; Domain location=4-197; Score= -89.5; E_value=0.0032; Accession=PF00069.15; Description=Protein kinase domain
  Pfam annotation: Domain name=Pkinase_Tyr; Domain location=1-197; Score=-133.4; E_value=0.00028; Accession=PF07714.7; Description =Protein tyrosine kinase
  Pfam module annotation: Pfam domain module=Pkinase::Pkinase_Tyr; Domain location=4-197::1-197
MANKEMFNMSGSECLDWKIRSKVAVGVADGLVYLHKECPRRIIHRDIKASNILLNENYEAEGRKIIGAVINFRYQILDWQSGSQLKHCLHQIIGCRYLAPEYFMHGVVDEKTDVFAYGVLLLELITGRRAVDSDSRQSLVIWAKPLLDTNNVKDLADPRLGEEYDPIEMKRAMVTASRCVHHVSSKRPYMNQVVQLLKGEETIMEPKKTLVAQKSLMLEACDLEEDYTCSSYLKDLNRHRQLIME

SEQ ID NO: 222488 - protein, 515 aa, Glycine max
  Coding DNA Sequence Number=SeqID_105710
MVMKQRDEELSLFLELRRREKENEKNNLVLLQNSEELHLSNLESNDGGSMISKIVSSVPPRKNEVEEFLNSEIDKSDYEWLLAPPDAPLFPTLEKESQISVKSEQETRNARPTALKPRVANIQADPALRSNVVSKHHASMPGLGSSTNGSRRPSSSGGLTPATSRSSTPSGRPTLPSTTKSSRPSTPTSRATLPSAKSTAPPVRSSTPTRSTARSSTPTARPSLAPPKTSQRSATPTLRSSTPSRAFGASAPPTRPSSASKARPGPLVAKNPVQSRGSSPSVRSRPWEPSQMPGFSLDAPPNLKTSLSDRPASATRTRPGAPNSRSSSVDASSNAKSRRQASTPSKGRTSTGLVHNNHTSMQVLSRARFTDGDDESPVMIGTKMVERVVNMRKLAPPKHEDHHSSRENSYGKSSSGSSGFGTTLSKKSLDMAMRHMDIRRSFQGNMRPLVTSIPASSMYSVRSGSSSKSRTVSASDSPLATSSTTSSEPSVNNSSISYDGSEAEENDFASEKGNS

SEQ ID NO: 222489 - protein, 44 aa, Glycine max
  Coding DNA Sequence Number=SeqID_105711
MSAFYRKQKCDINARGWTSLAIHGGVASVHPYDVHSQIYTRTKV

SEQ ID NO: 222490 - protein, 48 aa, Glycine max
  Coding DNA Sequence Number=SeqID_105712
MGTNRGLAVLEEHRACSSTGHSENAKLQEVFLISLNVAVVNFFRRMLT

SEQ ID NO: 222491 - protein, 756 aa, Glycine max
  Coding DNA Sequence Number=SeqID_105713
  Gene Ontology: Mol. function=ubiquitin-protein ligase activity; Cellular component=ubiquitin ligase complex; Biological process =protein amino acid phosphorylation
  Homolog annotation: Hit_ID=Q9FGD7; Match level="QueryCoverage=98%, HitCoverage=96%, E-value=0.0, Identity=48%"; Hit description =Similarity to receptor-like kinase
  Pfam annotation: Domain name=Pkinase; Domain location=419-652; Score=- 64.1; E_value=9.6e-05; Accession=PF00069.15; Description=Protein kinase domain
  Pfam annotation: Domain name=Pkinase_Tyr; Domain location=422-652; Score=-27.4; E_value=8.6e-11; Accession=PF07714.7; Description =Protein tyrosine kinase
  Pfam annotation: Domain name=U-box; Domain location=683-756; Score =52.3; E_value=1.6e-12; Accession=PF04564.6; Description=U-box domain
  Pfam module annotation: Pfam domain module=Pkinase::Pkinase_Tyr::U -box; Domain location=419-652::422-652::683-756
MDAIQTEKIYVAVGNDVQDGLKTLNWALKKWNSHPISIAVLHVTHNSTKDYVYTPFGKLPARSVSEEKLQILRKDEQDKINKLLSKYIAFCGKVPAEILEVEKFDEPMQKRVIDLIFGLGITKLVMGFSFMKPSMKSKGAISGLFYVHQHKPSFCELFIICGGKQVFLRGKNDEKIMEDDRGVMSARMRDKEIEKYYQELLSSNLEEGNCVLENDDSQIGPIEPHVTEHNNYDMSAADKIEILKNKLNEAQKIIQLKRKEAKDNIERHTKAEWAICLCNSRAEELESRIREEASAREELKKESDAEKEQTVEMKTELEERKRSLRSLTEVQSELSNRLQIWTLAKTRAETQLEKAVGERSEMVREIEELRRQRDVFNRRIEFCKEKDAIGMAASLAEMTCCAFREYTEEELRLATDNFSDRLRFKSGGDWTNVYRGRFNHSSVAIKMLPSLSHQHFQSKVRLLGDIRQPHLVAMVGFCSEPKCIVLEYMGNGSLRDMLFSRRRNRVLRWHDRIRIATEVCSGLGFLNAAELRPAIHCHLSSSKILLDRNLVAKITGFGLLECHDEQCNVESDLQAIGVLLIHLLTGRNWAGLVEEVMTVDMDRKALGSVLDEMAGQWPLDLARELAALAMRCMSIKAKPNSELSIARVLEELNEIRRNGDEIVEREGPKTIIGGCIDRAGSSDMPSVFLCPILQEAMTNPHVAADGFSYELEAIEHWLQSGRDTSPMTNLRLKHTFLTPNHTLRSLIQDWQTNKST

SEQ ID NO: 222492 - protein, 93 aa, Glycine max
  Coding DNA Sequence Number=SeqID_105714
  Gene Ontology: Mol. function=isomerase activity; Cellular component =nucleus; Biological process=biological_process
  Homolog annotation: Hit_ID=Q851S2; Match level="QueryCoverage=70%, HitCoverage=51%, E-value=1e-25, Identity=81%"; Hit description =Putative zinc binding protein
  Pfam annotation: Domain name=Yippee; Domain location=2-76; Score =50.0; E_value=7.8e-12; Accession=PF03226.5; Description=Yippee putative zinc-binding protein
MTFQLYLNGPAPCPSVNVTVGEKEERMMITGLHTVVDIFCVVCGSIVGWRYEAAHEKTQKYKEGKFILERFKVLGPDGSLYLAAQAAGSDADD

SEQ ID NO: 222493 - protein, 251 aa, Glycine max
  Coding DNA Sequence Number=SeqID_105715
  Gene Ontology: Mol. function=RNA-directed DNA polymerase activity; Biological process=RNA-dependent DNA replication
MERVWWYTGKERVLGGGEGKTKLRGRGGVENINIEVLGLVNLKQKQIEEEINDQDVLEERGSLCEVDFNRRLEQQKDFWRVWLKERDCNSKIFHSIMNWKRRKMFFKGLQVEGSWVEEPSMVKMEVKKYFERRFLEDFEDRLKLDGIEINHLSSKDNLMLTSFFKEGEIKEAICDCGSQKSHCLNGYTFLFIKEFWELLKGDIMRFLRNFILMVVLLECDITCVVSYELYNNPTSVYLRKKVYGRAVKWKV

SEQ ID NO: 222494 - protein, 258 aa, Glycine max
  Coding DNA Sequence Number=SeqID_105716
  Gene Ontology: Mol. function=zinc ion binding; Cellular component =integral to membrane
  Homolog annotation: Hit_ID=Q8L8R1; Match level="QueryCoverage=85%, HitCoverage=91%, E-value=4e-88, Identity=67%"; Hit description=RNA -binding protein-like protein
  Pfam annotation: Domain name=zf-C3HC4; Domain location=163-200; Score= 15.3; E_value=0.0041; Accession=PF00097.15; Description=Zinc finger, C3HC4 type (RING finger)
MGFGLNRRTKRREEQGEGKMRKSFKDSLKALEADIQFANTLASEYPSGGACFQLRLSYSPAAQFFLFLVQWTDCHLAGALGFIRILIYKAYEDGKTTMSIYERKASLREFYGVVFPSLLQLHRGITDVDDRKQKHLCATKYKLKDLTSKGNLSEIDMERELECGICLEINSKVVLPNCNHSMCMKCYEDWHARSQSCPFCRDSLKRVNTDDLWIYISSSEINDLASINKENFKRLFMYIESLPLTARPYMHHAIYHHH

SEQ ID NO: 222495 - protein, 202 aa, Glycine max
  Coding DNA Sequence Number=SeqID_105717
  Gene Ontology: Mol. function=transporter activity; Cellular component= integral to membrane; Biological process=transport
  Homolog annotation: Hit_ID=Q6SZ87; Match level="QueryCoverage=98%, HitCoverage=25%, E-value=4e-16, Identity=31%"; Hit description =Nucleobase-ascorbate transporter 11
  Subcellular localization annotation: CTP_CleavageSite=44; ConfidenceScore=5.03e-01
METGSNSESLNRNVAMSVRGSTGKKKQQGGVTLAGKKVDPFVPRSEHNPRELRSWAKRTGFVSDYSGEAGSSGSAKFEALERRGGGSSPKIEIDPVVGRTRQNEIEQETHGGAMRGENGAVLDGRGRKEKENEGCERKVGFNGNGNGHGVSAVAPVNEEKEGEEGNGDVKVSVLHEGEEVADGGWQGPLGLKCGLKENPGIG

SEQ ID NO: 222496 - protein, 961 aa, Glycine max
  Coding DNA Sequence Number=SeqID_105718
  Gene Ontology: Mol. function=kinase activity; Cellular component =proton-transporting two-sector ATPase complex; Biological process =ATP synthesis coupled proton transport
  Homolog annotation: Hit_ID=Q94CG5; Match level="QueryCoverage=99%, HitCoverage=96%, E-value=1e-173, Identity=37%"; Hit description =Kinase interacting protein 1
  Pfam annotation: Domain name=KIP1; Domain location=1-52; Score=80.5; E_value=5.3e-21; Accession=PF07765.3; Description=KIP1-like protein
MEEKVQTVLKLLEEEGDSFAKRAEMYYKRRPELISFVEESFKAYRALAERYDHISTELQNANNTIASVFPDRVPFMDEDEDDGSPRPSRKKAEGFKTNIPKPPVKDLKSVITTAAATRRLHSKKPAATATSAAPKVPKSGLSRKAALEEVDKLQKQILALQTVKEFVKNSYDNSVAKYWETDEQIKELQERVSILQDELGEGVDIEDDEARRLMAEAALKSCQEALTQLQEKQEKSLDETRIESKRVKDVNSMLGSLMEEFHYDQNNSEKPRVQRDLKEIAETKDLEENARLTQKKQELQLLKENIKEHFETSSNSSLSVAEMAEQIDELVNKVIRLETAVSSQSVMVKRLTTDTDELHEQIRTLENDKESLIKDKNKLNDQLRKLEEKMHGVQDLNQTIEDQNSNLQTQFNEALSNLDHLSEKVQNVQPGEEAKTTDLSHTQKDSSTQAELKIKSEGQVPLNQDNMLLNDKEITNGLVEDDATDKELKVAGTVEDDATSDNKPEVTGSPSASEPNVTGSLENDAKSANEVKVTSSLEMDEATPVENKSPKELEKQEKTVHPGNDDEKATVSMSTTTEKQDVSQHLASNKADSSSESSEKQQENDDKQSSREIENVLKVDPKGQATAQEDEPDWRQLFTSGMQDREQVLLTEYTNTLRNYKEVKKRLTEIEKKNQDNNSDSSLQLNELKTSNAMKDEEIRLLRQKLGLQQRSMEGNEDFTEELLQIELPESTSLIEEKFRSNMDEILEENLTFWLKFSAYYSEIQKFETTIKDLLTELSKLEEREKSSEGSSSIKYSIKSDSRPIYKHLTEIQSEITVWMEKGALLKEELQSRFSSLCDIQEEITTELKSSAEDDDFRFTSYQAAKFQGEILNMKQENNKVADELQTGLDGVTSLQLEIEKALVKLNDKFGFSASKRQQNGQLRQSETRAKVPLRSFIFGAKPKKQSIFSCMTPGMHRKYR

SEQ ID NO: 222497 - protein, 657 aa, Glycine max
  Coding DNA Sequence Number=SeqID_105719
  Gene Ontology: Mol. function=transcription coactivator activity; Cellular component=cytosol; Biological process=transcription from RNA polymerase II promoter
  Homolog annotation: Hit_ID=Q949K3; Match level="QueryCoverage=97%, HitCoverage=97%, E-value=0.0, Identity=55%"; Hit description =Suppressor-like protein
  Pfam annotation: Domain name=SGT1; Domain location=19-652; Score =869.8; E_value=1.3e-258; Accession=PF07093.2; Description=SGT1 protein
MEFPSSSSIFSPRPSDDTVFYAIYPDSPTTTSTATLRSLHLKILETLSPFTEDYIWQHQPFTLSVSTPPNPSCPCPSSSSHLLHLHGRLRFGDNLDDEWFAVFLLFRISQRFPSLSIRIWDSDGDFLLIEAAFHLPRWLNPDTAHHRLFLRNGSLHIVPRNRLTNPSLIDSLNFVASSPHESLASDAIQRAIKKRISNYPEQARNNMHRVRVRVPVSAASILKHEPRLISLAVEGFYDRDIDTMKFAARMERFVERGKTEELVCVSVKMSRAMYAQLAQQRFQAPKCYPEMPARSEREGFAEAELGMKIACGLEMMYQQRKRDGEEGKGSSWEAFRKSLENSGYFQGQLPGSSEYQRLMQSAQEYYRSTSLHSKASDLLNAPVRRIDEILALPHSVDDFKDQEVPPSDDDSWLYGGEEELNSVLMERQKEMELYDLKHKKKGKAKEGQDAGPSSASNADEFDPSDIAKTMQAFVHKLSSYKGAEAPEDRNKEVNLDVDQFIKDMESIMMHSDGEVANSNIEEGSSSDLDFGSKLFMSSRLGLPDGKLINSLVVWDSDNSDDSDIVELDEDNEDREDIFMRSYSDAMNEELKATTLQKSFVRANEQIPKKDQGTSNASEHIMDEDFSPVDVDQGLPGPASNLLGLMGVQLPQDGKKGK

SEQ ID NO: 222498 - protein, 178 aa, Glycine max
  Coding DNA Sequence Number=SeqID_105720
WLWGSSKEKEPVSSGSTLNSSSEWSFKERETVKFPSVKGTKIAPSHRKVKRKWQSREERRHDREYDVVLVPSDGDGCLSSSESDDSDFSIGWLEPHGSDFLQSDDDLDNSFAVLVPCYRKEVSSSNKELLSVIKNLPNEFSSVGLAFLMILMLMRKCLSLSDANALLSNYKCNGNWGQ

SEQ ID NO: 222499 - protein, 146 aa, Glycine max
  Coding DNA Sequence Number=SeqID_105721
MAIALAKRVTLLTRVDKLAAHASHDWGNGHPRQQLWTVIISLTTESTSKEDEVLSDWVWFSVYPEKEAEEGRRRRRLESERGIIGELGCRIDSLSICIVSPVFFLSPEKTIAPISSAFCFRYHSRLKGSVFPARSVGFSGDSLVVN

SEQ ID NO: 222500 - protein, 88 aa, Glycine max
  Coding DNA Sequence Number=SeqID_105722
MVSILIVVLVGRVGLQPSGWGFRVRGCGFDLREWNLLQLRCIPCSEFGDLVGQQQEDEEMLVPHTDLAENNHQPMEVVAQPDAANTVE

SEQ ID NO: 222501 - protein, 156 aa, Glycine max
  Coding DNA Sequence Number=SeqID_105723
  Subcellular localization annotation: CTP_CleavageSite=50; ConfidenceScore=5.43e-01
MVGNVCLFLLKTSAASLTWPYLQSVSSKTQMSSGVVLVYEKASCRGRRVRLGAGWGEVALVHFDDELPCTSNWRILAMGFGAVEEGEGDLGVVFEAEEGGGGASRPVRRRFRREVTAVGGSRSGGGVALTGFGKRHDGVASNLEVQYIRCRNAEES

SEQ ID NO: 222502 - protein, 138 aa, Glycine max
  Coding DNA Sequence Number=SeqID_105724
  Subcellular localization annotation: CTP_CleavageSite=56; ConfidenceScore=5.42e-01
MDQSHLTPTPSTFLTLIRRLICARLTRQAVRAFHDTTPSHKPKRRPKTSASCSTRSASMATSDSPPRKVSLHPEMFERTIRNAEEVFDQMRESGIEPEPRAYAAARAGSAEVDEGERDMSQCGDVHFGNQVSGLVRVA

SEQ ID NO: 222503 - protein, 758 aa, Glycine max
  Coding DNA Sequence Number=SeqID_105725
  Gene Ontology: Mol. function=protein serine/threonine kinase activity; Cellular component=cytoplasm; Biological process=protein amino acid phosphorylation
  Homolog annotation: Hit_ID=Q5CB53; Match level="QueryCoverage=90%, HitCoverage=99%, E-value=0.0, Identity=60%"; Hit description =Hypothetical protein bTSL
  Pfam annotation: Domain name=Pkinase; Domain location=394-680; Score =200.5; E_value=4e-57; Accession=PF00069.15; Description=Protein kinase domain
  Pfam annotation: Domain name=Pkinase_Tyr; Domain location=394-678; Score=-19.2; E_value=2.7e-11; Accession=PF07714.7; Description =Protein tyrosine kinase
  Pfam module annotation: Pfam domain module=Pkinase::Pkinase_Tyr; Domain location=394-680::394-678
  Subcellular localization annotation: CTP_CleavageSite=53; ConfidenceScore=5.50e-01
MSDDMLIHFSSNSSNQSDQSLPTKIAKLEARMVGKGSSTTAQQSGWSSVSVPSAGKLGGAAENLAEPSTSSDSDDDNGGEFLIQANTQKRQKFQEDGSASVFERVEVVTDARQTSLETMETKINVDANRKKHGRGRGSSGSGRGRGSRVTDQTKTQISPPTVLASNGQIESVYHKEDVASLEAKVVALEEELRKSKQETADYQNLYRQLEKELKELNDHEQQMKPKRMKIISDLLISVSKAERQEARLKVRQDSLRLGNVGVISSIMNCRAGTVISETWEDGQALKDLNAQLKQLIETKEAIERQRKLFKKKQSDKSDGIDAEAGLPEDILIHDEIYKSRLASLKRENVQEEEIIFRERERYEIEKGRLIREMKRIRDEDGSRFNNFQILNHRYALLNLLGKGGFSEVYKVRSELSKIRNFQQAFDLVEHRYVACKLHGLNAQWSEEKKQSYIRHAIREYNIHKTLVHRHIVRLWDIFEIDQNTFCTVLEHCSGKDLDAVLKATPVLPEREAKVIIVQIFQGLIYMNKRTQKIIHYDLKPGNVLFDELGVAKVTDFGLSKIVEDDVGSQGMELTSQGAGTYWYLPPECFELSKTPLISSKVDVWSAGILYYQMLFGRRPFGHDQTQERILREDTIIKARKVEFPSRPTISNEAKDFIRRCLTYNQAERPDVLTIAQDPYLTFSKNYWRWEHACEAIASFWEWRLVKVLMEGKEVKWWMESERLKGLDEKNLVERRFKDFESAMEYLSKYLKSMMMDGV

SEQ ID NO: 222504 - protein, 144 aa, Glycine max
  Coding DNA Sequence Number=SeqID_105726
  Gene Ontology: Mol. function=protein binding; Cellular component =nucleolus
  Homolog annotation: Hit_ID=Q9CX11; Match level="QueryCoverage=86%, HitCoverage=50%, E-value=2e-16, Identity=41%"; Hit description=13 days embryo stomach cDNA, RIKEN full-length enriched library, clone:D530033C11 product:...
  Homolog annotation: Hit description=RIKEN cDNA D530033C11
  Pfam annotation: Domain name=Fcf1; Domain location=51-144; Score =42.6; E_value=1.3e-09; Accession=PF04900.3; Description=Fcf1
MKVKKQKRHRKILTFYTACFGFRKPYKVLCDGTFVHHLLVNRITPADTAIGNVLSATIKLYTTRCVLAELKRLGSSYSEALEAAHKLIVARCEHEKCKSADACIMEVVGEKNSEHFFVASQDTDLRKQLQELNNNLGEFVSCPV

SEQ ID NO: 222505 - protein, 60 aa, Glycine max
  Coding DNA Sequence Number=SeqID_105727
MKIPGQNRDMKSVHVFSREIKYENRKSRAKMKEKQKHVKNLQELMGVAREYLRESSVTME

SEQ ID NO: 222506 - protein, 110 aa, Glycine max
  Coding DNA Sequence Number=SeqID_105728
  Homolog annotation: Hit_ID=Q8H2D2; Match level="QueryCoverage=27%, HitCoverage=2%, E-value=4e-07, Identity=80%"; Hit description=SMC3 protein
MYIKQVVIEGFKSYREQIATEPFSSKVNCVDYIHIFLKILPLISYHKSINDRTKNTKQENDVGNDRGRDSANGHFGEVAARPGELKLSAKAMSSPRRVGCFTMKSFGGPG

SEQ ID NO: 222507 - protein, 97 aa, Glycine max
  Coding DNA Sequence Number=SeqID_105729
  Gene Ontology: Mol. function=ATP binding; Cellular component =chromosome; Biological process=DNA metabolic process
  Homolog annotation: Hit_ID=Q8GU54; Match level="QueryCoverage=64%, HitCoverage=5%, E-value=2e-25, Identity=87%"; Hit description=SMC3 protein
MSIKRRVKETQEFYCEAENHGMISSYLIAMLIVGANGSGKTNFFHAIRFVLSDLFQNLRGEDRQALLHEGAGHQVLSAFVEIVFDNSDNRIPVICRG

SEQ ID NO: 222508 - protein, 103 aa, Glycine max
  Coding DNA Sequence Number=SeqID_105730
MASYGGELLLDSSSPGNGVSSLSSFSILLPFIFQEAKESIDEEVPRPTSSNGAYIKYNQSNNEDPTHECCFGVKYPQTHSLWHWIEDSKKIEPEMQEKALGFS

SEQ ID NO: 222509 - protein, 176 aa, Glycine max
  Coding DNA Sequence Number=SeqID_105731
  Gene Ontology: Mol. function=ATPase activity; Cellular component =chromosome; Biological process=chromosome organization and biogenesis
  Homolog annotation: Hit_ID=Q8GU54; Match level="QueryCoverage=90%, HitCoverage=11%, E-value=6e-37, Identity=51%"; Hit description=SMC3 protein
MEREKKLSILYQKQGRATQFSSKASRDKWLQKEIDDLERVLSSNKGQAMTLAIGSNICKLLISIMEQKLLDEIDRLKEELQDCDENINRRKSEITTLESLIAQSREGLNRYKEERDKLHGERKSLWGKENELTAEIDKLRAEVEKAEKSLDHAIPGHIDEGDCRNTLLPEIVLHLE

SEQ ID NO: 222510 - protein, 177 aa, Glycine max
  Coding DNA Sequence Number=SeqID_105732
  Gene Ontology: Mol. function=ATPase activity; Cellular component =chromosome; Biological process=chromosome organization and biogenesis
  Homolog annotation: Hit_ID=Q8S8B4; Match level="QueryCoverage=85%, HitCoverage=12%, E-value=7e-40, Identity=54%"; Hit description =Putative chromosome associated protein
MHSSVRQYLDERLKELDEEKEELRKYQQLDKQRKSLEYAIYSKEVQDAQQKLTEIEDARTKVSDTSARKYNDVLDAHEKSKDLENTLKDVSKELQNFNKEKEVIEKRRTVALKKHTELELDVKDLQEKISGNTRAKEDAARQLEILEKEIQDSTAELGKIIPLHEDQVQKEKDIGKQ

SEQ ID NO: 222511 - protein, 205 aa, Glycine max
  Coding DNA Sequence Number=SeqID_105733
  Gene Ontology: Mol. function=protein binding; Cellular component =chromosome; Biological process=chromosome organization and biogenesis
  Homolog annotation: Hit_ID=Q8S8B4; Match level="QueryCoverage=54%, HitCoverage=9%, E-value=1e-43, Identity=73%"; Hit description =Putative chromosome associated protein
  Pfam annotation: Domain name=SMC_hinge; Domain location=18-127; Score= 50.7; E_value=4.9e-12; Accession=PF06470.4; Description=SMC proteins Flexible Hinge Domain
DVRRGLNSVRKICREYNISGVHGPIIELLNCDEKFFTAVEVTAGNSLFHVVVENDDKSTQIIRHLNSQKGGRVTFIPLNRVKAPRITYPQSSDVIPLLKKLNFKHDYTPAFSQFLNYCNTAQGSSGGLITYGPTSGGGGSLCNVQIQILHRSSLEIFNVNTVINVVLNSGRSARYCSRATVTCDADFFRVAIGVAGIVLLTMKPK

SEQ ID NO: 222512 - protein, 246 aa, Glycine max
  Coding DNA Sequence Number=SeqID_105734
  Gene Ontology: Mol. function=2 iron, 2 sulfur cluster binding; Cellular component=peroxisome; Biological process=electron transport
  Homolog annotation: Hit_ID=Q2PHF4; Match level="QueryCoverage=94%, HitCoverage=17%, E-value=1e-95, Identity=72%"; Hit description =Aldehyde oxidase 1
STTSESSCEAVRLCCNILVERLKPLKEKLQEEMDSIKWETLILQAYMQAVNLSASSFYVPSNDSMGYLSYGAAVEIDLLNGETRFLQTDIIYDCGQSLNPAVDLGQIEGAFVQGLGFFMLEEYETNLDGLVLQDGTWNYKIPTIDTIPKQFNVQILNSGHHQKRVLSSKASGEPPLLLAASIHCATRAAVKEARKQLLSWSNQDEEDSTFQLGVPATMPVVKELCGLDIVERYLKWKMGKDIMVLT

SEQ ID NO: 222513 - protein, 152 aa, Glycine max
  Coding DNA Sequence Number=SeqID_105735
MSRGSGDLGDVRWGAIAQNQAWPIPTQPGHSQPIAMVAQLIHDRVVMECLEGVWETLEGNERCRFRGTIRLTATSLVHPEQPARTLQQPVEWILPTPTPYRLVESVQVIEVSSSEEDLEEDTEELPPEPAVDAPDYVLCAYHILLCTLCGYL

SEQ ID NO: 222514 - protein, 78 aa, Glycine max
  Coding DNA Sequence Number=SeqID_105736
MSRNLTDYTIIPSLAFGMLRNFMDCALTRPFNSRHVAELHRLPNDGCQVPQSGQARVAPQQIDDPRTKLGYDTWKEIL

SEQ ID NO: 222515 - protein, 316 aa, Glycine max
  Coding DNA Sequence Number=SeqID_105737
  Pfam annotation: Domain name=DUF647; Domain location=9-309; Score =104.4; E_value=3.4e-28; Accession=PF04884.5; Description=Protein of unknown function, DUF647
  Subcellular localization annotation: CTP_CleavageSite=41; ConfidenceScore=5.04e-01
MLPHAHAGTSSRELFLSALASKAKGSESESVSSLGIPRFAVAAARAPFFAQRAIGEETLEAVARGLKDPSFRVIQNHFAISGNLGEVAAKEEVWEVVAQLVGLSLGILILDTPGLVKSYGVISLTWLSMRLLHLWLCYESLSVLQFNTINIKRARILVKSHVLHSTVPGCTDSNREVNILAWSQFMKPKIIFGLPLEKMDGVERSYFMVEALIKLYASEKYILMVNQQTEDLRFYVSFKVGATNVSVLRSVWQSFWLSENWDSDDNVRDQIATSLMELEEKFEDFIQKLKDAEWDTQQFNLKVPKEIFIDDNTNSL

SEQ ID NO: 222516 - protein, 762 aa, Glycine max
  Coding DNA Sequence Number=SeqID_105738
  Gene Ontology: Mol. function=RNA-directed DNA polymerase activity; Cellular component=chromatin; Biological process=chromatin assembly or disassembly
  Pfam annotation: Domain name=zf-H2C2; Domain location=595-636; Score =8.7; E_value=0.026; Accession=PF09337.1; Description=His(2)-Cys(2) zinc finger
  Pfam module annotation: Pfam domain module=RVT_1::Retrotrans_gag::zf -H2C2; Domain location=366-548::72-159::595-636
  Subcellular localization annotation: CTP_CleavageSite=40; ConfidenceScore=5.14e-01
MAEHNDRTRLQHLQSQSHTIGGSNSNRGTPGSSNGIPVTLIMTVSAIRDISLGFPHFDGNTPVLEWIFKAEKFFNYHNTPDLDRMLQRMQVVSIWAELTRALETQFGPSLFDCPMAELFKLQQSCIVANYYLKFMASANRSEGLTPEALRNCFISGLNKDIRRDVVAQAPNETLLLRKLVLLKCNCEERKAFSDDVELEGHDSKDIIDNVNGNAEVILENHHLSLNALKGGRGVGIIRFTAYVDKLPVKPRVAKVLKLPVEPTPSFKVMVENGNYMVTEGKAQLHHIRRMLNTDVIAEIFTMQLIEPNSVQFPLVELPNDMEPELALLLHSYSVVFGTPTSLPPPRSHDHYIPLVEGSQPVKPSKSPFSSPIILVKKKYGSWRVCTDYRALNAITIKDTFPIPIVDELIDELYGAVFFSKLDLRSGYHQILINPEDRYKTAFRTHHGVGVAMETTKLQAVLNWSLPTSLKQLRRFLGMTGYYRRFVKSYATIAVPLTDLLKKDSFKWSASTTNAINQLKEAMTLAPVLAIPNFKEPFMLDTNVLGIGIGAVLSQGYDFVIQYKPGRENIPADALSKSLLMAWSEAIGVWMNQEFHASKIGGHEGVTKSVSWICKQFYWPKMQQDIRDFVKECIICQRAKVEQALSVGLLQSLPIPQRIWEDIDMDFITNFPFSHGYSTILVVRTTWEDVTWVGTTYPQFNLEDKVVLKGKGNVTYEKERERLAPKLVRKNGHVSANAEIKGDRQNMRIKRPNVLYKKFVTKK

SEQ ID NO: 222517 - protein, 534 aa, Glycine max
  Coding DNA Sequence Number=SeqID_105739
  Gene Ontology: Mol. function=chorismate mutase activity; Cellular component=nuclear envelope-endoplasmic reticulum network; Biological process=aromatic amino acid family biosynthetic process
  Homolog annotation: Hit_ID=Q949K0; Match level="QueryCoverage=96%, HitCoverage=97%, E-value=5e-27, Identity=24%"; Hit description =Putative centromere protein
MDVYEEIEETKAEIEKLTVKLRDKTNSLQNLKKYYDAQANKIQESIFKVEKLNQEMLQKADDINDYVSESLNNKESITKHLSAADDELGAICDDKFRKWKDEKRGYVLALEEEEQIKWKEEHFKHLEDVHEKLIDQFKASKKEWELEKSTLLDEISSLKSLKRLEDEVSNLNKKCFQLMKQLELKDAVLISSKKYINEEREKAACLMRQVESYGFANELLHLPHNELDRHKDLHMEDGFKEQLKEVYDALDRANIELDERICEKSEMEFELRIWKSFVERLRSGLEENLVMCKELENSLLAQVDFTESLKQEKDSLETEASVPANWETSESSETVEGTYLQIIEEKDNILEELQKGVIRLEQESHRREFESSMIAKGNMITAAEVLATLEIEEKLMMVELEYDIHDMEQKLKLQEENWRQSEQLALDIEEEMEAKQLQIKKLIDQMENKLRGSDVFLQKLKIENRSLLENSTDTQLMDTLRSIVQCFENDSVGINFKKDDGLLVKENMIMHSPTGIKKLETFSDIRSLFKELNT

SEQ ID NO: 222518 - protein, 732 aa, Glycine max
  Coding DNA Sequence Number=SeqID_105740
  Gene Ontology: Mol. function=zinc ion binding; Cellular component =membrane
  Pfam annotation: Domain name=MS_channel; Domain location=250-462; Score=91.8; E_value=2.1e-24; Accession=PF00924.9; Description =Mechanosensitive ion channel
MALPGSLQLSHGLGLCRNLDCNKHSVQKFSIILYSLCKRAADHGKLHLYSAGPSYPISFMRQECRGFQHLRHINRPAHTLSCKSRSFKCHCFLGQPNELPAVKVAATVLARSCNVLQNSPTIVKLIPAVGVIIFAVWGVGPLLFQTRKLLFQRSDSSWKRSTTYYIITSYLQPLLLWTGAILICRALEPLILPSETSQVVKERLLNFVRSLSTVLAFAYCLSSVIQQAQKFLAESTDASETRNMGFQFAGKAVYSAVWIAAFSLFMELLGFSTQKWVTAGGLGTVLLTLAGREIFTNFLSSVMIHATRPFVVNEWIQTKIEGYEVSGTVEHVGWWSPTIIRGEDREAVHIPNHKFTVNVVRNLSQKTHWRIKTHLAISHLDVNKINNIVADMRKVLAKNPQVEQQRLHRRVFLDNINPENQALLILVSCFVKTSHFEEYLCVKEAVLLDLLRVIGHHRARLATPVRTLQKIYSDADLENIPFADSTFGRGAGTVPNRPLLVIEPSYKINGDDKKSRSARPAVDQDNKTATRTKVDTEGDNKVVTPNSDANGNSKTVVTPNSDANGNSKTVVTPKPDPEVGENKPLKSDSSRENVEVPESPSKSKVTGLVVDNSAQKDVDVKQAKVHTTKNTKPNIDSDNVVSSSSTNNADKTGGFNTNMPMKQQGEKKPAAQPHASRTVLEENIVLGVALEGSKRTLPIDEEIDNVTSREAKEMAALQSGNGSPKAPDGNDN

SEQ ID NO: 222519 - protein, 239 aa, Glycine max
  Coding DNA Sequence Number=SeqID_105741
  Gene Ontology: Mol. function=nucleotide binding
  Homolog annotation: Hit_ID=Q949J8; Match level="QueryCoverage=88%, HitCoverage=44%, E-value=1e-106, Identity=85%"; Hit description =Putative auxin growth promotor protein
  Pfam annotation: Domain name=DUF246; Domain location=1-203; Score =149.0; E_value=1.3e-41; Accession=PF03138.5; Description=Plant protein family
MPLSAAFAILKAQLEKWAPTTFKRSLVQDMAAHSACDFGGGKAEKLALAKYRQVIWQGRVLNSQFTDEELRSQGRCPMTPEEVGLLLAAMGFDNSTRLYLASHKVYGGEARISTLRELFPLMEDKKSLASSEERSQIKGKASLLAALDYYVGLHSDIFISASPGNMHNALVGHRTYLNLKTIRPNMALMGQLFLNKTIEWSEFQDAVVEGHQNRQGELRLRKPKQSIYTYPAPDCMCQA

SEQ ID NO: 222520 - protein, 295 aa, Glycine max
  Coding DNA Sequence Number=SeqID_105742
  Gene Ontology: Mol. function=transcription factor activity; Cellular component=nucleus; Biological process=regulation of transcription, DNA-dependent
  Homolog annotation: Hit_ID=Q9FKP3; Match level="QueryCoverage=66%, HitCoverage=41%, E-value=2e-80, Identity=67%"; Hit description =Similarity to auxin-independent growth promoter
  Pfam annotation: Domain name=DUF246; Domain location=156-295; Score= -18.6; E_value=1.5e-13; Accession=PF03138.5; Description=Plant protein family
  Subcellular localization annotation: CTP_CleavageSite=46; ConfidenceScore=5.56e-01
MELLGYLNQGHPSRGTTLVITLSLVLSTLVSFSTFTHAFSSSAFPSCNLSESLNSYELWCATRMVIELEMNRTPEHAYVDATYLLASSALHLAINYVQELNPIKPRHSRLLRSAVQHETPTSQLSEIWSPLESQGWKPYVESNKPTLPEKSEGYIQVFLDGGLNQQRMGICDAVAVAKILNATLVIPYLELNPVWRDSSSFMDIFDVDHFIDVLKDDISIVKELPKEFSWSTREYYGLAIRETRIKAAPVHASAHWYLENVLPVLQSYGIAAISPFSHRLSFDNLPMDIQHLRCK

SEQ ID NO: 222521 - protein, 60 aa, Glycine max
  Coding DNA Sequence Number=SeqID_105743
MTLRAKMGMVILLYNYHASCMPIVKVGMVVVFASGAGVRGVSERDAYFMDFSNKGMILRR

SEQ ID NO: 222522 - protein, 643 aa, Glycine max
  Coding DNA Sequence Number=SeqID_105744
  Gene Ontology: Mol. function=translation initiation factor activity; Cellular component=cytoplasm; Biological process=multicellular organismal development
  Homolog annotation: Hit_ID=Q9XGW1; Match level="QueryCoverage=94%, HitCoverage=66%, E-value=0.0, Identity=81%"; Hit description=Protein PINHEAD
  Pfam annotation: Domain name=PAZ; Domain location=10-147; Score =176.6; E_value=6.1e-50; Accession=PF02170.12; Description=PAZ domain
  Pfam annotation: Domain name=Piwi; Domain location=274-567; Score =472.5; E_value=5.2e-139; Accession=PF02171.8; Description=Piwi domain
  Pfam module annotation: Pfam domain module=PAZ::Piwi; Domain location= 10-147::274-567
MASAAFIEPLPVVEFVGQLLGKDVLSRPLSDADRIKIKKALRGVKVEVTHRGSVRRKYRVSGLTSQPTRELVFPVDENSTMKSVVEYFQEMYGFTIQYTHLPCLQVGNQKKANYLPMEACKIVEGQRYTKRLNEKQITALLKVTCQRPRDRENDILRTVQHNAYDQDPYAKEFGIKISEKLASVEARILPAPWKMINGMTVSRWACINFSRSVQDSVARTFCNELAQMCQVSGMEFNPEPVIPIYNAKPEQVEKALKHVYHVAGSKTKAKELELLLAILPDNNGSLYGDLKRICETDLGLISQCCLTKHVFKITKQYLANVSLKINVKMGGRNTVLLDAVSCRIPLVVASQDWPEVTKYAGLVCAQAHRQELIQDLYKTWQDPVRGTVSGGMIRDLLVSFRKATGQKPLRIIFYRDGVSEGQFYQVLLYELDAIRKACASLEPNYQPPVTFIVVQKRHHTRLFANNYRDRSSTDRSGNILPGTVVDSKICHPTEFDFYLCSHAGIQGTSRPAHYHVLWDENNFTADGIQSLTNNLCYTYARCTRSVSVVPPAYYAHLAAFRARFYMEPDMQDNGSAGDGNGYGAKATRAAGDYSVKPLPDLKENVKRVVGVRSGIPVLTSSNERKLETDSDGDFSYQTQDGTE

SEQ ID NO: 222523 - protein, 67 aa, Glycine max
  Coding DNA Sequence Number=SeqID_105745
MYQANIKAKTVKDFYRVGHIRSRCHSSICMPSNFEPNTAYVRIRRHQKLSSFIQKQKWSEKPQNKAK

SEQ ID NO: 222524 - protein, 75 aa, Glycine max
  Coding DNA Sequence Number=SeqID_105746
MAAMAMREKKESTRHPKELNHPREPPDVRLTTRPLESRLSATKRGLAALSTPPSRTINSFNRKQVTRKQKLLIPY

SEQ ID NO: 222525 - protein, 573 aa, Glycine max
  Coding DNA Sequence Number=SeqID_105747
  Gene Ontology: Mol. function=protein serine/threonine kinase activity; Cellular component=chloroplast; Biological process=protein amino acid phosphorylation
  Homolog annotation: Hit_ID=P27450; Match level="QueryCoverage=63%, HitCoverage=84%, E-value=1e-122, Identity=60%"; Hit description =Probable serine/threonine-protein kinase Cx32, chloroplast precursor
  Pfam annotation: Domain name=Pkinase; Domain location=98-380; Score =153.1; E_value=7.3e-43; Accession=PF00069.15; Description=Protein kinase domain
  Pfam annotation: Domain name=Pkinase_Tyr; Domain location=98-380; Score=152.1; E_value=1.4e-42; Accession=PF07714.7; Description =Protein tyrosine kinase
  Pfam module annotation: Pfam domain module=Pkinase::Pkinase_Tyr; Domain location=98-380::98-380
  Subcellular localization annotation: CTP_CleavageSite=92; ConfidenceScore=5.71e-01
GNHAKEKSFLTWVSASLPLPPTLLSSTQARSASTDSKNVGFSATTSSAGKSQFSEIASGSIDSSQGSLPLPSPHGQILERPNLKVFSFGDLKSATKSFKSDTLLGEGGFGRVYKGWLDEKTLSPAKAGSGMVVAIKKLNPQSTQGFQEWQSEVNFLGRLSHPNLVKLLGYCWDDDELLLVYEFLPKGSLENHLFRRNPNIEPLSWNTRFKIAIGAARGLAFLHASEKQIIYRDFKASNILLDVNFNAKISDFGLAKLGPSGGQSHVTTRVMGTYGYAAPEYIATGHLYVKSDVYGFGVVLLEILTGMRALDTKRPTGQQNLVEWTKPLLSSKKKLKTIMDAKIVGQYSPKAAFQAAQLTLKCLEHDPKQRPSMKEVLEGLEAIEAIHEKSKESKTCNSYQPPRQRVHLIGSPSWRFNGYYGYLDITHRRDSWNLLRTLSCDNTLPWCIMGDFNDLLFHVEKKGLNPHPNSMKHEHFSPLPCSMFDTQAVHDSNMVDIPTLGQKARAPPTKETLIPHATISHIERNISDEDNSSLLAPFVIDEFRTTLSQLHNDKSAGPDGLNPAFYKKIWDVL

SEQ ID NO: 222526 - protein, 1013 aa, Glycine max
  Coding DNA Sequence Number=SeqID_105748
  Gene Ontology: Mol. function=2 iron, 2 sulfur cluster binding; Cellular component=peroxisome; Biological process=electron transport
  Homolog annotation: Hit_ID=Q9FV23; Match level="QueryCoverage=99%, HitCoverage=73%, E-value=0.0, Identity=59%"; Hit description =Aldehyde oxidase
  Pfam annotation: Domain name=Ald_Xan_dh_C; Domain location=559-669; Score=119.7; E_value=8.3e-33; Accession=PF01315.12; Description =Aldehyde oxidase and xanthine dehydrogenase, ab hammerhead domain
  Pfam annotation: Domain name=Ald_Xan_dh_C2; Domain location=680-1013; Score=192.5; E_value=1e-54; Accession=PF02738.8; Description=Aldehyde oxidase and xanthine dehydrogenase, molybdopterin binding domain
  Pfam annotation: Domain name=CO_deh_flav_C; Domain location=380-493; Score=130.2; E_value=5.7e-36; Accession=PF03450.7; Description=CO dehydrogenase flavoprotein C-terminal domain
  Pfam annotation: Domain name=FAD_binding_5; Domain location=181-363; Score=165.6; E_value=1.3e-46; Accession=PF00941.11; Description=FAD binding domain in molybdopterin dehydrogenase
  Pfam annotation: Domain name=Fer2_2; Domain location=37-124; Score =150.2; E_value=5.4e-42; Accession=PF01799.10; Description=[2Fe-2S] binding domain
  Pfam module annotation: Pfam domain module=Ald_Xan_dh_C::Ald_Xan_dh _C2::CO_deh_flav_C::FAD_binding_5::Fer2_2; Domain location=559 -669::680-1013::380-493::181-363::37-124
MVVLISKYDPVLDQVEDFTASSCLTLLCSIHGCSITTSEGIGNSKEGFHPIHKRFAGFHATQCGFCTPGMCVSLFGTLVNAEKTTCPEPPAGFSKVTVAVAEKAIAGNLCRCTGYRPIADVCKSFAADVDMEDLGFNSFWRKGDNKDSKLSRLPQYDHNQTNSRFPLFLKEVKHDVFLASEKHSWHRPISLMELQSLLKLNHCNGTRIKIVVSNTGMGYYKEKEAYDKYIDLRGISELSKIRKDQTGIEIGAAVTISKAIEALKEESRSDFLSDYVMILEKIADHMSKVASGYIRNTASVGGNLVMAQKNNFPSDIATILLAVDAMVHIMTGTQFECLTLEEFLERPPLGLESVLLSIKIPSLELNKTESSEPRSRFLFETYRASPRPLGNALPYLNAAFLVKVSQCKDSGGTVIDTCRFSFGAYGSKHAIRAKNVEEFLAGKLLSASILYDAVILVTATIVPKDDTSKTTYRSSLAAGFIFQFFNPLLDASAINNGYFNGHINLPYAKDFELKENQKQVRHDKVPTLLSSGKQILEAGCDYHPVGEPIMKSGAALQASGEVVFVDDIPSPANCLHGAYIYSAKPLARVRSIKLTPELQLDGLRDIISIKDIPNGGENIGSKTIFGVEPLFAEEIARCVGERLAFVVADTQKLADMAANSAVVDYDTKNLEPPILSVEDAVERSSFFEVPPFLYPKHVGDISKGMAEADHKILSAELKLGSQYYFYMETQTALAVPDEDNCITVYSSNQCPEFAHSTIARCLGIPENNVRVITRRVGGGFGGKALKAISVATSCALAAQKLQRPVRMYLNRKTDMIIAGGRHPMKITYSVGFRNDGKITALELQILINAGIYVDISAVMPHHIVCALKKYDWGALSFDIKVCRTNHPNRSAMRGPGEVQGSFIAEAIIENVAATLSMDVDSVRSVNLHTYKSLQSFYEYYHGEPYEYTLPSIWSKLAVSANYDQRTKLVQKFNRINTWKKRGISRVPAVIELTLRPTPGKLEELKWVKVFGQR

SEQ ID NO: 222527 - protein, 56 aa, Glycine max
  Coding DNA Sequence Number=SeqID_105749
MELEKTPTSLVFGVNGERFELSHVDPSTTLLQFLRTRTRFKSVKLGCGEVPGQTGY

SEQ ID NO: 222528 - protein, 100 aa, Glycine max
  Coding DNA Sequence Number=SeqID_105750
  Homolog annotation: Hit_ID=Q94GC7; Match level="QueryCoverage=88%, HitCoverage=35%, E-value=2e-13, Identity=42%"; Hit description =Hsp20/alpha crystallin family protein
MSDEKTNVQPAAAAAEPVNEDFLPPSDWDRQNDSDTLILMLPGFRKEQMKVQVTSNRMLRVSGGRKISDNKLRQFRKEEPLSDYHDTKGITAKFEAGMLY

SEQ ID NO: 222529 - protein, 68 aa, Glycine max
  Coding DNA Sequence Number=SeqID_105751
MGDMFVHLSGALEPKKKPEMECAASLYENQERLDLLHHCYYGPPLATERKAVHLPLGWVTLGVFLVFN

SEQ ID NO: 222530 - protein, 365 aa, Glycine max
  Coding DNA Sequence Number=SeqID_105752
  Homolog annotation: Hit_ID=Q1S4G7; Match level="QueryCoverage=17%, HitCoverage=34%, E-value=4e-11, Identity=50%"; Hit description=Heat shock protein Hsp20
FRKEQMKVQVTSNRMLRVSGGRKISDNKLRQFRKEEPLSDYHDTKGITAKFEAGMLYVRIPKVFKPQPPPTTTTKPTQQEPSKPQTTTTPTQQEPPKPPTQQEPSKPQPATTPPPTQQEPPKPPTQQEPSKPQPTTTTPPTQQEPPKPQLPPPTTQQKPPKPQPPPTTTPTKLEPPKPQQTTKTDHKTHAPQVNEKETKEDKISEEYFKTKTQTPVPQEPKAAHEDSQKKPQKEMMSKAKTEEERKTTSETQEMHGTAQTTFKEQKADHDEDSQKKEKGKAETDSNGIREAITSKAQETSPDGLSKSIIAMVHKILAMISGCVSEVKKQNKVPHILVFIILVLLMGHYTKTAIKTSFGGPQNQEL

SEQ ID NO: 222531 - protein, 290 aa, Glycine max
  Coding DNA Sequence Number=SeqID_105753
  Homolog annotation: Hit_ID=Q94GC7; Match level="QueryCoverage=91%, HitCoverage=95%, E-value=2e-24, Identity=31%"; Hit description =Hsp20/alpha crystallin family protein
  Pfam annotation: Domain name=HSP20; Domain location=20-116; Score =24.4; E_value=2.1e-06; Accession=PF00011.11; Description=Hsp20alpha crystallin family
MAQAQSAANFDYQDFDPFFEWSEDEGSATLIVMLPGFTKEQLRVQVTSTPVLRINGERQIVENKRRRFSREFSIPPYCDTNDVSAKFEGGVLSIKFPKLITPAARSQPQPQEAPTMPQKEKEPSQQQDQVHKQESLQKEKEPITSDEKEENKTEESSPQKENEPISDDDKEKDNKTEEVVAEKKVRTNGVPETAKELGTTTTTSSKPKITQRLKTRVLDFTVSLRSVEDRDIVKQGFGGNKCAKLIKRPKIWMNIFVVILLVMVLGLYVKNAAFMLSHKGGSELQEFKEF

SEQ ID NO: 222532 - protein, 42 aa, Glycine max
  Coding DNA Sequence Number=SeqID_105754
MGSRTQPAASDRVYEDFVPLYEWDRNERLVNVMLPGNVHRQI

SEQ ID NO: 222533 - protein, 144 aa, Glycine max
  Coding DNA Sequence Number=SeqID_105755
  Gene Ontology: Biological process=Mo-molybdopterin cofactor biosynthetic process
  Homolog annotation: Hit_ID=Q39054; Match level="QueryCoverage=37%, HitCoverage=8%, E-value=2e-16, Identity=72%"; Hit description =Molybdopterin biosynthesis protein CNX1
  Subcellular localization annotation: CTP_CleavageSite=45; ConfidenceScore=5.31e-01
MQFSCIFKSLVFVSKCADSFTINNGPRAVSVINSSSERLGGARVVATAVVPDNVAKIQDILRRWSDIEQMDLIITLGISLTCLETVAECWKLYCQHLSMVLRGDKREKHHRHVPHAEAVPADVWEQSNMLATGAGSDISCSCCK

SEQ ID NO: 222534 - protein, 193 aa, Glycine max
  Coding DNA Sequence Number=SeqID_105756
MFVSAPVDNLLVTSPSYSVEYEHFPSVAQCIADLDYDEVSPCLRWGPIAVRHRPERFVCQFGYVQSIPPQPIDSWESFDEIDDRWMHYSDHFASAGEMCVVPGQCAADYMNWFFVISHPFKTTAQPSDPPRDPPAMHDASFVEPHIPQVLEPVATSTHARSEVDEPIHAVEAYHVIAERLERHLNLRIVMPGT

SEQ ID NO: 222535 - protein, 250 aa, Glycine max
  Coding DNA Sequence Number=SeqID_105757
  Gene Ontology: Mol. function=RNA-directed DNA polymerase activity; Biological process=RNA-dependent DNA replication
MVEKRRLQFKILSHVCQLETAQNMLRGIFISRLDGVEFKTIRRKTSNWWPDLRRKDDSGRFFGVMEGQRKVVWVKWDTVCLPKEKGGLVVQDLSKYGSWRNLDDGEEEPQGVDLVAGLAFCVRIGRGREDGWLSLMEKYQRLYCISQQQHHSIQLMGVQVGESWEWNFELQRMTLEGEMELVAIFMEDIKGLKIQLNQEDRWIWKGDANGMYSVGSGYHLLNEVVADEIDDGAFTLIWNMKIPSKAVHFA

SEQ ID NO: 222536 - protein, 430 aa, Glycine max
  Coding DNA Sequence Number=SeqID_105758
  Gene Ontology: Mol. function=protein binding; Cellular component =nucleus; Biological process=ubiquitin cycle
  Homolog annotation: Hit_ID=Q8LI88; Match level="QueryCoverage=83%, HitCoverage=91%, E-value=1e-132, Identity=63%"; Hit description =Putative zinc finger POZ domain protein
  Pfam annotation: Domain name=BTB; Domain location=180-300; Score =65.5; E_value=1.8e-16; Accession=PF00651.21; Description=BTBPOZ domain
  Pfam annotation: Domain name=MATH; Domain location=27-156; Score =60.6; E_value=5e-15; Accession=PF00917.16; Description=MATH domain
  Pfam module annotation: Pfam domain module=BTB::MATH; Domain location= 180-300::27-156
MSGAALSPPTNSKSLTQTVSGSHKFVIEGYSLAKGMGVGKHIASDVFTVGGYHWAIYFYPDGKNPEDNSAYVSVFIALASEGTDVRALFELTLLDQSGQGKHKVHSHFDRSLETGPYTLKYKGSMWGYKRFFRRSLLETSDFLKNDCLKINCTVGVVVSASDCPQHYSINIPESDIGSHFGALLDNMEGSDIIFDVAGEKFHAHKLMLAARSPEFRSKFLDGLDEEKNEIIVTDLEPKVFKAMLHFIYKDTLTEEVATVSSTTTSHFPVSETLTAKLLAAADKYGLADILTLADHCHATELKAVCLKFAAQNLAAVMRSDGFEHMKEKGPWLQSEILKTIAGGEGEGSSAVEKSQSVWGQLSDGGDTNGDNADKLGGKKEHGKEGKPSSVQLFHVSMESLEKAGRLDVMQWVYVVSAEWSLKMSLSAVDY

SEQ ID NO: 222537 - protein, 327 aa, Glycine max
  Coding DNA Sequence Number=SeqID_105759
  Gene Ontology: Mol. function=RNA binding; Cellular component =ribonucleoprotein complex; Biological process=ribosome biogenesis and assembly
  Homolog annotation: Hit_ID=Q7XDT2; Match level="QueryCoverage=67%, HitCoverage=53%, E-value=2e-87, Identity=73%"; Hit description =Ribosomal RNA assembly protein mis3, putative, expressed
MEKHSDGENGVEEEPRSLEQKEKRKGKHDKPKPWDDDPNIDHWKIDKFDPSWNDGGMLEVSSFSTLFPQYREKYLQEAWPMVKSSLKEFGVACELNLVEGSMTVSTTRKTRDPYIIIKARDLIKLLSRSIPAPQAIKILDDEMQCDIIKISGMVRNKRASPGAAAAYNIPPPYLRIAKSLWAMGYEALEILTGCYILVQGNTVAAMGSFKGLKQVRRIVEECMLNKMHPVYNIKVLMMKKELEKDPALAQENWDRFLPKFKKKNVKQKKVNTKQKKPYTPFPPPQQPSKQPTKSAVCYGQFLVPCSKNAVKSVPLVMPGTLLQLLSM

SEQ ID NO: 222538 - protein, 70 aa, Glycine max
  Coding DNA Sequence Number=SeqID_105760
SCTMCGKILLDLGRNPRRIKKRRKSNVKIVKKELDAASKGPLIKEAKQPINSDTTQVSLKIVEESLFSVL

SEQ ID NO: 222539 - protein, 50 aa, Glycine max
  Coding DNA Sequence Number=SeqID_105761
  Homolog annotation: Hit_ID=Q2Z2G2; Match level="QueryCoverage=47%, HitCoverage=12%, E-value=4e-08, Identity=100%"; Hit description =AINTEGUMENTA-like protein
MGGLGDMKLIFGTTVVRKRGKAGKEDKQTSPTWKVAIMRRLSIYLSLTFN

SEQ ID NO: 222540 - protein, 190 aa, Glycine max
  Coding DNA Sequence Number=SeqID_105762
MAKENKRDSFSKKKLEGVVTNTYLKKILKKIKKKGVVVAPMYPQEEYPKAHEASLGPSLVHYGNKVPEENYLASPRYSAAIPDNDARNLRRKYENCDSKEKPFSVEETRPGKLEFTQASYLLRVEGTNSSKRVACLGLKFPLSPGKLNASLGESRVRKVYEKIILPLPVALFLDLTNNPQNPERPLGLAL

SEQ ID NO: 222541 - protein, 91 aa, Glycine max
  Coding DNA Sequence Number=SeqID_105763
MAEPSKKQKWCFDFICNHRNSKPRSIQSTDNTNYSLHIISYVVFLGRTTYPLSSDGVAFEGTLDDDWKFDFSVFDARRLVCTNQADMTGSS

SEQ ID NO: 222542 - protein, 56 aa, Glycine max
  Coding DNA Sequence Number=SeqID_105764
MIGCKLKKLWDGVQNLVNLKEIGLQGSQHLIEIQDLSKVEKLEKRKQHNKSCLQES

SEQ ID NO: 222543 - protein, 165 aa, Glycine max
  Coding DNA Sequence Number=SeqID_105765
  Homolog annotation: Hit_ID=Q1S7C5; Match level="QueryCoverage=46%, HitCoverage=6%, E-value=2e-08, Identity=41%"; Hit description =Integrase, catalytic region
MRTILTTLCRLTSLWPPLRTLELQILPQYLTAANRDAGVVSSEFLLWEQQDQLLLSWLQSIILPREHVSRYHHVDIILDGLPDEFESLVPFVSGKFESLSIDEVMTLLLAHETQIAHKKSHASSVTSINLTEEAKPNLVHQDSHTQAYVAQGFGSSSHFGSSTYL

SEQ ID NO: 222544 - protein, 78 aa, Glycine max
  Coding DNA Sequence Number=SeqID_105766
MHGGAASQTGEFVAGEAQPTCRLRVQATCCSRAQAWHRGEELAIGAGEMQLWCREVLASLTGELSFKFFFIYARYETP

SEQ ID NO: 222545 - protein, 179 aa, Glycine max
  Coding DNA Sequence Number=SeqID_105767
  Subcellular localization annotation: CTP_CleavageSite=48; ConfidenceScore=5.19e-01
MSSIFGPDVLDIVSDIVDPAASMLLATPVFSGRMSWNCIRHRGSCSFNAFSNSSIFGQDVLDIVSDIVNPAASILHLTFHLALYTMNSVITVLYFNGRVYEDNDGVIFEGSKKAIQIKRGISFNALKKKIGDKENILLCKFAMTKTLKRCLKVLNNNNKFPDMIPPVRIVHPAEGMISS

SEQ ID NO: 222546 - protein, 132 aa, Glycine max
  Coding DNA Sequence Number=SeqID_105768
  Homolog annotation: Hit_ID=Q9LU56; Match level="QueryCoverage=66%, HitCoverage=24%, E-value=2e-28, Identity=70%"; Hit description =Arabidopsis thaliana genomic DNA, chromosome 5, P1 clone:MWD22
  Pfam annotation: Domain name=DUF676; Domain location=28-132; Score= -34.2; E_value=4e-05; Accession=PF05057.5; Description=Protein of unknown function (DUF676)
MEEEKKVCASESAVDGSRDVWSSEPSLASSADHLVVMVNGILGRETDWKYAAEKFVRELPDKVFVHCSERNVSMLTLDGVDVMGGRLAEECYCKKKTDSNRGIRHTRSKNIENSRVRRSNQRKYLKEVVRAV

SEQ ID NO: 222547 - protein, 105 aa, Glycine max
  Coding DNA Sequence Number=SeqID_105769
MGAEEECGVRGDGGIREKVERGKRTEERRRKRTEPEEEELMRRTIWATLVTACAINPIKVQINYVCNDQHENSTIKKVKVIGFHFSSVQLAGYRGLWNINFENGN

SEQ ID NO: 222548 - protein, 97 aa, Glycine max
  Coding DNA Sequence Number=SeqID_105770
MKMNLSLMSGHPTPLIRPMSKCWTRITVVQEIGGHIKKREGGMWQPVSGADGVHRRDADNRGNHGYFGGEVFSGLVTYYPFSLNKETTAQNMELDKF

SEQ ID NO: 222549 - protein, 1044 aa, Glycine max
  Coding DNA Sequence Number=SeqID_105771
  Gene Ontology: Cellular component=integral to membrane; Biological process=vesicle-mediated transport
  Homolog annotation: Hit_ID=Q9FFF8; Match level="QueryCoverage=97%, HitCoverage=97%, E-value=2e-69, Identity=24%"; Hit description =Arabidopsis thaliana genomic DNA, chromosome 5, P1 clone:MOP10
  Pfam annotation: Domain name=WD40; Domain location=204-243; Score =14.9; E_value=0.29; Accession=PF00400.22; Description=WD domain, G -beta repeat
  Pfam annotation: Domain name=WD40; Domain location=385-469; Score =5.8; E_value=7.8; Accession=PF00400.22; Description=WD domain, G -beta repeat
  Pfam annotation: Domain name=WD40; Domain location=483-521; Score =0.3; E_value=34; Accession=PF00400.22; Description=WD domain, G-beta repeat
  Pfam annotation: Domain name=WD40; Domain location=547-584; Score =12.0; E_value=1.4; Accession=PF00400.22; Description=WD domain, G -beta repeat
  Pfam annotation: Domain name=WD40; Domain location=94-132; Score=2.1; E_value=21; Accession=PF00400.22; Description=WD domain, G-beta repeat
  Pfam module annotation: Pfam domain module=WD40::WD40::WD40::WD40::WD4 0; Domain location=204-243::385-469::483-521::547-584::94-132
MSLISEESYKLRSLTTSGNSSDGLKASDVDPRLVFHHGVPSGGAKFAYDTTLRILALATKDGQIKLYGKDNAQAMLESSEPLPSKFLQVWDIEKKLLSDVYIAKDEITSFTVIQHSLYMYIGHSNGNISVFKLDQEPSWHLAQMKYTIPLSASHGNSEASDDTAVTHILPQPAADSKRVLIVFRNGQMILWDIRESRSIFRTGGNMLQPLHTETKKVTSACWVCPFGSKVVVGYNNGELFIWSIPSLNIGNGSASKSSNQNTPLLKLNLGYKSDKISIGSIKWVYAGGKASRLYVMGASDFATSNLLQVVLLNEQTEARTIKLGLHLSECCIDMEIISTSTEQSKNKQDSFILLGKSGHLYLYDDSLIERYLIQCQSKSTPSLPKEVIVKLPLAESSITTAKFISNNPNMLTSEDEYYRQLIKNCPLFVPVETNQKDGISLSSAKFTGFSNVQNLYITGHSNGTITFWDASCPIFTPILQLKQQSENDCSLSGIPLTALYFNSNSLLLVSGDQCGMVCIFRFKPEPYATNSFLSLTGGTKKGTDHIIQSVKRVKSNGAILSLNIDPSSMHLAVGSDQGHVSVFNIDGPTLLYQKHIASEISAGIISLQFLTSSLHGFGTNILAVGTKDSSVLALDKETGNTLGTGTIHPKKPSKALFMQVLAVLWYTDGQGEPINGSITEDGLELSERNHIEDATTKQLYILLCSEKALYVYSLVHAIQGVKKVLYKKKFHSSTCCWASTFCSPSDVGLILIFTSGKVELRSLPELYLIVETSIRGFNYSPPKLKSFSYSQICCSSKGDLVLVNGGQEIFVVSLLVQRNIFRLLDSISCIYRKEMKLSQEELVPSPVIHKEKKKGIFSSVIKDFTGSKEKHAPILETEDTKESILELSAIFSNENFPCDADNNDNLTVDEDEIELNIDDIDLDDHEEKRKDQSILGALNKKKLTGKFQVLKGRLKEMKGNIQKTSSKEKQQDEQAGSVDQIKKKYGFSSSNETSVAKLAESKLQENMKKLQGINLRTTEMQDKAKSFSTLANQVLWTAEQERRN

SEQ ID NO: 222550 - protein, 155 aa, Glycine max
  Coding DNA Sequence Number=SeqID_105772
MDGLANGVALEEVITRVQGKGRRRDFFGRKGAARGGSYLGGTVAKKVRNRNLRTYPYEVQNISTPTSRGASLIVSWHLGKIPNPHKAKTVILLTHSHVARISRNTLHRSWRSKGTRLIYETHTQRKHKRIEGSHESQCFLSTRIADVARDRRNPA

SEQ ID NO: 222551 - protein, 53 aa, Glycine max
  Coding DNA Sequence Number=SeqID_105773
MMLGCKPGRSHCRTSTAFTHAELPHLLCSSISGWMLDNLNRILDFDYPLYKGC

SEQ ID NO: 222552 - protein, 887 aa, Glycine max
  Coding DNA Sequence Number=SeqID_105774
  Homolog annotation: Hit_ID=Q10S87; Match level="QueryCoverage=93%, HitCoverage=96%, E-value=6e-79, Identity=29%"; Hit description =Expressed protein
MAKKVHAHKNNNGVKCYFIYLNRDFSLATIDSFKEAKLSICSLISEHSFPKMIASNLETSGNGMELQVETSQVHCSEGELPYSCQVEDGWSKTNSYSNVYSVKKLNKEDFSKQSGTRNNAPNLVARLMGIDTMPLPLDTKSVVPLDESKHGNMERKFSKNGMNPRGSVGRGSSNFNSSSHMVFDSFYRDIDVGDDQCGQNFGKPRPREHPQEEELKKFKKEFEAYQASRFKEGSKNVEIGSGSGRMLSQENLSKEKMLQIASSKTDSHTFKTKLLNGNMMEPISTKKNEPFPSRSKTPSRDFEESLMMKSRSRLDICASSTQIVILKPGSDRICNCNHEQNCISLSGTLHGRKGIEDFLEEVREQLKCELQGIRASGTETPHNEKLSDAKEVRESVTRDAEPNLLRSESTRSYKSKLQFNGPSSPEFFNIDTRRFLSERLGNIVKSELHLEIPEVACYLDNGRIRLKQDTVKFANDKSQWGVLKEKKELQTGSYRHKLDDNVLFHKELSPRNLERSLSAPASGTSFGRLLLEDRHILTGALIQRKLEAVEAMPVDVKKKKRDGFNIKEKLSNFKYTLGLRGKLFGKRVQSIVESHGSEHGPILRDIRSGPTVLMKYGERHENSTEVPPSPASMCSCVHEEDWRKTGYSSLTSTPDASSLDDIFIPKVFRDISSGLNELKRQLSQLDSDGSDDFTTKPEPFESELVHLDDPAESYVRDLLVASGLYFGSWNKSLLRGDTFAKPIGNSVFEEVEESHNNLIKEDERSTKDQNKNKLEHKVLLDLLNEALSIVLRSHLTLSRFRRKLSNSSMQPPPCGKELLKLVWDIVNVSLNPTSNTCPYSLDSLLSQDLGSISWSGLTNDQIDTLEREMACLITDDLVEEFTKDMLF

SEQ ID NO: 222553 - protein, 270 aa, Glycine max
  Coding DNA Sequence Number=SeqID_105775
  Homolog annotation: Hit_ID=Q9LIL9; Match level="QueryCoverage=71%, HitCoverage=54%, E-value=2e-61, Identity=63%"; Hit description =Arabidopsis thaliana genomic DNA, chromosome 3, BAC clone:F4B12
MVLLLCQEPTLLKGLCCWVMTDAGNQLFQKLKPLGKGSEPILYSTYRKEVFTVIVSNHIFNNTRPHTRPFGFEGLKPIMDRLGEAYDSPEKTELALQLCWAIGEHGGGGGSHKDEARELFESLELLLYENLSSSRVGMTQEVSDEDTYRRSSQSRLLCFVVTAIAKLATYHRELLPRARVSLGKVARSRISDPRVWRRACDFLGLMKDPAICASILGPSRPAQGTTQKVGSINWSEGSTKMIAHIPFYILGEQEGPPFHDFSFSDIIPSI

SEQ ID NO: 222554 - protein, 97 aa, Glycine max
  Coding DNA Sequence Number=SeqID_105776
  Subcellular localization annotation: CTP_CleavageSite=33; ConfidenceScore=5.20e-01
MPWIFLLHHYNLFFLSLSENPNPGSSFAPLSLSATTGSGIKVLEWKDSMLGMSQISSSRGGLLAIKSGFVKDLVGLLKSWYHEGCGIGKELIDVAMV

SEQ ID NO: 222555 - protein, 254 aa, Glycine max
  Coding DNA Sequence Number=SeqID_105777
AARAAAEEKAARAAKAVAAAKRALDLVASFSEEVAGKERNLKKNKSKKHLPVQLLYKNNQQIENCRTDEELARKLHRAMNSSPRISKSSPNSDPKRSKHKKPRSSSSFEMTEGSESGVALRQDCLSLNNEHAIAGKIDSEGSIQEVCSSKKDKKVVKYHRPSQLEIDNGEAELSQSKGKNCEDLSPIGKKRGRVKLKKLPLSICTSKDRAQPKEEIRARSSPLTRTNTGNNPVNSMPSFTVESSTDRVMPIEAT

SEQ ID NO: 222556 - protein, 428 aa, Glycine max
  Coding DNA Sequence Number=SeqID_105778
  Gene Ontology: Mol. function=hydrogen:amino acid symporter activity; Cellular component=integral to membrane; Biological process=amino acid transport
  Homolog annotation: Hit_ID=Q8LAI4; Match level="QueryCoverage=95%, HitCoverage=94%, E-value=1e-142, Identity=60%"; Hit description =Putative amino acid transport protein
  Pfam annotation: Domain name=Aa_trans; Domain location=24-421; Score =233.0; E_value=6.6e-67; Accession=PF01490.8; Description =Transmembrane amino acid transporter protein
  Subcellular localization annotation: CTP_CleavageSite=49; ConfidenceScore=5.33e-01
MGFHNNNNNNNNNVETPFLSNAPPLSSKFKTLANIFISIVGSGVLGLPYSFKKTGWVTGMLMLFLVAFLTYHCMILLVHTRRKLEHSNDDVNVGFPKINSFGDLGHAIVGPLGKLFVDVMIVFSHCGFCVSYLIFISTTLAYLAGDDDTSSASWSSLFWGFATPKVLFLWGCFPFQLGLNAIPTLTHLAPLSIFADFVDIVAKSVVMVDDVFVFMKNRPPLKAFGGWSVFLYGLGVAVYAFEGIGLVLPLEAEAKDKEKFGGVLGVGMFLISLLYASFAALGYLAFGEGTQEIITTNLGQGVVSALVQLGLCINLFFTFPLMMNPVYEVVERRLCDYKFCLWMRWLLVFGVSLVALMVPNFADFLSLVGSSVCVILSFVLPAMFHYLVFREEIGWSKMVCDGLLVVFGLVIAVTGTWSSLMNIFGPNA

SEQ ID NO: 222557 - protein, 544 aa, Glycine max
  Coding DNA Sequence Number=SeqID_105779
  Gene Ontology: Mol. function=protein serine/threonine kinase activity; Cellular component=spindle pole body; Biological process =protein amino acid phosphorylation
  Homolog annotation: Hit_ID=O81783; Match level="QueryCoverage=79%, HitCoverage=95%, E-value=1e-176, Identity=70%"; Hit description =Protein kinase - like protein
  Pfam annotation: Domain name=Pkinase; Domain location=38-423; Score =188.0; E_value=2.3e-53; Accession=PF00069.15; Description=Protein kinase domain
  Pfam annotation: Domain name=Pkinase_Tyr; Domain location=38-421; Score=-94.4; E_value=1.1e-06; Accession=PF07714.7; Description =Protein tyrosine kinase
  Pfam module annotation: Pfam domain module=Pkinase::Pkinase_Tyr; Domain location=38-423::38-421
MSCSSSSGSEEDDEGFDSYRKGGYHAVRVADQFAGGRYIAQRKLGWGQFSTVWLAYDTTTSGCFHSGTIPLAYVALKIQKSAAQFVQAALHEIDVLTSLSDGADMDSKCVVHLIDHFKHTGPNGQHLCMVLEFLGDSLLRLIKYNRYKGLPLNKVREICKCILIGLDYLHREHGIIHSDLKPENVLLVSTIDPGKDPVRSGLTPILERPEGSINGGGVTSLIEKKLKRRARRAVAKISGRSSPIGGIEAPKSERNLDGIDVRCKVVDFGNACWADKQFAEEIQTRQYRAPEVILHAGYSFSVDMWSFACIAFELATGDMLFTPKDGQGFSEDEDHLALMMELLGKMPRKVATSGAKSKDFFDRHGDLRRIRRLKFWPLSKLLVVRYKFSERDAHEFSEFLSPLLDFAPEKRPTAQQCLQHPWLQGIESTPNEMRNESSVEKVDVGMSNLQIKKRDLRSSLMMLRREFVVTDVDDDTVNLRDTMMLRRNETTTKGRASSESDVAAEEEMTCRNAVFEIRLWPRRTVVAAIAGGGLNLGREKYDVE

SEQ ID NO: 222558 - protein, 82 aa, Glycine max
  Coding DNA Sequence Number=SeqID_105780
  Subcellular localization annotation: CTP_CleavageSite=54; ConfidenceScore=5.37e-01
MDLSFLQSPHAQSFLRSSKAQYQMINNTMGEGNTSTRDMSTINNTMGEGSTSTRDMSTDKINVDLNEYPIEDISLENGYSGT

SEQ ID NO: 222559 - protein, 296 aa, Glycine max
  Coding DNA Sequence Number=SeqID_105781
  Gene Ontology: Mol. function=protein binding; Cellular component =integral to membrane; Biological process=defense response to fungus
  Homolog annotation: Hit_ID=Q9ZS82; Match level="QueryCoverage=91%, HitCoverage=30%, E-value=2e-48, Identity=40%"; Hit description=NL0D
  Pfam annotation: Domain name=LRRNT_2; Domain location=27-78; Score =34.5; E_value=3.7e-07; Accession=PF08263.3; Description=Leucine rich repeat N-terminal domain
  Pfam annotation: Domain name=LRR_1; Domain location=109-132; Score =10.4; E_value=3.2; Accession=PF00560.23; Description=Leucine Rich Repeat
  Pfam annotation: Domain name=LRR_1; Domain location=134-156; Score =13.9; E_value=0.6; Accession=PF00560.23; Description=Leucine Rich Repeat
  Pfam annotation: Domain name=LRR_1; Domain location=188-210; Score =4.4; E_value=43; Accession=PF00560.23; Description=Leucine Rich Repeat
  Pfam annotation: Domain name=LRR_1; Domain location=216-238; Score =7.8; E_value=10; Accession=PF00560.23; Description=Leucine Rich Repeat
  Pfam annotation: Domain name=LRR_1; Domain location=240-261; Score =6.4; E_value=18; Accession=PF00560.23; Description=Leucine Rich Repeat
  Pfam annotation: Domain name=LRR_1; Domain location=264-286; Score =7.2; E_value=13; Accession=PF00560.23; Description=Leucine Rich Repeat
  Pfam annotation: Domain name=LRR_1; Domain location=83-102; Score =3.5; E_value=63; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1; Domain location=27-78::109-132::134 -156::188-210::216-238::240-261::264-286::83-102
MNINNILFWLLLPYFILASSSSSSFCNHHDTSALLLFKNSFALNTSLQYYYGLASCSSKTESWKNGTDCCEWDGVTCDTISGHVIGLDLSCSNLQGQLHPNSTIFSLRHLQQLDLSYNDFSGSSLYSAIGDLVNLMHLNLSHTLLSGDIPSTISHLSKLRSLHLGGDYQSMMRVDPYTWNKLIQNATNLRELSLDFVDMSYIRESSLSLLTNLSSSLISLSLSFTELQGNLSSDILSLPNLQQLDLSFNKDLGGELPKSNWSTPLSYLDLSKTAFSGNISDSIAHLESLNEIYLGS

SEQ ID NO: 222560 - protein, 72 aa, Glycine max
  Coding DNA Sequence Number=SeqID_105782
MEETLNLQDTLTCHCVEGHGRSQASSSNSFPLEIFRSDYGVPDDYADNDTVFGEHGKLNVVPYLKYDMHAYA

SEQ ID NO: 222561 - protein, 601 aa, Glycine max
  Coding DNA Sequence Number=SeqID_105783
  Gene Ontology: Mol. function=protein serine/threonine kinase activity; Cellular component=membrane; Biological process=protein amino acid phosphorylation
  Homolog annotation: Hit_ID=Q70KR7; Match level="QueryCoverage=93%, HitCoverage=97%, E-value=0.0, Identity=72%"; Hit description=Nod -facor receptor 1b
  Pfam annotation: Domain name=LysM; Domain location=121-166; Score =5.1; E_value=0.17; Accession=PF01476.10; Description=LysM domain
  Pfam annotation: Domain name=LysM; Domain location=186-228; Score =4.8; E_value=0.18; Accession=PF01476.10; Description=LysM domain
  Pfam annotation: Domain name=Pkinase; Domain location=327-573; Score =46.6; E_value=2.4e-11; Accession=PF00069.15; Description=Protein kinase domain
  Pfam annotation: Domain name=Pkinase_Tyr; Domain location=327-573; Score=54.6; E_value=8.1e-16; Accession=PF07714.7; Description =Protein tyrosine kinase
  Pfam module annotation: Pfam domain module=LysM::LysM::Pkinase::Pkinas e_Tyr; Domain location=121-166::186-228::327-573::327-573
LEIHFSDLSFFMSLLCALRDPMELKKWLLFFLLLEYVCCNAESKCVKGCDVALASYYVSPGYLLLENITRLMESIVLSNSDVIIYNKDKIFNENVLAFSRLNIPFPCGCIDGEFLGHVFEYSASAGDTYDSIAKVTYANLTTVELLRRFNSYDQNGIPANATVNVTVNCSCGNSQVSKDYGLFITYLLRPGNNLHDIANEARLDAQLLQSYNPGVNFSKESGDIVFIPGKGLATSASVGIPIAGICVLLLVICIYVKYFQKKEGEKAKLATENSMAFSTQDVSGSAEYETSGSSGTASTSATGLTGIMVAKSMEFSYQELAKATNNFSLENKIGQGGFGIVYYAELRGEKTAIKKMDVQASTEFLCELKVLTHVHHLNLGSLFLVYEYIDNGNLGQYLHGTGKDPFLWSSRVQIALDSARGLEYIHEHTVPVYIHRDVADFGLTKLIEVGGSTLQTRLVGTFGYMPPEYAQYGDISPKVDVYAFGVVLYELISAKNAVLKTVESVAESKGLVALFEEALNQSNPSESIRKLVDPRLGENYPIDSVLKIAQLGRACTRDNPLLRPSMRSIVVALLTLSSPTEDCYDDTSYENQTLINLLSVR

SEQ ID NO: 222562 - protein, 166 aa, Glycine max
  Coding DNA Sequence Number=SeqID_105784
  Gene Ontology: Mol. function=protein serine/threonine kinase activity; Cellular component=membrane; Biological process=protein amino acid phosphorylation
  Homolog annotation: Hit_ID=Q6UD74; Match level="QueryCoverage=99%, HitCoverage=27%, E-value=5e-58, Identity=68%"; Hit description=LysM domain-containing receptor-like kinase 7
MDENMVADFGLNKLIDVGSSSLPTANLKGIFGYMPPEYAYGNVSPKIDVYAFGVVLYELISAKEALIRGGVTGAELKGLFDEVFDQQDPTEGLKKLVDPRLGDNYPIDSVCKMAQLARACTESDPQQRPNMISVVVTLTALTSTTEDWDIASIIENPNHANLMSGK

SEQ ID NO: 222563 - protein, 66 aa, Glycine max
  Coding DNA Sequence Number=SeqID_105785
MDVSSCTGENRERPKRLHLKRLGENSFLCGFLAFGIAKDETINNEKNCFALKAVSIPQKNMYMPYS

SEQ ID NO: 222564 - protein, 562 aa, Glycine max
  Coding DNA Sequence Number=SeqID_105786
  Gene Ontology: Mol. function=unfolded protein binding; Cellular component=chaperonin-containing T-complex; Biological process =cellular protein metabolic process
  Homolog annotation: Hit_ID=Q653F6; Match level="QueryCoverage=94%, HitCoverage=94%, E-value=0.0, Identity=87%"; Hit description =Putative t-complex protein 1 theta chain
  Pfam annotation: Domain name=Cpn60_TCP1; Domain location=35-530; Score=616.1; E_value=3.1e-182; Accession=PF00118.14; Description=TCP- 1cpn60 chaperonin family
MSAMLQPQIILLKEGTDTSQGKPQLVSNINACTAVADVVRTTLGPRGMDKLIHDDKGTVTISNDGATIMKLLDIVHPAAKILADIAKSQDSEVGDGTTTVVLLAAEFLREAKPFIEDGVHSQNLIRSYRTACSLAIEKIKDLAVSIEGKSLEEKKSLLAKCASTTLSSKLIGGEKEFFAPMVVDAVISIGNEDRLNMIGIKKVPGGTMRDSFLVNGVAFKKTFSYAGFEQQPKKFLNPKILLLNVELELKSEKENAEIRLSDPAQYQSIVDAEWNIIYDKLDKCVSSGAKVVLSRLAIGDLATQYFADRDIFCAGRVAEEDLKRVAAATGGTVQTSVNNIIDEVLGTCEIFEERQVGNERFNIFNGCPSGQTATIVLRGGADQFIEEAERSLHDAIMIVRRALKNSTVVAGGGAIDMEISRYLRQHARTIAGKSQLFINSYAKALEVIPRQLCDNAGFDATDVLNKLRQKHALPSGEGAPYGVDIATGGIADSFANFVWEPAVVKINAINAATEAACLILSVDETIKNPKHIVWEWYPPCTACEWGFHGLLREETVRASFLT

SEQ ID NO: 222565 - protein, 86 aa, Glycine max
  Coding DNA Sequence Number=SeqID_105787
  Gene Ontology: Mol. function=hydroxymethylglutaryl-CoA reductase (NADPH) activity; Cellular component=integral to membrane; Biological process=lipid metabolic process
  Homolog annotation: Hit_ID=P93081; Match level="QueryCoverage=59%, HitCoverage=9%, E-value=7e-12, Identity=86%"; Hit description=3 -hydroxy-3-methylglutaryl coenzyme A reductase
MEWGMYRHKALKERLKVQARSQQDQTQDSWAPLLLDVSDVCHCSRAASEQPHEIQQIKQRSNQNIIILRSGTWLQSLGKENGETLD

SEQ ID NO: 222566 - protein, 130 aa, Glycine max
  Coding DNA Sequence Number=SeqID_105788
MTKKSTRNMEIAKRSGTNFVKVVETLHGRMYKLLPLDDQSTLAMSVQLELRIVPPVEPEVAPSSVHVRIKGSCVDPSEHDPDTDALDKCGLYPDDNSPCLVALGRVYKGSIIVHHILLRKNLVNIGIDEV

SEQ ID NO: 222567 - protein, 232 aa, Glycine max
  Coding DNA Sequence Number=SeqID_105789
  Gene Ontology: Mol. function=3-oxo-5-alpha-steroid 4-dehydrogenase activity; Cellular component=integral to membrane; Biological process=sphingolipid metabolic process
  Homolog annotation: Hit_ID=Q8GTD7; Match level="QueryCoverage=99%, HitCoverage=72%, E-value=3e-96, Identity=74%"; Hit description =Steroid 5-alpha reductase
MKVTVVSRSGREVVKGGVELSDSEIVREKEDAFFCGMLFASPIAKKYPSRQRLTLPVQPGSKERPVVLNYKKSLKDYTSGNSETLTVVFKDLGPQVSYRTLFFCEYLGPLLLYPVFYYLPVYQYFGYKGERVIHPVQTYALYYWCFHYAKRILETFFVHRFSHATSPLSNVFRNCAYYWTFGSYIAYYVNHPLYTPVNDLQMKIGFAIGILCQISNFYCHIILKNLRSPGGE

SEQ ID NO: 222568 - protein, 47 aa, Glycine max
  Coding DNA Sequence Number=SeqID_105790
MADNGCTRRRCDTLETGLMDAECVDERWIEDTNRAKKLTSGLSGVKK

SEQ ID NO: 222569 - protein, 203 aa, Glycine max
  Coding DNA Sequence Number=SeqID_105791
MEKMVRYHVKEMHRIGKVTSKVLLRSPNIKKGRHPRLLALIISSMQVMDKNTKETYGSNEGMSISYSFILTPSVKPKKKDVHVVDLSPYQGPFNLEVDKDKKNHDTLVVSSKIKSLNKEQNDVRKFVKRNDDVDKDEVQSQSESSPLKQPSHQEPTIEENFMEFDSSINNPSNPIIKNKAQPEMAQYGEEELLNMDVLAVIIP

SEQ ID NO: 222570 - protein, 72 aa, Glycine max
  Coding DNA Sequence Number=SeqID_105792
MTVSQVHKPYNVSQRRSTYVPHAGVPLNRWIQLGHQGSSSQWQPFEEHVENQVKKTSKVEKECNLGAIDEQW

SEQ ID NO: 222571 - protein, 109 aa, Glycine max
  Coding DNA Sequence Number=SeqID_105793
MDTLSLFYYEKMVGYMPSSFADLVFVGERIEVGLKRGKFDYAYTMSFGNRRPGVNGAKKKEGETHAMTVVPTWSSSSQTPHNPMYQYPSHQYHYSTNISPPPCPTPIRP

SEQ ID NO: 222572 - protein, 109 aa, Glycine max
  Coding DNA Sequence Number=SeqID_105794
MDAMMSIRKMMEVNTATVAIVSIVIEMDLIHPSDFNRVSRPISDVVGLGGEAAENAGGPYYVQESLVGEAITWYTNQKPSRVRSWMDLMAAFIRQYQYNSDMAPDRMQL

SEQ ID NO: 222573 - protein, 153 aa, Glycine max
  Coding DNA Sequence Number=SeqID_105795
MAAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSSYHHYGHLCSG

SEQ ID NO: 222574 - protein, 102 aa, Glycine max
  Coding DNA Sequence Number=SeqID_105796
  Gene Ontology: Mol. function=catalytic activity; Cellular component =cytoplasm; Biological process=metabolic process
  Homolog annotation: Hit_ID=Q6YXW6; Match level="QueryCoverage=73%, HitCoverage=25%, E-value=3e-20, Identity=48%"; Hit description =Putative sucrose-phosphatase
  Pfam annotation: Domain name=S6PP; Domain location=8-96; Score= -120.5; E_value=0.013; Accession=PF05116.4; Description=Sucrose-6F -phosphate phosphohydrolase
MDRLNGSTNLMIVSDLDFTMVDHDNPENLALLRFNALWEASYCHNSLLVFSSGRSPTGDGWKQHLDKKWNRDIVVKLREIGLYNHARYAGLKGQQICTNNAK

SEQ ID NO: 222575 - protein, 65 aa, Glycine max
  Coding DNA Sequence Number=SeqID_105797
MILYKVIQHTSEDASGLQDVKVDPEEVDMPNPSTIQKQVDEDAYDLVEADNVVGELEDDFEFEFV

SEQ ID NO: 222576 - protein, 55 aa, Glycine max
  Coding DNA Sequence Number=SeqID_105798
MVKMILANRQSSAQLMKMRIRYIIEWRKLKKLKIKVAKLIAKLAMLKPYNTLTML

SEQ ID NO: 222577 - protein, 322 aa, Glycine max
  Coding DNA Sequence Number=SeqID_105799
  Gene Ontology: Mol. function=oxidoreductase activity; Cellular component=vacuole; Biological process=hydrogen peroxide catabolic process
  Homolog annotation: Hit_ID=O81772; Match level="QueryCoverage=99%, HitCoverage=94%, E-value=1e-111, Identity=60%"; Hit description =Peroxidase 46 precursor
  Pfam annotation: Domain name=peroxidase; Domain location=27-285; Score=349.7; E_value=4.9e-102; Accession=PF00141.13; Description =Peroxidase
  Subcellular localization annotation: CTP_CleavageSite=32; ConfidenceScore=5.09e-01
MARIILHARSLVFNFYAASCPTAEFIVRNTVSSSSSSDSSIPGKLLRLVFHDCFVEGCDASLMLLGNNTEKSDPANRSVGGFSVIESAKRVLEFLCPGTVSCADIIALAARDAVEIVGGPMIQIPTGRRDGMVSVASNVRPNILDTSFTMDEMINRFSDKELSLFDLVILSGAYSFKFLAGGFKRAHTIGTAHCSSFRDRFQEDSKGKLTLIDKTLDSTYADKLMQECPLSASPSVQVNNDPETSMVFDNQYYRNLLTNKGLFQSDSALLRDNRTRKFVEDLANDQEFFFESWGQSFLKLTSIGVKTGDEGEIRRSCASTNA

SEQ ID NO: 222578 - protein, 44 aa, Glycine max
  Coding DNA Sequence Number=SeqID_105800
MAVNISIARGESLGKACLLIVVVCGTKMCHTIIWDVSPPRNTPD

SEQ ID NO: 222579 - protein, 116 aa, Glycine max
  Coding DNA Sequence Number=SeqID_105801
MSSTTKAPPSSNDAMSTEESGWTTYFDDFFNNHVVDNNKCSMPLSGGVASSSLVSDAASSAEKKKVANSKQVEEFNYVNRYVKRSSFKKRKDVITALIDDSLEDTATSPLNSPKVH

SEQ ID NO: 222580 - protein, 73 aa, Glycine max
  Coding DNA Sequence Number=SeqID_105802
MHNKRDCIELAEENKESMMRLEALTQEAQLQDEVYQAQLEEIQSLKEKLNWTKLPPNLWTSISGEEARNNSSN

SEQ ID NO: 222581 - protein, 930 aa, Glycine max
  Coding DNA Sequence Number=SeqID_105803
  Gene Ontology: Mol. function=ionotropic glutamate receptor activity; Cellular component=integral to membrane; Biological process=ion transport
  Homolog annotation: Hit_ID=Q9C8E7; Match level="QueryCoverage=94%, HitCoverage=95%, E-value=0.0, Identity=57%"; Hit description =Glutamate receptor 3.3 precursor
  Pfam annotation: Domain name=ANF_receptor; Domain location=46-412; Score=324.7; E_value=1.6e-94; Accession=PF01094.18; Description =Receptor family ligand binding region
  Pfam annotation: Domain name=Lig_chan; Domain location=586-850; Score= 287.8; E_value=2.1e-83; Accession=PF00060.17; Description=Ligand -gated ion channel
  Pfam annotation: Domain name=SBP_bac_3; Domain location=467-809; Score=-5.2; E_value=1e-07; Accession=PF00497.10; Description =Bacterial extracellular solute-binding proteins, family 3
  Pfam module annotation: Pfam domain module=ANF_receptor::Lig _chan::SBP_bac_3; Domain location=46-412::586-850::467-809
  Subcellular localization annotation: CTP_CleavageSite=50; ConfidenceScore=5.31e-01
MRKVWLLVIVMFYHVFPSKGISNVSTRPSTVNIGALMSFNSTVGRVAKVAIEAAVDDINSNATILNGTKLNISMLDTKLSTGFLGIIDSLRLMEKDTVAIIGPQFSVMAHVISHIANEMQVPLLSFAATDPTLTSLQFPYFVRTTQSDLYQMAAVAEIVDHFQWRDVIAIYIDDDHGRNGVAALGDKLAEKRGKISYKAPFRPNNITREEINNALVKIALIESRVIVLHIYPSFGLQVLHVARSLGMMGSGYVWIATDWLSTLLDSNPSLFTTQAMNDIQGVITLRMYTPESEIKRNFSSRWNKLSQKKDPEEGPFALNTFGLYAYDTVWLLASALDAFFKSGGTLSFSNDSSLNMLKGDTLKLDTMGVFVDGVMLLEKILEVNRTGLTGQMMFSPDGNLVHPSYEVINVIGTGIRRIGYWSETSGLHTGETPNHSNSSEGLFGVIWPGQTTQTPRGWVFASNGRHLRIGVPLRISYREFVSRTEGTEMFGGYCIDVFTAALNLLPYPVPYKFVPFGDGKTNPLNTKLLNKITAGEFDAVVGDITITTNRTKIVDFTQPYIESGLVVVAPIRKMKSSAWAFLRPFTPMMWFVTGMFFLAVGVVVWILERRLNEDFRGPSRRQFVTIIWFSFSTLFFAHREKTVSTLGRLVLIIWLFVVLILNSSYIASLTSILTVEQLSSSVKGIESLATSNERIGFLSGSFAENYLTEELNIHRSRLVPLNSPSEYEKALKDGPANGGVTAIIDERAYMELFLATRCEYGIVGQEFTKMGWGFAFPRDSPLAIDMSTAILKLSENGDLQRIHDKWLTRSACSSEGAKQGIDRLELESFWGLFLLSGIACFIALLCYVIRMAYRFSRHPNSNPEGCSSYYTRLRSFFTFVNEREEEEEKNIMSKRKRTEKGSSRRVAHEDGLIMDGSSVSVHIENDAAQG

SEQ ID NO: 222582 - protein, 233 aa, Glycine max
  Coding DNA Sequence Number=SeqID_105804
MAKFDPEIVMKFYANVWPTEGGVRDKHSWPKAESTPLASRGGYQPVAVHSGARLCLERSGETGADHAHQHDHPYANLDDVSVHVAQLISDAIYQFVGIMPPRHPVDPERSNRALGFPSLITACANSMEWSGATIAKGGPVAASYRCATIASTRDTFPGMHTYMQHVTSQQATNHRGQDPNLFPWPTPEQFGATVAWPRDETDFQTQARPVGTPGDDRRAQEDDDKANVLDFFT

SEQ ID NO: 222583 - protein, 75 aa, Glycine max
  Coding DNA Sequence Number=SeqID_105805
MSLNVIRVHLLEEAFNAKILSLLALTRDKIEELIQEGALANYIYTPNNNTDSYRGHGRGHGSHHGGQRQQSHGDK

SEQ ID NO: 222584 - protein, 931 aa, Glycine max
  Coding DNA Sequence Number=SeqID_105806
  Gene Ontology: Mol. function=ionotropic glutamate receptor activity; Cellular component=integral to membrane; Biological process=ion transport
  Homolog annotation: Hit_ID=Q84W41; Match level="QueryCoverage=93%, HitCoverage=97%, E-value=0.0, Identity=57%"; Hit description =Glutamate receptor 3.6 precursor
  Pfam annotation: Domain name=ANF_receptor; Domain location=56-419; Score=308.9; E_value=9.3e-90; Accession=PF01094.18; Description =Receptor family ligand binding region
  Pfam annotation: Domain name=Lig_chan; Domain location=600-851; Score= 262.6; E_value=7.7e-76; Accession=PF00060.17; Description=Ligand -gated ion channel
  Pfam annotation: Domain name=SBP_bac_3; Domain location=481-823; Score=-11.7; E_value=2.7e-07; Accession=PF00497.10; Description =Bacterial extracellular solute-binding proteins, family 3
  Pfam module annotation: Pfam domain module=ANF_receptor::Lig _chan::SBP_bac_3; Domain location=56-419::600-851::481-823
  Subcellular localization annotation: CTP_CleavageSite=61; ConfidenceScore=5.46e-01
MAFQRASATMIGVWIVVLMVLSKGLSSSGVVSDNSTIPAFVNIGVLYSFNTSVGRMVKTAVQAAVDDVNFDQSILANTKLKASLQEDTKYRGFLSIAEALQLMATQTVAIIGPQTSTTAHVISHIANELQVPLLSFTATDPTLSSLQFPFFIRTAFSDIYEMTAIADFVNYFGWREVIAVYGDDDHGRNGIGALGDKLAERRCKISFKAPMTPETTREEITDVLVQVALAESRVIVLHTSTAWGPKVLSVAKSLGMMENGYVWITTTFLSTWLDIGSPLSSDATDDMQGVITLRMYIPDSERKRWFFSRWKNLTTGKTANGSQGLSTYGIFAYDTVYALAHALDAFFKQGNQITFSRDPKLSQLRGDNMHLDAVKIFNEGKLLRKYIYEVNMTGVSGLFKYTSDGNLVNPAYEIINVIGTGTRRVGYWSNYTGLSIVPPEALYSKPPNRSSASQKLLPVLWPGETTHRPRGWVFPNNGRMLKIGVPKRVSYREFVSQVQGTDMFKGFCIDVFLSAVNLLPYAVPYKFVSYGDGDSNPSNTELVRLITAGVFDAAVGDITITTERTKMVDFTQPYIESGLVVVASVKKTDSNAWAFLTPFTPMMWTVTAVFFLLVGAVVWILEHRLNDDFRGPPKQQMVTILWFSFSTMFFAHRENTVSTLGRFVLLIWLFVVLIINSSYTASLTSILTVQQLSSPVKGIESLISSKEPIGYLQGSFTRTYLIDEIGIDESRLVPLKTPEETTEALKKGPQKGGVAAYVDERAYIELFLSSRCDYSIVGQEFTRNGWGFAFPRDSPLAVDLSTAILELAENGDLQRIHDKWLLSSACLSQGAKLEVDRLNLRSFWGLYLTMRQYSKHGPEELESSGHGSGSSRLRTFLTFVDEKEEIVKSRSKRKKMEGISYRSTSEVGSSITFNKAYSQASLNRIDSVNEI

SEQ ID NO: 222585 - protein, 1034 aa, Glycine max
  Coding DNA Sequence Number=SeqID_105807
  Gene Ontology: Mol. function=ionotropic glutamate receptor activity; Cellular component=integral to membrane; Biological process=ion transport
  Homolog annotation: Hit_ID=Q9C8E7; Match level="QueryCoverage=89%, HitCoverage=95%, E-value=0.0, Identity=55%"; Hit description =Glutamate receptor 3.3 precursor
  Pfam annotation: Domain name=ANF_receptor; Domain location=119-486; Score=332.1; E_value=9.4e-97; Accession=PF01094.18; Description =Receptor family ligand binding region
  Pfam annotation: Domain name=Lig_chan; Domain location=660-956; Score= 241.5; E_value=1.8e-69; Accession=PF00060.17; Description=Ligand -gated ion channel
  Pfam annotation: Domain name=SBP_bac_3; Domain location=541-915; Score=-20.1; E_value=9.8e-07; Accession=PF00497.10; Description =Bacterial extracellular solute-binding proteins, family 3
  Pfam module annotation: Pfam domain module=ANF_receptor::Lig _chan::SBP_bac_3; Domain location=119-486::660-956::541-915
MRLNSNLSYFTPTRGRIQTSTSSSKQQVELGAELPPTNSIHRGPTWLRTWHNSLNTGHVYIDPEERSPVKYNMSKVWLLVLVILYSGFPSIGTTTTDSTSPSAVNIGAILSFNSTIGKVAKVAIHAAVDDINSNATILNGTKLNITLLDTKLSTGFLGIIDSFLLMEKDTVAIIGPQYSVMAHVISHIANEMQVPLLSFAATDPTLTSLQFPYFVRTTQSDLYQMAAVAEIVDHFQWRDVIAIFVDDDHGRNGIAALGDKLAEKRCKISYKVPFKPDNISHEEINSALVKVALMESRVIVLHIYPSSGLEVLHHAAQSLGMMGSGYVWIATDWLSTVLDSEPSLFSSSAMNDIQGVITLRMHAPDSDMKKQFVSRWKKLSQKEDSNQDPFGVNIFGLYAYDTVWLLASALDSFFKSGGTLSFSNDSSLNMLRGDSLNLDTIGVFVNGSMLLQKILEVNRTGLTGQMMFSPDGNLVHPSYEIINVIGTGIRRIGYWSETSGLHTGEGPNHSNFSEGLFGVIWPGQTTQTPRGWVFASNGRHLRIGVPLRISYREFVSKIEGTEMFGGYCIDVFTAALNLLPYPVPFKFIPFGDGKTNPLNLDLLHMITTGAFDAVVGDITITTNRTKIADFTQPYIESGLVVVAPIKKLKSSAWAFLTPFTPMMWFVTGMFFLVVGAVVWILERRINDDFRGPPRRQFVTIVWFSFSTLFFAHIILDAFLVYRTETQFLPDCKDQSTKKKNTFYAGEKTVSTLGRLVLIIWLFVVLILNSSYIASLTSILTVEQLSSPVKGIESLVISSDRIGFLRGSFAENYLTEELNIHRSRLVPLNSPSEYEKALKDGPANGGVAAIIDERAYMELFLATRCEFGIVGQEFTKMGWGFGFPRESPLAIDMSTAILKLSENGDLQRIHDKWLTRSACSSEGAKQGIDRLELKSFWGLFLLSGIACFIALLCYVIRMAYRFSRDSNSNNIECSSLSARLRSFLSFVNEREGEDKCWPKTRRKEKCSCRKVVHEDGSLDDSTVRVHIENNVTAQD

SEQ ID NO: 222586 - protein, 152 aa, Glycine max
  Coding DNA Sequence Number=SeqID_105808
MDRGGRLVPCQCRPFEGGGKDLAHHGVINGVQNDLCEGELSVAFLGMCLGIGGWWGQKARWGWWRWQRWWMLGCKSSFEGEVPAKGTPKSKSMVLRGVCVSSTEMSQTFLRISLLGLYIDVGVKGVARCLEPRLSSMPRGLIHGWQLGITMS

SEQ ID NO: 222587 - protein, 113 aa, Glycine max
  Coding DNA Sequence Number=SeqID_105809
MFKIFKAEVKYKLNKRIKNVQSDHGGEYYDKYGGSGEQRLGPFAKFQEILGIVPQYTMLGSHSMNDVAERQNCGSNAFQDYFDDAKESRVKQVPKNQESSKFQESRSRFKIQE

SEQ ID NO: 222588 - protein, 621 aa, Glycine max
  Coding DNA Sequence Number=SeqID_105810
  Gene Ontology: Mol. function=endoribonuclease activity, producing 5' -phosphomonoesters; Biological process=protein amino acid phosphorylation
  Homolog annotation: Hit_ID=Q1SZQ5; Match level="QueryCoverage=88%, HitCoverage=61%, E-value=1e-147, Identity=51%"; Hit description =Protein kinase; PUG; Quinonprotein alcohol dehydrogenase-like
  Pfam annotation: Domain name=Pkinase; Domain location=451-621; Score=- 104.6; E_value=0.025; Accession=PF00069.15; Description=Protein kinase domain
MLHTVGIEIEHEFFRQIVPIHVNASGLTPLRQSFGKAATTALIVTLDGTMYLVDQLESGSTRVIWSFSTGLPIYQSYQAPTKKDNGKENASAALMSGFMECGEGNDWSLYMHDKHFGKMRISESIAEYVARTPTFSDDGAVTLGSKRSTLFEVDAKSGSIIKIHAMSDFDNASAPCSDGKQGVTNILNVKNKDLADPMKLNSPQPLLKIFRTDYSLKSVGPSSGMVLWTMAVAEFEAVLLCQHTSFDLEDEYASDSSLNFRMPYPCQEINQVFRLKKNFRFEPSLTERLLVDYHENDMLSMPNSKLMLPSQPNIDRLFNGHDDNMMLPQPPVEITTPGEVYLNRTSEWPTPLPLILFTVFLLAFSLIYPLVIENQDILKDQDSESELKGSPAKKKKTRKSGKKNGTIDTREKHLSPENEDVLTQKDNEREVWKHFNQGDESVDGRRIGKLFVSNKEIAKGSNGTIVLEGIYECRVVAVKRLVKSHHDVAYKEIQNLIVSDHHPNIVRWHGVEYDSDFVYLALERCTCNLDDLIQIYSDMSENFAFRKDQGFRCLIKSQMEMEKYNTQCLWKENGYPSPLLLKLMSCCGISTHPLTPRLDKWNVEIGELNFFIALGELLGQF

SEQ ID NO: 222589 - protein, 105 aa, Glycine max
  Coding DNA Sequence Number=SeqID_105811
MAEHGSRQKFRHINMPLRLMTLPWWATLHKLAMAVAKKSTMVEPWLLFNNTVRVLSEPDRSLTRCSYLGTCQSIIVTIVQLHVSDRSVPSLITMLRKSTSRHELS

SEQ ID NO: 222590 - protein, 152 aa, Glycine max
  Coding DNA Sequence Number=SeqID_105812
  Gene Ontology: Mol. function=endoribonuclease activity, producing 5' -phosphomonoesters; Cellular component=endoplasmic reticulum; Biological process=protein amino acid phosphorylation
  Homolog annotation: Hit_ID=Q1SZQ5; Match level="QueryCoverage=83%, HitCoverage=14%, E-value=4e-54, Identity=81%"; Hit description =Protein kinase; PUG; Quinonprotein alcohol dehydrogenase-like
  Pfam annotation: Domain name=Ribonuc_2-5A; Domain location=44-149; Score=99.3; E_value=1.1e-26; Accession=PF06479.2; Description =Ribonuclease 2-5A
MDLFLLEFIPEAKDLISCLLNPNPDLRPKATEVLYHPFFWSSEMRLSFLRDTSDRVELENRETNSDLLVTLESVATVALGGKWDERMEPTFIANIGHYRRYNFNSVRDLLRVMRNKLNHYRELPREIQLDRLCNMMCWGGILLTDPIPHPLA

SEQ ID NO: 222591 - protein, 69 aa, Glycine max
  Coding DNA Sequence Number=SeqID_105813
MAYLEAANKDSFRRFWTIRDTYLTSLQAQGISLKKVTHQLGSSIREVQTYNIHGKVWGLNKILKYTLTE

SEQ ID NO: 222592 - protein, 207 aa, Glycine max
  Coding DNA Sequence Number=SeqID_105814
  Gene Ontology: Mol. function=sulfotransferase activity; Cellular component=integral to membrane
  Homolog annotation: Hit_ID=Q1SZN9; Match level="QueryCoverage=87%, HitCoverage=43%, E-value=8e-53, Identity=55%"; Hit description=Auxin Efflux Carrier
MGNLPVVIIPAICDQKGGPFGAPDDCRNRALSYSFCSLALGGVFIWTYTYQLMQNTSLRYKAFEAAEILKIPSKDIDANAEARLLKQNDGYAVDTENQILVDQGPSIATKNMEKCFCHRMMETLVQILAELMSPPTIATRNFTCFHDQFLGFLFGGVKWLRNLIIGHDAPLKVIQDSIQLLGYTPKDRIQNNCIGKNIDVKIIKEKR

SEQ ID NO: 222593 - protein, 1119 aa, Glycine max
  Coding DNA Sequence Number=SeqID_105815
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=99%, E-value=0.0, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=389-523; Score =40.5; E_value=5.7e-09; Accession=PF00665.16; Description=Integrase core domain
  Pfam module annotation: Pfam domain module=RVT_1::RVT_2::rve; Domain location=688-911::692-929::389-523
MKQSMTTFPGNLPILDGKNWDCWQIQMKAILGSQDVSDIVEQGLSALPDGATEEQKVAHKKNKMKDCKSMVLFHQSGTAEKVKLQTLRRQYELMQMEENERIAVYLNRIISHTNAMKSKKVEILKVEKLQGSLEAHEQRLMERSMARSGDQVLQATVSKKGGYGGRSSFRNRGSTETNLEEKPLMLMMVTNHNPKDDERWYIDSGSSSHITGHNNWFVNLDETKKSTVRFADNRVIQAEGIGEVLIKRDDGSSAILSECLYVPNMKSNLISLGQLVEKKFHIDIHNGYLAIFEPVTEKMVIRTKMASNRTFQVSLRNLESQCMTAEILAEDTWLRHLRLGHLNFRDLSMLRNKEMVLGLPAIQIPSKVCDSCLISKQPRNSFSNFTPSRANDLLHIVYSDVCGPFDAPSLGGSKYFVTFIDDLTRKIWIYPIQPKSEVFSVFKNFKALVEKQSGKCIKIFRTDGVENLPQKRLRIFARTRALCMRSKKLPHSFWAEAATTTVYVLNRCPTKKLDGKVPEEAWSGVKPSVRHFRIFGSLCYRHIPDQKRKKLDDKSEAMIFVGYNSTGSYKLYNPKKNEVVFSRDVHFDETQAWNWEKSQERLTFVSSLQFEWEDENTTENVWDIINGTEEFQIDEARPQRQRNLPARLRDFEVYPDNAISKDGDLVQHMALLADTEPVSFEEAITSSVWRDAILEEIKSIEKNNTWELVSLPTEKTPIAVKWIFKIKLKPDGTIEVFAPVARLETIRLLVALASWKRWILWQLDVKSAFLNGPLEEEVFVTQPPSFINKGSEDKVLRLKKALYGLKQAPRAWNRRIDSFLAKTGFHKCSVEHGMYVKQLSQKAGNLYICLYVDDLLITGSSASEIEALKESLKGEFEMTDLGVLSYFLGLEFQKHDCGLFMHQSKYLLEVLKKFKMLDCNPSKTPAEMSCKLGITFSVGVISRFMSDPRHSHMMAAKRILRYLRGTLDFDSNWGGDVLDRKNTVGHLFLFGGAPISWCSKKQDVVALSICEAEYIAACSAACQACWLSSLLEELGVVTTDAVKLLVDSKSTIDLAKNSVSHGRSKHIETKFHFLRDQVTKGKIKLVHCKTKIQLADIFTKALKIDRFKELRMMMNILEL

SEQ ID NO: 222594 - protein, 288 aa, Glycine max
  Coding DNA Sequence Number=SeqID_105816
  Gene Ontology: Mol. function=calmodulin binding; Cellular component =integral to membrane; Biological process=response to biotic stimulus
  Homolog annotation: Hit_ID=Q9FKY5; Match level="QueryCoverage=86%, HitCoverage=46%, E-value=4e-99, Identity=67%"; Hit description=MLO -like protein 10
  Pfam annotation: Domain name=Mlo; Domain location=3-288; Score=297.9; E_value=1.9e-86; Accession=PF03094.6; Description=Mlo family
MLKLARLHRSASKSSRSSAQRGSHERGLSVIVKTEELIRGWKAWEAETSSHGYEFANDPSRFRLTHETSFVKAHASFWTRYSIFFYIGCFFRQFYRSVGKADYLALRNGFITVHLAPGSKFNFQKYIKRSLEDDFKVVVGVSPVLWASFVVFLLLNVNGWHAMFWASLIPVVIILAVGTKLQAALANMAIEITERHAVVQGIPLVQGSDRYFWFGRPQLVLHLIHFALFQYSFGLRNCFHADYKLAVVKVALGLGVLCLCSYITLPLYALVTQSHSNALIDVFSVSMN

SEQ ID NO: 222595 - protein, 672 aa, Glycine max
  Coding DNA Sequence Number=SeqID_105817
  Homolog annotation: Hit_ID=Q1SZN5; Match level="QueryCoverage=18%, HitCoverage=22%, E-value=2e-30, Identity=54%"; Hit description=Mlo -related protein
  Pfam annotation: Domain name=Mlo; Domain location=31-365; Score= -165.2; E_value=5.5e-11; Accession=PF03094.6; Description=Mlo family
MSVLKYRNLFLCLVSWLCCCCVAVASSESSIGSKDLDQTPTWAVAGVCTVFILISITLEKSLHKVGTWLREKHKKALLEALEKVKAELMVLGFLSLLLTFGQSYIVRICIPMDVADKLLPCPYVGNDKGSSSEEEHRRKLLSYERRYLSDDATPYQCKEWVLGLCTPTLRGAFVKRIRGRTCETKDSDVQVECLCSCCRVECCLTSGVVTSRSVKELQVDVACQAPEPEQVLSGCIEDKCYVLFVAADAQYSCIRVTCKVGMHWSRGVCLSGGASWSLFFLKISLLPCFLAYGFPFLLRLSLQSSRGSIEQPIMDLDVISISGSSSEDTRRGASNSESSFSKRVKALCRTGGGTSVPRGRTRSSAVAWEPIPVIMILLLSASGGVTRGGGGDVRASPRVGRNHSAGRHRLPLPSLAIIGPKNFCKLSIQACGSDDFSFLRVASGSSPFYFIYRDGKSCFSFYWQFDPTSPQGYFGATAGLARCMSHSVSSFGEQSPHRLGCIIGDFAWGSLVKQVKLASEIVSPSATIGKGGQLAGEVYPSAIVAKVTPSTPSFVLAKRKRDDGVGLFDRKKSKAPMSLRALRQAPSTVSPAPSSPVVIVVQERTFVAVEVSESATLAGFVVAPSSTATAPLLSVGVVATSALTEPEDDSVSFPCLTVGLSMFERDDLVLDA

SEQ ID NO: 222596 - protein, 376 aa, Glycine max
  Coding DNA Sequence Number=SeqID_105818
  Gene Ontology: Mol. function=transcription regulator activity; Cellular component=nucleus; Biological process=regulation of transcription
  Homolog annotation: Hit_ID=Q2R581; Match level="QueryCoverage=56%, HitCoverage=80%, E-value=1e-29, Identity=37%"; Hit description =Expressed protein
MEEHLTPLAVTHLLQHTLRSLCIHENSQWVYAVFWRILPRNYPPPKWEGQGAYDRSRGNRRNWILVWEDGFCNFAASAAPEVNSGDCSTPPVYGNCEFQPYQGLQPELFFKMSHEIYNYGEGLIGKVAADHSHKWINKEPNDQEINFLSAWHNSADSHPRTWEAQFLSGIKTIALIAVREGVVQLGAVHKVIEDLSYVVLLRKKFSYIESIPGVLLPHPSSSAYPYKIEGGGYGAPEQWHYQGGNNHHHLASPQQTELYDHHGHFNLPLKITPSMSSLEALLSKLPSVVPPTTTQQQPLLPSNSQQQQRRPLEFIMGMQKVAKEELEQEEVYRPELDIGESSSSLPGGGYHQHQHQHHFHQDQNNNVTRSGANNGF

SEQ ID NO: 222597 - protein, 96 aa, Glycine max
  Coding DNA Sequence Number=SeqID_105819
  Gene Ontology: Cellular component=integral to membrane
  Homolog annotation: Hit_ID=Q1SZN9; Match level="QueryCoverage=75%, HitCoverage=17%, E-value=1e-26, Identity=82%"; Hit description=Auxin Efflux Carrier
MGFLQLLEVASAPVIQVLLISAVGAFMATDYCDNLLSAEFRKSLNKIVFFAFTPSLIFASFSKNVSLEDMISWNKPCVVETLRQNRNALPEQDKVF

SEQ ID NO: 222598 - protein, 229 aa, Glycine max
  Coding DNA Sequence Number=SeqID_105820
MTMLEPLRCDVALPVQSQHVDDAPVFMGSEVPTDLRALPRFAHTVHELTDQGGRGHTVRLVICVLCAEVFDKGVEAVYRPRWVVTVPDIQVLIWICGPIIPLEVEWFLPHGYVSLHNVVNERMLRSSPPYWTSRAHAMHEQSAHRPGDSSRGVSYLRPNRVLTMDEQEIVDDRPRDMFYRIPTMDAKCTYQNPEVAHVGVDVAEVDFWTSHIGFRSALSRGQEGEVQNC

SEQ ID NO: 222599 - protein, 34 aa, Glycine max
  Coding DNA Sequence Number=SeqID_105821
MREGKIRQLLRDQSRAYGLERVTGFGGGTIYKSQ

SEQ ID NO: 222600 - protein, 213 aa, Glycine max
  Coding DNA Sequence Number=SeqID_105822
  Gene Ontology: Mol. function=transferase activity, transferring hexosyl groups; Cellular component=integral to membrane; Biological process=metabolic process
  Homolog annotation: Hit_ID=Q59J81; Match level="QueryCoverage=92%, HitCoverage=38%, E-value=3e-48, Identity=54%"; Hit description=Cyclo- DOPA 5-O-glucosyltransferase
MAAEKKGHIVMEPKLHHLWCSRNLGLCFYLGGSNLPHRKTDSDEFHVPGFPQNYKFHRTQLHKFLRAADGTDEWSQFFIPQTALSMKSDGWICNTVEEIEPLGLHLLRNYLQLPVWPVGPLLPPASLSGSKHRAGKEPGIALEACMEWLDLKDENYVLYISFGSQNTIRASQMMALAEGLEESGRSFIWVIWPPFGFDINGEFIAEWLPKGFE

SEQ ID NO: 222601 - protein, 890 aa, Glycine max
  Coding DNA Sequence Number=SeqID_105823
  Gene Ontology: Mol. function=zinc ion binding; Cellular component =nucleus; Biological process=transcription
  Homolog annotation: Hit_ID=Q1S9M8; Match level="QueryCoverage=84%, HitCoverage=96%, E-value=0.0, Identity=70%"; Hit description=FAR1; Zinc finger, SWIM-type
  Pfam annotation: Domain name=FAR1; Domain location=68-286; Score =173.4; E_value=5.6e-49; Accession=PF03101.5; Description=FAR1 family
  Pfam annotation: Domain name=SWIM; Domain location=563-599; Score =47.4; E_value=4.8e-11; Accession=PF04434.8; Description=SWIM zinc finger
  Pfam module annotation: Pfam domain module=FAR1::SWIM; Domain location=68-286::563-599
IKACNSGYIQVISMGEGSDHQAMADNGNAESGEGGVRSAENNSGSHVRVGVSEPYVGREFDSQDAAKTFYNEYGKRVGFSCKAGPHGRSTADGANMFREFLCGREDSKRKPPESCNAMIRIEQNGQNKWVVTKFIKEHSHSMASVSKVHNIRPRKPFSSVGRTMPETYQGVGLVPSGMMYVSMDKNCIPTKNIQGIKNTPAAVAVAETYQPVKSPTMMNYAVRPATRKRTLGKDAHNLLEYFKKMQAENPGFFYAIQLDEDNHMSNVFWADARSRTAYSHFGDAVTLDTTYRITQYGVPFAPFTGVNHHGQMILFGCALLLDDSEASFVWLFKTFLTAMNEHYPVSITTDQDRAIQTAVSQVFPQTRHCISKWHVLREGHEKVAHVCNMHPNFQIELYNCINLTETIEEFDSSWNFIINKYELTKNDWLQSLYSARAQWVPAYFRDSFFAAISPNQGFDGSIFYGFVNHQTTLPLFFRQYEQALECWFEKELESDYDTICTTPVLKTPSPMEKQAANLYTRKIFSKFQEELVETFAYTANRIEEDGENSIFRVAKFEDDQKVYIVTLNLSELRANCSCQMFEYSGILCRHVLTVFTVTNVLTLPSHYILKRWTRNSKSSAGSVELADESHGPKSLTSRYSNLCWEAIKYAEEGALTVETYDTAISALRESGKKISFMRRSVAKVAPPSHPVSGTAYDDRKSPTSAADTNPLLWPLQDETTQRFNLNDDSTPVQSVADLNLPQMTPVSLQRDDGPPEMVVYPCLKSLTWVMENKNSTPGNRVAVISLKLQDYSRIPSTESEVRFNLSKVTLEPLFNHMVNISDQLSIPTRKFAVLNLKLPVAETTSGASEVKFQVSKDTLGAVLRSMAYIREQLLGPGDVQTEPMSKRPRK

SEQ ID NO: 222602 - protein, 41 aa, Glycine max
  Coding DNA Sequence Number=SeqID_105824
MSRSTLNSCPACALAQCADPTQHEKAHEEKPRVIHWENGNV

SEQ ID NO: 222603 - protein, 214 aa, Glycine max
  Coding DNA Sequence Number=SeqID_105825
  Gene Ontology: Mol. function=auxiliary transport protein activity; Cellular component=nucleus; Biological process=regulation of cell volume
  Homolog annotation: Hit_ID=Q9LVA7; Match level="QueryCoverage=98%, HitCoverage=96%, E-value=2e-56, Identity=52%"; Hit description =Arabidopsis thaliana genomic DNA, chromosome 5, P1 clone:MMI9
  Pfam annotation: Domain name=ICln_channel; Domain location=41-116; Score=115.1; E_value=2e-31; Accession=PF03517.4; Description =Nucleotide-sensitive chloride conductance regulator (ICln)
MVLGVREISCSGEPVLDSDNGEELMQVQPGIDIVLGDLPRQSPGTLYITNKQVIWVSDVDKTKGYAVDFLCISLHAVSRDPEAYPLPCLYTQIDTGEADDDHSDSESNHIQQDLSHITEMRLIPSDPTQLDSLFAIFCQCAELNPEPNDEEGEGHGWVFSADEMGDEEAEDEGYIFHNPANSIGHSNGNHDLTRTTLEYDSLTQGCSSSNKMRE

SEQ ID NO: 222604 - protein, 860 aa, Glycine max
  Coding DNA Sequence Number=SeqID_105826
MAADDSTKRNSNVQLLEELEALSETLNQSHTSNTNRRTASLAIPRASPSFVSFADDDNDTAKVNNKQSNKTRSRRMSLSPWRSRPKPEDAKAPLTQPDTKKFDDTANSGDKKGIWNWKPMRALSHIGMHKLSCLFSVEVVTAQGLPSSMNGLRLSVCVRKKETKDGSVQTMPSRVDQGAADFEETLFIRCHVYCNHGSGKQLKFEPRPFWLYLVAVDAKELSFGRNSVDLSQLIQESVEKSQQGLRVRQWDTSFGLSGKAKGGELVLKLGFQIMEKEGGVQIYNQDENMKSKRFRNLTSAFARKQSKSSFSLPSPRITSRSDAWTPSQRRLAEDLQGIDDLNLEDPHLVHDAPPSIQKLDGGKENVEDFDLPDFEVVDKGVEVQETKELYDGEESEKSIEVKSATSEVVKEIMHDQLRLTRLTELDSIAKQIKALESIMVEDNKFTKGEEAESLRLDSDEENVTREFLHMLEDQKARGFKLNQSETPPLQIAEAESKVYLPDLGKGLGCVVQTKDGGYLTSMNPLDNAVARNETPKLAMQMSKPYVLASNQSPNGLELFQKLAGIGLDELSCQVFSMMPLDELIGKTAEQIAFEGIASAIIQGRNKEGASSSAARIVSALKGMANAMSSGRQERISTGLWNVDETPFTAENILAFTMQKIEFMAVEGLKIQADMTEEEAPFDVSPLSTEEGNKENELLASAVSLEDWIRDQSYSDTASSSDDETSNITLIFVVQLRDPIRRFEAVGGPMMVLIHATSEEHTKGSECDHYQDNEEEKEFKVTSMHVGSLKVRSVTKNAWDSEKQRLTAMQWLIEYGLGKAGKKGKHALVKGPDLLWSISSRIMADMWLKTMRNPDVKLVKE

SEQ ID NO: 222605 - protein, 59 aa, Glycine max
  Coding DNA Sequence Number=SeqID_105827
MAVAKCCDFATMPNKRLKSWMQGKGFRVSIRWKKSTETETAASADWRVRMEFKRRVRAA

SEQ ID NO: 222606 - protein, 430 aa, Glycine max
  Coding DNA Sequence Number=SeqID_105828
  Gene Ontology: Mol. function=phospholipid binding; Cellular component= coated pit; Biological process=endocytosis
  Homolog annotation: Hit_ID=Q1RZR4; Match level="QueryCoverage=90%, HitCoverage=99%, E-value=1e-129, Identity=63%"; Hit description=ANTH
  Pfam annotation: Domain name=ANTH; Domain location=35-307; Score =203.3; E_value=5.5e-58; Accession=PF07651.6; Description=ANTH domain
  Pfam annotation: Domain name=ENTH; Domain location=35-163; Score= -21.6; E_value=0.0023; Accession=PF01417.11; Description=ENTH domain
  Pfam module annotation: Pfam domain module=ANTH::ENTH; Domain location=35-307::35-163
MGVDIQGKLRLALGSVKDHASIGKAMMYHYQHDGFSNIEIAVLRATGHDNGTIDDRYMHEILFLVSNTPGSIPFLAERISRRLSKTKDHAVALKTLVLIHRLLRGGNRSFEQELCKAHVSGHLQISTRCFTKSSDHPSVGFLHKYAAYLEERMSWLINQAGKLEPVMSKGLEFRRYDEKSIDMAFRTLPKCQVLIDKVLECSPHDILCSDHSLAQAAMSNTLRESFQVYMTFSEGIAALVNMFFDLTASARGLACEILKKASLQSQKLHDLYESCKQVVENKNLDYPSVQIISMNHVVALEQLGSPQNELAASLVSLSSISRPPPISGHFTKSREIELAVEAKESKRSEENIDIDLSPTPTLLSWTLETKISMVWVVFEDEVPNESQVLPAPQKLGGADAVCDIKSEYGRPSVFLNPFSSSFQTSMSTKV

SEQ ID NO: 222607 - protein, 389 aa, Glycine max
  Coding DNA Sequence Number=SeqID_105829
  Gene Ontology: Mol. function=protein serine/threonine kinase activity; Cellular component=mitochondrion; Biological process =protein amino acid phosphorylation
  Homolog annotation: Hit_ID=Q1SB26; Match level="QueryCoverage=99%, HitCoverage=91%, E-value=1e-129, Identity=41%"; Hit description =Tetratricopeptide-like helical
  Pfam annotation: Domain name=PPR; Domain location=11-45; Score=42.6; E_value=1.3e-09; Accession=PF01535.11; Description=PPR repeat
  Pfam annotation: Domain name=PPR; Domain location=118-152; Score =38.2; E_value=2.9e-08; Accession=PF01535.11; Description=PPR repeat
  Pfam annotation: Domain name=PPR; Domain location=155-189; Score =50.8; E_value=4.5e-12; Accession=PF01535.11; Description=PPR repeat
  Pfam annotation: Domain name=PPR; Domain location=190-224; Score =29.6; E_value=1.1e-05; Accession=PF01535.11; Description=PPR repeat
  Pfam annotation: Domain name=PPR; Domain location=225-259; Score =16.9; E_value=0.073; Accession=PF01535.11; Description=PPR repeat
  Pfam annotation: Domain name=PPR; Domain location=260-294; Score =32.7; E_value=1.3e-06; Accession=PF01535.11; Description=PPR repeat
  Pfam annotation: Domain name=PPR; Domain location=295-329; Score =58.5; E_value=2.2e-14; Accession=PF01535.11; Description=PPR repeat
  Pfam annotation: Domain name=PPR; Domain location=330-364; Score =18.3; E_value=0.028; Accession=PF01535.11; Description=PPR repeat
  Pfam annotation: Domain name=PPR; Domain location=46-81; Score=2.3; E_ value=3.9; Accession=PF01535.11; Description=PPR repeat
  Pfam annotation: Domain name=PPR; Domain location=83-117; Score=31.5; E_value=3e-06; Accession=PF01535.11; Description=PPR repeat
  Pfam module annotation: Pfam domain module=PPR::PPR::PPR::PPR::PPR::PP R::PPR::PPR::PPR::PPR; Domain location=11-45::118-152::155-189::190 -224::225-259::260-294::295-329::330-364::46-81::83-117
MVKRNLEPNVVVYNAILDGLCKRGLVGEALGLFYEMGVVNVEPNVVTYNCLIQGLCGEVGGWREGVGLFNEMVAEKGIVPDVQTFSILVNGFCKEGLLLRAESMVGFMIRIGVELNVVTYNSLISGYCLRNRMEEAVRVFDLMVREGEGCLPSVVTYNSLIHGWCKVKKVNKAMSLLSEMVGKGLDPDVFTWTSLIGGFFEVGKPLAAKELFITMKDQGQVPILQTCAVVLDGLYKCWLDSEAMTLFRAMEKSGLDLDIVIYNIMLDGMCKMGKLNDARKLLSFVLVKGLKIDSYTWNIMIKGLCREGLLDDAEELLRKMKENGCPPNKCSYNVFVQGLLRKYDISRSRKYLQIMKDKGFPVDATTAELLIRFLSANEEDNAFQEFLQI

SEQ ID NO: 222608 - protein, 265 aa, Glycine max
  Coding DNA Sequence Number=SeqID_105830
  Gene Ontology: Mol. function=translation release factor activity; Cellular component=cytoplasm; Biological process=translational termination
  Homolog annotation: Hit_ID=Q9C815; Match level="QueryCoverage=67%, HitCoverage=69%, E-value=3e-56, Identity=63%"; Hit description =Peptide chain release factor, putative; 8726-9996
  Pfam annotation: Domain name=RF-1; Domain location=72-176; Score =42.4; E_value=1.5e-09; Accession=PF00472.11; Description=Peptidyl -tRNA hydrolase domain
  Subcellular localization annotation: CTP_CleavageSite=66; ConfidenceScore=5.39e-01
MAHKTLFKPSLILTLRLNKTAISFSHHHPFRHSQPPFPFLNTSPISLPPTTRITNYTHLWCSNYTTVSTIEEGSEKCYLNLSDEELMRQCEMDTFKASGPGGQHRNKRESAVRLKHLPTGIIAQASEDRSQHKNRASAINRLRSLIALKVRKTVDLEAYSPPRELLQILPPKSSIRGSDCGSQIGPNNPKFASGMQALLDLIFAVEGSVSEAAKYLGLSTGALSRLILSDDSLRKEVNDLRATKRGLLAPNPQLGNFYIREKGGA

SEQ ID NO: 222609 - protein, 59 aa, Glycine max
  Coding DNA Sequence Number=SeqID_105831
MSPSHRTKHQLLPPTIALHLLHIVLDGVTWGLVVHNDVHGGVVLACVCGDNIGGGWVEI

SEQ ID NO: 222610 - protein, 335 aa, Glycine max
  Coding DNA Sequence Number=SeqID_105832
  Gene Ontology: Mol. function=catalytic activity; Cellular component =cellular_component; Biological process=biosynthetic process
  Homolog annotation: Hit_ID=Q1S7I7; Match level="QueryCoverage=93%, HitCoverage=100%, E-value=1e-115, Identity=73%"; Hit description =Phenazine biosynthesis PhzC/PhzF protein
  Pfam annotation: Domain name=PhzC-PhzF; Domain location=44-331; Score= 352.6; E_value=6.6e-103; Accession=PF02567.7; Description=Phenazine biosynthesis-like protein
MAEKDVGGGGLTRDICWYVNGKETREILCGMFVVLAYAESELEKQVDAFTESAFKGNPASVCFLEEERDEEWLQAVAAEFNISETCYLSRITHSLHGISNPRFRLRWFTPVAEVKLCGHATLAAAHALFSSDLVDTDVIEFVTLSGVLTAKKIPAIHITSASDSQNGEAQDGFYIELDFPVDPVTEFSFDESTSLLSEALNGASIIDVKRTQIGDDLLVELTSVKAVSELQPKLDAIVRCPGRGVIVSAIAPPGSGFDFYSRFFCPKLGINEDPVCGSAHCALASYWSNKLGKFDLNAYQASSRGGVLNIHLDEKIQRVLLRGKAVTVMEGCVLV

SEQ ID NO: 222611 - protein, 924 aa, Glycine max
  Coding DNA Sequence Number=SeqID_105833
  Gene Ontology: Mol. function=zinc ion binding; Biological process =metabolic process
  Homolog annotation: Hit_ID=UPI0000196CCB; Match level="QueryCoverage =94%, HitCoverage=96%, E-value=1e-126, Identity=33%"; Hit description= protein binding / zinc ion binding
  Pfam annotation: Domain name=PHD; Domain location=638-695; Score=7.7; E_value=0.0097; Accession=PF00628.19; Description=PHD-finger
MAKGADSDEFVVLSRVRTGLKREFAFAMKAQSEICGGSLGRTRASKNRVEAPVQPASARKRSRKSEEPKTSEDAMSEEEVKSDVVDLQSDDNNHVGESESAAMQVCEEEPKMLEPKPEPVISEEEPKVLDDVINEEEAVVAETLKGEEPIVAETLKEEVVDEMAEQPLCKEESEKGVSDEMAEQPLCEEESEKGVSDEMAEQPLCEEEPEKGGVSEEKDSNGVALALVNDDGDEGNKKKRRMKKRLEMPQSERRFTRSALKVKSEETNDVEHVGVAGIDDDGVKGETEASAEASLLMTPPSSAKFSNSRLKKFPSKLKDLLATGILEGLPVMYMKGAKTRWKAGEKGLQGVIQDSGVLCFCKICNGVEVVTPTVFELHAGSANKRPPEYIYIHDGNCGKTLRDVMNACCCCDFPLESMDEAVQKLLGDFTMKKSSICLNCRACKGVSKLVCDLCLASPPQTAMASRKVISQPVQPRSPEPVVIQKSLDNEVQPNSLDNEVPPNSLDNEVQPNSLDTGVQPKSFSNGMKHSASRGKSQGRLTRKDLRLHKLVFEADVLPDGTELAYYAHGQKLLVGYKKGCGIFCTCCNEQNVFQKDRHGQHEVNALAAAGRIAGPDILELMNKRCIRVVKTVEVDHGGCALCSRPNFSKSFGPRTVIICDQCEKEYHVGCLKEHNMENLEKLPEGNWFCSGNCSHIHTALTDLVASKEKDVPDPLLSLIKKKHEEKSLEIGAGLDVKWRVMNWKLDSDSDDSVETRKLLSKAVAIFHERFDPIVDSTSGRDFIPTMLFGRNIRGQDFSGIYCAVLTVNGDIVSAGVFRVFGSEIAELPLVATTADHQGQTLLGSLNVKNLVLPAADEAESIWTGKFGFTKLPQDEGTTLASYICPCHEQSKKMGNTSEFSGYERSCAKFDGGVLPVYWQFNINL

SEQ ID NO: 222612 - protein, 76 aa, Glycine max
  Coding DNA Sequence Number=SeqID_105834
  Homolog annotation: Hit_ID=Q7XEJ0; Match level="QueryCoverage=66%, HitCoverage=17%, E-value=5e-12, Identity=68%"; Hit description =Expressed protein
MEEKVKLAHYKVGSLPTLFYVPDFITDSDQSLLLNNVIYGAPASKWKILKNRRLQNWEYTDIQILKILESWDFREK

SEQ ID NO: 222613 - protein, 387 aa, Glycine max
  Coding DNA Sequence Number=SeqID_105835
MVATCFSSLVFYKQGYRYGLTFTDVEMAGRGGVVGKTKCGLGLGFALNGTKQQCFGVMGWPKYKKDMGECVSLDKNGYLRRRGVTIQYATVAHHYLELGHLGCRQIQKPSHTRLDKIMSTVVVDEDHDTMMTNKAIHSKGFWCRHPCRRVKANLRWRIRVVCGSWVVGHKWVGGVTVAQLASVIEDPFLVTMIAGAFVSSGVGGSHYVWLWAKSGKEQCDGAGTAASIIELVFLEFGPGSRLGQRIMIEEPEPPKDFRRMKEQSRTLRPGALSTTMYTLIIKELGNFKDPSHWILAVKSRNFELYVRPRLSDRIWCLWRFWGCGGGGDGCEEVSGGFSVVLVGHGGWGVKVEAVLEVVRPLSDPYGSASGYRGVEVAINFSLYTFFL

SEQ ID NO: 222614 - protein, 228 aa, Glycine max
  Coding DNA Sequence Number=SeqID_105836
MARFNVGSLCHTTLRLDMDIVLSWEIVWFMKKGRRDKKGEGRGALTNFETSYSHPSHLNAFTLSFATSCDTKTSSPSALQPLVVLQHHVGVTHDAATSLSLSRFCNLSVGDKSVTHDVAASLSLPWFYNLNVGDKRTRIISFLLILRVTLTGCNIKEGRGKVYEKKREMKAVANAAKCGRACIAIGSSGTKAVSPVAPARQVLTSTSETYMHLLHALQTPSSRLDPAT

SEQ ID NO: 222615 - protein, 77 aa, Glycine max
  Coding DNA Sequence Number=SeqID_105837
MWENWEQLQDSYDLGDKVVLPDGGNDSNSNTTISTSRPIRITKKPNHLKDYCLQKKLRWRVVEGDGGWGHLGFIAAF

SEQ ID NO: 222616 - protein, 449 aa, Glycine max
  Coding DNA Sequence Number=SeqID_105838
MYDTLESDSKKPFYSGCKKSLTLLSAVLSPVNVKARYGWSDKSFTSLLQVVQGMHPGENTLAKSYYQPKKILYPMGMEHEYEEHEITPIPLTDQQVLERKNLWDSVIGMLRSFQGKTKDGLNTCQDLAEMGIRDQLHPSVICSKVIDPTKLNELENEGEDDKVCGKYDISKEKWNQFCQSRRDPSWETIQKQNTAPYMLSHGGYDYLEEKLMEDKKKKQLEKASQSGSTNIIVDPPSPIRLHVKWKMARMKKYGQLTSKVAKEIANRIISEFFMSVGRFVTQVRQDVLTIAIGRLNHLGRVRAVGASTQMQSQELVLPPEPKDPDTGDLEKFGLYVDENLPRLVALRKVYEGLTTVHNVPLDNDQVKVSVEEVQDANASVPIPTQEDKQGPVRSSKLVDRLDPDVDHLYLMTLTIPQLFLKPLQVSWAATITLKGFNDSQGSKSKVAAR

SEQ ID NO: 222617 - protein, 232 aa, Glycine max
  Coding DNA Sequence Number=SeqID_105839
MGMQWTNDHGKYLGVLNFYPRVSRGTFQFIVHNFHLRLSAWKAKTLSFADTRDGTKIHLVPWDDICTPKFKGVDDGSFSVKPAYEIACQSQSIPEMKLFKLIHKWAIFCHEIGSANDIAQKAFHASQVYRASSDMMTSLSFSHKLQINKSDLQWTSPQPGQVVISCDAAISKARPQCFMQNYPPSVGFEASLGKSQHHPCFNLVEDIEIVLSRINQVSWNRVFREANLVADI

SEQ ID NO: 222618 - protein, 134 aa, Glycine max
  Coding DNA Sequence Number=SeqID_105840
MVITMVAVVWKDDGDTNMVDRINLTTTQRSDQVELPIGSPCMHGTWCNLRQNGHNDNGDGGRMVVMEATKARCGGGGDGGNGGEMVEAIVAMVVVVATVWWWRQGQGHCDGGRGTVAVAKAMVVMVVRICFLFY

SEQ ID NO: 222619 - protein, 531 aa, Glycine max
  Coding DNA Sequence Number=SeqID_105841
  Gene Ontology: Mol. function=enzyme inhibitor activity; Cellular component=cell wall; Biological process=cell wall modification
  Homolog annotation: Hit_ID=O04887; Match level="QueryCoverage=93%, HitCoverage=94%, E-value=1e-137, Identity=52%"; Hit description =Pectinesterase-2 precursor
  Pfam annotation: Domain name=PMEI; Domain location=28-179; Score =80.8; E_value=4.2e-21; Accession=PF04043.6; Description=Plant invertasepectin methylesterase inhibitor
  Pfam annotation: Domain name=Pectinesterase; Domain location=218-517; Score=640.2; E_value=1.7e-189; Accession=PF01095.10; Description =Pectinesterase
  Pfam module annotation: Pfam domain module=PMEI::Pectinesterase; Domain location=28-179::218-517
MENLGKTFLLLLLLSSIFSIASSRRRPPASSSNIDWWCNLTPHPEQCKQHLSTQMKSHHFQIKHKTIFREMLLQNALNQALIMQKEANDNDQNNMLTKNHRTVHGDCLKLYGKTIFHLNRTLECFHGKHNCSSVDAQTWLSTSLTNIQTCQDGTVELGVEDFKVPNNNVSEMIRNSLAINMDFMKHHDHMEEKPEDAFPSWFSKHERKLLQSSSIKAHVVVAKDGSGNFKTVQDALNAAAKRKVKTRFVIHVKKGVYRENIEVSVHNDNIMLVGDGLRNTIITSARSVQDGYTTYSSATAGIDGLHFIARDITFQNTAGVHKGQAVALRSASDLSVFYRCAFMGYQDTLMAHAQRQFYRQCYIYGTVDFIFGNAAVVFQNCYIFARRPLEGQANMITAQGRGDPFQNTGISIHNSQIRAAPDLRPVVDKYNTFLGRPWQQYSRVMVMKTFMDTLVNPLGWSPWGDSDFAQDTLYYGEYQNYGPGASTTNRVKWPGFHVINSPTEASQFTVTHLLAGPTWLGSTTVPFTSGL

SEQ ID NO: 222620 - protein, 166 aa, Glycine max
  Coding DNA Sequence Number=SeqID_105842
  Homolog annotation: Hit_ID=P49161; Match level="QueryCoverage=36%, HitCoverage=20%, E-value=4e-18, Identity=79%"; Hit description =Apocytochrome f precursor
MDIEVPQAVLLDTVFEAVVRIPYDMQVKQVLANGKKGALNVGVVLILPKLAPPIKRKNEKKTYLEFNRGGGRKKGEWEGTKEEEGTGGRSKQRDHGRGRGKKGEGEGRKKEEEEEEVGEKEEEERKKKRDKREGGGESGHVGKWRKWRERKWDVGEGKGHCVHIHV

SEQ ID NO: 222621 - protein, 77 aa, Glycine max
  Coding DNA Sequence Number=SeqID_105843
DGDVDLNASPEALDKILGYTLALKVKVQPKFRNSIVLKYSFNSSLMNTMVDLLPDAEMVIQFMVEGSMLKQFQKMRL

SEQ ID NO: 222622 - protein, 169 aa, Glycine max
  Coding DNA Sequence Number=SeqID_105844
MGPNNLSMTQGQQEEVQGELVTLDNNEDMNLAILVCTKLCVLPSSMRITTRWLAMVPKILKVSGAGMPDKALRLICGRDVGSGGAFGRMGEIREPPQGSLDPWVSSSSSAMRRWRWGQKAVWLVERTMKVKSYGGGHGAYLPVTLPTPLPKEASVVGDQELRKLFRDIH

SEQ ID NO: 222623 - protein, 74 aa, Glycine max
  Coding DNA Sequence Number=SeqID_105845
MARMQKPTMLGQQGGHDCKLLCFSWACNHMKTRPFYSIASEGTNVEHCGGCRRHPRYAEGGAVVGKVRKRYGSS

SEQ ID NO: 222624 - protein, 108 aa, Glycine max
  Coding DNA Sequence Number=SeqID_105846
  Gene Ontology: Mol. function=RNA-directed DNA polymerase activity; Cellular component=chromatin; Biological process=RNA-dependent DNA replication
MTLLRKDHFLWTPASQLAFDRLKSLMTEAPILATPDFIAPFIMETNASGIAMGVVLMQNSHPLLISSSCSAPDSNKLRYSPFITLLMDEFHKTPIGGHMGVAKTLHHL

SEQ ID NO: 222625 - protein, 157 aa, Glycine max
  Coding DNA Sequence Number=SeqID_105847
MNDFSEDEDQHFFDHIDHQSDDQSDDQSEDEGVGGSTTLPSPLLQYHQPRCPIDLNLDHLPHYIDRHHFVQQQHNVQPPIGAFEVGMAFDEKAQCIREAHVVQRGIRNGLSRVPEVITLIHGKKTRTRGYPSESVPTLTGNTRVDRVWVRVQVFPDN

SEQ ID NO: 222626 - protein, 350 aa, Glycine max
  Coding DNA Sequence Number=SeqID_105848
  Gene Ontology: Mol. function=aspartyl esterase activity; Cellular component=cell wall; Biological process=cell wall modification
  Homolog annotation: Hit_ID=O04887; Match level="QueryCoverage=76%, HitCoverage=61%, E-value=7e-50, Identity=39%"; Hit description =Pectinesterase-2 precursor
  Pfam annotation: Domain name=PMEI; Domain location=3-102; Score=10.7; E_value=0.0019; Accession=PF04043.6; Description=Plant invertasepectin methylesterase inhibitor
  Pfam annotation: Domain name=Pectinesterase; Domain location=122-348; Score=105.8; E_value=1e-29; Accession=PF01095.10; Description =Pectinesterase
  Pfam module annotation: Pfam domain module=PMEI::Pectinesterase; Domain location=3-102::122-348
MEQSVNAQIHITWLGSKCRSKQEKAAWSDCVTLYQDTINILNQALNPTKQSTSYDLQTWLTTSLTNTDTCQTGFHKVGVGNNVLPLIPNKNISKIISDFLTLNNASSFIPPKTNKNGFPRWDFKTIKEALKAVPKLSPKRLTVISGSRSVGGGSTTFNSTNVGLNIVYSCDKDGFIARGITFRNTEGPENHQAGALRCGADLSVFHRCAFEGYQDTLYVHSQRQFYKECHIFGTVDFIFGNAAVVFQSCNIYATRSMQKQKNAIAAEGNLFMVLPGGVDSAASPRFMAPSPDSRGRIAIPTSGLIADVVLWMNWRGAVAVLVYATALWYLFERVGYNFLSFVTKVFANKL

SEQ ID NO: 222627 - protein, 191 aa, Glycine max
  Coding DNA Sequence Number=SeqID_105849
  Gene Ontology: Cellular component=membrane
  Homolog annotation: Hit_ID=Q4WVH7; Match level="QueryCoverage=97%, HitCoverage=52%, E-value=6e-22, Identity=32%"; Hit description =Integral membrane protein, putative
  Subcellular localization annotation: CTP_CleavageSite=3; ConfidenceScore=5.21e-01
MALANTSVASIAVLSSMSGLFALFFGAILGQDSVNITKIAAVLISMAGVSMTTVGKTSAADENISMHEYSIANVILNWNSAGSGDKVDMQKLFGCIGLYSLLGFWWLAWPLNVVGIEPHFKFPSSMSTWEIVIANSIWSNVISDYIWALSIVWTAPLVATLGMSLTIPIAMIADMVIHGHKYSAMYILGCI

SEQ ID NO: 222628 - protein, 309 aa, Glycine max
  Coding DNA Sequence Number=SeqID_105850
  Gene Ontology: Mol. function=nucleic acid binding; Cellular component= intracellular; Biological process=regulation of transcription
  Homolog annotation: Hit_ID=Q41070; Match level="QueryCoverage=95%, HitCoverage=95%, E-value=6e-52, Identity=43%"; Hit description =Putative zinc finger protein
  Pfam annotation: Domain name=zf-C2H2; Domain location=121-143; Score =19.0; E_value=0.018; Accession=PF00096.16; Description=Zinc finger, C2H2 type
  Pfam annotation: Domain name=zf-C2H2; Domain location=218-240; Score =20.7; E_value=0.0052; Accession=PF00096.16; Description=Zinc finger, C2H2 type
  Pfam module annotation: Pfam domain module=zf-C2H2::zf-C2H2; Domain location=121-143::218-240
  Subcellular localization annotation: CTP_CleavageSite=54; ConfidenceScore=5.56e-01
MEELVSCNNNDATNIAKGKRTKRRLRPLSPCAVVPTTTTITTVTAATTPIMTSSCSSASCGGGSSSSTTFEEEEEDMANCLILLAQGKVGGDPPHRHKDLYGSDVKTEKLGSTKVDHFYVYECKTCNRTFPSFQALGGHRASHKKPKVEEKKSSSPPLSLPPPPPPPPPSSSSLFNFEEAKQSHHMKNIISPSVSLQLGCGNNNKVGLNFHGNKSKIHECSICGSEFTSGQALGGHMRRHRASTNNNNIVQTTTTTSNGAVDVKPRNVLELDLNLPAPEDDLRDSKFQFPATQNSMMRSAAPALVGCHY

SEQ ID NO: 222629 - protein, 242 aa, Glycine max
  Coding DNA Sequence Number=SeqID_105851
  Gene Ontology: Mol. function=histone-lysine N-methyltransferase activity; Cellular component=nucleus; Biological process=chromatin modification
  Homolog annotation: Hit_ID=Q945S8; Match level="QueryCoverage=93%, HitCoverage=70%, E-value=1e-77, Identity=58%"; Hit description =Histone-lysine N-methyltransferase ASHH3
  Pfam annotation: Domain name=Pre-SET; Domain location=2-89; Score= -18.1; E_value=0.026; Accession=PF05033.6; Description=Pre-SET motif
  Pfam annotation: Domain name=SET; Domain location=91-203; Score=97.6; E_value=3.8e-26; Accession=PF00856.18; Description=SET domain
  Pfam module annotation: Pfam domain module=Pre-SET::SET; Domain location=2-89::91-203
MLGKELGEPVDFELPDSFNKSKPMQYTYIKRNIYLTKKVKRSRFDDDGIFCSCTPSPGSTSVCGRDCHCGMLLSSCSSGCKCGSSCLNKPFQNRPVKKMKLVKTEKCGSGIVADEDIKLGEFVIEYVGEVIDDKTCEERLWNMKHSGETNFYLCEINRDMVIDATYKGNKSRYINHSCCPNTEMQKWLTTNCFIYQDCHCGAAECRRKLGVRPTKSKLSSDAALKLVAYQVASSSRKNSRKK

SEQ ID NO: 222630 - protein, 110 aa, Glycine max
  Coding DNA Sequence Number=SeqID_105852
MDSPIRIIFMEGVKTPLCCTLFNRIEFLFASSSSFVLHTHTNISMCHNTTAQRGSHVRAEPQRLRSRTQGPSKIGSRTQMEAVMHNVVQEEGGCARIFGVWNNGDEQQLG

SEQ ID NO: 222631 - protein, 231 aa, Glycine max
  Coding DNA Sequence Number=SeqID_105853
  Gene Ontology: Cellular component=endoplasmic reticulum; Biological process=response to oxidative stress
  Homolog annotation: Hit_ID=P19244; Match level="QueryCoverage=75%, HitCoverage=89%, E-value=2e-49, Identity=58%"; Hit description=22.7 kDa class IV heat shock protein precursor
  Pfam annotation: Domain name=HSP20; Domain location=84-185; Score =96.1; E_value=1.1e-25; Accession=PF00011.11; Description=Hsp20alpha crystallin family
MAISQHTPYCVCPLCLVPLILLVFAGFPSKAKGSLLPFTNHPNTLLADLWSNHFPDPFRVLEQIPFGVDKDETFTALSSHARVDWKETPEGHVIMLDVPGLKRDEIKIEVEGNRVLRVSGERKREEEKEGDHWHRVERSYGKFWRHFKVPDNVDSQDVIPYGSSNNNDFFLHKTKRGTSNNLKVVHSGTKEFKIASNKRDLFLGFSEHQERLRKKLALDEGRIFAANEQLS

SEQ ID NO: 222632 - protein, 45 aa, Glycine max
  Coding DNA Sequence Number=SeqID_105854
LPGLDVAPSAILALSANVFPDSPLLSKRAGAGLSHLCVLSALSLR

SEQ ID NO: 222633 - protein, 107 aa, Glycine max
  Coding DNA Sequence Number=SeqID_105855
MCHRSLSTDCSESRAASQQTQGEQAQVKPKPFKPSQPRLKLPTKRKDPPPSSDPKPSNQSKKSKKQPPSDPKHSNLQTTQKKKELDSKSEPKSHTPPKIPIIKIKHP

SEQ ID NO: 222634 - protein, 108 aa, Glycine max
  Coding DNA Sequence Number=SeqID_105856
MEELERIQSTIEHETEVFSTNVVARQVEIEVALIHKNLDPIEKEALEEAMVQSVIEAFLNKSEDNIVEIDLVGEDNIKRFEAIYGPLTSNTIANLQAGLERRLQATKD

SEQ ID NO: 222635 - protein, 130 aa, Glycine max
  Coding DNA Sequence Number=SeqID_105857
MMSISLSNTPLEKTAMYVTNILLEPNLYILKNKKSWGATAPKPQNLDPFMSLKTLSIVSQPTLLRASEVRLTGASSKGGKCVESPPTFICGKRRKNRRKPVMKNIPDSGVVFTFEEGISTSHVCPKGQQP

SEQ ID NO: 222636 - protein, 310 aa, Glycine max
  Coding DNA Sequence Number=SeqID_105858
  Gene Ontology: Mol. function=oxidoreductase activity; Cellular component=vacuole; Biological process=response to oxidative stress
  Homolog annotation: Hit_ID=Q9SZB9; Match level="QueryCoverage=96%, HitCoverage=96%, E-value=1e-126, Identity=74%"; Hit description =Peroxidase 47 precursor
  Pfam annotation: Domain name=peroxidase; Domain location=42-274; Score=411.9; E_value=9.3e-121; Accession=PF00141.13; Description =Peroxidase
MANLLTMFFVMEMIVVSGFSFGASGLSMNYYLLSCPIAEPVVKNTVNTALQDDPTLAAGLVRMHFHDCFIEGCDGSVLIDSTKDNTAEKDSPANLSLRGYEVIDDIKEELEKQCPGVVSCADIVAMAARDAVFFAGGPVYDIPKGRKDGTRSKIEDTINLPAPIFNASELIKMFGQRGFSTRDMVALSGAHTLGVARCSSFKNRLTQVDSEFAKTLSKTCSAGDTAEQPFDSTRSDFDNQYFNALVSNNGVLTSDQTLYNSPQTRNIVNAYAMNQALFFLDFQQAMVKMSMLDAKQGSKGENQIKALLFN

SEQ ID NO: 222637 - protein, 76 aa, Glycine max
  Coding DNA Sequence Number=SeqID_105859
  Gene Ontology: Mol. function=actin binding; Cellular component =intracellular
  Homolog annotation: Hit_ID=Q9XEN2; Match level="QueryCoverage=64%, HitCoverage=36%, E-value=3e-19, Identity=90%"; Hit description=Actin depolymerizing factor
  Pfam annotation: Domain name=Cofilin_ADF; Domain location=1-76; Score= 8.5; E_value=0.0012; Accession=PF00241.10; Description=Cofilintropomyo sin-type actin-binding pr
MECVESMVGMRGRRTSNLLIWDLIDIWSPSVARIRPKMLYATSKDRFRRELQGIHYEIQATDPTEMDLEVLRERAN

SEQ ID NO: 222638 - protein, 218 aa, Glycine max
  Coding DNA Sequence Number=SeqID_105860
SVTKHRTIRGFLIVPNKLVRTPERSVQENDHGRNEHREEEVEPGAGGKESDEGDEGERDDCDGEVVAGEVEEVPGGGEEEEEEEGEGVAEEGEEEDEEEEEGVVEEEVGQVVGEARGGFRDGGWEAEGGGPVDQQEPKPYVGFLGGPKEMSLLNSYANHMAWEVWGGIVNYYECGDLKLVSHVRNYQTIDKGLLSAFAEKWHRDKHLPFAHGRDDDNT

SEQ ID NO: 222639 - protein, 169 aa, Glycine max
  Coding DNA Sequence Number=SeqID_105861
  Pfam annotation: Domain name=PRA1; Domain location=14-155; Score =136.3; E_value=8.4e-38; Accession=PF03208.9; Description=PRA1 family protein
  Subcellular localization annotation: CTP_CleavageSite=46; ConfidenceScore=5.23e-01
MWPSAEMLSNIKEASQSVVSTRRPWRVFLDPSSLSLPSSISETTTRLAHNLTYFLFNYALLLLLVFLLTLLRHPFPLLLFLLLSAAWYFLYFSRDDLPIAIIPLSLVTLVALFATGAWLYLLLAVLIAAVVVFLHAALRSTDELVGDDQESPYGPMLGDTPATGAYVPV

SEQ ID NO: 222640 - protein, 34 aa, Glycine max
  Coding DNA Sequence Number=SeqID_105862
MDNMGTIIDGMNCAKWVTRPQILRKMHAEQKAFN

SEQ ID NO: 222641 - protein, 49 aa, Glycine max
  Coding DNA Sequence Number=SeqID_105863
MENYFEMPRGTNPMNPLQGYQTGEFTQTRESSINSTRDSTRRLVRVYFI

SEQ ID NO: 222642 - protein, 426 aa, Glycine max
  Coding DNA Sequence Number=SeqID_105864
MAFVTCCNDGCTRASVGEVSLHEIEAPRFRISSPPCLVATLVILGVVSLHVSSSCLSLCHVLATPRGRTIHCPLSFKAVKAAKHLSHECVSLVCPYELAFQDGRMIHSPLSAKDGRAIHNPSSVKAVKDGSLHDVERDIVDEEVVPLTMNFQEEEEESEGENNIGEYKWVDKGVVALVTNGARLRELSRRKEKVITTNAKEGNKKRKHDDFVDCEVNSKSELHLVQTQFSFLVMNGDVSWCKTFAFEEFEGKEALCSIWSKPFPFHEVLGQNFSGVGDLAKMEKKKMVATQVKKLNGEVSRLKEEVKKYKEEVGCFSNKLSVYKKHVARVEELEQYLVEIQVKLESNIKAFEKYLVKQLHLKGKEKSLLEEVERWRSECNPKDVTAIDDHAKGFNKALAHVVALCPDIDLSDITVKLNFYAKDFYT

SEQ ID NO: 222643 - protein, 232 aa, Glycine max
  Coding DNA Sequence Number=SeqID_105865
MTLGLQQLMGTFNVVLPWDHSKSDVTFQTEDNLLEEPKASLNFFCWELFDYGLDMKMKLSTYIKEIRLRQASIRKIKRLNTHMSFMLGSQFSCLTNLETRFQIVVDKLVLYKKIKCYNAKEILIEDEEDVDYIHFVKARPGRLFKHELEALKHKFELPSLDGYAIKKFYGLQACSSRLEPKEKPPIDAYHHEVECFYQTLNHFFFTQETPFNMIYTSIVILFISNKLPLLEG

SEQ ID NO: 222644 - protein, 73 aa, Glycine max
  Coding DNA Sequence Number=SeqID_105866
MYSVERDLQVLVDRVCYGDVTTFADDYRLIDNSRWLIDNVREITCPLKSPTAKGWTFELLCQGLMCVLECHVA

SEQ ID NO: 222645 - protein, 521 aa, Glycine max
  Coding DNA Sequence Number=SeqID_105867
  Gene Ontology: Mol. function=RNA-directed DNA polymerase activity; Cellular component=nucleus; Biological process=RNA-dependent DNA replication
MCIEMFAFIAGRHMMHSVIIANEVVEEAYDSASWNFLIYMLRRMGFCSRWIQWIEGCLRSSSVSVLVNGSPTTEFIPQRGLRQGDSLAPLLYNIMAEGLNGLMRAATQKNLFRGVQVGANRVEISILQYADDTIFFGEATMENVKAIKVILRSFELVAGLKINFAKSSVTAIRMPDQWSQQAASLLNCSLLSIPFVYLGIPIGANPSKCERKLSKWKQKHLSFGGRVTLIQSILTSIPIYLFSFFKVPSKVVDKLVRLQRRFLWGGEADHNKIAWIKWETVCRSKDEGGLGIKDIRNFNLALLGKWKWSLFYHNGDIWAKVLESKYGGWRSLNVAYWDHTDSIWWRDLKQALHHQQLASTFQNGLSWRVGCGDKIKFWEDIWINDDISLVAKYPRLYSISNQQNHLIQQVGAHTDSGWEWDFRWRRSLFDSEVIIADSFLNDIEGKTVHPCRRDEWVWKAEPSGIYSTQSAYNLQQGEIIEASDDGVFAELWKLKVSKKISVFAWRLIRDRLPTKTNLRRR

SEQ ID NO: 222646 - protein, 385 aa, Glycine max
  Coding DNA Sequence Number=SeqID_105868
  Homolog annotation: Hit_ID=Q6Q151; Match level="QueryCoverage=19%, HitCoverage=15%, E-value=7e-25, Identity=71%"; Hit description =Multidomain cyclophilin type peptidyl-prolyl cis-trans isomerase
MSIGHRYCRVVTTMSRGDRFCLAAKFKVFGELAEGFETLTRINEAYVDEKGRPYKNIRIKHTYILEDPYDDPSQLSDFIPDASPEGKPKDEPSAIDYVFFEQFVLLLFRISKTIAEKLDDSNFLMWQQQVELVIKSHHLQRRSFLDCLEAFSLIKSGRKSMTIFTNNHEQELVNCELNYAQQSTSMRSSKVFLKIITLISVIESKFGPLPIEDVEVLLLAHEARLQRLILVFSSAHGYDGYNVPNKASQPNSENFLSNSRGGFGRGGNFNRSGRHGGGCSCGRRVPSKVVDKLVTIQRRFWGGGLEKRKIAWVKWKTVCLPKDKGGLGIKDIKTFNTALLGKCRWDLFQQSGEPWAKILDSKYGGWRSLEEGKRGRHDSLVEGPD

SEQ ID NO: 222647 - protein, 145 aa, Glycine max
  Coding DNA Sequence Number=SeqID_105869
  Gene Ontology: Mol. function=DNA binding; Biological process=DNA integration
  Homolog annotation: Hit_ID=Q1SAZ0; Match level="QueryCoverage=92%, HitCoverage=12%, E-value=4e-36, Identity=53%"; Hit description =Integrase, catalytic region
  Subcellular localization annotation: CTP_CleavageSite=85; ConfidenceScore=5.22e-01
MRSLQTGERKEEVTAVHFKLVRLTKRSNLPQVHFLSLRNNSTNSQKGSFLTSAFLSVNSNYTWIVDSGASDHMTGESSFFVSYSRCEGKGCVVISPTLILQNVLHVPNLSCNLLYDLNSGRTIDSAKESGGLYLLEDVSGSRQQS

SEQ ID NO: 222648 - protein, 84 aa, Glycine max
  Coding DNA Sequence Number=SeqID_105870
MGESRGGVRPQAMEAWDMSFVKESEKTNTEVFTFVFVDAGGIICFRRNRGTRSTLGSIEGKVTLVPLVTTWGSRRVRGSRRVRA

SEQ ID NO: 222649 - protein, 74 aa, Glycine max
  Coding DNA Sequence Number=SeqID_105871
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q8S8Z0; Match level="QueryCoverage=94%, HitCoverage=21%, E-value=1e-28, Identity=85%"; Hit description =Protein phosphatase 2C
MGYLNSVLSSSSQVHAAEDSPVSGGGLSQNGKFSYGYASSPGKRSSMEDFYETKIDGVDGEIVGLFGVFDGIFT

SEQ ID NO: 222650 - protein, 97 aa, Glycine max
  Coding DNA Sequence Number=SeqID_105872
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q8S8Z0; Match level="QueryCoverage=96%, HitCoverage=25%, E-value=2e-23, Identity=64%"; Hit description =Protein phosphatase 2C
MLLTEEKVDSSLEFLILASDGLWDVVSNEVGNDVHFFPFPVDNYSEAVAMIKPIEDAEEAAKRLMQEAYQRGSSDNITCVVVRFLSNQGASSHSNSG

SEQ ID NO: 222651 - protein, 227 aa, Glycine max
  Coding DNA Sequence Number=SeqID_105873
  Gene Ontology: Mol. function=thymidine kinase activity; Cellular component=cytoplasm; Biological process=DNA replication
  Homolog annotation: Hit_ID=Q71F77; Match level="QueryCoverage=88%, HitCoverage=87%, E-value=4e-81, Identity=69%"; Hit description=TK1 -like deoxyribonucleoside kinase
  Pfam annotation: Domain name=TK; Domain location=22-199; Score=230.8; E_value=3.1e-66; Accession=PF00265.9; Description=Thymidine kinase
MASSSPSSLSLDTAKDLSHSFSEVHVIIGPMFAGKTTALLRRIKSELNAANNVALLKSSKDTRYAIDSVVTHDGIKFPCWALPDLLSFREKYGEDAYQKLDVIGIDEAQFFVDLYEFCCKAADEDGKTVIVAGLDGEYLRRSFGSVLHIIPLAESVTKLTARCELCGKRAFFTLRKTEQRETELIGGADVYMPVCRLHYINSQVAERSVLESENEKTDSLLEAATDV

SEQ ID NO: 222652 - protein, 142 aa, Glycine max
  Coding DNA Sequence Number=SeqID_105874
  Subcellular localization annotation: CTP_CleavageSite=46; ConfidenceScore=5.31e-01
HIGGVGGSSNADDDASAVCFLFFFVFFFNLGVGTSALGATTGVGVVGTSAGGELTGTGDGGELIGSGTGGKLTGVTAGGVAVGGVAAGGVATGGVIAGAGAAALNGGDATMGDGTRGVAVATLGMKMEKMKWEKQQAQLILV

SEQ ID NO: 222653 - protein, 83 aa, Glycine max
  Coding DNA Sequence Number=SeqID_105875
  Gene Ontology: Mol. function=protein binding
  Homolog annotation: Hit_ID=Q53LS9; Match level="QueryCoverage=86%, HitCoverage=16%, E-value=1e-10, Identity=52%"; Hit description =Expressed protein
  Pfam annotation: Domain name=DUF525; Domain location=6-82; Score= -38.1; E_value=0.0021; Accession=PF04379.5; Description=Protein of unknown function (DUF525)
MEGFPVRKLVCASALVMLELIDVQDDLQKYLFAYSIRLSLEPQGCIINGTSFSSYQLHWRHWIIRANDIVISDVNGEAVIGQV

SEQ ID NO: 222654 - protein, 66 aa, Glycine max
  Coding DNA Sequence Number=SeqID_105876
MGERNFELMCYARHPGKLNSISTSKVLGTFDINSRANSSQEGGNDRRLSKEEKFDLGGLDMDGAIT

SEQ ID NO: 222655 - protein, 212 aa, Glycine max
  Coding DNA Sequence Number=SeqID_105877
  Gene Ontology: Mol. function=ionotropic glutamate receptor activity; Cellular component=integral to membrane; Biological process=ion transport
  Homolog annotation: Hit_ID=Q8GXJ4; Match level="QueryCoverage=96%, HitCoverage=21%, E-value=5e-64, Identity=55%"; Hit description =Glutamate receptor 3.4 precursor
MYRQKGSVVSFSFDPKLLETNGSMLHLHSLRVFDDGPLFLETILSTNFSGLTGTAHFDIERNRNHPAYDMLNIGRCGMRKIGYWSNYSGLSIVTPEILYKKPANTSTSSQQLYGVIWPGETAAKPRGWVFPNNGKPLRIAVPNRVSYKEFVSKDNNPPGVTGYGIVLEAAIKLVPYPIPREYILFRPGNRNPSYDDLKSQVTLNGWLRSLQT

SEQ ID NO: 222656 - protein, 286 aa, Glycine max
  Coding DNA Sequence Number=SeqID_105878
  Gene Ontology: Mol. function=protein serine/threonine kinase activity; Cellular component=protein complex; Biological process =protein amino acid phosphorylation
  Homolog annotation: Hit_ID=A0D9Q7; Match level="QueryCoverage=71%, HitCoverage=18%, E-value=6e-14, Identity=27%"; Hit description =Chromosome undetermined scaffold_42, whole genome shotgun sequence
  Pfam annotation: Domain name=Pkinase; Domain location=23-281; Score= -3.7; E_value=2.4e-08; Accession=PF00069.15; Description=Protein kinase domain
  Pfam annotation: Domain name=Pkinase_Tyr; Domain location=23-233; Score=-82.8; E_value=2.2e-07; Accession=PF07714.7; Description =Protein tyrosine kinase
  Pfam module annotation: Pfam domain module=Pkinase::Pkinase_Tyr; Domain location=23-281::23-233
MSPPGPCELVRGYLHFSPHAWNIILIKRGATWVQMLIDACRPLDIRQEKDPEYFCSERGLLKHRVLRSAIFMEYVEGGSLKNYLEKLSEAGEKHVLVELALHIAKDVSCALSELHSKHIIHRDIKSENILFDLDRKRDDGTPTVKLCHFDSAVPLRSTLHVCCIAHAGTCPPCICVGTPRWMAPEEANIWLFGCLLLEMLTLQIPYSGLSDSHFLDSLQMGKRPQLTDELRVLSSMNGPTMIPSGEELEKSDAGVDMLKFLVDLFHKCVEQNPSKYVFSSIIWWPL

SEQ ID NO: 222657 - protein, 182 aa, Glycine max
  Coding DNA Sequence Number=SeqID_105879
  Homolog annotation: Hit_ID=Q9FHH5; Match level="QueryCoverage=49%, HitCoverage=59%, E-value=6e-07, Identity=36%"; Hit description =Arabidopsis thaliana genomic DNA, chromosome 5, P1 clone:MRI1
  Subcellular localization annotation: CTP_CleavageSite=75; ConfidenceScore=5.78e-01
MRSTPIPPTTKTNTLAPASSTAVVTTTTTTNTTSVASPWHSPVPYLFGGLAAIMALIALALFMLACSYWRLTRITQQESNNDDDDDDDVVKEVDDDSEKKEQPKVYEEKILVIMAGDHKPTFLATPSSSLGCSNFDHKHLGISEDSNKSQKEVIVDDHVVVSDAEHENGSFRHEQRIVSERL

SEQ ID NO: 222658 - protein, 87 aa, Glycine max
  Coding DNA Sequence Number=SeqID_105880
MLLKKYSKICISKENFTNSSRRMDVSMTMRSLVKYSIPAQFITGKLSQASTQEPPTSNDEREMEGNFLSKGVYVDANDDVDGDYIRT

SEQ ID NO: 222659 - protein, 590 aa, Glycine max
  Coding DNA Sequence Number=SeqID_105881
  Gene Ontology: Mol. function=sequence-specific DNA binding; Cellular component=nucleus; Biological process=regulation of transcription
  Homolog annotation: Hit_ID=Q1T4J9; Match level="QueryCoverage=50%, HitCoverage=55%, E-value=9e-22, Identity=29%"; Hit description=DNA -binding WRKY
IGNAKSNKHWEAELPPNFDRNGYGVEKFIRSKYVEKRWASKGGLQPASKSAEIIFNSNESPAAGAKSATQRNRRLSLEESILVKHVAQIRPPVTRYHEVLGLLGGNQLNNAINSEKAVKMDSAAVAELLDLIDTGDLNDSSWNRVASESLKNDDPFADVSFHSNDNKEHADIFSSMTVVDDKLDHHVSHENMGRKWAKEIHAPELTIDALLLHLVQVCGAGLDVFTSEPAGYITTACTFSTSGTHNHPLPMSATAMACKTSATASMLQSPSLSSQHGLVDSAISSIINSSARYYNPNNALNFSTHQVSRPQQFYFPNSSISTLNSHPTITLDLTTPLTSSSNSSFTCMPKYSSTNLNFSSGFSPLHSQHSFPNPIVAATEAIIRSNPKFQSALATALTTYVGNEASSGRTRENHVLESAELMKLKLLHSENSIGNSSIFPLPLSEQKNRLGSYGFPDPCSPLFSKASATLVANSLQYCAILLDLDDEVEEVRSMPKKGASMEEGVGLQCQRAEVNVKERSKQKGVGFTVRRKQAESSRVHSKEKASRKAVFNNRLRKCVVKCNLLHKNYKSATAPLSKAVPQITVVDHVS

SEQ ID NO: 222660 - protein, 64 aa, Glycine max
  Coding DNA Sequence Number=SeqID_105882
MTNLKYDIQKITFIFKIRDSSVNLKIHIKAKKKHSKAEKLKSKQEINIRATETAEKTKRRRNKY

SEQ ID NO: 222661 - protein, 1064 aa, Glycine max
  Coding DNA Sequence Number=SeqID_105883
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=92%, HitCoverage=83%, E-value=1e-149, Identity=44%"; Hit description =Chromo
  Pfam annotation: Domain name=rve; Domain location=843-999; Score =74.7; E_value=3e-19; Accession=PF00665.16; Description=Integrase core domain
  Pfam annotation: Domain name=zf-H2C2; Domain location=787-825; Score =10.7; E_value=0.014; Accession=PF09337.1; Description=His(2)-Cys(2) zinc finger
  Pfam module annotation: Pfam domain module=Retrotrans_gag::rve::zf -H2C2; Domain location=120-210::843-999::787-825
MADNNNDCTRLQHMQTQINTLNSWMEEQHKRDIENHDRFEKLQKSMDMLLQHPFLSIGGSNSGSSSSGGILITPISSSAPVKDISLGFPHFDGHTPVLEWIFKAKNFFNYHHTLDSDRVKIIAIHFEKDVIPWFQMLQHMESVNSWSDLTHALESQFGPSPFDCPMGELFKLQQTGTVSDYYLKFMALANRPKGLSNEVVLNCFLSGLNVDIRRDVIAQRPMTLIRVVSLAKLYEEKYQPVNSNQTHNYSHRYSPISAHTVNFNSAPSNAAKNTTKTSLPSLLPTPNTPPLRNNFDDEGEAEMNFDVVSGDNNSTAETVIDNLHHLSLNALKGVLGVGTIRFLAHINNLPVRVLVDGCSSDNFLQPRVAKVLKLPIKPAPLFKVMVGNANWLKTLGSHIADYDSLQLKFLHDGKFITLQGDDDGTPTQAQLHHIRRMISTDSIAEVFNLEPELALLLHTYEPVFKTPTSLPPPRSYDHAIPLLEGSKPVKVKPYRYLHSQKDEIEKLVQGMLEEGIIQPNTFLIPTIDELIDELFGAEFFSKLDLRSGVGVTVETTKLEAITNWPQPAIIKQLRGFLGLTAMTSAPVLAIPNFREPFVLETDAFGSSNGTVLSQSQHPIAYFSKLSPRMQKQYTYTREFYVINEAMAKFRHYLLGHKFIIRTDQKSLKELLEQTLQTPEQQQWLPKFLGYNFTIQYKPSRKNIHADALSRSLFIAWSEPTNHWLAKVVAVTKEDKLLSELISCYDHGGTIDPKYDVKDGLIFGKGKLMIPENSALRNQILQEFHDTKMRGHVGRNKIIARICSQFYWPKLQEDIKSYIRCCSICQQAKVDQAVPTGLLQPLPIPQQIWEDIAMDFITNLPSSHGYSTITVIVDRLSKFGHFIALKAEFNSKLVADAFINHVAKIHGFPKSIVYDSDRVFINSFWQQLFKAQGTTLAMSSSYHPQNDAQTKILNKTLEMYLRCFVFDNPKLWYPMLAWAQYWYNSSYHHSLDMSPFKDVFGREPPAVVPYQVHPKDPISLQETLVGDLALVKLQPYRQHFVALRKNQKLGMHFFGPFEVVERVGQ

SEQ ID NO: 222662 - protein, 497 aa, Glycine max
  Coding DNA Sequence Number=SeqID_105884
  Homolog annotation: Hit_ID=UPI000060E704; Match level="QueryCoverage =99%, HitCoverage=31%, E-value=3e-12, Identity=22%"; Hit description =UPI000060E704 related cluster
MSGVPKRSHEDAVHQSSKHPHQDSGAYSKLMPSVSNDHHIPYDMSQDSRVAKTVRTEPRDADRRSPLHTVYRMPSSSNDSHADHPIGPENRIESRDFKESRDPRFENRDTKTEKKELHGEARRDSQIAKSEKDVRVDGREDDNKDIRYERDSHNDSKGDIKTDKDGYGMVSSSSHLSWKESKEYRGKRFSDAPGGSLDSWHTSRGNTPTEVGKDSSMAEERDYLETHEAVGENKIDSKSEDRFKERKRKDVKHRDWGDREKERSDRRSSTPVNNNSGDNKESAKEDRDVEKWEKERKDLPKEKESSKEKEKDNSKRESLNGMEKDGLNDGKELGDGSAKNTEQENVLKQKDVDGWKNVDGEVRERRKERDADLEGDRPDKRCKIDKQSEDGSAHGEGTGEKEREVHNYNVQHRKRIHRSRGSPQVANREARFRSHTQAPDNEENKDRHGNKNSVGEEVEGSNGMHAVTRKILVDRLGSWHHARKRDYEGSRWGEEGY

SEQ ID NO: 222663 - protein, 374 aa, Glycine max
  Coding DNA Sequence Number=SeqID_105885
  Homolog annotation: Hit_ID=Q01AC6; Match level="QueryCoverage=98%, HitCoverage=82%, E-value=3e-35, Identity=29%"; Hit description=[S] KOG4843 Uncharacterized conserved protein
  Pfam annotation: Domain name=Rxt3; Domain location=1-65; Score=33.1; E_value=1.5e-09; Accession=PF08642.1; Description=Histone deacetylation protein Rxt3
MVRGGQLWGTDVYTYDSDLVAGYCRPTASPPPMAVQELRTTIRVLPPQDCYISTLRNNVRSRAWGAAIGCSYKVERCCIVKGCLCLEWVCTLHVFVFAFYLSIFVHSQLDKKGGGTIDLEPCLTHTSTVEPTLAPVAIERTITTRAAASNALRQQRFVREVTIQYNLCNEPWIKYSISIVADKGLKKPLYTSARLKKGEVLYLETHSCRYELCFTGEKMVKAIPATQMHDPDTEKSQNHHHHHHPANGDKADSDVMVDVFRWSRCKNPLPQKLMRTIGIPLPLEHVENFFSSIMSNSCISIECFHLPVSLPLHLLRLTTYEMGDDVRVFLKGRGEYHMVLEENLDWEDVQWSQTGVWIAGKEYTLARVHFLSMN

SEQ ID NO: 222664 - protein, 311 aa, Glycine max
  Coding DNA Sequence Number=SeqID_105886
  Gene Ontology: Mol. function=hydrolase activity; Cellular component =nucleus; Biological process=metabolic process
  Homolog annotation: Hit_ID=Q0ZPW9; Match level="QueryCoverage=86%, HitCoverage=80%, E-value=1e-100, Identity=65%"; Hit description=CXE carboxylesterase
  Pfam annotation: Domain name=Abhydrolase_3; Domain location=88-299; Score=205.1; E_value=1.7e-58; Accession=PF07859.3; Description =alphabeta hydrolase fold
  Subcellular localization annotation: CTP_CleavageSite=77; ConfidenceScore=5.06e-01
SQQPKPVLPWRARISISFLCTLSDAARRSNGTVNRLLINLLDLKSHPNAAPVNGVSSNDVTVDASRNLWCRVFSPTVAAASGGALPVVIFFHGGGFAFLSPDSLAYDAVCRRFCRQIPAVVVSVNYRLTPEHRYPSQYDDGEDILKFLDENRAVLPENADLSKCFLAGDSAGANLAHNVAVRVPKSGLRIIRVVGLVSIQPWFGGEERTAAEEKFKGAPLVSMARTDWLWKVFLPDGSDRDHVAANVSGPNSEDLSGLDYPDTLVVVGGFDPLQDWQRSLVVARGEMIINTNRHMQCCNYGPCLGVPECQI

SEQ ID NO: 222665 - protein, 342 aa, Glycine max
  Coding DNA Sequence Number=SeqID_105887
  Gene Ontology: Mol. function=voltage-gated chloride channel activity; Cellular component=membrane; Biological process=chloride transport
  Homolog annotation: Hit_ID=Q8LPA2; Match level="QueryCoverage=96%, HitCoverage=46%, E-value=6e-76, Identity=46%"; Hit description =Chloride channel
  Pfam annotation: Domain name=Voltage_CLC; Domain location=137-342; Score=20.7; E_value=7.5e-12; Accession=PF00654.10; Description =Voltage gated chloride channel
MDAEDGVNCSDYEHDIENEDLWDGNEESGGYWSGIYDRNKAHTKPLLMKGTNTTSQIAIIGANLCPIESLDYEKKVQIIHYVMLKWGFALLIGLGTGLVGFFNSFAVENIAGFKLFMTTSLMSKHRYLEAFLAYAGANMCLAAAAAALCAFIAPAAAGSGIPEVKAYLNGVDAQHILAPSTLFVKIFGSILGVSAGFVVGKEGPMGGSRKYHLTCTWLRYFKNDRDRRDMITCGAAAGVAAAFRAPVGGVLFALEEAATWTFFTTAVVAIVLRVAIQFCATGGKCGLFGEGGLIMYDVSSANITYSASGIFAVLLMGAIAGILGSIYNYLVDKVVRTYSIIN

SEQ ID NO: 222666 - protein, 210 aa, Glycine max
  Coding DNA Sequence Number=SeqID_105888
  Gene Ontology: Mol. function=translation initiation factor activity; Cellular component=cytoplasm; Biological process=mature ribosome assembly
  Homolog annotation: Hit_ID=Q9M060; Match level="QueryCoverage=96%, HitCoverage=98%, E-value=1e-65, Identity=67%"; Hit description =Eukaryotic translation initiation factor 6 (EIF-6)-like protein
  Pfam annotation: Domain name=eIF-6; Domain location=9-198; Score =170.5; E_value=4.4e-48; Accession=PF01912.9; Description=eIF-6 family
MGFLQDFSLKIIVKLEPSLNLPMPTVWLPLEVLKTSTGLFEAELAGVIPVVKTSISGIRVIGHLCAGNKNGLLLPHTTTDQELQHLRNSLPDQVVQRIEERLCSLGNCIACNDHVALAHTDLDRETEEIIGDVLGVEVFRHTIADNIMVGSYCAFSNRGGLTSTVSFDNTLDADTTATELSVIESVFKLREAQHSAIVDEMRKSLIDTYV

SEQ ID NO: 222667 - protein, 154 aa, Glycine max
  Coding DNA Sequence Number=SeqID_105889
  Gene Ontology: Mol. function=hydrolase activity, acting on acid anhydrides, catalyzing transmembrane movement of substances; Cellular component=integral to membrane; Biological process=ethylene mediated signaling pathway
  Homolog annotation: Hit_ID=Q9S7J8; Match level="QueryCoverage=84%, HitCoverage=13%, E-value=4e-59, Identity=87%"; Hit description =Copper-transporting ATPase RAN1
VGIQDVRAEVMPAGKADVVRSFQKDGSIVAMVGDGINDSPALAAADVGMAIGAGTDVAIEAANYVLMRDNLEDVITAIDLSKKTFFRIRLNYVFAMAYNVVAIPVAAGVFFPWLGIKLPPWVAGACMALSSQYARVHVNVSLFAKPGQENTEIE

SEQ ID NO: 222668 - protein, 248 aa, Glycine max
  Coding DNA Sequence Number=SeqID_105890
MHKALRSSAPLPYPQLVTLFIHHFEIPLNSESFVQIKRSFAIGVGAVTSFSYRKDKDGQWLKKDAQPPQDERTPSPLSQRDDSSTLMHEVLSELRGLRTYVGERFDSLDGRIDVVATCPLRASEGEAHGCAFQRRKGARSRHQRLFVENVGKTEGNRGGACHPARPGEQGCFLQKQQPSGGRIWKAQLSKKLRKLTDSDPALMLGQTRGDDLTSLPPPALLAPPKIEEGRITITETGSLTIAEDPALP

SEQ ID NO: 222669 - protein, 98 aa, Glycine max
  Coding DNA Sequence Number=SeqID_105891
MAVIVVAGTIMIVVVITTMVVSCSDGDDGSGSNSDGSSNSEIVVMTTMTMIRQKNGNDDKGNIDGTSDSGGTSRSSDGMMVMVTTSVVVIEVVVVVEW

SEQ ID NO: 222670 - protein, 75 aa, Glycine max
  Coding DNA Sequence Number=SeqID_105892
  Gene Ontology: Mol. function=aspartate kinase activity; Cellular component=chloroplast; Biological process=amino acid biosynthetic process
  Homolog annotation: Hit_ID=Q9XHC5; Match level="QueryCoverage=72%, HitCoverage=15%, E-value=1e-15, Identity=92%"; Hit description =Precursor monofunctional aspartokinase
MKFGGSSVASADRMEEVATLILSFPEERPIVVLSVVGKTTNKDCGSAWCEGICYFNLKQQLHCICINVSDEIDLV

SEQ ID NO: 222671 - protein, 65 aa, Glycine max
  Coding DNA Sequence Number=SeqID_105893
MQPRRSKSSLRSASEASRRERRRVTNLVKPLKVQKSEECKIRVGRRFQRFKDGVSGMQEATDVEG

SEQ ID NO: 222672 - protein, 183 aa, Glycine max
  Coding DNA Sequence Number=SeqID_105894
  Gene Ontology: Mol. function=4 iron, 4 sulfur cluster binding; Cellular component=mitochondrion; Biological process=tricarboxylic acid cycle
  Homolog annotation: Hit_ID=Q9SIB9; Match level="QueryCoverage=91%, HitCoverage=19%, E-value=6e-71, Identity=71%"; Hit description =Aconitate hydratase 2, mitochondrial precursor
  Pfam annotation: Domain name=Aconitase; Domain location=6-183; Score=- 204.3; E_value=0.00061; Accession=PF00330.10; Description=Aconitase family (aconitate hydratase)
MRVLSLTRFFSSPLDFTGIPAVVDLACVRDARNKLGSDSNKINPLVPVDLVINHSVQVDVARNNERFAFLKWGSNAFRNMLVVPPGSGIVHQVNLEYLGRIVFNTEGLLYPDSVVGTASHTTMIDRLGVAGWGFGGIEAEATVLGKLSGKLCNGVTTTDLVLTVTQILRKHGVVGKFVEFYGN

SEQ ID NO: 222673 - protein, 66 aa, Glycine max
  Coding DNA Sequence Number=SeqID_105895
MEREADKSIWNVEKERNIIFHSVRKKVTVKSVGNRWAPRVQTSSQNTAEMRRKNMATNVRWDLVIW

SEQ ID NO: 222674 - protein, 837 aa, Glycine max
  Coding DNA Sequence Number=SeqID_105896
  Gene Ontology: Mol. function=transferase activity, transferring phosphorus-containing groups; Cellular component=membrane; Biological process=two-component signal transduction system (phosphorelay)
  Homolog annotation: Hit_ID=Q3S4A7; Match level="QueryCoverage=93%, HitCoverage=75%, E-value=0.0, Identity=54%"; Hit description =Cytokinin independent 2
  Pfam annotation: Domain name=HATPase_c; Domain location=263-458; Score=144.2; E_value=3.4e-40; Accession=PF02518.16; Description =Histidine kinase-, DNA gyrase B-, and HSP90-like ATPase
  Pfam annotation: Domain name=HisKA; Domain location=152-217; Score =82.1; E_value=1.7e-21; Accession=PF00512.15; Description=His Kinase A (phosphoacceptor) domain
  Pfam annotation: Domain name=Response_reg; Domain location=647-787; Score=87.8; E_value=3.4e-23; Accession=PF00072.14; Description =Response regulator receiver domain
  Pfam module annotation: Pfam domain module=HATPase_c::HisKA::Response_ reg; Domain location=263-458::152-217::647-787
MSAIVRDLSIRKGLTLILFFQDKELRYRFIYNHFPSLQEEDIIGKTDVEIFTGSGVKESQDFKREVMEKGLPAKKEITFETELFGSKTFLIYVEPVFSKAGETIGVNYMGMEITDQVRKRERMAKLREEIAVQKAKETELNKTIHITEETMRAKQMLATMSHEIRSPLSGVVSMAEILSTTKLDREQRQLLNVMISSGDLVLQLINDILDLSKVESGVMKLEATKFRPREVVKHVLQTAAASLQKMLTLEGNVADDMPIEVIGDVLRIRQILTNLVSNAVKFTHEGKVGINLYVVPEPPFAKAEGHQKMITEQSTNSANGVKEEKRASTPRSSSDQNCLDGQKHNDHPSQNHAFNDECRSSVKSECSMNGDTEEQTHSTETVWIRCDVYDTGIGIPEKAIPTLFRRYMQVSADHARKYGGTGLGLAICKQLVELMGGRLTVTSKEHVGSTFTFILPYKVSTACDDSDDPDELSDVDDNDDDTTEGFFQFQPRTLGSLFTSNGPTRPQNILPGFRSSHKFNGISENSYSFLTTNTRSKGISSTEDASSVIVDAPEMSESTSSSSHSPETKQESVINTNNENQDKAHARLQNGSVDSSQHKEVMVMTLGTMSNEPQQTCQLVNTDITSQRVISSNNNTLSEVTKSSLGPKILLVEDNKINVMVTQSMMKRLGYSMDVVNNGVEAVRAVQHHTYDIILMDVYMPVMNGLQTTKLIRSYEDTGNWEAARKAGIEQCLPASNECSVPPKNRIHIIAMTANTMSESAEECYANGMDSFVSKPVTFQKLKDCLEQYLSVYLKNCIDLLIYNILFHLSECIIAIRKLVGLAGACKVEVYNISLSY

SEQ ID NO: 222675 - protein, 51 aa, Glycine max
  Coding DNA Sequence Number=SeqID_105897
IRSSLPDYSIDVEAKHRYSEFESLRKLLSKAYPTSVIPIKLIDTVDLEGGP

SEQ ID NO: 222676 - protein, 134 aa, Glycine max
  Coding DNA Sequence Number=SeqID_105898
  Homolog annotation: Hit_ID=Q1SHW0; Match level="QueryCoverage=57%, HitCoverage=10%, E-value=2e-07, Identity=43%"; Hit description =Integrase core domain, putative
MDTGIPCIEILFGIESTHGGQAMCLVESVTMQDTRAFLNTKSWYLELRSKSFRICYMLCDINVKLEDENLGMILLASLPYSYENFMSTLSVAKECITLEEVKSCLYSRELQHKVSGNGEEASASRLSMTNSAKG

SEQ ID NO: 222677 - protein, 111 aa, Glycine max
  Coding DNA Sequence Number=SeqID_105899
MLRLIILRMPILDLSKQDSIIWEASKDGIYSMRSAYKLIMLNLTDVKFIFALFNDLHDHHQQQMAMLLWRRRNDKVWDNKAYPDSHVIAQGDEFFQSWSRVNREIGSRLCQ

SEQ ID NO: 222678 - protein, 37 aa, Glycine max
  Coding DNA Sequence Number=SeqID_105900
MACDTFLTGLPITIADLEPHQIHSFYESKSIIASYTK

SEQ ID NO: 222679 - protein, 177 aa, Glycine max
  Coding DNA Sequence Number=SeqID_105901
  Homolog annotation: Hit_ID=Q1SAV4; Match level="QueryCoverage=40%, HitCoverage=19%, E-value=8e-07, Identity=42%"; Hit description =Integrase, catalytic region
MSTGPKGHVANQHLRIKSEEDKDQKSPNILLAILLLVHNNWSNLSSLCLSTIPGRPPQNDLEEVVHCLTQNHASILQAQSIMNIKIDSILEHLATLTVQPPSPQDHPTPSHTHPHMKLEGQPPEDIDTLPPTNSDNHPVVEPLTILDWKWDTIGVSPSKLVLVQWLGLALKDTTWEH

SEQ ID NO: 222680 - protein, 117 aa, Glycine max
  Coding DNA Sequence Number=SeqID_105902
MRNGGEGLTLGNERWVWSVRLKEGSGVLKRLEGNWERACLKQSSKAPRRQCIVPWQEPPPCMIKCNVDAVIFGPQRLFGAATDLLSIFKMTFSRPKDCRNCNAERRLQASSSVTERN

SEQ ID NO: 222681 - protein, 86 aa, Glycine max
  Coding DNA Sequence Number=SeqID_105903
  Homolog annotation: Hit_ID=Q9LTY1; Match level="QueryCoverage=80%, HitCoverage=9%, E-value=7e-09, Identity=41%"; Hit description =Mitotic checkpoint protein-like
MECRANNAEREAELLKEQLKHLKDQLDKCLHQKIEVEKKLSTLMFQEVASTESNVLVKHLQQELRNYVADGNLMALDSCYNHLSHK

SEQ ID NO: 222682 - protein, 100 aa, Glycine max
  Coding DNA Sequence Number=SeqID_105904
LGRIDGDPVLRETRIWATWEYVSSVGGGQQGMSGTWRYVAGGQETLGTSGGVLLPKTKLDQSRPNPGIVGDWNIVEASGNRLLAYVIDYTEGWVTGNRLP

SEQ ID NO: 222683 - protein, 96 aa, Glycine max
  Coding DNA Sequence Number=SeqID_105905
MADGGVFRKFRKNLFRKVSGRSVLPEVTKRLPEEHFFRKTPGKGSSGNFPEEVVHPEEFRKTPSSGRTFKFPEDLFGRITSSGMFPEEPLLPEVIL

SEQ ID NO: 222684 - protein, 719 aa, Glycine max
  Coding DNA Sequence Number=SeqID_105906
  Gene Ontology: Mol. function=ubiquitin thiolesterase activity; Cellular component=cytosol; Biological process=ubiquitin-dependent protein catabolic process
  Homolog annotation: Hit_ID=Q9SJA1; Match level="QueryCoverage=78%, HitCoverage=83%, E-value=1e-179, Identity=56%"; Hit description =Putative ubiquitin carboxyl terminal hydrolase
  Pfam annotation: Domain name=UCH; Domain location=170-476; Score =175.2; E_value=1.6e-49; Accession=PF00443.19; Description=Ubiquitin carboxyl-terminal hydrolase
  Pfam annotation: Domain name=zf-MYND; Domain location=70-97; Score =12.5; E_value=0.0015; Accession=PF01753.9; Description=MYND finger
  Pfam module annotation: Pfam domain module=UCH::zf-MYND; Domain location=170-476::70-97
MLVAVGASWDLNWFLQLLLSVIVVAIGVHYFVKVTASKYFLVDANFEGDHHHALATDAMPGALAAADPLCAVCATPAPKNSQACQQSHWMSGHKTVCKDFRETSARSSAQNGVINRGFKASAAGGKSLSTIALIPGCGAGAISRPIKQAKDVLFSYDEFVKFFNWDKPGFPPCGLLNCGNSCFANVVLQCLSFTKPLVAYLLEKGHRRECSCNDWCFLCEFENHVERTRLSSQAFSPMNILSRLPNIGGTLGYGRQEDAHEFMRFSIDTMQSVCLDEFGGEKAVPPNLQETTLIQHIFGGRLQSEVICTKCNKISNQYENMMDLTVEIHGDAASLEECLDQFTARERLDGENMYKCEGCKDYVKAWKRLTVKCAPNILTIALKRFQSGRFGKLNKRISFPETLNLSPYMSEAGDGSDIYKLYGVVVHIDMLNASFFGHYICYIKDFQGNWYRIDDWKVMTVEVEEVLSQGAYMLLYSRCSARPSGLQIQTSESSGIAEVQTEVEVEPGQTEQDECLSNMKALTCSRGSEVLPSDVSPELKVSSSYDCESFAGLNSPVKREQFNDVDMMDVDSTGIVNEISCGAVESSYVPISQTDSDLGDVDMGRSLEETSGCKEEQDDTDMVSSGLCSGPPNDNSFDKHPSVSRDHQNMEEDSEHIDVVNCKLITAKDNACYSNGYVSANEPSIPVEDAGSQISGISSFPTENDKGNGIKKVEISADI

SEQ ID NO: 222685 - protein, 95 aa, Glycine max
  Coding DNA Sequence Number=SeqID_105907
  Gene Ontology: Mol. function=DNA binding; Biological process=DNA integration
MKGHQTVVNNILKYLGRTKDSFYTSFRDRDDSQSQSGFVFCLNGEVMPLVQAEEWDVWIGMFITGLGIVPSIAGLIDLDCDNKGVIPQAKEPRSH

SEQ ID NO: 222686 - protein, 102 aa, Glycine max
  Coding DNA Sequence Number=SeqID_105908
MEDEYSEATILEPFTAEEEVGDTKTTQVAAAIPERSLEAISLPPAPAVDPSSPQHTTNPSTLVLEILKGQTTPVLTLDTSSPATPMLHLTDEEDVQTQDTQD

SEQ ID NO: 222687 - protein, 145 aa, Glycine max
  Coding DNA Sequence Number=SeqID_105909
  Homolog annotation: Hit_ID=Q1SAZ0; Match level="QueryCoverage=82%, HitCoverage=8%, E-value=4e-11, Identity=34%"; Hit description =Integrase, catalytic region
MKTAKDVWESCKQNYFKVGDVGQIYIIKIKITTTKQEDRFVGEYVQNLHNLWLELDRYEKFEAKCTKDANLLKSYKEKDITYKLLIGQNNEFNPVRIQVLGKELPSLNETMTTFRGKKIDQVQTNQHGGIAHRMEIDKGDNKDSL

SEQ ID NO: 222688 - protein, 210 aa, Glycine max
  Coding DNA Sequence Number=SeqID_105910
  Homolog annotation: Hit_ID=Q1S5C0; Match level="QueryCoverage=21%, HitCoverage=5%, E-value=9e-08, Identity=63%"; Hit description =Polynucleotidyl transferase, Ribonuclease H fold
MDALEKNGTWELVELPKEKTLVGCKWVFTSNIRQMGHSKGIRQEFEIKEQDRLKYFLGVEVAHSRHGCNCGQRILSKADWKIDLFVPYCGSINDRKPMIMTFPNKEDLLEIWRIEGNPIILVEHRFNINMLEAMRVPFRDNLHLCNIINFFTKDEVVVAEMVREFWRNVFEKDRITRIMLGIQDIDPKLIKAFLYKPSASEKLELTKFFD

SEQ ID NO: 222689 - protein, 144 aa, Glycine max
  Coding DNA Sequence Number=SeqID_105911
  Gene Ontology: Mol. function=nucleic acid binding; Biological process= transport
  Homolog annotation: Hit_ID=Q8H6Q8; Match level="QueryCoverage=52%, HitCoverage=42%, E-value=7e-15, Identity=49%"; Hit description=CTV.20
MVATTYQTSHECSEETIIDILVAGFSRQLKGWWDNYLTNDEKSKIYSAVKTDLNGKVITNENNKEIPDVVNTLIFTITQHFIGDPSLWKDRSGELLSNLKCRTLADFRWYRDTFLTRVYTREDSQQPFWKEKFLVGLPRSLGDK

SEQ ID NO: 222690 - protein, 537 aa, Glycine max
  Coding DNA Sequence Number=SeqID_105912
  Gene Ontology: Mol. function=unfolded protein binding; Cellular component=cytoskeleton; Biological process=cellular protein metabolic process
  Homolog annotation: Hit_ID=Q6K3R8; Match level="QueryCoverage=98%, HitCoverage=90%, E-value=0.0, Identity=81%"; Hit description =Putative chaperonin containing TCP1, subunit 3
  Pfam annotation: Domain name=Cpn60_TCP1; Domain location=6-509; Score= 460.1; E_value=2.7e-135; Accession=PF00118.14; Description=TCP-1cpn60 chaperonin family
MWGWDYDLGIVVTNDGNAILRELDLAHPAAKSMIELSRTQDEEVGDGTTSVIILAGEMLHVADAFIDKIHPTVICRAYAKALEDAIAVLDKIAMPINAQDRGIMLGLVKSCIGTKFTGRFGDLIAVLDLWDGFVAVIQFLRTVSSKESLALRLDLAIDATTTVGVEVGQGLRDVDIKNYIKVEKVPGGQLEDSRVLKGVMINKDVVAPGKMRRKIVNPRIILLDCPLEYKKGENQTNAELLKEEDWSLLLKMEEEYIEELCMQILKFKPDLVITEKGLSDLACHYLSKHGVSAIRRLRKTDNNRIAKACGAVIVNRPDELQESDVGTGAGLFEVKKIGDEYFAFIVDCKEPKACTVLLRGASKDLLNEVERNLQDAMSVARNIIKNPKLVPGGGATELTVSAALKQKSSSIEGIEKWPYEAAALAFEAIPRTLAQNCGVNVIRTMTALQGKHANGENAWIGIDGNTGSITDMKECKIWDAYNVKAQAFKTAIEAACMLLRIDDIVSGIKKKQAPGATPSKPKVETEADADSEQILPD

SEQ ID NO: 222691 - protein, 93 aa, Glycine max
  Coding DNA Sequence Number=SeqID_105913
MYTPLTNQRLKSRNIRSQQVTIEKRESLISWSFIKWRLKQQWFREKNANYLNLAGDCSIGAGSGRDTVVDGGGKGARAQKKNNRFGEIIGGRV

SEQ ID NO: 222692 - protein, 105 aa, Glycine max
  Coding DNA Sequence Number=SeqID_105914
MDALGFCSLCSAAIAPQRARTLEGGDNNRVCKSGWCKGDYSLHLMVLLLGDACTNLGDGGGVVKWKEKRVNGGGHTKMVDRKVMTRCDDDVVVFGRVGTRVMVAQ

SEQ ID NO: 222693 - protein, 230 aa, Glycine max
  Coding DNA Sequence Number=SeqID_105915
  Gene Ontology: Mol. function=zinc ion binding; Cellular component =nucleus
  Homolog annotation: Hit_ID=Q5N7H4; Match level="QueryCoverage=81%, HitCoverage=20%, E-value=4e-30, Identity=40%"; Hit description=Zinc finger (CCCH-type) protein-like
  Pfam annotation: Domain name=Plus-3; Domain location=171-230; Score =20.9; E_value=1.4e-05; Accession=PF03126.8; Description=Plus-3 domain
  Pfam annotation: Domain name=SWIB; Domain location=42-115; Score =42.7; E_value=1.2e-09; Accession=PF02201.9; Description=SWIBMDM2 domain
  Pfam module annotation: Pfam domain module=Plus-3::SWIB; Domain location=171-230::42-115
MGDEPHAGSFGLEEIYGGVPTPMRRKRKYRTKKKEYQGWGSTSLIWFLESIGRDTSTEITQSEVANIVMEYVKQHNLFHKTKKKRIECDEKLHLLFGRKTISRLKINDLLESHFAENCEESSDGIFFDSEDDESALTACETPRTAPSERKSQPKKPAFEKPRSCFAAIVPANIKLVYLKRSLVEDLLKDPETFETKVVGSFIRIRCDPNDYLQKNSHQLLQVTGNLAAVG

SEQ ID NO: 222694 - protein, 93 aa, Glycine max
  Coding DNA Sequence Number=SeqID_105916
  Homolog annotation: Hit_ID=Q1SZU4; Match level="QueryCoverage=57%, HitCoverage=6%, E-value=2e-09, Identity=66%"; Hit description =Protein kinase PKN/PRK1, effector
LSKLLEEATARNQTEGNKDLNHNEKDYLLPKVVEFSEENRHGGKDTSKVELSANEGLNSNKAYRNKSLMTEKWNLGTRGIIPPCLLPLVCNPW

SEQ ID NO: 222695 - protein, 113 aa, Glycine max
  Coding DNA Sequence Number=SeqID_105917
  Gene Ontology: Mol. function=structural constituent of ribosome; Cellular component=intracellular; Biological process=translation
  Homolog annotation: Hit_ID=Q1S5H1; Match level="QueryCoverage=86%, HitCoverage=68%, E-value=4e-50, Identity=92%"; Hit description =Ribosomal protein L35Ae, putative
  Pfam annotation: Domain name=Ribosomal_L35Ae; Domain location=12-103; Score=148.8; E_value=1.4e-41; Accession=PF01247.8; Description =Ribosomal protein L35Ae
MVKGRQGERVRLYVRGTILGYKRSKSNQYPNTSLIQIEGVNAKEEVAWYAGKKMAYIYKAKVKKNGSHYRCIWGKVTRPHGNSGIVRAKFKSNLPPKSMIQVIKRSVEVPADL

SEQ ID NO: 222696 - protein, 76 aa, Glycine max
  Coding DNA Sequence Number=SeqID_105918
  Subcellular localization annotation: CTP_CleavageSite=49; ConfidenceScore=5.07e-01
MKATKKSSVSIIYAPAKVNNDIQRSAEPINLVRPNVMAIAMQPPTRTLRQDLVTGVFPRTAPTPPNTNNAKLFYKH

SEQ ID NO: 222697 - protein, 80 aa, Glycine max
  Coding DNA Sequence Number=SeqID_105919
  Gene Ontology: Mol. function=membrane alanyl aminopeptidase activity; Biological process=proteolysis
  Homolog annotation: Hit_ID=Q1SLQ6; Match level="QueryCoverage=86%, HitCoverage=7%, E-value=2e-23, Identity=75%"; Hit description =Peptidase M, neutral zinc metallopeptidases, zinc-binding site
MIIMKGTNRQIGWDSISGEDHSISLLRGEVFQALATFDHDKTQQEALHRFQILLDGRNTSLPPANIRRVAYVAVMRNTTT

SEQ ID NO: 222698 - protein, 529 aa, Glycine max
  Coding DNA Sequence Number=SeqID_105920
  Homolog annotation: Hit_ID=Q8H612; Match level="QueryCoverage=97%, HitCoverage=95%, E-value=5e-68, Identity=30%"; Hit description =Pentatricopeptide (PPR) repeat-containing protein-like
  Pfam annotation: Domain name=DUF247; Domain location=32-512; Score =165.1; E_value=1.8e-46; Accession=PF03140.6; Description=Plant protein of unknown function
MASPSIFNSESDEDSWVIQINQLVSETNLSILNKMPVCIYQVPKSLSCAKPEAFSPQLIAIGPYTHFHPDLYPMERFKVFAAKGVLDHFKKHDFKQLIEQLRSTGQFIRASYHKYLDFKEDTLLYIIAIDGLFLLDFFHNYLNEEVSGSFMTGLQDQVQLSGVKLTKDAIIRDIIMVENQIPTYILVRILVLESSKPADSVLEFLGSMLLSFCKKHSPLKVTHIPTDSEAVSKHYHILDLMYHLVVSHPEKSETPTTPDQSEGTSTLKKSSKSEGTAASNHFKKVKNVLSWTLESAKKLKDVNIPLVQPIKRHIDTILNMSSHLESLSSHPKLSEEEEAPVVVNIPCVRELHSVGVYFQPVEGGNMAIDFDEKKGIFYLPVLKLDVNSEVIMRNLVAHEALTKPDFLIFTRYTELMRGIIDTVEDVKLLKNAGIIDSSSSLSVEETEELFNGMSKSIGPTKTEKLDETIKKVNKYYHDKRKANLYRTLTEYVYNSWKLFTLLATFVLLAMTALQTFCSAYDCPSYFRPK

SEQ ID NO: 222699 - protein, 108 aa, Glycine max
  Coding DNA Sequence Number=SeqID_105921
  Gene Ontology: Mol. function=oxidoreductase activity; Biological process=electron transport
  Homolog annotation: Hit_ID=Q9SZ83; Match level="QueryCoverage=91%, HitCoverage=26%, E-value=8e-10, Identity=36%"; Hit description =Probable oxidoreductase At4g09670
FGNKRCLRLHDFALPFEESLGHGKFLEASELDYGKIEPGMWCPKPNEHVVETGFSQDALMVKEFADLVQKVKGCEMKPEKTWPVLSRKQDSGGVGCSERVDSERLPAC

SEQ ID NO: 222700 - protein, 212 aa, Glycine max
  Coding DNA Sequence Number=SeqID_105922
  Gene Ontology: Mol. function=hydrolase activity; Cellular component =mitochondrion; Biological process=metabolic process
  Homolog annotation: Hit_ID=Q2QUG4; Match level="QueryCoverage=95%, HitCoverage=33%, E-value=4e-53, Identity=50%"; Hit description=3 -hydroxyisobutyryl-coenzyme A hydrolase, putative, expressed
EYIGLTGAQLDGAEMVACGLATHFVPSVKINTLENVLQTVTNSNLPIAEVIETFAEKANVKEDSSFRRLEIINKCFSKGTLEEIIICLEKESENGAEEWIKNALSSMRSSCPLSLKIFLKSIRTGRVQNIEQCLYRDYTIAGHFLRRTISNDFYEGTRAKLIDKDNKPKWEPSKLELVSEEMVDQCFRDIDEEEMDCLKLPDRSNSQIASRL

SEQ ID NO: 222701 - protein, 94 aa, Glycine max
  Coding DNA Sequence Number=SeqID_105923
  Gene Ontology: Mol. function=hydrolase activity; Biological process =metabolic process
  Homolog annotation: Hit_ID=Q9LKJ1; Match level="QueryCoverage=72%, HitCoverage=18%, E-value=3e-11, Identity=50%"; Hit description=CoA -thioester hydrolase CHY1
MAQSFTLDRDEKQVLFTGNSCVKIVTLNRTQKLNTLNYEMIYQIKKNLQMCENDPSVKLVILKANGKAFSAGGDVVSVIMSSLAGHLASLSDSE

SEQ ID NO: 222702 - protein, 543 aa, Glycine max
  Coding DNA Sequence Number=SeqID_105924
  Gene Ontology: Mol. function=binding; Cellular component=nucleus
  Homolog annotation: Hit_ID=Q6ZA95; Match level="QueryCoverage=64%, HitCoverage=85%, E-value=5e-63, Identity=39%"; Hit description=SET -domain transcriptional regulator-like protein
  Subcellular localization annotation: CTP_CleavageSite=44; ConfidenceScore=5.78e-01
MDIASPPSSSSMALPSLQPRNTTLSKVSIFQRLTPLTTIIPSWACSNKPNTTTLSPISSKFPSFLRCSTKPDTSANSETQHNNNQNNEPNSISNSQNAPQSSDSSSSAAFSSSPPPLGPSHSSSSRGLVLDLGPSNSWDSADIGSPLVKRFLSDEEERWYMWYHGRAKGHPSSDLIGLAVSKNGVHWERGGGPARSSSDVGFVMSSGKDWWGFDTGGIRPSEMVVMSSSRVRASSAVYWLYYTGFVSERVEFSDHSLEFSVENPDGVINGSVSCGYGNGNGKVLKSLPGMAISKDGRYWARIEGEHHSGALIDVGSEKEWDSLFISSPQVVLHGNGDLRMYYHSFDVQRGHFGVGIVRSRDGIRWVKLGKIMGGGKGGSFDEFGVMNPCVTRNRSGGNYVMTYEGVAADGRRSIGMAVSPDGLKEWARLQDEAILKPSDQGCWDDKDVGSPCLVEMDIEGNEWRLYYRGIGNGGRVGIGMAVSEGRDIGRFRRWTVRLELVLTFMNMVYVLTLILCSSRTSKIVMYYAGSKGATLERLRISFA

SEQ ID NO: 222703 - protein, 138 aa, Glycine max
  Coding DNA Sequence Number=SeqID_105925
  Gene Ontology: Mol. function=DNA binding
  Homolog annotation: Hit_ID=Q2QW42; Match level="QueryCoverage=70%, HitCoverage=51%, E-value=2e-32, Identity=69%"; Hit description =Expressed protein
MRRQLDGTSQCCLLKQAKQEIKASMFHAFDPPPSRVFALRVLELKEQGVSEEQAMAIADMEYVTEKKAKKKAYTRLKEIARLQGKRLPQNPYPSAIKEIQAEERKYVRDRFFNPKILEIVEKQKAEAAAERLSRGGDW

SEQ ID NO: 222704 - protein, 245 aa, Glycine max
  Coding DNA Sequence Number=SeqID_105926
  Homolog annotation: Hit_ID=Q1T1F7; Match level="QueryCoverage=55%, HitCoverage=32%, E-value=2e-13, Identity=35%"; Hit description=IMP dehydrogenase/GMP reductase
  Pfam annotation: Domain name=DUF1723; Domain location=126-173; Score =23.9; E_value=0.00056; Accession=PF08330.1; Description=Protein of unknown function (DUF1723)
IMVRTRGLGRALGRVIDKALGREDHHDSDDVPQRQRLTTSARRQRGAAPVPEDAATISEDIPAPGAEAVDGAEGFAVDDVEEFLGEPYDPSVLTEYGDHVALSIWNGEERPELKLASHGRKVEKFGRSAPEIEGLRWHKETSSFHLPVGELTITLDDVASLLHLSIIGTFHSFEPLHVDEAVLMLVELLEVSGPTLDCYNSCVSPTLVSGSYAWGAAALVHMYDHLNDACKSGGRQLAGYITLLQ

SEQ ID NO: 222705 - protein, 407 aa, Glycine max
  Coding DNA Sequence Number=SeqID_105927
  Homolog annotation: Hit_ID=Q8GSA3; Match level="QueryCoverage=91%, HitCoverage=92%, E-value=1e-84, Identity=45%"; Hit description=F-box protein family, AtFBX13-like protein
  Pfam annotation: Domain name=F-box; Domain location=21-68; Score =48.4; E_value=2.3e-11; Accession=PF00646.23; Description=F-box domain
MEHSLKRKSPESGDNLLFSSFSLDDLNEDLLERVLSWLPTSSFFRLTSVCKRWKSAAASVSFKLACSRVPLRDPWFLMVAPNLNQSIVFDTAENSWKRLNHPHLPLKDSNISCMPVAASGGLVCYRKLSGNFIVCNPVTGSCTELPPLHFTPENQSLNAVVMSTTFNDQLSYKIVLVFGELPNLLFKVYNSSSGCWEDEAALRRNVDDNSLDCDSTDDDNVVYFLSKAGTVVASSMHRSPSKQYSSVITNKEGQETVYFLSSSGMVVACNLTSKYFFEYPRLLPVFSEYSIDIVECGSEMLVVLLSEFLESASLRVWKYDEANRCWKQIAAMPAAMSQEWYGKKADINCVGAGDRIFICLNSPELCAYVLCDLVTNKWTELPKCCLNGELMEFMSAFSFEPRIEASV

SEQ ID NO: 222706 - protein, 85 aa, Glycine max
  Coding DNA Sequence Number=SeqID_105928
  Gene Ontology: Cellular component=integral to membrane
  Homolog annotation: Hit_ID=Q8S403; Match level="QueryCoverage=90%, HitCoverage=10%, E-value=3e-13, Identity=51%"; Hit description =Putative phosphate transporter 1
MVKFSKELEAQLIPEWKEAFVNYRQLKKHIKRIKLNRVSKQLQAPEETFGRSVFDSFRFITNKFCNSDNNHKQDMIQLILLVWFR

SEQ ID NO: 222707 - protein, 554 aa, Glycine max
  Coding DNA Sequence Number=SeqID_105929
  Gene Ontology: Mol. function=oxidoreductase activity
  Homolog annotation: Hit_ID=Q5VPG7; Match level="QueryCoverage=72%, HitCoverage=67%, E-value=1e-120, Identity=53%"; Hit description =Oxidoreductase, 2OG-Fe(II) oxygenase family protein-like
  Pfam annotation: Domain name=2OG-FeII_Oxy; Domain location=331-428; Score=46.8; E_value=7.5e-11; Accession=PF03171.10; Description=2OG -Fe(II) oxygenase superfamily
  Subcellular localization annotation: CTP_CleavageSite=53; ConfidenceScore=5.00e-01
MDDQEQHRQPQPNSNNGSNADPFLLNYSTSDLRTASEFLATWLPFLSRDLCTRCTLSLSDRIRSIDPGRNTLTFLRNSRFFHLGINVFLLTPFLSFGFQVKRLKTKSPVTNTTSTWRITATTATRILSGVVRTVADVNNSNVETPSQRISWADMAQEDDEFGDEEDSNNGGNFAVGDSNAFSHVAKVVAEKPTLPREQREYIRFMNVRRKKDFICFERVNGKLVNILEGLELHTGIFSAAEQKRIVNYVASLQEMGRKGELKEQTFSAPQKWMRGKGRQTIQFGCCYNYAVDRDGNPPGILGNGMVDPIPALFKVIIRRLIKWHVLPPTCVPDSCIVNIYEEGDCIPPHIDNHDFVRPFCTVSFLSECNIVFGSNLKIVGPGEFDGSIAIPLPMGSVLVLNGNGADVAKHCVPAVPTKRISITFRRMDVSKRPFGYVPEPDLQGIQPLAYEVEQEKKSSGHRPSRHTKRHKDRRGGGRNDAMGSATRNDRFLEPHDSNLNSPRSATRNDRFSEPRDSNLSSPRSATRNDRFSEPRDSNLSSSRSANRWSRKPGS

SEQ ID NO: 222708 - protein, 172 aa, Glycine max
  Coding DNA Sequence Number=SeqID_105930
  Homolog annotation: Hit_ID=Q10PS1; Match level="QueryCoverage=30%, HitCoverage=16%, E-value=9e-08, Identity=47%"; Hit description=UDP-3- 0-acyl N-acetylglucosamine deacetylase family protein, expressed
MYKEFFKNTFLSSFDAFMQTGRLQQTLADCVERQGKALHSGKVSTVRLCPERASRGRRVPNSNVEEVGLTVATDLDGKSVEKMAPHVNEPVYAWRNDSFVAAFPSEVVRITYGINFSQGLCFMDLSITPVNLLPIMRTMSRFVSKVKIIAFSILVVQIKGTWLLTGYIWTFG

SEQ ID NO: 222709 - protein, 98 aa, Glycine max
  Coding DNA Sequence Number=SeqID_105931
  Gene Ontology: Cellular component=integral to membrane
  Homolog annotation: Hit_ID=Q8S403; Match level="QueryCoverage=97%, HitCoverage=12%, E-value=3e-19, Identity=52%"; Hit description =Putative phosphate transporter 1
MDEVISTLERNGLSFANSAMRVKTKKKGKPHMALKIDIPATTPTGVTSMLWEDLVNSPIKPEYGGEFINKRKILCAEKMIKSAFVELYKGLGLLKTYR

SEQ ID NO: 222710 - protein, 280 aa, Glycine max
  Coding DNA Sequence Number=SeqID_105932
  Gene Ontology: Mol. function=signal transducer activity; Cellular component=membrane; Biological process=response to light stimulus
  Homolog annotation: Hit_ID=Q1SGA7; Match level="QueryCoverage=91%, HitCoverage=41%, E-value=4e-76, Identity=59%"; Hit description =BTB/POZ; NPH3
  Pfam annotation: Domain name=NPH3; Domain location=18-261; Score =227.5; E_value=3e-65; Accession=PF03000.5; Description=NPH3 family
  Subcellular localization annotation: CTP_CleavageSite=50; ConfidenceScore=5.18e-01
MKDSSPSRTSRFLQIGGLKMPQSLGLITLLESSLPSSDTATPGDEASNCSMSNSSSSGGGSWKSGLHMVVTGTKDDNTSSLQAKEQRMIIESLVSIIPPQKDSVSCSFLLRLLRMAIMLKVAPALVTELEKRVGMQFEQATLADLLIPSYNKGETMYDVDLVQRLLEHFIVQEQTESSSPSRNSFSDKQHMGMGMGMGCILNAKARVARLVDSYLTEVSRDRNLSLTKFQVLAEALPESARTCDDGLYRAIDSYLKDMCAYVTDIRVALPDSNKIVCGRS

SEQ ID NO: 222711 - protein, 97 aa, Glycine max
  Coding DNA Sequence Number=SeqID_105933
MTRWMTLKNLVLEDVGTRCSDRMEMRNKGHGGGVERGSTEKAFLKQPKVFLKKTCVFSSQVIYCMFSGWRFRSKVYVHNLVTENGLVSLSSVGHFHF

SEQ ID NO: 222712 - protein, 142 aa, Glycine max
  Coding DNA Sequence Number=SeqID_105934
MVIPKFKVSDFDKYKGTTCPKNHLKMYRRKMGACANDEELLIHSFQESLTGVAVTWQYQYNCDMVPDRMKLQNMCKKGHESFKEYTQRWRDLAAQVAPPMMEREMVIVMVDTLPVFYYEKWWVTHLQVLQIWSSPAKGSKWV

SEQ ID NO: 222713 - protein, 44 aa, Glycine max
  Coding DNA Sequence Number=SeqID_105935
EPVPTQVQHRVSGIQYPESYQQPFGPRYGRGYGVPTPPPATSAT

SEQ ID NO: 222714 - protein, 200 aa, Glycine max
  Coding DNA Sequence Number=SeqID_105936
  Gene Ontology: Mol. function=receptor activity; Cellular component =integral to membrane; Biological process=red or far red light signaling pathway
  Homolog annotation: Hit_ID=Q8S403; Match level="QueryCoverage=89%, HitCoverage=23%, E-value=1e-72, Identity=71%"; Hit description =Putative phosphate transporter 1
MVTMILCSVFALLSLHLFMYGCNLYMWKSTRINHNFIFEFSPSTTLKHRDAFLMCTTLMTTVFGAMVVHLLLRAGGFSPGQVDAIPWNHFFGLLICPFDIFYRPTRFCFIRVIRNIVCSPFYKVLLVDFFMADQLTSQIPLLRHLETTGCHIFARVFKSHHPEACHSGRLYIEITYLISFLPYWWRALQILYQLLLELVA

SEQ ID NO: 222715 - protein, 86 aa, Glycine max
  Coding DNA Sequence Number=SeqID_105937
  Gene Ontology: Cellular component=integral to membrane; Biological process=red or far red light signaling pathway
  Homolog annotation: Hit_ID=Q8S403; Match level="QueryCoverage=81%, HitCoverage=9%, E-value=4e-24, Identity=77%"; Hit description =Putative phosphate transporter 1
MPFDQVSNQKASANYMKEVKRSHFISSDKVVRLMDEVESIFTKHFANNDRKRAMKFLRPQQPKVSHTVTFLVGNAPLSPLTLNSCP

SEQ ID NO: 222716 - protein, 750 aa, Glycine max
  Coding DNA Sequence Number=SeqID_105938
  Homolog annotation: Hit_ID=Q6KA75; Match level="QueryCoverage=80%, HitCoverage=63%, E-value=1e-164, Identity=48%"; Hit description =Peroxisomal membrane protein-like
MDIKGIQWQNANAMVVNQGNDNFLVCSFHMPKGTTIATSLALRFGKAALEAIAAALSDRLGNPPWPLAAAAATMPPPSVPVPSPPLAASLLLLFLSRKKTPTLAAPIPIPTTKPSLAAAAPAPPSTAPPPISPPSPPPPPQSPNLPPPGKVKRIASDIKKTKEMLDMNNPDASKVILSDIQDKISGIEKAIVHVVSNKESENGAVKVAAKDKNLAKELKLNTDELEARLFPHQKLLRDRTVVKDKDKDSVVEAQKVLSPVDDNLVAVEFLALIGKEKDKVNAGEDVKESGGGNGRWNDKRNNDIDALLGADEKLEDFDDDQENKENKEGVVVEEEMDEAFNFRLNGIGSNVATGGWFVNEGEAVLLAHHDADNSSTFQEKAVYMPPSEVSPNTWRDCWVIRAPGSDGCSGRFVVAASAGNTMDSGFCSWDFYTKEVRAMQVDAGTASSRIALRPLPNNIRRNSTSSTVTVEATQWWYRPCGPLIVSTTSSQRAVKVFDVRDGEQIMKWDVQKPVLAMDYCSPLQWRNRGKVVVAEAESISLWDVNSLTAQALLSVPTGGKKVSALHVSNTDAELGGGVRKRVSSSEAEGNDGVFCTSDSINVLDFRQPSGVGLKISKHGVNVQSVFSRGDSVFLGCSSTSSMGKKQTSLLQQFSLRRQGLFTTYALPESNSHSHHAAISQVWGNSDFVMGVCGLGLFVFDAVKDDALRVLNMDYSSDQSFREVIGPDDMYCPSFDYLGSRALLISRDRPA

SEQ ID NO: 222717 - protein, 209 aa, Glycine max
  Coding DNA Sequence Number=SeqID_105939
  Homolog annotation: Hit_ID=UPI0000162C4B; Match level="QueryCoverage =58%, HitCoverage=63%, E-value=4e-17, Identity=40%"; Hit description =RIC3 (ROP-INTERACTIVE CRIB MOTIF-CONTAINING PROTEIN 3)
  Pfam annotation: Domain name=PBD; Domain location=27-78; Score=34.1; E_value=5e-07; Accession=PF00786.18; Description=P21-Rho-binding domain
MSTKVKGILKGLRYISQIFEEKEEEFQIGLPTDVKHVAHIGSDDPSANAPSWMTDFKGGKEPPSGNPTQTVEEREKKASSNSKRSKIRNHLIPKSRHNSIDIDPDAPKQKATRRHNRSSDPSADSSNHESSSGSRQRHHRGSNHDPGSLSSQEMPPTGPKTNRRKSKASEDGSTKKPSSRRSSKGDSLTDISISDFGSDSRPESELTTH

SEQ ID NO: 222718 - protein, 124 aa, Glycine max
  Coding DNA Sequence Number=SeqID_105940
MKLMSPSRRVIRESIASKRSPTKARRSHSSIRMSCNKEEEVSHYDGGEGVRSSGMRGCRSCLLTHWPSISFWYPKESSEENRVNDLGDEKEGGFGGSPNVPWWHWPATVVVEDEHFLFFEGSSI

SEQ ID NO: 222719 - protein, 201 aa, Glycine max
  Coding DNA Sequence Number=SeqID_105941
  Gene Ontology: Mol. function=oxidoreductase activity, acting on NADH or NADPH, NAD or NADP as acceptor; Biological process=electron transport
  Homolog annotation: Hit_ID=Q8ZE60; Match level="QueryCoverage=99%, HitCoverage=100%, E-value=2e-94, Identity=89%"; Hit description=FMN -dependent NADH-azoreductase
  Pfam annotation: Domain name=FMN_red; Domain location=2-200; Score= -12.5; E_value=0.00025; Accession=PF03358.6; Description=NADPH -dependent FMN reductase
  Pfam annotation: Domain name=Flavodoxin_2; Domain location=2-200; Score=202.4; E_value=1e-57; Accession=PF02525.7; Description =Flavodoxin-like fold
  Pfam module annotation: Pfam domain module=FMN_red::Flavodoxin_2; Domain location=2-200::2-200
MSNVLVLKSSILATYSQSNQLADFFVEQWSNAHSGDTITVRDLAAQPIPVLDGELVGALRPSDAPLTPRQQEALALSDELIAELQANDVIVIAAPMYNFNIPTQLKNYFDLVARAGVTFRYTENGPEGLVKNKRAVILTSRGGIHKGTPTDLVEPYLRLFLGFIGITDVEFVFAEGIAYGPEVATKAQEDAKATLSQVVSA

SEQ ID NO: 222720 - protein, 98 aa, Glycine max
  Coding DNA Sequence Number=SeqID_105942
  Homolog annotation: Hit_ID=Q6K1Q5; Match level="QueryCoverage=88%, HitCoverage=43%, E-value=6e-38, Identity=81%"; Hit description =Glycolipid transfer protein-like
  Pfam annotation: Domain name=GLTP; Domain location=1-95; Score=-30.1; E_value=9.1e-06; Accession=PF08718.1; Description=Glycolipid transfer protein (GLTP)
MDFLVALFRNLIEHEDWPMSQACTDSYNKTLKKWHGWLASSSFTVVMKLAPDRKKFMDVIGGTGNISADIEKFCTTFSPLLEENHKFLHIPLIILAVP

SEQ ID NO: 222721 - protein, 184 aa, Glycine max
  Coding DNA Sequence Number=SeqID_105943
MDGEGMAEIKSLGEQHQMEWNDTMSLGTSAWWFNCLKNMEHEVKNEDGACHIFDELNEFPTGLNNANEWCLEHSSEDYFQDYTVPCIAAKRFYKSFQVKIMEPKILKRKKQTRTRRPHTDIVDRRTGKGYTICIKMVQVLSSEQTQLKQKYRGQGFKYRLRWHCGFVTLIDIMTNHGQMWLMQF

SEQ ID NO: 222722 - protein, 106 aa, Glycine max
  Coding DNA Sequence Number=SeqID_105944
  Homolog annotation: Hit_ID=Q6K1Q5; Match level="QueryCoverage=58%, HitCoverage=31%, E-value=2e-21, Identity=77%"; Hit description =Glycolipid transfer protein-like
  Pfam annotation: Domain name=GLTP; Domain location=1-98; Score=-37.5; E_value=3.2e-05; Accession=PF08718.1; Description=Glycolipid transfer protein (GLTP)
  Subcellular localization annotation: CTP_CleavageSite=44; ConfidenceScore=5.06e-01
MADKFGAAMALVKSDIGGNISRLETMYSSNPTRFNYLYSLVQVEVETKTAKSSSSCTNGLLWLTRFNRTNARTSFEVKIGGHSYRKLHGLANLVLLHIVIEKWREM

SEQ ID NO: 222723 - protein, 99 aa, Glycine max
  Coding DNA Sequence Number=SeqID_105945
MYAMMLATDDIESPTSTLCFPERTTSSEGAIETVNGGGDSESWRYFTKHNNEEELVETDEKRIMYDTMSCLQDDDDIMVAVEALRGADEFQENWKLKGD

SEQ ID NO: 222724 - protein, 110 aa, Glycine max
  Coding DNA Sequence Number=SeqID_105946
  Pfam annotation: Domain name=DUF789; Domain location=1-110; Score= -133.5; E_value=4e-06; Accession=PF05623.3; Description=Protein of unknown function (DUF789)
NRREDSDGIEFESDSWSEDSGSDNLSRSLSNNSSKAWEDAVSEDSSCDQEGSWLRDNKLGYLYLQYTEMASPYSRVPLAEKIDKLAQSHPALLTLKSVDLSPASWMAVSW

SEQ ID NO: 222725 - protein, 220 aa, Glycine max
  Coding DNA Sequence Number=SeqID_105947
  Gene Ontology: Mol. function=RNA-directed DNA polymerase activity; Cellular component=chromatin; Biological process=RNA-dependent DNA replication
MVKKANDKWRMCTDYIDLNGACPKDAYPLPSIDRLVDGKSGFQVLSFLDTYSRYNQIRMHPPDKRQQVPRLHDHTPGIEANPDKCTAILKMHNPTNIQEVQKLNDRLPSLSRFLPKLAKKAKPFYKLLKKTKSFSWDKTREQAFLAFKKTIATPPILSRPRLGAPLLLYLLVADKDVSLALVQKEGKHQLPIFFTSHMLRDIEKRYQMIKKVALALVTST

SEQ ID NO: 222726 - protein, 80 aa, Glycine max
  Coding DNA Sequence Number=SeqID_105948
  Gene Ontology: Mol. function=ribonuclease H activity; Cellular component=mitochondrion; Biological process=DNA integration
MADFLAEFSGNNTTTPGWWILYVDSASNVKGSGIGIILKSPDIITLEQALKLNFRASNNQAEYEALIADLKLAREVRAKM

SEQ ID NO: 222727 - protein, 154 aa, Glycine max
  Coding DNA Sequence Number=SeqID_105949
QKHDKHKANTKADLHKSNKRHKPDKCQPLFKGLKYERYTPLMPNHTMILEEACNLEVPIRLPQMKPPRSRSDAIKYCRDFKGINSVNQYDHVVVSIIIANFMVSRVLIDQDSSVDILYWKTFQRLKVSPDTVHPHADPLLDFPARESRLEAMCT

SEQ ID NO: 222728 - protein, 497 aa, Glycine max
  Coding DNA Sequence Number=SeqID_105950
  Pfam annotation: Domain name=PH; Domain location=64-189; Score=14.6; E_value=0.094; Accession=PF00169.19; Description=PH domain
MVLFFALILLGFLLGVVAVVAAEALGFLWVIKRLQSKISKDQAKIASKTQLGGAQSDHPQQQLLKKEGVVWVLEPDKVSKFWVEKQSKEQKRKKEVLEVTPVRKYGKINGQSLVLTDTDGFHTTIQLKGCLVEAVSATSLPSKKWAKKFPIKVEAKTSVIYHASKTFYIYLETACDKEAWCKALRLASSDKKEKHEWFAQLQDGFHSYLSSLNTEHHSLAKPSVGSSAEAIERASKPDGSSSKVRQFLKKLTKKSSRVGVENKSAWTSLSGREERKHTEKLHACQDAVLTTGLMKSAAAANHLKSPLLDNAAQSFSTLSHSGSQSQFSVSSDADADEKPGIDEGTLCWNLLVSRLFFDVKGNVQMKKSIHERIQRTLANMRTPSYVGEVICTDINMGNVPPHIIRMRVLPMEMSEVCALEVDIEYAGGALLEIETRLEVREPEHERGTEDSNPESSNVGAVPSDLLEGFECLGEQLNLAEGMNDLQEPKGDGEWNIG

SEQ ID NO: 222729 - protein, 527 aa, Glycine max
  Coding DNA Sequence Number=SeqID_105951
MSGWTWLSGVPNFTHQLGEVPLTGGGTWKTKDFVAQAKRPRSYSRANVEGGHMSSGATWDATRLSCVEGVCLMSGVVVLTSRGLMWLVKPLSLDKSCPSCFSQVVCVGRVFGVSSKGTTLTPASSFSIPCTFLAFDFPFFPCQLLKVLPSTAMSFFLSDSAIGLGGSDSRARLSNLSWIERSSQYAIPCLRILIEVPLIASPPPQRGVSAGSPSSTPIVAGYEWACVNDDFPFFRVAPGRPPFFFMYRCLFEDFEIQCPFSTSDLKLFEFNSNIFRHFKDHFFKVLATNVMADGMPLMLNRDGEPCFPFYCDPLVVLDGTMGDFTWRPLAKQVGLIGATLPPSVAAPFIGENGQPAREVGPAAVAVEDDGAGPSGRKKPKAFMSLCALRQAAGLRPTVGCLTTVHDMSPTPLIIETPATAIAASVTPSTSAHSPLLTLLFKSVGVVITSAPTVPPASSSAPMVFLVVVLVVMVLPSSSSCPSISLDHLYTSSDIDTLWGATYKLEQKTPTMGVAILEENELRHQEAM

SEQ ID NO: 222730 - protein, 579 aa, Glycine max
  Coding DNA Sequence Number=SeqID_105952
  Gene Ontology: Mol. function=nucleic acid binding; Cellular component= intracellular; Biological process=metabolic process
  Homolog annotation: Hit_ID=Q6K8H8; Match level="QueryCoverage=97%, HitCoverage=91%, E-value=1e-112, Identity=38%"; Hit description =Selenium binding protein-like protein
  Pfam annotation: Domain name=PPR; Domain location=182-216; Score =30.2; E_value=7.5e-06; Accession=PF01535.11; Description=PPR repeat
  Pfam annotation: Domain name=PPR; Domain location=217-251; Score=6.7; E_value=1.2; Accession=PF01535.11; Description=PPR repeat
  Pfam annotation: Domain name=PPR; Domain location=283-317; Score =40.8; E_value=4.7e-09; Accession=PF01535.11; Description=PPR repeat
  Pfam annotation: Domain name=PPR; Domain location=384-418; Score =27.2; E_value=5.7e-05; Accession=PF01535.11; Description=PPR repeat
  Pfam annotation: Domain name=PPR; Domain location=420-454; Score =13.8; E_value=0.17; Accession=PF01535.11; Description=PPR repeat
  Pfam annotation: Domain name=PPR; Domain location=522-556; Score =12.8; E_value=0.23; Accession=PF01535.11; Description=PPR repeat
  Pfam annotation: Domain name=PPR; Domain location=77-111; Score=40.9; E_value=4.5e-09; Accession=PF01535.11; Description=PPR repeat
  Pfam module annotation: Pfam domain module=PPR::PPR::PPR::PPR::PPR::PP R::PPR; Domain location=182-216::217-251::283-317::384-418::420 -454::522-556::77-111
MAHSGVHGNNLTYPLLLKACANLPSIQHGTMLHGHVLKLGFQADTFVQTALVDMYSKCSHVASARQVFDEMPQRSVVSWNAMVSAYSRRSSMDQALSLLKEMWVLGFEPTASTFVSILSGYSNLDSFEFHLLGKSIHCCLIKLGIVYLEVSLANSLMGMYVQFCLMDEARKVFDLMDEKSIISWTTMIGGYVKIGHAVEAYGLFYQMQHQSVGIDFVVFLNLISGCIQVRDLLLASSVHSLVLKCGCNEKDPVENLLITMYAKCGNLTSARRIFDLIIEKSMLSWTSMIAGYVHLGHPGEALDLFRRMIRTDIRPNGATLATVVSACADLGSLSIGQEIEEYIFLNGLESDQQVQTSLIHMYSKCGSIVKAREVFERVTDKDLTVWTSMINSYAIHGMGNEAISLFHKMTTAEGIMPDAIVYTSVFLACSHSGLVEEGLKYFKSMQKDFGITPTVEHCTCLIDLLGRVGQLDLALNAIQGMPPDVQAQVWGPLLSACRIHGNVELGELATVRLLDSSPGSSGSYVLMANLYTSLGKWKEAHMMRNSMDGKGLVKESGWSQVEVTDTYHTFAVGNQSQVA

SEQ ID NO: 222731 - protein, 327 aa, Glycine max
  Coding DNA Sequence Number=SeqID_105953
  Gene Ontology: Mol. function=hydrolase activity, hydrolyzing O -glycosyl compounds; Cellular component=membrane; Biological process =carbohydrate metabolic process
  Homolog annotation: Hit_ID=Q39811; Match level="QueryCoverage=99%, HitCoverage=77%, E-value=1e-173, Identity=89%"; Hit description =Alpha galactosidase
  Pfam annotation: Domain name=Melibiase; Domain location=1-271; Score=- 117.4; E_value=3.6e-09; Accession=PF02065.9; Description=Melibiase
MVSTGLAALGYQYINIDDCWGELNRDSKGNLVPKASTFPSGMKALADYIHKKGLKLGIYSDAGNQTCSKTMPGSLGHEKQDAKTFASWGIDYLKYDNCENNNISPKERYPPMSEALANTGRPIFFSLCEWGSEDPATWAKSVGNSWRTTGDIEDKWESMISRADLNDKWASCAGPGGWNDPDMLEVGNGGMTTEEYRAHFSIWALAKAPLLIGCDIRALDATTKELLSNNEVIARMLLKLITLWYCRQAWSSRKEGPLSNNKVAVILWNRSSSKAKVTASWSDIGLKPGTSVKARDLWAHSTQSSVSGEISSELDSHACKMYVLSPN

SEQ ID NO: 222732 - protein, 227 aa, Glycine max
  Coding DNA Sequence Number=SeqID_105954
AVIRETLVLPNCESICIPWMLAEKDDWVPRSVAPFIWVHPELGNETSTSVDTNNQACGGLKASASTLSDDGPELKQHKPPKCPKSSQEPARKSDSVALTPISSSSVTLRSSKSSEELTRPLLENDKPPETRDLQELRTTSLQNDNTNEASEASEEKMGDISVSESPPRNVVLDKQHRSIERDDSRPKKIGRREKILDLKKRVSEKLEEQKRNFEEKSRHIVEKMRGP

SEQ ID NO: 222733 - protein, 588 aa, Glycine max
  Coding DNA Sequence Number=SeqID_105955
  Gene Ontology: Mol. function=protein-tyrosine kinase activity; Cellular component=integral to membrane; Biological process=protein amino acid phosphorylation
  Homolog annotation: Hit_ID=Q1SNC9; Match level="QueryCoverage=99%, HitCoverage=96%, E-value=0.0, Identity=71%"; Hit description=Protein kinase
  Pfam annotation: Domain name=LRRNT_2; Domain location=11-53; Score =24.6; E_value=0.00034; Accession=PF08263.3; Description=Leucine rich repeat N-terminal domain
  Pfam annotation: Domain name=LRR_1; Domain location=104-126; Score =5.3; E_value=30; Accession=PF00560.23; Description=Leucine Rich Repeat
  Pfam annotation: Domain name=LRR_1; Domain location=128-149; Score =14.8; E_value=0.32; Accession=PF00560.23; Description=Leucine Rich Repeat
  Pfam annotation: Domain name=LRR_1; Domain location=150-171; Score =11.4; E_value=2.1; Accession=PF00560.23; Description=Leucine Rich Repeat
  Pfam annotation: Domain name=LRR_1; Domain location=81-102; Score =12.1; E_value=1.5; Accession=PF00560.23; Description=Leucine Rich Repeat
  Pfam annotation: Domain name=Pkinase; Domain location=303-577; Score =23.4; E_value=5.9e-10; Accession=PF00069.15; Description=Protein kinase domain
  Pfam annotation: Domain name=Pkinase_Tyr; Domain location=302-577; Score=29.7; E_value=2.7e-14; Accession=PF07714.7; Description =Protein tyrosine kinase
  Pfam module annotation: Pfam domain module=LRRNT_2::LRR_1::LRR_1::LRR_ 1::LRR_1::Pkinase::Pkinase_Tyr; Domain location=11-53::104-126::128 -149::150-171::81-102::303-577::302-577
MVLCIELEEYYPEERDALMLIRDSLNSSVNLHGNWTGPPCIDNRSRWIGITCSNWHVVQIVLEGVDLSGYLPPTFLLNITFLSQLDFRNNALSGPLPSLKNLMFLEQVLLSFNHFSGSIPVEYVEIPSLQVLELQDNYLEGQIPPFDQSSLTSFNVSYNHLSGPIPETSVLQRFPESSYGNNSDLCGEPLDKLCPIEPPAPSPSPFPALKPNKRRFQAWIVALIGGAAALILLSLIIIIAFMFRKRRTNGKESIRNDSTEYVFRAWAKKMVSYAGNSDVSGRLGKLEFSNKKLPVFDLDDLLRASAEVLGRGNLGITYKTTLETGTVVAVKRLNHMNELNKKEFLQQMQLLGQMKHENLVEIISFYYSEDQKLIIYEFISDGTLCELLHEGRGIGRIPLDWTTRLSIIKDIAKGLVFLHDSLPQHKVPHANLKSSNVLIHQDSKGYHSKLTDYGFLPLLSAKQNAEKLAIRRSPEFVKGKKLTHKADVYCFGIIMLEIITGRIPGHILGEIEETTNDLSDWVRTVVNNDWSTDILDLEILAEKEGHDAMLKLTELALECTDMTPEKRPKMSVVLVRIEEIEQMRKEND

SEQ ID NO: 222734 - protein, 1009 aa, Glycine max
  Coding DNA Sequence Number=SeqID_105956
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=98%, HitCoverage=99%, E-value=0.0, Identity=63%"; Hit description=Protein kinase
  Pfam annotation: Domain name=LRRNT_2; Domain location=33-72; Score =30.4; E_value=6.3e-06; Accession=PF08263.3; Description=Leucine rich repeat N-terminal domain
  Pfam annotation: Domain name=LRR_1; Domain location=123-145; Score =15.0; E_value=0.28; Accession=PF00560.23; Description=Leucine Rich Repeat
  Pfam annotation: Domain name=LRR_1; Domain location=148-170; Score =12.1; E_value=1.5; Accession=PF00560.23; Description=Leucine Rich Repeat
  Pfam annotation: Domain name=LRR_1; Domain location=172-194; Score =5.8; E_value=24; Accession=PF00560.23; Description=Leucine Rich Repeat
  Pfam annotation: Domain name=LRR_1; Domain location=196-220; Score =10.1; E_value=3.7; Accession=PF00560.23; Description=Leucine Rich Repeat
  Pfam annotation: Domain name=LRR_1; Domain location=222-244; Score =10.4; E_value=3.2; Accession=PF00560.23; Description=Leucine Rich Repeat
  Pfam annotation: Domain name=LRR_1; Domain location=246-268; Score =11.8; E_value=1.8; Accession=PF00560.23; Description=Leucine Rich Repeat
  Pfam annotation: Domain name=LRR_1; Domain location=270-292; Score =13.1; E_value=1; Accession=PF00560.23; Description=Leucine Rich Repeat
  Pfam annotation: Domain name=LRR_1; Domain location=293-315; Score =17.2; E_value=0.061; Accession=PF00560.23; Description=Leucine Rich Repeat
  Pfam annotation: Domain name=LRR_1; Domain location=317-339; Score =15.1; E_value=0.25; Accession=PF00560.23; Description=Leucine Rich Repeat
  Pfam annotation: Domain name=LRR_1; Domain location=341-363; Score =4.8; E_value=36; Accession=PF00560.23; Description=Leucine Rich Repeat
  Pfam annotation: Domain name=LRR_1; Domain location=365-384; Score =8.1; E_value=8.7; Accession=PF00560.23; Description=Leucine Rich Repeat
  Pfam annotation: Domain name=LRR_1; Domain location=389-411; Score =11.4; E_value=2.1; Accession=PF00560.23; Description=Leucine Rich Repeat
  Pfam annotation: Domain name=LRR_1; Domain location=413-436; Score =6.7; E_value=16; Accession=PF00560.23; Description=Leucine Rich Repeat
  Pfam annotation: Domain name=LRR_1; Domain location=437-456; Score =7.9; E_value=9.4; Accession=PF00560.23; Description=Leucine Rich Repeat
  Pfam annotation: Domain name=LRR_1; Domain location=459-481; Score =7.0; E_value=14; Accession=PF00560.23; Description=Leucine Rich Repeat
  Pfam annotation: Domain name=LRR_1; Domain location=483-505; Score =10.1; E_value=3.7; Accession=PF00560.23; Description=Leucine Rich Repeat
  Pfam annotation: Domain name=LRR_1; Domain location=507-529; Score =11.2; E_value=2.3; Accession=PF00560.23; Description=Leucine Rich Repeat
  Pfam annotation: Domain name=LRR_1; Domain location=531-553; Score =11.2; E_value=2.3; Accession=PF00560.23; Description=Leucine Rich Repeat
  Pfam annotation: Domain name=LRR_1; Domain location=555-574; Score =5.0; E_value=33; Accession=PF00560.23; Description=Leucine Rich Repeat
  Pfam annotation: Domain name=LRR_1; Domain location=576-598; Score =18.3; E_value=0.028; Accession=PF00560.23; Description=Leucine Rich Repeat
  Pfam annotation: Domain name=LRR_1; Domain location=75-97; Score=8.7; E_value=6.7; Accession=PF00560.23; Description=Leucine Rich Repeat
  Pfam annotation: Domain name=LRR_1; Domain location=99-121; Score =7.4; E_value=12; Accession=PF00560.23; Description=Leucine Rich Repeat
  Pfam annotation: Domain name=Pkinase; Domain location=692-971; Score =165.1; E_value=1.8e-46; Accession=PF00069.15; Description=Protein kinase domain
  Pfam annotation: Domain name=Pkinase_Tyr; Domain location=692-968; Score=70.5; E_value=5.4e-18; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=33-72::123-145::148-170::172-194::196-220::222-244::246 -268::270-292::293-315::317-339::341-363::365-384::389-411::413 -436::437-456::459-481::...
  Pfam module annotation: Domain location=483-505::507-529::531 -553::555-574::576-598::75-97::99-121::692-971::692-968
MTIPLIQLCLEFPCHIFLVLFFLLGHTSSQSLYDQEHAVLLNIKQYLQDPPFLSNWTSTSSSHCSWPEIICTTNSVTSLTLSQSNINRTIPSFICGLTNLTHLDFSFNFIPGGFPTPLYNCSKLEYLDLSGNNFDGKVPHDIDQLSANLQYLNLGSTNFHGDVPSSIAKLKQLRQIKLQYCLLNGSVAGEIDDLSNLEYLDLSSNFMFPEWKLPWNLTKFNKLKVFNLYGTNLVGEIPENIGDMVALDMLDMSNNSLAGGIPSGLFLLKNLTSLRLYANSLSGEIPSVVEALNLANLDLARNNLTGKIPDIFGKLQQLSWLSLSLNGLSGVIPESFGNLPALKDFRVFFNNLSGTLPPDFGRYSKLETFMIASNSFTGKLPDNLCYHGMLLSLSVYDNNLSGELPESLGNCSGLLDLKVHNNEFSGNIPSGLWTSFNLTNFMVSHNKFTGVLPERLSWNISRFEISYNQFSGGIPSGVSSWTNLVVFDASKNNFNGSIPRQLTALPKLTTLLLDQNQLTGELPSDIISWKSLVALNLSQNQLYGQIPHAIGQLPALSQLDLSENEFSGQVPSLPPRLTNLNLSSNHLTGRIPSEFENSVFASSFLGNSGLCADTPALNLTLCNSGLQRKNKGSSWSVGLVISLVIVALLLILLLSLLFIRFNRKRKHGLVNSWKLISFERLNFTESSIVSSMTEQNIIGSGGYGIVYRIDVGSGYVAVKKIWNNRKLEKKLENSFRAEVRILSNIRHTNIVRLMCCISNEDSMLLVYEYLENHSLDKWLHKKVKSGSVSKVVLDWPKRLKIAIGIAQGLSYMHHDCSPPVVHRDIKTSNILLDTQFNAKVADFGLAKMLIKPGELNTMSAVIGSFGYIAPEYVQTTRVSEKIDVFSFGVVLLELTTGKEANYGDQHSSLSEWAWRHVLIGGNVEELLDKDVMEAIYSDEMCTVFKLGVLCTATLPASRPSMREALQILQSLGEPFAYGDQKNFGHYYDAIPLLKSSEKETRLDVVDHSE

SEQ ID NO: 222735 - protein, 243 aa, Glycine max
  Coding DNA Sequence Number=SeqID_105957
MAGREVREYTNLSDPKDKKWGKGKDKIDDEDITFQRMVAKMQEVAGERGGYLHGRGALDSDDLLYLKEQMEAEEDAERLLRRTEKRAFAAFKISFCAAYNDPPPYLHIVTSPLAPGAASLADSSPTSVPLAFRVEPKPKSGIRQQDLLKKVVEIKPKRPRCDSNQSTPASNAPVTNRKPYHDSSKEKEQSLPGTKKVEEQSLSGSKKAKEHASLGSQEAEAKPKVESSGGGLLGLAYDSSDDE

SEQ ID NO: 222736 - protein, 451 aa, Glycine max
  Coding DNA Sequence Number=SeqID_105958
  Gene Ontology: Mol. function=monooxygenase activity; Cellular component=membrane; Biological process=electron transport
  Homolog annotation: Hit_ID=Q1SND2; Match level="QueryCoverage=99%, HitCoverage=92%, E-value=0.0, Identity=87%"; Hit description=E-class P450, group IV
  Pfam annotation: Domain name=p450; Domain location=41-449; Score =56.9; E_value=6.8e-14; Accession=PF00067.12; Description=Cytochrome P450
MRENISESWLVMITVILATAIFAKLFQFKLRKEDKSKCRLPPGRRGWPLIGDSINWYNAVASSHPPQFVEEMVKRYGKIFSCSLFGKWAVVSADPSFNRFVMQNEGKLFKSSYPKSFRDLVGKNGVITVQGEQQRKLHGIASNMMRLEKLKFHFLNDVQKVMLQTLSNFNNNQVILLQDVCRKVAIHLMVNQLLGVSSESQVNEMAQLFSGFVDGCLSIPINIPGYAYHTAMKAREKIISKINRTIEVHRQNGASIEGNGVLGRLLEEESLPDDAVADFIINLLFAGNETTTKTMLFAVYFLTQCPRAMKQLLDEHDSLRSNSGDKFLTWQDYKAMSFTQCVIDETLRLGGIAIWLMREAKEDVQYQDFVIPKGCFVVPFLSAVHLDENVYSGALNFNPWRWMEPENEEKRNWRTSPFYAPFGGGARFCPGTELARLQIAFFLHYFVTTYR

SEQ ID NO: 222737 - protein, 63 aa, Glycine max
  Coding DNA Sequence Number=SeqID_105959
MDRHRPCHNGVKHYESFSMKEEEFVDNMFGRLQVILNSLEALGYTFTKAQINRFYTTFPRSYF

SEQ ID NO: 222738 - protein, 219 aa, Glycine max
  Coding DNA Sequence Number=SeqID_105960
  Homolog annotation: Hit_ID=Q1T0L0; Match level="QueryCoverage=48%, HitCoverage=14%, E-value=6e-52, Identity=90%"; Hit description=DNA repair exonuclease
  Pfam annotation: Domain name=Mre11_DNA_bind; Domain location=34-189; Score=39.3; E_value=1.8e-12; Accession=PF04152.5; Description=Mre11 DNA-binding presumed domain
MVCRVKINPKNAINEHFLPCFLDFIVWGHEHECLVDPQEVPGMGFHISQPGSSVATSLIDGESKPKHGNQYLPTKIPLMSVRPFKYTEVILKDKSDIDPNDQSSILEHLDKVMMTKVKTKSSKVKQRMSSKCSRWNQEQFKTQEEKLKNTSRFKRKDEFKNQDSRSRFKIQESREDLIKISMKRIFQKLSSTWIFHKTCLPKSFYSLVIDYQIAVIDYQ

SEQ ID NO: 222739 - protein, 87 aa, Glycine max
  Coding DNA Sequence Number=SeqID_105961
  Gene Ontology: Mol. function=transition metal ion binding
  Pfam annotation: Domain name=Transposase_21; Domain location=1-87; Score=-130.3; E_value=0.0017; Accession=PF02992.5; Description =Transposase family tnp2
MVFCTIDDFPTDGNFTGYSVKGHHACPICERNTSFTQLKHGKKKFYTRHRRLLKPYHPYRRLKKTFTGSQETESAPEPLAVNEVHDQ

SEQ ID NO: 222740 - protein, 85 aa, Glycine max
  Coding DNA Sequence Number=SeqID_105962
MEAVRGHKRTEHGRWHLILWLREIGNHFYKRFEVLRVMEKGSYIADNNGGTTKVLLAACTNEDQTEQVTTVIRTMHKDMKTVLPF

SEQ ID NO: 222741 - protein, 689 aa, Glycine max
  Coding DNA Sequence Number=SeqID_105963
  Gene Ontology: Mol. function=binding; Cellular component =intracellular; Biological process=metabolic process
  Homolog annotation: Hit_ID=Q2QNV4; Match level="QueryCoverage=97%, HitCoverage=62%, E-value=0.0, Identity=42%"; Hit description =Pentatricopeptide, putative, expressed
  Pfam annotation: Domain name=PPR; Domain location=113-147; Score=1.8; E_value=4.6; Accession=PF01535.11; Description=PPR repeat
  Pfam annotation: Domain name=PPR; Domain location=151-185; Score =10.5; E_value=0.42; Accession=PF01535.11; Description=PPR repeat
  Pfam annotation: Domain name=PPR; Domain location=250-284; Score =31.2; E_value=3.7e-06; Accession=PF01535.11; Description=PPR repeat
  Pfam annotation: Domain name=PPR; Domain location=285-319; Score=2.1; E_value=4.2; Accession=PF01535.11; Description=PPR repeat
  Pfam annotation: Domain name=PPR; Domain location=351-385; Score =28.0; E_value=3.4e-05; Accession=PF01535.11; Description=PPR repeat
  Pfam annotation: Domain name=PPR; Domain location=452-486; Score =38.4; E_value=2.5e-08; Accession=PF01535.11; Description=PPR repeat
  Pfam annotation: Domain name=PPR; Domain location=553-587; Score =41.9; E_value=2.2e-09; Accession=PF01535.11; Description=PPR repeat
  Pfam annotation: Domain name=PPR; Domain location=588-622; Score=1.8; E_value=4.5; Accession=PF01535.11; Description=PPR repeat
  Pfam annotation: Domain name=PPR; Domain location=78-112; Score=19.7; E_value=0.01; Accession=PF01535.11; Description=PPR repeat
  Pfam module annotation: Pfam domain module=PPR::PPR::PPR::PPR::PPR::PP R::PPR::PPR::PPR; Domain location=113-147::151-185::250-284::285 -319::351-385::452-486::553-587::588-622::78-112
MVREKVKPDERTYAGVLRGCGGGDVPFHCVEHIQARTITHGYENSLLVCNPLIDSYFKNGFLNSAKKVFDSLQKRDSVSWVAMLSSLPQSGCEEEVVLLFCQMHTLGVYPTPYIFSSVLSACTKVEFFKLGEQLHGFVLKQGFSSETYVCNALVTLYSGLAQQGYSDRALELFKKMCLDCLKHDCVTVASLLSACSSVGALLVQFHLYAIKAGMSSDIILEGALLDLYVKCLDIKTAHEFFLSTETENVVLWNVMLVAYGLLDNLNESFKIFTQMQMEGIVPNQFTYPSILRTCSSLRVLDLGEQIHSEVLKTGFQFNVYVSSVLIDMYAKLGKLDNALKIFRRLKETDVVSWTAMIAGYPQHEKFAETLNLFKEMQDQGIQSDNIGFASAISACAGIQTLNQGQQIHAQACVSGYSDDLSVGNALVSLYARCGKVRAAYFAFDKIFSKDNISRNSLISGFAQSGHCEEALSLFSQMNKAGLEINSFTFGPAVSAAANVANVKLGKQIHAMIIKTGHDSETEVSNVLITLYAKCGTIDDAERQFFKMPKKNEISWNAMLTGYSQHGHEFKALSVFEDMKQLDVLPNHVTFVEVLSACSHVGLVDEGISYFQSTSEIHGLVPKPEHYACAVDILWRSGLLSCTRRFVEEMSIEPGAMVWRTLLSACIVHKNIDIGEFAASHLLELDPKIQ

SEQ ID NO: 222742 - protein, 342 aa, Glycine max
  Coding DNA Sequence Number=SeqID_105964
  Homolog annotation: Hit_ID=Q7DM58; Match level="QueryCoverage=28%, HitCoverage=8%, E-value=5e-22, Identity=44%"; Hit description =Multidrug resistance-associated protein 4
MARCVTERYHCSEGIHLKRLVGLRSDLASAGGTEERPNESLPTFESALTASLKRSSSQWSSLTKASSLYKSSLKKMLACVSIFKTFDRLELEESGVLSELVRLRKDFWGLHKPLVCPDGAVVAYAWTTSRTSWRTFFPATGLKIGEYKPTASGYCQFGLVVYATENESMSSSYEGYQTTLKLEDVPSVPIDFRAEKMSELFHSSWPKPEENSKHPVGLILFRCFWKHIAFTGSTSWEGLVLILILYLAKPTEVLSVHQFNFHSQKLGMLIHCFEVGCYSFHRNAGPEDLVARESMLAKITKNPGEYSEPFLKEFKIFHQELKDFFNASRFDMTITNMTQYPL

SEQ ID NO: 222743 - protein, 312 aa, Glycine max
  Coding DNA Sequence Number=SeqID_105965
  Gene Ontology: Mol. function=sequence-specific DNA binding; Cellular component=nucleus; Biological process=regulation of transcription, DNA-dependent
  Homolog annotation: Hit_ID=Q1SSB6; Match level="QueryCoverage=79%, HitCoverage=72%, E-value=3e-28, Identity=34%"; Hit description =Homeodomain-related
  Pfam annotation: Domain name=Homeobox; Domain location=76-137; Score =66.2; E_value=1.1e-16; Accession=PF00046.19; Description=Homeobox domain
  Subcellular localization annotation: CTP_CleavageSite=29; ConfidenceScore=5.16e-01
MSDSFGSTFHSSAPNSTLNSHAPPKITTFCSIAQPYCICTHCNHILTFNHHVGNLAEEGTNSTGSHNNNVQSQPQHSTRWSPTPVQLLVLEELYKQGTKTPSAEQIQQIASQLRQFGKIEGKNVFYWFQNHKARERQKRRRREMEENNNNNAAASSSSGEGLKETGCGVKETKKWASTSNCSGHAEESALDIAEKGSNGWTQFEERGSIQVLRRNISEKQAKLQEMEMPCFLPITIAAPTTTSHRTTTHNTQLLSPQNYNNLSSSLINRESLNYYGGDENADSRTLDLFPHKRDDQDGISLAERKSSSMFVL

SEQ ID NO: 222744 - protein, 267 aa, Glycine max
  Coding DNA Sequence Number=SeqID_105966
  Homolog annotation: Hit_ID=Q1S8P7; Match level="QueryCoverage=36%, HitCoverage=31%, E-value=2e-19, Identity=52%"; Hit description=HMG-I and HMG-Y, DNA-binding
  Pfam annotation: Domain name=DUF296; Domain location=163-267; Score =57.3; E_value=5.1e-14; Accession=PF03479.5; Description=Domain of unknown function (DUF296)
MTATTKVRLMKDRGTGEHKDYAFVAFKTKQVTQKAIEEIHSKESKNNKVVNEIHGSSTKKNKEYQEKLHVVVLRAEEIIFSKANFEAEYMDLTTLLERTNDAIDTIIQHDEHTETGEYLRRCFKEVVKCAADLHPSGSNDAEKKVCKKLGEEGARDIYTGEDFVAYFISLYDVAGKILSFSQKGPRGICILSANGAISNVTIRQPGSSGGILTYEACCRQQWHEKPNRWIECTSHLHGPDGQVIGGGVAGLLTASGPIQVWYITCDT

SEQ ID NO: 222745 - protein, 249 aa, Glycine max
  Coding DNA Sequence Number=SeqID_105967
  Gene Ontology: Mol. function=oxidoreductase activity, acting on single donors with incorporation of molecular oxygen, incorporation of two atoms of oxygen; Cellular component=beta-galactosidase complex; Biological ...
  Gene Ontology: Cellular component=process=hypusine biosynthetic process from peptidyl-lysine
  Homolog annotation: Hit_ID=Q9ZVF6; Match level="QueryCoverage=99%, HitCoverage=83%, E-value=1e-96, Identity=68%"; Hit description =Expressed protein
  Pfam annotation: Domain name=PhyH; Domain location=10-249; Score =214.8; E_value=2e-61; Accession=PF05721.4; Description=Phytanoyl-CoA dioxygenase (PhyH)
MGILSPEQLQFFNSQGYLVIESFASSDEIESMMQRMEQLVDEFDPSSTASIFSTKNQQKLTDDYFFDSVERISFFFEEKAFGDDGKLKQPKQLSLNKVGHEIEFHVDNPCNKALHEIEPAFKKFSSSEKVSSLMHSLGYKRPVVMQSMYIFKQPGIGGEVVPHQDNSFLYTEPQTCTGLWLALEDANILNGCLWAIPGSHKNGLVRRFLRDKDGVKFDQPSPSYDQKDFVPIEVKAGSLVVIHGDLIHQ

SEQ ID NO: 222746 - protein, 97 aa, Glycine max
  Coding DNA Sequence Number=SeqID_105968
MRSLSQHIGGYILCGTSRGYIYLGLTENKRGYISCGSVLVEDTSTRFKENKGGYIPCGSLLVKGFLQVKLQAYLMSDTLISAVANNHSLLGANLKWN

SEQ ID NO: 222747 - protein, 82 aa, Glycine max
  Coding DNA Sequence Number=SeqID_105969
  Gene Ontology: Mol. function=oxidoreductase activity; Biological process=ethylene biosynthetic process
  Homolog annotation: Hit_ID=O04076; Match level="QueryCoverage=62%, HitCoverage=17%, E-value=9e-12, Identity=58%"; Hit description=ACC -oxidase
MENFPVINLENINGEERKTILDQIQDACQNWGFFEGGSEVQMRTEMKKLDKDVSLSVIAMKTPGFSGADLANLMNQASILAN

SEQ ID NO: 222748 - protein, 149 aa, Glycine max
  Coding DNA Sequence Number=SeqID_105970
MKLASTSLFSFSLSREAKRWLHSFKANSLKTWDEVVEKLLKKYFPESKTTEGKVAIFSFHQFPDESLIDDLVELEEIVEEAEGDEEGEISIKDYQERIKKEEKEEETKEKEEKVKKLKNEKQKEKVVEIEKKKGKSKANSEKKKKVTLY

SEQ ID NO: 222749 - protein, 56 aa, Glycine max
  Coding DNA Sequence Number=SeqID_105971
MGSIAAPGTTVGGGDLTRVVKRACNDFNRGQFLTSLSNRLYRIKFITIKYRDVRYT

SEQ ID NO: 222750 - protein, 101 aa, Glycine max
  Coding DNA Sequence Number=SeqID_105972
MTSHVGFLDPQASFTSKADHDVFLSSNNYCKGKSTEVLVDSKKRKTCNNIIGEGGSGLNYDSDEISDDNNKMEEISARNGGNSPNANSTITGGVHQKGKKT

SEQ ID NO: 222751 - protein, 139 aa, Glycine max
  Coding DNA Sequence Number=SeqID_105973
  Gene Ontology: Mol. function=transcription regulator activity; Cellular component=nucleus; Biological process=regulation of transcription, DNA-dependent
  Homolog annotation: Hit_ID=Q9LSE2; Match level="QueryCoverage=95%, HitCoverage=27%, E-value=5e-34, Identity=66%"; Hit description =Transcription factor ICE1
  Pfam annotation: Domain name=HLH; Domain location=1-45; Score=26.4; E_ value=9.9e-05; Accession=PF00010.16; Description=Helix-loop-helix DNA- binding domain
MAERRRRKKLNDRLYMLLRSVVPNISKMDRASILGDAIEYLKELLQRISELRNELESTPAAGASSSFLLHPLTPTTLPTRMQEELCLSSLPSPNAQPASARVEVGLREGRGVKTSTCFATGNPDSCPRQPWISYGYFQS

SEQ ID NO: 222752 - protein, 96 aa, Glycine max
  Coding DNA Sequence Number=SeqID_105974
MEFLRRKFDRQFSSEEVLQLLDRFYNLEMLLVILLFLSPLPSFGIMFMVDPLSVGGVLIIMYLATLVGILTTGTTFAAGIGPWTFKMHGYFDKPVG

SEQ ID NO: 222753 - protein, 111 aa, Glycine max
  Coding DNA Sequence Number=SeqID_105975
MIVANGDGGDNNGSDSSNKNDSGSNSNGDNIDRVVVTMVGKSQELPTISAPIQPVTAPITITICKFPFQFQIQRERERERPWGERKQRKEEGKLLLKMDTNNELRAQIEKE

SEQ ID NO: 222754 - protein, 791 aa, Glycine max
  Coding DNA Sequence Number=SeqID_105976
  Gene Ontology: Mol. function=protein tyrosine/serine/threonine phosphatase activity; Cellular component=intracellular; Biological process=protein amino acid dephosphorylation
  Homolog annotation: Hit_ID=Q9FFA8; Match level="QueryCoverage=93%, HitCoverage=80%, E-value=0.0, Identity=57%"; Hit description =Similarity to DsPTP1 protein
  Pfam annotation: Domain name=Act-Frag_cataly; Domain location=99-397; Score=273.3; E_value=4.9e-79; Accession=PF09192.1; Description=Actin -fragmin kinase, catalytic
MAKEQNQGKGQERELELEREVEIEAPLPLTVTSRVLYMLGDITAGPAFRFTQWLQLVRKRTANYRSSGFPHRTSTTMPSSSCIRGSLENSKLELHPDQTETSLWERLGKAAMLDIESGSFSWDMLSSLHHTEHSSSNEHSEDEMNKALEVTVNSGGVVFFAFFNIPGNADASPKEAAAVIKIASSRMATQSERLGYELAKWMGVQTPQARVIHNTCLEWQQIKEASEKAREAANSEGDEIGEVTCFELLEALELSRCLFFMSYVHGSPLLENSSAFKSRESAERTSEALGRVLMLDLVIRNEDRLPCRELRWRGNPANLLLAGKNICANTDALEAAFDSAVNRYRPKVIRAFHKERRSTSVDCRLDSHNPGLISQSSDLSDITESPRSADMSFQTSGESLSPDFNIVAIDSGVPRRPPAGKRANDQVNYPKLVELLVNSSEFASNLLYDITGAKLGCPPPEDMEKTDVRIISDTMFVVHAFRNGFRAALRDLQGFHIFLLTLHQRLDTLLRSFMNIISKISLGEFDKEDSVVPDSPSLTAGGSCSSPTCKERLTNDNHQDFIDSESQRTALRSSSSGNRDCSDSTPMSRETWHGKFCKGNGEPLRSLRLTAKLRDFHKFAKVDAESNKELEQWNEMLKSDAIKLCQENNFNPGFFEGSDNNCVVDAYELKVRLEHILERIALISDAASTEKPSAVTSSLFIGGALAARSVYTLQYLGITNILCLCTNEIGQSETQYPDLFEYKNFSNEGGKSYTIDQLPIEVLWCEDKSMIRDQSSLQEESHRREKLDFIH

SEQ ID NO: 222755 - protein, 355 aa, Glycine max
  Coding DNA Sequence Number=SeqID_105977
  Gene Ontology: Mol. function=binding; Cellular component=integral to membrane; Biological process=transport
  Homolog annotation: Hit_ID=O80413; Match level="QueryCoverage=99%, HitCoverage=97%, E-value=1e-151, Identity=74%"; Hit description =Mitochondrial phosphate transporter
  Pfam annotation: Domain name=Mito_carr; Domain location=161-249; Score=82.2; E_value=1.7e-21; Accession=PF00153.17; Description =Mitochondrial carrier protein
  Pfam annotation: Domain name=Mito_carr; Domain location=262-345; Score=1.1; E_value=0.0028; Accession=PF00153.17; Description =Mitochondrial carrier protein
  Pfam annotation: Domain name=Mito_carr; Domain location=64-152; Score= 101.4; E_value=2.6e-27; Accession=PF00153.17; Description =Mitochondrial carrier protein
  Pfam module annotation: Pfam domain module=Mito_carr::Mito_carr::Mito_ carr; Domain location=161-249::262-345::64-152
  Subcellular localization annotation: CTP_CleavageSite=35; ConfidenceScore=5.42e-01
MAPSDQSRHSLVPGFLYSSKTLSHLNNNTNHELPPSSSPQGGTNTKSPMILSPKEGIRMFSPAYYAACSAGGIFSCGLTHMAVTPLDLVKCNMQIDPVKYKNITSGFGVLLKEQGAKGFFKGWVPTLLGYSAQGACKFGFYEFFKKYYSDLAGPENAIKYKTIIYLAGSASAEVIADVALCPMEAVKVRVQTQPGFARGLSDGLPKFIKADGVSGLYKGLVPLWGRQIPYTMMKFASFETIVEKIYKYAIPTPKEQCSKTMQLGVSFAAGYIAGVLCAIVSHPADNLVSFLNNAKGATIGDAVNKIGVVGLFTRGLPLRIVMIGTLTGAQWGLYDSFKVFVGLPTTGGSTPAPVK

SEQ ID NO: 222756 - protein, 507 aa, Glycine max
  Coding DNA Sequence Number=SeqID_105978
  Homolog annotation: Hit_ID=Q337I5; Match level="QueryCoverage=90%, HitCoverage=79%, E-value=1e-46, Identity=33%"; Hit description =Expressed protein
  Pfam annotation: Domain name=DUF1308; Domain location=1-506; Score= -79.0; E_value=6.5e-07; Accession=PF07000.2; Description=Protein of unknown function (DUF1308)
MEEEQRVAQVELAKQRCKCVIDAINSLPCSTNITVSCRRTLLKLARAELAFLSRPSSSSVPLSVNIGHLETVVHILQQPFVTGVSRVCKPIPLSPSVSSEERRHSPLNNIHVDVVCTLNKKPVWIIVSDRNPEYISWDRCHKSKGLKLRIEEVLAAAQSNLTLRPSSVILFFANGLPTQIYNKLRDEFGGSEIWLDFSVFSSDMLEETEGDWINVIARSYRNACVLEINPADGKDVEGTKSGCSVQGSTVDSSQLEPSVGKAETQPQLVDENARSGDSFHLELSVDEAETQAQPTEENVRINLGVMFCSILMGMKLSSMESKACESSNPGNLLGETDLVNFDTTALIALVSGISNGGTEKLLATPESGMRQRFKGNYDFVIGQITSEIQNPIHMEFDRILRGKNGLICESVLTEFKELVSMCGGPNEKLRADWLINCLRVVPDTPSERMMGLPSTRKLALKNKVVFGTGDHWHAPTLTANMAFVRAVSQTGMSLSTIEHRPRALTGD

SEQ ID NO: 222757 - protein, 289 aa, Glycine max
  Coding DNA Sequence Number=SeqID_105979
  Gene Ontology: Mol. function=transcription regulator activity; Cellular component=nucleus; Biological process=regulation of transcription
  Homolog annotation: Hit_ID=Q9SP39; Match level="QueryCoverage=58%, HitCoverage=53%, E-value=3e-22, Identity=38%"; Hit description=BHLH transcription factor GBOF-1
MAAFSSQYYHPFLVDSACLSITPPIINTSSTLPPSPHYLLNNNNIHIQETSYSVTNNQETSCVDNQSSKVTTISDTEYSVVNKNHSPETSMVVDKLEKGEQFTQKVVTPMEKEKKRRARNGSSKESTEGGNEKQKKPKEVKKDEKKGAEDPPTGYIHVRARRGQATDSHSLAERVTGKALVLDEIINYVQSLQNQVEFLSMKLALVNPMFYDLAIDLDTLMVRPDQKLNYNIASPSPCLAQFRPNQAIAFADTTTTNSFPTANNGDYLLDYSSSLFLQGPRSNLFFEVC

SEQ ID NO: 222758 - protein, 1191 aa, Glycine max
  Coding DNA Sequence Number=SeqID_105980
  Gene Ontology: Mol. function=transmembrane receptor activity; Cellular component=membrane; Biological process=defense response
  Homolog annotation: Hit_ID=Q8W2C0; Match level="QueryCoverage=90%, HitCoverage=96%, E-value=0.0, Identity=52%"; Hit description =Functional candidate resistance protein KR1
  Pfam annotation: Domain name=AAA; Domain location=217-401; Score= -24.2; E_value=0.014; Accession=PF00004.19; Description=ATPase family associated with various cellular activities (AAA)
  Pfam annotation: Domain name=Arch_ATPase; Domain location=204-395; Score=-99.4; E_value=0.1; Accession=PF01637.9; Description=Archaeal ATPase
  Pfam annotation: Domain name=LRR_1; Domain location=566-591; Score =10.9; E_value=2.6; Accession=PF00560.23; Description=Leucine Rich Repeat
  Pfam annotation: Domain name=LRR_1; Domain location=634-655; Score =8.9; E_value=6.2; Accession=PF00560.23; Description=Leucine Rich Repeat
  Pfam annotation: Domain name=LRR_1; Domain location=657-679; Score =5.7; E_value=25; Accession=PF00560.23; Description=Leucine Rich Repeat
  Pfam annotation: Domain name=LRR_1; Domain location=681-702; Score =1.2; E_value=1.7e+02; Accession=PF00560.23; Description=Leucine Rich Repeat
  Pfam annotation: Domain name=LRR_1; Domain location=703-725; Score =13.5; E_value=0.79; Accession=PF00560.23; Description=Leucine Rich Repeat
  Pfam annotation: Domain name=LRR_1; Domain location=727-748; Score =9.8; E_value=4.1; Accession=PF00560.23; Description=Leucine Rich Repeat
  Pfam annotation: Domain name=LRR_1; Domain location=750-774; Score =2.0; E_value=1.2e+02; Accession=PF00560.23; Description=Leucine Rich Repeat
  Pfam annotation: Domain name=LRR_1; Domain location=803-823; Score =1.2; E_value=1.7e+02; Accession=PF00560.23; Description=Leucine Rich Repeat
  Pfam annotation: Domain name=LRR_1; Domain location=828-849; Score =11.5; E_value=2; Accession=PF00560.23; Description=Leucine Rich Repeat
  Pfam annotation: Domain name=LRR_1; Domain location=851-876; Score =9.2; E_value=5.4; Accession=PF00560.23; Description=Leucine Rich Repeat
  Pfam annotation: Domain name=MotA_activ; Domain location=421-513; Score=-0.7; E_value=0.012; Accession=PF09114.1; Description =Transcription factor MotA, activation
  Pfam annotation: Domain name=NACHT; Domain location=216-369; Score =2.1; E_value=3.9e-05; Accession=PF05729.3; Description=NACHT domain
  Pfam annotation: Domain name=NB-ARC; Domain location=177-460; Score =169.6; E_value=7.8e-48; Accession=PF00931.13; Description=NB-ARC domain
  Pfam annotation: Domain name=TIR; Domain location=11-151; Score =159.4; E_value=9.6e-45; Accession=PF01582.10; Description=TIR domain
  Pfam module annotation: Pfam domain module=AAA::Arch_ATPase::LRR _1::LRR_1::LRR_1::LRR_1::LRR_1::LRR_1::LRR_1::LRR_1::LRR_1::LRR _1::MotA_activ::NACHT::NB-ARC::TIR; Domain location=217-401::204 -395::566-591::634-655::...
  Pfam module annotation: Domain location=657-679::681-702::703 -725::727-748::750-774::803-823::828-849::851-876::421-513::216 -369::177-460::11-151
MTVSASFSYDVFLSFRGSDTRYGFTGNLYNALSDRGIHTFIDEEELQRGDEIRPALVEAIKQSRMAILVFSKNYASSSFCLDELVKIMECVKAKGRLIFPIFYDVDPCHVRHQSGSYGEALAMHEERFTSSKENLKENMERLQKWKMALNQAADVSGKHYKLGNEYEHEFIGKIVKEISNKINRTPLHVADYPVGLESRVQTVKSLLEFESDTGVHIVGIYGIGGMGKTTLARAVYNSIADQFKGLCFLDDVRENATKHGLIHLQEMLLSEIVGEKDIKIGSVSKGISIIKHRLQRKKILLILDDVDKLEQLRATVGGPNWFGSGSRVIVTTRDKHLLASHGVDRKYEVEDLNEEESLELLCWNAFKDDKVDPCYKDISSQAVAYASGLPLALEVVGSLLFGKGIKEWESALEQYKKIPNKRIQDILKVSYNALEEDQQKIFLDIACCLKGYELAEVEDILCAHYGVCMKYGIGVLVDKSLIKIKNGRVTLHELIEVMGKEIDRQESPKELGKHRRLWFHKDIIQVLAENTGTSEIEIISLDFPLFEEDEEAYVEWDGEAFKKMENLKTLIIRNSHFSKGPTHLPNSLRVLEWWTYPLQDLPTDFHSNKLAICKLPRSCFTSLELSGISKKFMNLTVLNFDGTECLTQIPDISSLQNLVKLTFECCENLVAIHDSVGFLDKLKILSAFGCGKLMSFPPIKLISLEQLDLSSCSSLESFPEILGKMENITQLELKYTPLKEFPFSFRNLARLRDLVLVDCGNVQLPISIVMLPELAQIFALGCKGLLLPKQDKDEEEVSSMSSNVNCLCLSGCNLSDEYFPMVLAWFSNVKELELSCNNFTFLPECIKECHSLILLNLDNCEHLQEIRGIPPNLEYFSAGNCKSLSFCCTAMLLNQELHETGNTMFCLPGTRSPEWFEQQSIGPSLSFWFRNKFPVMDLCFVIGPMGKDSILFRPIMTINGNTMETQLTEKRCCLDFRALDYHILIIGTKYMKFGECLDKPLTKNEWNHVVVSIGIEPTPKDVIVKQTGLHVIKPESSMDDVQFTNPYKQPSFKEKQRLVDIVDCHRQFMQQQTTLVSLKPHVRQGGESFSLLPPQACKNNMNWDSNSTGITSTSSVQAAKKIGYIRFIATTPNGFIGFTAAAGQRNGFLAFFSIIGVDGIMAEEMHHQCPSNDGNDNDRTSSPVEQLPMAK

SEQ ID NO: 222759 - protein, 1169 aa, Glycine max
  Coding DNA Sequence Number=SeqID_105981
  Homolog annotation: Hit_ID=Q1RTS7; Match level="QueryCoverage=61%, HitCoverage=93%, E-value=1e-173, Identity=50%"; Hit description=IMP dehydrogenase/GMP reductase
  Pfam annotation: Domain name=CDT1; Domain location=753-878; Score =106.5; E_value=7.8e-29; Accession=PF08839.1; Description=DNA replication factor CDT1 like
MELNACEELAKIASDFKCEKLVDRARALLKCLLDVAVESVFETRLKTSFEHEKRVAVQDSKSPVAANISQSSVTYPTCSKMTSVKEEQPQLKLLSKKELPELSKFCISDDGGTKCNTLCSIGEESSVMQQNSVKETNLPNDNGIFPNIESNLNKQQHNDVNALYGDGENTEESLQMFDAKAGEQNEENNMSLQSRIQEAQSDSNAAKQVEHPDQKGDFSDDLVNAIKRIESRILAFQLCSNLSGSTKNSAGLHTTHEAANSDCPVIKRNNGASGSQMNSGKSLLDGRRLVNQKTCNESSKGENSISSNALVEPFCAVNGSLSQSQMANQNRWHHNGAESAKSIDIPQQIGTKQASVGEWLRSRNRIQNSVQNIAMIDRVKSLKRLVSGDAYFGSQASECIQGLRVPLNQDEHTKKHSMLVSKTNRESMVRLNPVAWSKTDQNRKEKGSESSYAQKLAGSKALISGREKPPLHQMVMKPTLLDQRSSEIKVSSHEHRDSRVLDRRITHKTGHLEPRKTRVLPQDHKLEEANSNSDSFRLSSWQGSANSSSDSEDYSLPDGTQYPSSAMMVDSAYEGSSEESNNSYLKKEGGTSRRFGSFKPYRHHRERNPKETVGRLRRLKNKLGLIFHHHHHHHHYHHHDDDVHGHRHTMWNQLQNVFHHKVKHGVTTNKVDKTRRGAVARVLPQRNHVGQFHRLAEGVLRHIRHSKKPNPFKLDGMKQLRNGHSQKKLRWWQNLRPHRRVRLKKKGRVKMGYSTLADLFGHMSCSLRLLHLCKKTPIFQNVCRQVEVLSKRKFSHAHLAQMKYILPKSVCIDKVLVHDKKSLCMVTDMKITLKFEVVKDCSGESADLALRRYFKSKLIDFFDMHPEVADIPEAPLPEPFGKKSCRSNCKDSHVEEFTGQSPHNNTDQAEKAQCFLPTKTSPSSHAFDFLDNEESEKTLQKECVPLYDDVANPIMERGHQKESFSMSFEPSVINTPVHMIHPPHSVTCSDSESPYLKNISCAADSFIAETPAQSAPARLLPISDVKLQDMPTQKSTSSYKPAKRVLDFSLMEDNDGLGIEVDKLESIRDLHEFDSFPESSRGCSEDCNSFGSVSAPQEAEESLGYASEKITQKQADLDTQHKKSSPLLNLPTNILIAIGEVEEQIEYLEKLVPDWICKKLVATGDTVYW

SEQ ID NO: 222760 - protein, 659 aa, Glycine max
  Coding DNA Sequence Number=SeqID_105982
  Gene Ontology: Mol. function=binding; Cellular component =intracellular; Biological process=protein kinase C activation
  Homolog annotation: Hit_ID=Q1SV87; Match level="QueryCoverage=68%, HitCoverage=83%, E-value=3e-90, Identity=40%"; Hit description =Pentatricopeptide repeat
  Pfam annotation: Domain name=Kunitz_legume; Domain location=33-199; Score=83.8; E_value=5.5e-22; Accession=PF00197.9; Description =Trypsin and protease inhibitor
  Pfam annotation: Domain name=PPR; Domain location=219-253; Score =25.1; E_value=0.00024; Accession=PF01535.11; Description=PPR repeat
  Pfam annotation: Domain name=PPR; Domain location=289-323; Score =12.2; E_value=0.27; Accession=PF01535.11; Description=PPR repeat
  Pfam annotation: Domain name=PPR; Domain location=351-385; Score =23.9; E_value=0.00056; Accession=PF01535.11; Description=PPR repeat
  Pfam annotation: Domain name=PPR; Domain location=454-488; Score =46.1; E_value=1.2e-10; Accession=PF01535.11; Description=PPR repeat
  Pfam annotation: Domain name=PPR; Domain location=489-523; Score =11.4; E_value=0.33; Accession=PF01535.11; Description=PPR repeat
  Pfam annotation: Domain name=PPR; Domain location=525-559; Score =10.9; E_value=0.38; Accession=PF01535.11; Description=PPR repeat
  Pfam annotation: Domain name=PPR; Domain location=591-625; Score=7.6; E_value=0.93; Accession=PF01535.11; Description=PPR repeat
  Pfam module annotation: Pfam domain module=Kunitz_legume::PPR::PPR::PP R::PPR::PPR::PPR::PPR; Domain location=33-199::219-253::289-323::351 -385::454-488::489-523::525-559::591-625
MKVSIAKFHSLPLCFLLLLAINTQPLLAAEPEPVVDKQGNPLVPGVGYYVWPLWADNGGLTLGQTRNKTCPLDVIRDPSFIGSPVRFHASGLNHIPTLTDLTIDFPVVTVCNQPTVWRLSKEGSGFWFVSTRGNPQDLITKFKIERLEGDHAYEIYSFKFCPSVPGVLCAPVGTFVDADGTKVMAVGDNIDPYYVSYKNVGKTEQAQRVFDQIKDPDIVSWTCLLNLYLHSGLPSKSLSAFSRCLHVGLRPDSFLIVAALSSCGHCKDLVRGRVVHGMVLRNCLDENPVVGNALIDMYCRNGVMGMAASVFEKMGFKDVFSWTSLLNGYILGNNLSCALELFDAMPERNVVSWTAMITGCVKGGAPIQALETFKRMEADDGGVRLCADLIVAVLSACADVGALDFGQCIHGCVNKIGLELDVAVSNVTMDMYSKSGRLDLAVRIFDDILKKDVFSWTTMISGYAYHGEGHLALEVFSRMLESGVTPNEVTLLSVLTACSHSGLVMEGEVLFTRMIQSCYMKPRIEHYGCIVDLLGRAGLLEEAKEVIEMMPMSPDAAIWRSLLTACLVHGNLNMAQIAGKKVIELEPNDDGVYMLLWNMCCVANMWKEASEVRKLMRERRVRKRPGCSMVDVNGVVQEFFAEDASLHVFATEANDGEVD

SEQ ID NO: 222761 - protein, 58 aa, Glycine max
  Coding DNA Sequence Number=SeqID_105983
MFIKVQLVEKGIKVHMLNFEDHVYKLLLEGWVSLIAKEPEPENKGSSCNIGTTIIITV

SEQ ID NO: 222762 - protein, 331 aa, Glycine max
  Coding DNA Sequence Number=SeqID_105984
  Gene Ontology: Mol. function=transferase activity, transferring hexosyl groups; Cellular component=cytoplasm; Biological process =metabolic process
  Homolog annotation: Hit_ID=Q1RTR9; Match level="QueryCoverage=90%, HitCoverage=61%, E-value=3e-74, Identity=47%"; Hit description=IMP dehydrogenase/GMP reductase
IASPIPRSSVPTVLLQPNSLFESIFMEDSANLAKLNGVFINSFEELEGEALAALNEGKVAKGLPPVYGVGPLMACEFEEVDQGGQRGGCMRSILEWLDEQSETSVVYVCFGNRTATRREQIKDMALGLVECGYSFLWVVKLKEVDREEEEDLEEVLGSELMNKVKEKGVVEKEFVEQVEILGHPSVGGFVSHGGWNSIMETVWEGVPILSWPQSGDQKITSETARISGVGIWPHEWGWGAQEVVKGEEIAKRIKEMMSNESLRVRAAEMKKAARKAAAAGVGGSCEFMVEVAADSQKNNKKALDVAAFRAERLALDAETQLAMAEAAEHGM

SEQ ID NO: 222763 - protein, 54 aa, Glycine max
  Coding DNA Sequence Number=SeqID_105985
MAKARDRDRDRRICSKKSNSGRDQAAHTYRGSRDENGRIVCSKWKVVTTSLCNN

SEQ ID NO: 222764 - protein, 555 aa, Glycine max
  Coding DNA Sequence Number=SeqID_105986
  Gene Ontology: Mol. function=protein serine/threonine kinase activity; Cellular component=nucleus; Biological process=protein amino acid phosphorylation
  Homolog annotation: Hit_ID=Q1S9D3; Match level="QueryCoverage=99%, HitCoverage=99%, E-value=0.0, Identity=76%"; Hit description=Protein kinase
  Pfam annotation: Domain name=Pkinase; Domain location=90-374; Score =301.7; E_value=1.4e-87; Accession=PF00069.15; Description=Protein kinase domain
  Pfam annotation: Domain name=Pkinase_Tyr; Domain location=90-373; Score=38.7; E_value=7.6e-15; Accession=PF07714.7; Description =Protein tyrosine kinase
  Pfam module annotation: Pfam domain module=Pkinase::Pkinase_Tyr; Domain location=90-374::90-373
MGCKLGKPADAGDRLRHNTATTSGGNNAVKVREKQKPPDAGELSGVIPAPERRTLRLDSFTASHQGWPPWLMAVAGDSIGDWTPRRANTFEKLAKIGQGTYSNVYKAKDLVSGKIVALKKVRFDNLEAESVKFMAREILVLRRLDHPNVVKLEGLVTSRISSSIYLVFEYMEHDLAGLSASVGVKFSEPQVKCYMKQLLSGLEHCHSRGVLHRDIKGSNLLIDNEGILKIADFGLATFFDPKQKHPMTSRVVTLWYRPPELLLGSTSYGVGVDLWSVGCILAELLTGKPIMPGRTEVEQLHKIFKLCGSPSEEYWKKYRLPNAALYKPQQPYKRNTLETFKDFPSSSLPLIETLLAIDPDDRGSTSAALNSEFFTTVPYACEPSNLPKYPPTKELDIKLRDEKARRQKALSGKTNAVDGARRVRVRERGLADPAPEANVEIQNNLDRWRVVTHANAKSKSEKFPPPHQDGAVGYPLDDSNKGAVSFGATETSSVSTIFDSKSCGSVISHDAARDKGRKTSKADSQMASSWKFMRSFKLSAVGHSFDLLFRSNSSR

SEQ ID NO: 222765 - protein, 201 aa, Glycine max
  Coding DNA Sequence Number=SeqID_105987
  Gene Ontology: Mol. function=endopeptidase inhibitor activity; Cellular component=cellular_component; Biological process=biological_ process
  Homolog annotation: Hit_ID=Q1SMC2; Match level="QueryCoverage=97%, HitCoverage=99%, E-value=5e-49, Identity=49%"; Hit description =Kunitz inhibitor ST1-like
  Pfam annotation: Domain name=Kunitz_legume; Domain location=26-196; Score=187.9; E_value=2.4e-53; Accession=PF00197.9; Description =Trypsin and protease inhibitor
MKMTLVTLVLVFALITKALAGPASEPVLDALGKKVRADSIYYIVPASSDIGGLASARTDVDCPLDVVAVDGDLGLPLSFTPVNDKKGIIRVSSDLNIYFTSYTIFCPQTTVWKLKYYDDSTSQWFVTTGGELGHPSSQTVANWFKIEKYEDAYKLVYCPSVCSDCNHQCSDIGIYQDQYGKRLALSSEPYKVQFERCWACE

SEQ ID NO: 222766 - protein, 303 aa, Glycine max
  Coding DNA Sequence Number=SeqID_105988
  Homolog annotation: Hit_ID=Q2QQY1; Match level="QueryCoverage=17%, HitCoverage=24%, E-value=1e-14, Identity=69%"; Hit description=SAM domain family protein
  Pfam annotation: Domain name=SAM_1; Domain location=239-299; Score =54.5; E_value=3.5e-13; Accession=PF00536.20; Description=SAM domain (Sterile alpha motif)
  Pfam annotation: Domain name=SAM_2; Domain location=236-301; Score =44.7; E_value=3.2e-10; Accession=PF07647.7; Description=SAM domain (Sterile alpha motif)
  Pfam module annotation: Pfam domain module=SAM_1::SAM_2; Domain location=239-299::236-301
MAEIQPPEGQINGGAGTLILHSSEPSIGSKRQRRPSVRLGDIGGDQPYDSHARRNTKPWKLAFDNHHHHHRSKDKDPGKPSKTRPLTNLSEFNETLEPSNDREPGNIDTVAIGSWKVKESKKRGSVATKRVRSNWVSRIDGGGEGEGEKYNNEDEDGDDDDGYREFEVENSESPLKEQSPIHSMENLGVDGHRRVFKGREREQQQHDGVELSVPSDTDVRDWKCGDRNNENGGGRVRGGEDGVRVWLNGLGLGRYAPVFEVHEVDDEVLPLLTLEDLKDMGISAVGSRRKMYTAIQKLGKGFS

SEQ ID NO: 222767 - protein, 47 aa, Glycine max
  Coding DNA Sequence Number=SeqID_105989
  Gene Ontology: Mol. function=DNA-directed RNA polymerase activity; Cellular component=DNA-directed RNA polymerase II, core complex; Biological process=transcription
  Homolog annotation: Hit_ID=Q9FLM8; Match level="QueryCoverage=91%, HitCoverage=86%, E-value=5e-18, Identity=88%"; Hit description =Similarity to metallothionein-I gene transcription activator
  Pfam annotation: Domain name=DNA_RNApol_7kD; Domain location=10-41; Score=83.0; E_value=9.1e-22; Accession=PF03604.4; Description=DNA directed RNA polymerase, 7 kDa subunit
  Pfam annotation: Domain name=PhnA_Zn_Ribbon; Domain location=9-37; Score=10.7; E_value=0.036; Accession=PF08274.2; Description=PhnA Zinc-Ribbon
  Pfam module annotation: Pfam domain module=DNA_RNApol_7kD::PhnA_Zn _Ribbon; Domain location=10-41::9-37
MDPQPEPVSYICGDCGMENTLKPGDVIQCRECGYRILYKKRTRRSKL

SEQ ID NO: 222768 - protein, 425 aa, Glycine max
  Coding DNA Sequence Number=SeqID_105990
  Gene Ontology: Mol. function=nucleotide binding
  Homolog annotation: Hit_ID=Q9ZVF7; Match level="QueryCoverage=92%, HitCoverage=62%, E-value=1e-166, Identity=73%"; Hit description =Similar to axi 1 protein from Nicotiana tabacum
  Pfam annotation: Domain name=DUF246; Domain location=16-376; Score =456.7; E_value=3e-134; Accession=PF03138.5; Description=Plant protein family
MTIGSFLMFLMILIKNVHVSSKFRDIYDEEFFVNTLKNDVRVVDKIPEYLMERFGSNMTNVHNFRIKAWSSIQYYKDVEEKAVHNVVVLWPLCHHMPVEESVASTPHIDIFSFLLVIYPFGLYGREFGVIRISPFANRLSFDAPPAVQRLRCLANYEALRFSSPILTIGESLVERMRKHSAINGGKYVSVHLRFEEDMVAFSCCVFDGGKQEREDMIAARERGWKGKFTKPGRVIRPGAIRINGKCPLTPLEVGLMLRGMGFTKNTSIFLASGKIYNAEKTMAPLLQMFPNLHTKETLASEEELAPFKNYSSRMAAIDYTVCLQSEVFVTTQGGNFPHFLLGHRRFLYGGHAKTIKPDKRKLALLFDNPNIGWKSLKRQLLSMRSHSDSKGVELKRPNDSIYSFPCPDCMCRSNRTDDLRSSLAT

SEQ ID NO: 222769 - protein, 91 aa, Glycine max
  Coding DNA Sequence Number=SeqID_105991
  Subcellular localization annotation: CTP_CleavageSite=26; ConfidenceScore=5.21e-01
MYCSKKHSHATTAVQPNSTTVDCTVNSALGTDLGLRLSFSFFPFGSKVSVDGKNDKVDNPDGGFELVYGTGIRDNKDGYHIGNLELHGRDR

SEQ ID NO: 222770 - protein, 111 aa, Glycine max
  Coding DNA Sequence Number=SeqID_105992
MATKSKTYQGTVDTADTRRGEKSALVPMAARKATSADTVNTVDTKQENLPERSEEGGFATKARLGWLCETPLGGSRTMALQKVALQGGSGAMAVTRILVNISFVKTDVNMT

SEQ ID NO: 222771 - protein, 58 aa, Glycine max
  Coding DNA Sequence Number=SeqID_105993
MTALNFPTCSCSSGLTESAPYVTAPYHLATCPHSFYALSENTFRAPKSWSTFASFLTI

SEQ ID NO: 222772 - protein, 193 aa, Glycine max
  Coding DNA Sequence Number=SeqID_105994
MDAHVVSVESQEIESSIVDASAASRKRRRDEEEEEELEQAFFIIVSVATMLLGAMTWYHNKYFVKEPAQNLELERHSFLNRLYRGTKTDCIEQLRVNLCAKDKATGFRAKNALDADAIMSKEANEEEAIHSVSIDLEGSSSATRKNIHPSKSGEKEGMISSMKEVVESLKEFVEVIKKKMENQKKMEIKEAQE

SEQ ID NO: 222773 - protein, 80 aa, Glycine max
  Coding DNA Sequence Number=SeqID_105995
MHEDEEHGILQEALEPLDKRRFMSKSKQQRYAELESRSLISWPGDNLIFSGGMEATGDASANTDAIQGAEDVDEGRDGLA

SEQ ID NO: 222774 - protein, 92 aa, Glycine max
  Coding DNA Sequence Number=SeqID_105996
  Gene Ontology: Mol. function=nucleic acid binding; Cellular component= intracellular; Biological process=ubiquitin-dependent protein catabolic process
  Homolog annotation: Hit_ID=Q5JLH9; Match level="QueryCoverage=96%, HitCoverage=21%, E-value=1e-19, Identity=42%"; Hit description =Putative PRLI-interacting factor K
  Pfam annotation: Domain name=zf-C2H2; Domain location=62-84; Score =22.1; E_value=0.002; Accession=PF00096.16; Description=Zinc finger, C2H2 type
MGGGTYSIGVYGFKGITNYKILVMVQDNFNQNVGQQASSSMSSMELDTEQLFLRIEESKNHIHCDKCGQAFQQEELENHMKVFHEALHCPVE

SEQ ID NO: 222775 - protein, 164 aa, Glycine max
  Coding DNA Sequence Number=SeqID_105997
  Gene Ontology: Mol. function=calcium ion binding; Cellular component =flagellin-based flagellum; Biological process=ciliary or flagellar motility
  Homolog annotation: Hit_ID=Q6ZXI3; Match level="QueryCoverage=91%, HitCoverage=82%, E-value=1e-14, Identity=33%"; Hit description =Putative calmodulin-like protein
  Pfam annotation: Domain name=efhand; Domain location=134-162; Score =26.9; E_value=7.3e-05; Accession=PF00036.22; Description=EF hand
  Pfam annotation: Domain name=efhand; Domain location=8-36; Score =33.0; E_value=1.1e-06; Accession=PF00036.22; Description=EF hand
  Pfam annotation: Domain name=efhand; Domain location=95-123; Score =34.4; E_value=4e-07; Accession=PF00036.22; Description=EF hand
  Pfam module annotation: Pfam domain module=efhand::efhand::efhand; Domain location=134-162::8-36::95-123
MCPLTPSDLKRIFNKVDMNGDGLLSLEELKMLLEKTGFSYSIEELESLVGKKSLDFSEFLFFYESMLKQNNNGEEELGASNYGDDSDEVEEVERDLVKAFKVFDLDGDGFITSQELEFVLKRLGMWDDERCGKDCKSMICSYDTNFDGKLDFQEFKDMMLLTTS

SEQ ID NO: 222776 - protein, 1232 aa, Glycine max
  Coding DNA Sequence Number=SeqID_105998
  Pfam annotation: Domain name=DUF789; Domain location=877-1226; Score =6.8; E_value=1.4e-16; Accession=PF05623.3; Description=Protein of unknown function (DUF789)
MANLLCLSNVATVLYVVIQVVVCYLRGETSFGNMHIRLGATDYTGFGLLILQARKMHCAPQEIGNDSPKVSEARKDSISTVYQQQNKLTSLEDCQESSLLKINTDSRCAILPIFSFEPDGTWRIVALPVQCQNHINLASGVNMDGLQLLFPPPLNRLKIDQCKGPRVPLPPYAYSAKSCTKKGFTGSNVHRRCQNKIANRVSKLNELPDNSCSQSSLVSGPGLFPGSSAALNSSDKYTSHSKEDDKSLKKNSRKRARKKVKQSKKKSSDSGSPEREVLTEEYVSVSLTSETCSSNDVDKEDVGEFSTSDDRLIKSDCERNCNINIMEAPNSCNSYLNQGMSKATEPIVQSSARECATFEPKNQLQDEGPDFEVIDRGIKDIQHMEPCCFNDVHDSLVLDSVSGGFRSDESINANDTGKPSNKANCTITSDSGDGYSLGQNLTNGIHNNCEHNEGIWHGGQNCISNDKRVKQKRTMSKSSDLNKFGGAGILHGRKGKENSHSVWQKVQKNSSDDGSGDLKKVNTTSSQFASTLEKDPSVIKECNSVSVNGVSKTEDKKHLKNKIGRKSKAKVESGAKTGLDNYSWKSFQFNGSLSNDHGKASFQQNDMLHISSQEIDQQGLNTVSGFSDINCLMDGVQTNGVEQVTSEIGHSAEFHLEESGPQKSASNIIAKTNNENIDSQDSSFIMPGEYINQSNMSEELSPDSCNLEGDEVGQNEKEVSSADYNAQNHSSGTTLWKWIPVGKKDRGLEKSESNSAPPENSDASSRNNSNSESSVEPEVASSENPDSLNASRACNGQIYDKVSCLDEGENHKMGSQVARTLTEHRDKHEAANHMFYECENQDMLENYSYRIAQAVNDACKAQLACEAVHMATGGPVAEFERLLHFCSPVICKSLSSHSCSACSHNHGGGASLCRHEIPDLSLGCLWQWYEKHGSYGLEIRAQGHENPKRQGGVADFPFRAYFVPSLSAVQLFKNHENLCVNNGDRLPNSEVSEACEMVDISANSSTASQHSIFSVLFPQPRNQDKSSQTPKETASINNASIPSINSTCSGDLELLFEYFEFEQPQQRQPLYEKIQELVRGHIPIESSTYGDPTKLDSINLRDLHPRSWFSVAWYPIYRIPDGNFRASFLTYHSLGHLVRRRTSDLSTVGSCIVSPTVGLQSYNAQGECWFQLKHSAPAAEMVNLEPSLLLKERLRTLEETASLMARAVVNKGNLTCTNRHPDYEFFLSRRRY

SEQ ID NO: 222777 - protein, 154 aa, Glycine max
  Coding DNA Sequence Number=SeqID_105999
  Gene Ontology: Mol. function=nucleotidyltransferase activity; Biological process=aromatic amino acid family biosynthetic process
  Homolog annotation: Hit_ID=Q6R3K4; Match level="QueryCoverage=67%, HitCoverage=14%, E-value=1e-41, Identity=80%"; Hit description=Metal- nicotianamine transporter YSL8
MAQNGSGDRVVVDNGFESIDDAYDHEHKLSQKGSTKVKEEEVSVERVFQHLLVPSWRNQLTVRAFVVSFALSILFSFIVMKLNLTTGIIPSLNVSAGLLGFFFVKTWTKFLEKSNMLRQPFTRQENTVIQTCVVASSGIAFSGTFFLSLYSMPL

SEQ ID NO: 222778 - protein, 269 aa, Glycine max
  Coding DNA Sequence Number=SeqID_106000
  Gene Ontology: Mol. function=catalytic activity; Cellular component =mitochondrion; Biological process=tricarboxylic acid cycle
  Homolog annotation: Hit_ID=Q307Y1; Match level="QueryCoverage=78%, HitCoverage=72%, E-value=8e-85, Identity=76%"; Hit description =Succinyl-CoA ligase alpha 1 subunit-like
  Pfam annotation: Domain name=Ligase_CoA; Domain location=84-248; Score=203.9; E_value=3.7e-58; Accession=PF00549.10; Description=CoA -ligase
MPLILFNLAPLNGGKDKLIEEAFLNFFFSKVSTYFKKAAYGEVYPDRAEITLPFKVRVKAALNRQSKTRLIGPNCPGIIKPGECKIGIMPGYIHKPGRIGIVSRSGTLTYEAVFQTTAVGLGQSTCVGIGGDPFNGTNFVDCLQKFLTDPQTEGIILIGEIGGTAEEDAAALIKLLITEEALIKIEKVEKNGIGNKESGTEKPVVAFIAGLTAPPGRRMGHAGAIVSGGKGTAQDKIKTLREAGVTVVESPAKIGAAMLDVFKQRGLVQ

SEQ ID NO: 222779 - protein, 812 aa, Glycine max
  Coding DNA Sequence Number=SeqID_106001
  Gene Ontology: Mol. function=heat shock protein binding; Cellular component=integral to membrane; Biological process=protein folding
  Homolog annotation: Hit_ID=Q9LJL2; Match level="QueryCoverage=92%, HitCoverage=92%, E-value=0.0, Identity=49%"; Hit description =Arabidopsis thaliana genomic DNA, chromosome 3, P1 clone: MVI11
MAFTYAAAIAPSIYGIARIGYCDQKVSLAGYHGEVNTTSFCVSSHAGRSDVLLERRKLKLADTRIVENTQMKSSAEIEIPVSCYQLIGVPDRAEKDEIVKAVMGLKNAEIDEGYTIDVVAARQDLLMDVRDKLLFEPEYAGNLREKIPPKSSLQIPWSWLPGALCLLQEVGESKLVLEIGQTSIRHQNAKPYTDDLILSMALAECAVAKIGFEKKKVSQGFEALARAQCLLRSKPSLAKMTLLSQIEESLEELAPACTLELLSMPHAPENVDRRRGAISALRELLRQGLDVEASCQVQDWPSFLSQAFDSLLAKEIVDLLPWDNLAVMRKNKKTIESQNLRAVIDSNCFYRVFKAHIAIGFSSKQKELINKAKGICECLIASEGIDLKFEEAFCLFLLGQGTEAEVVEKLKQLELSSNSKNISVLGKAIMDASAVNPSLEMWLKDSVLALYPDTKDCSPALANFFNAQQKFSGSKNSKGAQQMLPTICHRPLSSSGSLERRDVEESRSYMSSSPNLGFAVKQLTPTDLRSSLLSGRNETGSNPVESPVQVKRNLGSHRNSGIWHSYFPQGHIFERITYLTVLGCIAFASIKLSGIGLSKTLTGSHWASTKANDNIAWTADSADYPVVPAYIRQSTMANKVKRILSMFKILLLHQSGTGNHSDLHTTLTSSSYPINVSRRLMPVEEAETMVRQWQTIKAEALGPSHEVNCLAQVLDESMLAQWKGLANAAKERSCYWRFLLLKLSIIRADILSDGNGDDMAEIEALLEEASELVDGSQQKNPNYYLTYKVKYVMKRQDDGSWKFCENDIMETP

SEQ ID NO: 222780 - protein, 310 aa, Glycine max
  Coding DNA Sequence Number=SeqID_106002
  Homolog annotation: Hit_ID=Q9SBG7; Match level="QueryCoverage=82%, HitCoverage=67%, E-value=8e-44, Identity=40%"; Hit description=ROOT HAIRLESS 1
MKLFGTIVYPKNRYLTLQFPKGGKSVMCEDYFDNMIVFSDAWWIGRKEENPEEAKLEFPKELYEGHQSEYDFKGGAGAGAASVVNQGVPRTKIQRVEQESPKTPTEDDLSDSEINLEDTKELVPVRHSTRTAKKSYKFAEISSGDDSGENSPDLSDHEEKVAEVDTAVNDHNSSNILIIQKKTVVFDLDDEDDAPVDQPAKKNNESASRSKCKEVSQSASASASTEVKSSNRGSLVQATISTLFKKVEEKDEGSKKRARKTKDKDPGKKIKAKSKKDNVEDDDDDDDGDDIEEFSNASEDTNESDEDWTA

SEQ ID NO: 222781 - protein, 369 aa, Glycine max
  Coding DNA Sequence Number=SeqID_106003
  Gene Ontology: Mol. function=metal ion binding; Biological process =cell redox homeostasis
  Homolog annotation: Hit_ID=Q9LT14; Match level="QueryCoverage=80%, HitCoverage=73%, E-value=3e-68, Identity=45%"; Hit description =Genomic DNA, chromosome 3, P1 clone: MPN9
  Pfam annotation: Domain name=zf-C3HC4; Domain location=203-243; Score= 32.9; E_value=1.1e-06; Accession=PF00097.15; Description=Zinc finger, C3HC4 type (RING finger)
  Subcellular localization annotation: CTP_CleavageSite=30; ConfidenceScore=5.03e-01
MSSAGGDRGGGATSGDPRQYFCHQCNRTVSISPSPSSDLLCPTCNGGFLEELEFPIPNPNPNPPNPFFPDFPLAGAATIPLVLPGAAASPPFEDLSALFGNRPDAAADAFNPLVFLQNYFQTLRAGGNLQLVIESGDPGGAFRFPGVTHGDYFFGPGLEELIQHLAENDPNRYGTPPASKSVVEGLPDVSVTEELLASDSSQCAVCKDTFELGETAKQIPCKHIYHADCILPWLELHNSCPVCRYELPTDDPDYEQRARRGGSGGGGAAGSGAAPQVNWNMALGSGGSADSSGSGGGDNSQRRRFRVSLPWPFRQFAETSNVGSGNNDSNNNNNSNSNSDSSGNNGGQSNSGNRGNQNFDSETRQEDLD

SEQ ID NO: 222782 - protein, 401 aa, Glycine max
  Coding DNA Sequence Number=SeqID_106004
  Gene Ontology: Biological process=cell wall catabolic process
  Homolog annotation: Hit_ID=Q9FN43; Match level="QueryCoverage=93%, HitCoverage=83%, E-value=2e-41, Identity=35%"; Hit description =Genomic DNA, chromosome 5, P1 clone:MYJ24
MSPSNGLHNGGGGGSGGGGGNGVSYIEHQVSKLDTLAGVAIKYGVEGYADLTQPFELSASVFPLMINNANGGNAFIRDRYDCITCKITYANGSVADIKRMNGLATDLQMFALKTLKIPLPGRHPPSPAPGPHDEPAKSGEASIERKPLRIGQSAMKEPLQSLGLKPPQPNISPAMSILQKFYGLKSSNSRDTLNGTEMAVYLSSNSDHSSGEWLPKASPILDLPSASNDYPRSTNLVYDLLTGDDEYVPLAEIGDTGVEKSDEKSVRRRQKAEVDNGTSTPEKIMKEGNGNGSNGLSSNGKTLAMRPKSASRAALFPESESGWLDSIPVGLGESIFTDGFSGVRKSSSASSLREQEKNNSAAAWPPAIWSLKPDLQAAISKPIFDGLPIPISGRRSKAALD

SEQ ID NO: 222783 - protein, 46 aa, Glycine max
  Coding DNA Sequence Number=SeqID_106005
MPKEAVMENHFIWEKKQEREYKALKLQMEWCSWWHLRLILVDYITF

SEQ ID NO: 222784 - protein, 218 aa, Glycine max
  Coding DNA Sequence Number=SeqID_106006
  Gene Ontology: Mol. function=nucleic acid binding
  Homolog annotation: Hit_ID=Q653U4; Match level="QueryCoverage=65%, HitCoverage=24%, E-value=2e-13, Identity=33%"; Hit description=Zinc finger (C3HC4-type RING finger) protein-like
EEEEEEESDEEEESFGHGVGPAGQGRGRGRGMMWPPHMPLGRGARPMPGMQGFNPVMMGDGLSYGPVGPDGFGPPAAMMFRGRPSQPGMFPGGGFGMMLNPGRGPFMGGIGVGGANPPRGGRPVNMPPMFPPPPPLPQNANRAAKRDQRTADRNDRFGSGSEQGKSQDMLSQSGGPDDDPQYQQGYKGNQDDHPDDSESEDEAPRRSRHGEGKKKHKI

SEQ ID NO: 222785 - protein, 126 aa, Glycine max
  Coding DNA Sequence Number=SeqID_106007
  Gene Ontology: Mol. function=nucleic acid binding
  Homolog annotation: Hit_ID=Q653U4; Match level="QueryCoverage=74%, HitCoverage=13%, E-value=2e-42, Identity=82%"; Hit description=Zinc finger (C3HC4-type RING finger) protein-like
  Pfam annotation: Domain name=YTH; Domain location=7-97; Score=132.6; E_value=1.1e-36; Accession=PF04146.6; Description=YT521-B-like family
MAKPLNLKLSMFWQGCAKMTSKIGGSVAGGNWKYAHGTAHYGRNFSVKWLKLCELSFHKTRHLRNPYNENLPVKISRDCQELEPSIGEQLASLLYLEPDSELMKLIGNNHDVQMGEKQNVLLLVRN

SEQ ID NO: 222786 - protein, 294 aa, Glycine max
  Coding DNA Sequence Number=SeqID_106008
  Gene Ontology: Mol. function=nucleic acid binding; Cellular component= nucleus; Biological process=mRNA processing
  Homolog annotation: Hit_ID=Q653U4; Match level="QueryCoverage=94%, HitCoverage=38%, E-value=1e-55, Identity=43%"; Hit description=Zinc finger (C3HC4-type RING finger) protein-like
  Pfam annotation: Domain name=zf-CCCH; Domain location=155-174; Score =0.5; E_value=1.1; Accession=PF00642.15; Description=Zinc finger C-x8- C-x5-C-x3-H type (and similar)
  Pfam annotation: Domain name=zf-CCCH; Domain location=70-95; Score =15.2; E_value=0.013; Accession=PF00642.15; Description=Zinc finger C- x8-C-x5-C-x3-H type (and similar)
  Pfam annotation: Domain name=zf-CCCH; Domain location=98-123; Score =8.6; E_value=0.096; Accession=PF00642.15; Description=Zinc finger C -x8-C-x5-C-x3-H type (and similar)
  Pfam module annotation: Pfam domain module=zf-CCCH::zf-CCCH::zf-CCCH; Domain location=155-174::70-95::98-123
MEDSEGVLSFDFEGGLDAAPSSAAAAPSGPLIPHDSSAAASAVSNGGPAAPAPSAVDPVGGGNVPGRRSFRQTVCRHWLRSLCMKGDACGFLHQYDKARMPVCRFFRLYGECREQDCVYKHTNEDIKECNILYFNYSLHSNCWTVWHDDFGLSSERYKLGFCPNGPDCRYRHAKSPGPPPPVEEVLQKIQHLYSYNYNSSNKFFQQRGASYNQQAEKPLLPQGNNSTNQGVTGNPLPAELGNAQPQQQVQQSQQQVNQSQMQNVANGQPNQANRTATPLPQGISRCVQGPVFFN

SEQ ID NO: 222787 - protein, 55 aa, Glycine max
  Coding DNA Sequence Number=SeqID_106009
MTESMHVMRGPKETNKLGLKVRWPNKHIWWGIGNVVKLEIGRRGGGGGRKKITTL

SEQ ID NO: 222788 - protein, 97 aa, Glycine max
  Coding DNA Sequence Number=SeqID_106010
  Homolog annotation: Hit_ID=Q10CF2; Match level="QueryCoverage=51%, HitCoverage=24%, E-value=1e-17, Identity=84%"; Hit description =Expressed protein
  Pfam annotation: Domain name=GLTP; Domain location=3-94; Score=-66.5; E_value=0.0044; Accession=PF08718.1; Description=Glycolipid transfer protein (GLTP)
MEIKCNDSVKPMGELLPFVHGKNEEGNSLRNPASKAYEQVFAPHHGWAIRKAVSVGMYVLPTKEQLLKKLNEDELEQGWQTGREMIYVKPIYDECGM

SEQ ID NO: 222789 - protein, 79 aa, Glycine max
  Coding DNA Sequence Number=SeqID_106011
  Gene Ontology: Mol. function=nucleic acid binding; Cellular component= intracellular; Biological process=ubiquitin-dependent protein catabolic process
  Homolog annotation: Hit_ID=O23395; Match level="QueryCoverage=90%, HitCoverage=9%, E-value=2e-23, Identity=68%"; Hit description=UFD1 like protein
MAKSIKAEASICPLRLITFQFCGDMVQAGMSAMDVSDKLRGLSEHESICCSRTAPCDSCGHSMMLKDMDIHQIVVHQSG

SEQ ID NO: 222790 - protein, 124 aa, Glycine max
  Coding DNA Sequence Number=SeqID_106012
MNKKLIIQMMNYLLVLADFINVFFDIFPRDWLPPSKSSSLWNLIYPVQNNMNPQEPCHGSLPSLQNSQIRDPPRTAPSFVAATRTCQSPHHLCLQQRREQAISIDGDLVVVIEPQDNGFEGGGG

SEQ ID NO: 222791 - protein, 92 aa, Glycine max
  Coding DNA Sequence Number=SeqID_106013
MIPMLEKCAVGTSFQVSGLVAKDRSRVALYVRFKVDGDYDATVGGGGRGEPGGVAIVEAMTSKIILMMPKNPELSKFQRIRSQKASRIKIQE

SEQ ID NO: 222792 - protein, 97 aa, Glycine max
  Coding DNA Sequence Number=SeqID_106014
MPPEPLPWDRKDFFKERKHERSESLGSVARWRDSSHHRDFNRWGSAEFRRPLGHGHGYAISRSSNDKMLEDYSRPSFSWGDGKYGRSSRENRGGPFG

SEQ ID NO: 222793 - protein, 49 aa, Glycine max
  Coding DNA Sequence Number=SeqID_106015
MEMKGFVRGTPRRMRFIGVQNPDNVKFREVEPWRQSMSSGRPKILSQWG

SEQ ID NO: 222794 - protein, 72 aa, Glycine max
  Coding DNA Sequence Number=SeqID_106016
  Subcellular localization annotation: CTP_CleavageSite=18; ConfidenceScore=5.19e-01
MSTIGVSKAGVSSRRTTRAKTTVAKVGRKETRDAPFSKGFISKVDGIKSTPTSSKKRQPSFILSLQKIRDKR

SEQ ID NO: 222795 - protein, 68 aa, Glycine max
  Coding DNA Sequence Number=SeqID_106017
  Gene Ontology: Mol. function=DNA binding; Biological process=DNA integration
  Homolog annotation: Hit_ID=Q0PEL6; Match level="QueryCoverage=98%, HitCoverage=6%, E-value=1e-14, Identity=46%"; Hit description =Putative integrase
MKQGTRAWYDRLRYFLLENGFMRATKESLCKDFSDLMKNEFKMSTMEELKFFLGLQIKQDSKGIYIHQ

SEQ ID NO: 222796 - protein, 202 aa, Glycine max
  Coding DNA Sequence Number=SeqID_106018
MDLAFKTFCSDITRHSSIDLFSYPSWEILHEEEEYSLGVYKDKEQVIKELPPRQTVAPNPNSVILEHHLTNRKVYPLGVSVWKSREAKSAEMSLSTLLDLQQLMGFMCCINVVLPWHRTNYLLIENRLDQGKFLFEIAIDKLVLYQKASCYKGNELLIEDGDNAPLTIYAKACPGQLFKHELEDLKQKVELTNMDRYAMKRF

SEQ ID NO: 222797 - protein, 156 aa, Glycine max
  Coding DNA Sequence Number=SeqID_106019
MVVQVYDPSSSRVYAHFLKAELAISRETLAQALKDRAHAENEAHKCFFFSIVLKTVKALFFLSIATLPRYVSSKLYCSIDYLGLFGEIVVNPRTFIGFCCKDWGSRGDLRFVPVTHIQVSDPGNQIELPGRKLAVDSRVLHSSVIVVIVCPGHPQS

SEQ ID NO: 222798 - protein, 127 aa, Glycine max
  Coding DNA Sequence Number=SeqID_106020
MAPKRSEAIVFPGINSEEEARNVFHLESFIPRRSMDFQTLEEEGFPIKGRGDGITQKIMDIMLYGTPRHLKDDKKAMINFLKTANLTYMCRLIHTFLFSMVMPRMGSHDCLSNRDKFCNAKSWYKKM

SEQ ID NO: 222799 - protein, 115 aa, Glycine max
  Coding DNA Sequence Number=SeqID_106021
MKKANLDEMLEKNEAFELEEECLPLLKHYLRKNTRESWRKMPSLLPLEAKYATQIFSLDIVQRQVEIEVVIIPEDMDHVEREALEEDMLQPIIEASLVEINDDIVFDTDEQLFAT

SEQ ID NO: 222800 - protein, 416 aa, Glycine max
  Coding DNA Sequence Number=SeqID_106022
  Homolog annotation: Hit_ID=Q2HRX8; Match level="QueryCoverage=71%, HitCoverage=59%, E-value=5e-18, Identity=34%"; Hit description=IMP dehydrogenase/GMP reductase
  Pfam annotation: Domain name=DUF1723; Domain location=144-193; Score =64.8; E_value=2.8e-16; Accession=PF08330.1; Description=Protein of unknown function (DUF1723)
MPRTRGGDHTRPTAFVRRCAVVDEEQKIYEAPEHVVADDVAPKDIVFGVVDEEQEIYKALKHIVADDVAPEDVVFGGGPKDKSVLTKYVDHMACKLWDSLDCGELKLVAHGRKLRDLPPLPHKEIMQLVQVLGLLSLTKCSYETIDKGLLFAFTERWHRETNTFHLPIGEMTITLNDVSSLLHIPIVGEGFMFAYLGCEAFMQISVGTSSGTKLLELTCCNEWHRELNGKHTKGLPRVSRWTIGKRLLSLADYRSALDELTIDRVLWMPYKEHCNVCPFGMLSLFSGYIQLGSNMHLHFPKRVLQQFDYTQNYSSTPIYVYNGCVIGYMEWYFRISHPFVLSVNKECIPIVQPVIPDMRDVLNSSTQHNLVYEMINLRMVTEGTTTWEKDEVEEEFGVVGEVVNGLGDILCKNLLT

SEQ ID NO: 222801 - protein, 252 aa, Glycine max
  Coding DNA Sequence Number=SeqID_106023
MEDDYVRKMSNEVDMEVDMDNDIRVDEDIHKDYRQEIEKIVDCSKGFITTKDVAFEMGFVVVILRSDTSKGQPRRKTFVVLGCERGGKRPLKNDEGWILKLICGVHNHDLPKSLVGHLLNEMITLFGHSKSLEDIFFRVDGLPKVIVIDSDLALINAVESDQVMDAWGSVKDCLTRSKYEGRVKMFEIVCSPSEYFVKYVKNALLIPHKECFVKAWTNKADDHCGYHAIASLLHMGEDTWPIVRNNLLKELG

SEQ ID NO: 222802 - protein, 572 aa, Glycine max
  Coding DNA Sequence Number=SeqID_106024
  Homolog annotation: Hit_ID=Q69K57; Match level="QueryCoverage=99%, HitCoverage=99%, E-value=1e-131, Identity=49%"; Hit description=Smr domain-containing protein-like
  Pfam annotation: Domain name=DUF1771; Domain location=413-478; Score =64.2; E_value=4.1e-16; Accession=PF08590.1; Description=Domain of unknown function (DUF1771)
  Pfam annotation: Domain name=PAM2; Domain location=18-35; Score=18.0; E_value=0.027; Accession=PF07145.5; Description=Ataxin-2 C-terminal region
  Pfam annotation: Domain name=Smr; Domain location=491-572; Score =69.4; E_value=1.1e-17; Accession=PF01713.11; Description=Smr domain
  Pfam module annotation: Pfam domain module=DUF1771::PAM2::Smr; Domain location=413-478::18-35::491-572
  Subcellular localization annotation: CTP_CleavageSite=51; ConfidenceScore=5.61e-01
MSLSKKGSQTDAKLSSLNKATYLNPNAAEFVPFALRSSPSGSTSLVDATARFAAAGSLGKAVLDRAESSISNNSDDEAHQYWRCQLPDDITPDFKVMGEDESQGLNNLSLAGLSINDDNESSMFPSSKGFRYILNEQQELSQQHLNGNTFADKLRFSNSTYRDEPSSASILNSSAKPWDRQIRNTDLHVSSGQEALVYDDNTGHGFFNDVFAGNSLVNDTDLNPLEFLASLFPGFASESLSEVFFANGCDLHLTIEMLTQLEIQVDSSFNQNPSPKTLSSPNLSAMDFPALTSSNGQNASKYAADNVQQSGNPYLSSDKDMLMFKSGSSIPSRGAVDFASAVRKLASQDSGIWKYDKNGSGDASTGSSRSLNALASAYNGGQGRVNNGDRLQNRGSARAAPVWLETGDAVANMYSELREEARDHARLRNAYFEQARQAYLVGNKALAKELSVKGQLHNVHMKAAHGKAQESIYRQRNPVAPENGRGPQRMIDLHGLHVSEAIHVLKHELSVLRSTARAPEQRLQVYICVGTGHHTRGSRTPARLPIAVQRYLLEEGLDFTEPQPGLLCVVIY

SEQ ID NO: 222803 - protein, 112 aa, Glycine max
  Coding DNA Sequence Number=SeqID_106025
  Homolog annotation: Hit_ID=Q2QM63; Match level="QueryCoverage=60%, HitCoverage=22%, E-value=3e-10, Identity=52%"; Hit description =Transducin family protein, putative, expressed
FPWQNIFLTYCLEEGHSTRVKGIVVTTDGDGDDYYLMAFGSSDGFIRFWDVRMAAREKPLVECNTNSRLTCLAGSYHKLNMKQGNEIQRNKRKVKNLGLEPNETYTAKSQRV

SEQ ID NO: 222804 - protein, 952 aa, Glycine max
  Coding DNA Sequence Number=SeqID_106026
  Gene Ontology: Mol. function=RNA-directed DNA polymerase activity; Cellular component=nucleus; Biological process=RNA-dependent DNA replication
MNTLEQRKNLWHDIEGLHASISGPWALMGDFNNVLHAQDRIGGNMVTENEYRDLEKMLEITDLHEKDSSGGYYTWTNNQANGVIYSRIDHVFGNLSWLQQHVDFNLQIMNSGVSDHSLLCLRKQEDRRPSRTPFKFQNVITNVLGFQESVRDNWNNPITGATAMCRLWKKLKRLQPVELLTDRFNMQVIENVRRCTMQVLNLSNLEKQLLKKKSKVEWLKLGDGNNAYFHASLKSKSRKTQILSLVTENGDTIFEQEKIEDEIVNFYRKLVGTRSSQLNSIDLVAMRQGKQLTSDQRTSLTAPITEEEIVNNLKGISDISALGIDGYSAKIFKATWNITKVDVISAVKEFFEECLIYKAVNCSLITLIPKLDNANMVKDFRPISCCTVVYKIISRIMSTRLGKVLSSVLHQSQAAFIPGQRIHDHILLAYELIKGYNTKGGTPRCMLQMDLQKAYDSVEWSALEAILNELSIPHMFIKWIMIMVTTVSYRYQVNGALSNIVQAKRGLRQGDPLSPLLFVIVMEYLYRVLQKLKQVPNFNFHPKCEKLAIINLSFAEDLLMFTRGDPMSVRLAMNAFNDFSAATGLKVNPSKCNIYFGNVTDEVKKEIQANVNYNEGTIPFRYLGIPLSNKRLSVAHCLLIADKITARITHWSARLLSFAGRAQLINSVLFAVSNFWLQCIPLPKEVIKRINAICRSFLWSGGDKLTRKSPIAWKRVCTPTKQGGLNIISIEEWNKANLIKLLWNLNGKTDSLWIKWVHCYFLKKWSIMNVPMKTNTSWIFESSFISKTRKVKWRYLFKGNMARPRARFILWMACHERMATKDRLMRFGMLNDDTCCYCKEKETIQHIFFQCNVLSQFWKHTLKWLEVPHSPGGWNEELDWIIKKCKSKGSKAKIIKCAFTEAVYETWMFRNNKCFGLDTTSSNVGTRITDTIVYRCWLNPKLRNHLGRLMIP

SEQ ID NO: 222805 - protein, 437 aa, Glycine max
  Coding DNA Sequence Number=SeqID_106027
  Gene Ontology: Mol. function=binding; Cellular component =intracellular; Biological process=protein kinase C activation
  Homolog annotation: Hit_ID=Q9LTV8; Match level="QueryCoverage=90%, HitCoverage=82%, E-value=1e-75, Identity=29%"; Hit description =Selenium-binding protein-like
  Pfam annotation: Domain name=PPR; Domain location=200-234; Score =41.0; E_value=4e-09; Accession=PF01535.11; Description=PPR repeat
  Pfam annotation: Domain name=PPR; Domain location=235-269; Score =15.8; E_value=0.1; Accession=PF01535.11; Description=PPR repeat
  Pfam annotation: Domain name=PPR; Domain location=337-371; Score=3.2; E_value=3.1; Accession=PF01535.11; Description=PPR repeat
  Pfam annotation: Domain name=PPR; Domain location=97-131; Score=36.5; E_value=9e-08; Accession=PF01535.11; Description=PPR repeat
  Pfam module annotation: Pfam domain module=PPR::PPR::PPR::PPR; Domain location=200-234::235-269::337-371::97-131
MISAYAGNGCPKESLELVYCMVRLGFRPDLFTAIPAISSVTQLKYKEWGKQMHAHVIRNGSDYQVSIHNSLVDMYSVCDDLNSAQKIFGLIMDKTVVSWSAMIKGCAMHDQPLEALSLFLKMKLSGTRVDFIIVINILPAFAKIGALHYVSYLHGYSLKTSLDSLKSLKTSFLTSYAKCGCIEMAKKLFDEEKSIHRDIIAWNSMISAYSKHGEWFRCFQLYSQMKLSNVKLDQVTFLGLLTACVNSGLVSKGKEIFKEMVEIYGCQPSQEHHACMVDLLGRAGQIDEANEIIKTVPLESDARVYGPLLSACKIHSETRVAELAAEKLINMEPKNAGNYVLLSNIYAAAGKWDKVAKMRSFLRDRGLKKTPGYSWLELNGQVHEFRVADQSHPRWEDIYSILKVLELEAGDMEDDLELFDPSVIKGCELHMNQLNQL

SEQ ID NO: 222806 - protein, 192 aa, Glycine max
  Coding DNA Sequence Number=SeqID_106028
  Homolog annotation: Hit_ID=Q2HVA1; Match level="QueryCoverage=36%, HitCoverage=11%, E-value=3e-07, Identity=46%"; Hit description=KH, type 1
  Subcellular localization annotation: CTP_CleavageSite=47; ConfidenceScore=5.11e-01
MKSNKGKETIYLTPYLSFKTLILHLVSILIFSTTFPDPSNDTGSTCKVSTRSQQETIQSPTSMSVVSEGPLCRRCIALGSDSGGADEDDVVGGVRWHILDLNLGIGGLLERLDEQVGLANDGAHSRHVTKETEGHVSRVGFGTVHVTIRVVRVGGWLAIKVEHSAFYFLLSTSALEEVVVSFSHNVVASEEI

SEQ ID NO: 222807 - protein, 127 aa, Glycine max
  Coding DNA Sequence Number=SeqID_106029
  Gene Ontology: Mol. function=nucleic acid binding; Biological process= DNA integration
MDVKTTFLNSDLQEELYMTQLEGCEVPGQENKDDWDALANLLRYLRGTMDYGIKYSGFFVVLEGYSNANWISNSNETKSISEMDGSKTEWLKNFLANIPLGMKPTPIVSMHYNSQSATIVAKNKTFN

SEQ ID NO: 222808 - protein, 126 aa, Glycine max
  Coding DNA Sequence Number=SeqID_106030
MEEEPRMELLKVLWFGAEIQYGRGSGEKPCLEEWWKVWDFGNVKEMKPMVVGVEHVLSESNSSCYYGYEAWKGFLKGYFGRAYRGLENIGLREYYERSMRLEEKEYLVVGAYVSGNLIVLGTRHNP

SEQ ID NO: 222809 - protein, 44 aa, Glycine max
  Coding DNA Sequence Number=SeqID_106031
MPSPLLSSSATPTMQEPLYYIGLKSIKLKLDPRREVDRKLEQLG

SEQ ID NO: 222810 - protein, 180 aa, Glycine max
  Coding DNA Sequence Number=SeqID_106032
  Gene Ontology: Mol. function=nucleic acid binding; Cellular component= nucleus; Biological process=DNA integration
  Homolog annotation: Hit_ID=Q1S1X7; Match level="QueryCoverage=97%, HitCoverage=13%, E-value=2e-47, Identity=54%"; Hit description =Integrase, catalytic region; Zinc finger, CCHC-type; Peptidase aspartic, catalytic
MLNRFGMASIKPICTPLTTFIHLTELNATQSKSEREYMSHVPYVSVVGSLMYVMVYTRPNLAQTVNVVSKYMGKLGKEHWQTVKCIFRYLKGTTDIGLVYQGDTSCALAGYSDSDYAIDLDARQSVTGYAFTIRYSLISWKVTLQSTISLSTTEVEYMALAEVTKEGIWLKGLISNLRFL

SEQ ID NO: 222811 - protein, 156 aa, Glycine max
  Coding DNA Sequence Number=SeqID_106033
MAKKRLSANFPSFIIQCSYGGGGSNVGGASGEGDGSDTGEIVVVVASDCVVVVVVVVATLVAIVVTMIEQCQCDGDSGDDGGGDDNDGDGGSSDKNADSNGDGSDNDDDGGGSDASDHDDDKIAIVTITDVVFVVVINGGSSKECHCQGWSKIVLL

SEQ ID NO: 222812 - protein, 91 aa, Glycine max
  Coding DNA Sequence Number=SeqID_106034
MKLIFDGNKNTMRYLPNPPVLVPLVLKEGILSSNNKMMKTMVTKSHPSVGKEDPPKKKVIPKELKWSKKKRVDYYAGGSGQEGQITLFDGG

SEQ ID NO: 222813 - protein, 54 aa, Glycine max
  Coding DNA Sequence Number=SeqID_106035
MMQALREEVAFVERRAEEERVAHNATKMDSMEREVELEHRAVESSTALARIQLM

SEQ ID NO: 222814 - protein, 107 aa, Glycine max
  Coding DNA Sequence Number=SeqID_106036
MDSTRVWRLVSETRKWKMFSRKRELWRMECTATIELQRVGMQWGRSELGERNPWGSLFHHWIYAHVVREAKGQLVGKALLLTYIILGLTIINTNYYMTKIITVLTKN

SEQ ID NO: 222815 - protein, 88 aa, Glycine max
  Coding DNA Sequence Number=SeqID_106037
MITNIALTHGLIPTINATHMPKGVTHHGNSKRKVIRGVIESGEREELRESSKVDSTSMKRKGEGFKAYVGGDNSGHATIIVIVLVVTT

SEQ ID NO: 222816 - protein, 110 aa, Glycine max
  Coding DNA Sequence Number=SeqID_106038
  Subcellular localization annotation: CTP_CleavageSite=23; ConfidenceScore=5.17e-01
MKGRTSIDKWQRRTPQRRTPQCGCSHGSVGQFATKTNSGRRRKKKNDKSMRQYIEKPLSSNVSFLNRHKLRPFLQRRMKMQEHVCRINTARRGDMIGLVKIRANEWVNSN

SEQ ID NO: 222817 - protein, 193 aa, Glycine max
  Coding DNA Sequence Number=SeqID_106039
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9SL03; Match level="QueryCoverage=77%, HitCoverage=9%, E-value=9e-56, Identity=71%"; Hit description =Putative glucan synthase
MAFELYGMLVGNVSPLTGELVKPAYGGDNEAFLMKVVKPIYDVIAKEAERSNMGKAKHSHWRNYDDLNEYFWSVDCFRLGWPMRVDSDFFSVPFPQQQHQVNKHEAMITIAWNGSGKLSSIFDGDIFKQVLSIFITAAILKLAQVFDTAIKVILEPPRRKEMARKKRHRRYAYAVASALHGAKHNLRKHFMVQ

SEQ ID NO: 222818 - protein, 162 aa, Glycine max
  Coding DNA Sequence Number=SeqID_106040
  Gene Ontology: Mol. function=nucleic acid binding
  Homolog annotation: Hit_ID=Q1RU92; Match level="QueryCoverage=77%, HitCoverage=27%, E-value=2e-10, Identity=32%"; Hit description=IMP dehydrogenase/GMP reductase
MKQIHTEAWVRFYDLPQEYWRPKTLFEILAVVGTLITLADSMRRKAFKHILCKAFGGCRFSWNPLGRSDEYKKLPFFCTQCNTINHKEPQYKKKVQSLGERVKQQPPTNLKPLTLNQAIAQPEEPKPLEPTTHNGVLGEQNPKENLIENTVSPNLQMNEHIA

SEQ ID NO: 222819 - protein, 76 aa, Glycine max
  Coding DNA Sequence Number=SeqID_106041
MKVAHLYWPERLNRWLPNSLKYKNLQQENNRGSVGSKHSRLFVAPLLQLRESWHSLSEFYTADDPSQADQRMDHFV

SEQ ID NO: 222820 - protein, 103 aa, Glycine max; identical to SEQ ID NO: 146197
  Coding DNA Sequence Number=SeqID_106042
  Gene Ontology: Mol. function=hydrolase activity; Cellular component =microtubule; Biological process=cell division
  Homolog annotation: Hit_ID=Q8LF21; Match level="QueryCoverage=97%, HitCoverage=16%, E-value=2e-38, Identity=79%"; Hit description =Dynamin-related protein 1C
  Pfam annotation: Domain name=Dynamin_N; Domain location=38-101; Score= -31.1; E_value=0.0056; Accession=PF00350.13; Description=Dynamin family

SEQ ID NO: 222821 - protein, 49 aa, Glycine max
  Coding DNA Sequence Number=SeqID_106043
MSWVRSAVNKAVEGGQRNIGRAVRTYADSVMVHASNAVAGGARIIQDRI

SEQ ID NO: 222822 - protein, 80 aa, Glycine max
  Coding DNA Sequence Number=SeqID_106044
MWCYEWKKSEALRVGRVFCLCPVFLAVLGRIDGDPVLRETRLWATWEYVSSVGGGQQGMVGLCALCGCGKLVVHHRPTAT

SEQ ID NO: 222823 - protein, 191 aa, Glycine max
  Coding DNA Sequence Number=SeqID_106045
  Homolog annotation: Hit_ID=Q8UGN0; Match level="QueryCoverage=29%, HitCoverage=14%, E-value=2e-16, Identity=90%"; Hit description=AMP nucleosidase
MAESGGLEADLRVAGAVTPGNRRALGKSALKAATASFGSVNVCGAKGSGLMKVRGGIVGFAIVMAHYKRPISTGKRQKYEETEKKRENAAGQCWRGRNSAERAALQAHQQHEAGAFGGWAGIGLVNRKSGHRAEKDRGHQHQPQCGEQAVGKTGGHWPVLTIRRGNWRRAPSRAGMRLPHRHSRAGNCGSD

SEQ ID NO: 222824 - protein, 43 aa, Glycine max
  Coding DNA Sequence Number=SeqID_106046
KLKKAETLILVDFVECPKVEVVYGSSWKTGDLKMEDLDIDLME

SEQ ID NO: 222825 - protein, 453 aa, Glycine max
  Coding DNA Sequence Number=SeqID_106047
  Gene Ontology: Mol. function=uroporphyrin-III C-methyltransferase activity; Biological process=cobalamin biosynthetic process
  Homolog annotation: Hit_ID=Q57IZ6; Match level="QueryCoverage=45%, HitCoverage=79%, E-value=2e-86, Identity=80%"; Hit description=FNT family, nitrite transport protein
  Pfam annotation: Domain name=Form_Nir_trans; Domain location=1-214; Score=205.4; E_value=1.3e-58; Accession=PF01226.8; Description =Formatenitrite transporter
MAGAYVGLAIILIFTLGNLADPAYRPLLMGATFGIALTLVIIAGSELFTGHTMFLTVGVKAGTISHGQMWCVLPQTWLGNLIGSVFVALLYYYAAGALLPNAGSLIHSVALAKTTQTTMALFFKGALCNWLVCLAIWMAVRSEGAAKFIAIWWCLLAFIASGYEHSIANMTRRPDAERHRPQPAVGDARQYVLWHGADGPRLLVCHAAGAAPTDASPGFAAEIGDVAERKARLLLEAGAELYVGARDFSPAFQLWAQQGKVTLLHGAFTDDWLNECWLAIAATSDDAVNQQVADAAEQRRLFCNLVDAPQQASAIMPSIVDRSPLMIAVSSGGRAPVLARLLREKLEAMLPQHLGELAALAGSLRERVKQHFSAMAPRRAFWERFFTSDRLAQTLANGDRARAAAQVDALFAAPLTQQGEVVLVGAGPGDAGLLTLKGLQAIQQADVVVYDRL

SEQ ID NO: 222826 - protein, 92 aa, Glycine max
  Coding DNA Sequence Number=SeqID_106048
MIRGDTLRLFAPICHPEAAGPMTSRDQVWSFCTLVSSRGGGPDDTRKYPSGYPYKHSFAICKTERLIACRGAKFHGRPRLSSTERSEISVIH

SEQ ID NO: 222827 - protein, 63 aa, Glycine max
  Coding DNA Sequence Number=SeqID_106049
SYFHKETGFRCQSLKEIKNYEKYGSPPRRHKVKTQAKEESNEKTKNETEFTDNYKLMSRTESD

SEQ ID NO: 222828 - protein, 68 aa, Glycine max
  Coding DNA Sequence Number=SeqID_106050
MHGAIGDDAFDRDEPRGCVATATDDKGLHIAAPIGASKGATGGSDLSEREAPVRLAFSASVVIACVEK

SEQ ID NO: 222829 - protein, 112 aa, Glycine max
  Coding DNA Sequence Number=SeqID_106051
  Homolog annotation: Hit_ID=Q1SE16; Match level="QueryCoverage=79%, HitCoverage=23%, E-value=1e-15, Identity=65%"; Hit description=Amino acid/polyamine transporter II
  Subcellular localization annotation: CTP_CleavageSite=71; ConfidenceScore=5.41e-01
MAVDQMKSIESPKVKQYTIKHSLPKRAVARGNFKMSNLGILLNQRRPSRRKRRKQGFVNEGSASGVCLLVSDVERKELLSLDNEGVPKNPMFGDGTLLYRSIDCLKHHQLQQ

SEQ ID NO: 222830 - protein, 295 aa, Glycine max
  Coding DNA Sequence Number=SeqID_106052
  Gene Ontology: Mol. function=L-isoleucine transporter activity; Cellular component=integral to membrane; Biological process=amino acid transport
  Homolog annotation: Hit_ID=Q1SE16; Match level="QueryCoverage=90%, HitCoverage=60%, E-value=1e-134, Identity=86%"; Hit description =Amino acid/polyamine transporter II
  Pfam annotation: Domain name=Aa_trans; Domain location=11-295; Score =20.2; E_value=4.6e-08; Accession=PF01490.8; Description =Transmembrane amino acid transporter protein
MVKVILTCVKKVIGSIEEQSINVLCGVGILSTPYAAKVGGWLGLSILVIFAIISFYTGLLLRSCLDSEPELETYPDIGQAAFGTTGRIAISIVLYVELYACCIEYIILEGDNLSSLFPSAHLNLGGIELNSRTLFAVITTLAVLPTVWLRDLSILSYISAGGVVASILVVLCLLWVGIEDVGFHSKGTTLNLSTLPVAVGLYGYCYSGHAVFPNIYTSMANPNQFPGVLLACFGICTLLYAGAAVMGYTMFGEAILSQFTLNMPKELVATNIAVWTTVVNPFTKYPLYVPYVNYI

SEQ ID NO: 222831 - protein, 691 aa, Glycine max
  Coding DNA Sequence Number=SeqID_106053
  Gene Ontology: Mol. function=protein serine/threonine kinase activity; Cellular component=integral to membrane; Biological process=protein amino acid phosphorylation
  Homolog annotation: Hit_ID=Q49N12; Match level="QueryCoverage=99%, HitCoverage=76%, E-value=0.0, Identity=83%"; Hit description =Putative receptor-like protein kinase 2
  Pfam annotation: Domain name=LRR_1; Domain location=116-138; Score =17.6; E_value=0.046; Accession=PF00560.23; Description=Leucine Rich Repeat
  Pfam annotation: Domain name=LRR_1; Domain location=140-162; Score =3.8; E_value=56; Accession=PF00560.23; Description=Leucine Rich Repeat
  Pfam annotation: Domain name=LRR_1; Domain location=19-41; Score =12.5; E_value=1.3; Accession=PF00560.23; Description=Leucine Rich Repeat
  Pfam annotation: Domain name=LRR_1; Domain location=43-65; Score=9.5; E_value=4.7; Accession=PF00560.23; Description=Leucine Rich Repeat
  Pfam annotation: Domain name=LRR_1; Domain location=67-89; Score=8.0; E_value=9; Accession=PF00560.23; Description=Leucine Rich Repeat
  Pfam annotation: Domain name=Pkinase; Domain location=475-691; Score =106.8; E_value=6.3e-29; Accession=PF00069.15; Description=Protein kinase domain
  Pfam annotation: Domain name=Pkinase_Tyr; Domain location=475-689; Score=68.6; E_value=2e-17; Accession=PF07714.7; Description=Protein tyrosine kinase
  Pfam module annotation: Pfam domain module=LRR_1::LRR_1::LRR_1::LRR _1::LRR_1::Pkinase::Pkinase_Tyr; Domain location=116-138::140-162::19- 41::43-65::67-89::475-691::475-689
DLTRNYLNGTIPKEWGSTKLAIMVLEGNQLSGNLPPELGNLTQIQRLLLSSNNFIGELPVTLVKLTTLQDIVIQGSGLSGPIPSGISFLENLTDLRISDLNGSEHSLFPQLNQMKNLKYLDLSFNKLTGPIPSTYDALRKVDYIYLTGNLLNGQVPAWTEKSDNVDISFNNFSVTSQGSTCQIGNVNLFASSMTHNDSGTVACLGSSVCQETLYSLHINCGGKIVTDNGSTYDDDSDTGGPARFHRSGTKNWAYINTGNFMDNDAGAYYIVQNKTLLSMDNVDLYMDARVSPISLTYYGFCLGNGNYTVNLHFAEIMFIDDQTFNSLGRRVFDIYIQGALVKKDFDIVEEAGGIGKAVITSFTAVVTSNTLEIRLYWAGKGTTSLPFRSVYGPLISAISVEPDFTPPSKNKSSISVGVVVGVVAAGAVVIILVLGILWWKGCFGKKSSLERELQGLDLRTGLFTLRQIKAATNNFDVANKIGEGGFGPVYKGCFSDGTLIAVKQLSSKSRQGNREFLNEIGMISALQHPHLVKLYGCCVEGDQLLLVYEYMENNSLARALFGAEEHQIKLDWTTRYKICVGIARGLAYLHEESRLKIVHRDIKATNVLLDQDLNPKISDFGLAKLDEEDNTHISTRIAGTFGYMAPEYAMHGYLTDKADVYSFGIVALEIINGRSNTIHRQKEESFSVLEW

SEQ ID NO: 222832 - protein, 232 aa, Glycine max
  Coding DNA Sequence Number=SeqID_106054
  Gene Ontology: Mol. function=nucleic acid binding; Biological process= DNA integration
  Homolog annotation: Hit_ID=Q1S6N9; Match level="QueryCoverage=93%, HitCoverage=26%, E-value=5e-25, Identity=41%"; Hit description =Integrase, catalytic region; Zinc finger, CCHC-type; Peptidase aspartic, catalytic
  Pfam annotation: Domain name=zf-CCHC; Domain location=115-132; Score =6.8; E_value=0.075; Accession=PF00098.13; Description=Zinc knuckle
MKAHLEANDLWEAVEEDYEVLPLIDNPTMTQLKSHTLKKSRKLKAKATLFAAVSEEIFTRIMHQNSAFESWNFLKIEDEGDDKVKAGNKKRDFPPCKHCNKKGCPPFKCWRRPDVKCGKCHKHGHHERICKSNSQRKNNAQAVTEQEEEQQLFVASCFTSSCSSSNGYWLVDSGCTNHITSHEELFRDSNKSQVSKVRIGHGDYIIIKGKGTVTPSTSHIYVLIIKGTRNQN

SEQ ID NO: 222833 - protein, 81 aa, Glycine max
  Coding DNA Sequence Number=SeqID_106055
MWDRHRLKEALKVGVFTPKAYTPKSPLRPLPSDSGSLHMFILTPTAINLSLTSKWAHACFDSDSGISNGSLTFLKLFLWLP

SEQ ID NO: 222834 - protein, 76 aa, Glycine max
  Coding DNA Sequence Number=SeqID_106056
MALARDFCRETTHGAIWFRIGSKVLEIPRCAHVQFLVPQNAWSMHVCEFSQGDVCDEWPRGSLPQEVQEGQGGRRN

SEQ ID NO: 222835 - protein, 180 aa, Glycine max
  Coding DNA Sequence Number=SeqID_106057
  Homolog annotation: Hit_ID=Q9FML3; Match level="QueryCoverage=36%, HitCoverage=22%, E-value=7e-17, Identity=54%"; Hit description =Arabidopsis thaliana genomic DNA, chromosome 5, P1 clone:MDC12
MSPLRALGKKREKISGRGRGKTYVNEAQRKKEKYLWVSTFVVRQPNSILRPAQTAFPPIVPPDPLALLGFSANTTARLLLHCWELDPAVIQVAREYFNLARLERDNQNRLFIYFGDALNATIPNISRASSSSMLSAVAPVPVSTAVMEPYNNVFSTLSLLEHTDLAVLLDNEAIYDNNGG

SEQ ID NO: 222836 - protein, 78 aa, Glycine max
  Coding DNA Sequence Number=SeqID_106058
MKKQARLPGADSLGKEQKALGNGRLPGAEFLGKTPIANQFARDFTPGKKTRGWPWQNPCLSPCLLTDASAHFSDALLY

SEQ ID NO: 222837 - protein, 453 aa, Glycine max
  Coding DNA Sequence Number=SeqID_106059
  Gene Ontology: Mol. function=protein serine/threonine kinase activity; Biological process=protein amino acid phosphorylation
  Homolog annotation: Hit_ID=Q49N12; Match level="QueryCoverage=95%, HitCoverage=41%, E-value=1e-116, Identity=52%"; Hit description =Putative receptor-like protein kinase 2
  Pfam annotation: Domain name=Pkinase_Tyr; Domain location=367-453; Score=-146.7; E_value=0.0018; Accession=PF07714.7; Description =Protein tyrosine kinase
MSFCQGFPWLSPWEICQGYLTGNFLTGLVPEWTSANNKNFYPSINHLFLCHRNLFGSFSRTNLGPVSCENSTRTCTKNVQSLYINCGGKQVVVGGITYDEDMDSAGPAVYKQSRNNWAFSNTGQFMDNNTLAIQGKLPAYTTENETRLYMTDAELYKNARISPMSLTYYGFCLENGDYTVKLHFAEIMFTADSTYSCLGRRLFDVYIQGRRVLKDFNIANEAQGVGKELIKEFPAHVSTNDLEIRFYWAGKGTTNIPYKSVYGPLISAISVKYAQYDSTGDMSAGVIVAIVAALVIVVILIVLGILWWMGFIGDCCWNASVEGLLSTSNFLPHFGRKKHLLMKELRDLDLQTGVFTLHQIKVATNNFDISNKIGEGGFGPVYKGILSNSKPIAVKQLSPKSEQGTREFINEIGMISALQHPNLVKLYGCCVEGDQLLLVYEYMENNSLAHALF

SEQ ID NO: 222838 - protein, 309 aa, Glycine max
  Coding DNA Sequence Number=SeqID_106060
MPLRGRIASTPMVKFDPDVVLEFYANAWPTEEGGWDMRQFLGDPLVLEEGQEFEYSQRRNWADGFDEEAIAQLLCIPGQDFARTAAGRWVRIMHTSMTTLTQMWMTLLLSNVLPSDHNSDLPQQKCSAGVCHLPGTLLDPDKSSRALGFPTLIMGLCQSFGVPVTPSKVIRPPITRAFIEKYCTSRQAQGDAPQAADAPPPPHQVDPAGSFGMERYLQHLVRQQAANHKGQVQIHECLYQLSLSRQCQGFAPFTCPTLNQFRAEVAWPGEWPEAQAGEPPAEAPGDAEEARMDEEMTNLLGFLGGSGAT

SEQ ID NO: 222839 - protein, 282 aa, Glycine max
  Coding DNA Sequence Number=SeqID_106061
  Gene Ontology: Mol. function=RNA binding
  Homolog annotation: Hit_ID=Q1SE18; Match level="QueryCoverage=78%, HitCoverage=22%, E-value=2e-92, Identity=79%"; Hit description =Nucleic acid binding NABP
MGFSILVSERIRFRVTSSLDMQMGGGSKVDLQTLDEGMQPLANGTIEDTLQSELEKILQEQRNRQFINREREYNISRSGSAPPTVEGSLSAFGSLRNSDFGLINDRRSNNNGLLTEDEIRSHPAYLSYYYSHESINPRLPPPLLSKEDWRVAQRFHGGGSSSIEGFGDWRKNVAPNGDSSSLFSMQPGFSVQQVENDLMELSKASGWNVSRQGSSQMLDRHMGGLTRMSGAGLGGRRTSYTDILQFWLNSVVNIPEHTGDVSFVESGGTSSFPFIMFIYAVY

SEQ ID NO: 222840 - protein, 514 aa, Glycine max
  Coding DNA Sequence Number=SeqID_106062
  Gene Ontology: Mol. function=RNA binding; Cellular component=voltage -gated potassium channel complex; Biological process=potassium ion transport
  Homolog annotation: Hit_ID=Q1SE18; Match level="QueryCoverage=98%, HitCoverage=53%, E-value=0.0, Identity=64%"; Hit description=Nucleic acid binding NABP
  Pfam annotation: Domain name=NABP; Domain location=1-184; Score= -94.9; E_value=0.00075; Accession=PF07990.3; Description=Nucleic acid binding protein NABP
  Pfam annotation: Domain name=PUF; Domain location=185-219; Score =41.0; E_value=4.1e-09; Accession=PF00806.9; Description=Pumilio -family RNA binding repeat
  Pfam annotation: Domain name=PUF; Domain location=221-255; Score =43.0; E_value=1e-09; Accession=PF00806.9; Description=Pumilio-family RNA binding repeat
  Pfam annotation: Domain name=PUF; Domain location=257-291; Score =35.1; E_value=2.4e-07; Accession=PF00806.9; Description=Pumilio -family RNA binding repeat
  Pfam annotation: Domain name=PUF; Domain location=293-327; Score =35.4; E_value=2e-07; Accession=PF00806.9; Description=Pumilio-family RNA binding repeat
  Pfam annotation: Domain name=PUF; Domain location=329-363; Score =44.2; E_value=4.5e-10; Accession=PF00806.9; Description=Pumilio -family RNA binding repeat
  Pfam annotation: Domain name=PUF; Domain location=366-400; Score =34.5; E_value=3.8e-07; Accession=PF00806.9; Description=Pumilio -family RNA binding repeat
  Pfam annotation: Domain name=PUF; Domain location=402-436; Score =33.1; E_value=9.4e-07; Accession=PF00806.9; Description=Pumilio -family RNA binding repeat
  Pfam annotation: Domain name=PUF; Domain location=444-478; Score =27.4; E_value=5e-05; Accession=PF00806.9; Description=Pumilio-family RNA binding repeat
  Pfam module annotation: Pfam domain module=NABP::PUF::PUF::PUF::PUF::P UF::PUF::PUF::PUF; Domain location=1-184::185-219::221-255::257 -291::293-327::329-363::366-400::402-436::444-478
MRLRRDGQSLDAQGNHVGPELHSTTLDPRFIQCLQQSADYSMQGMSSSGHPLQMRNFPDASHGDLEGLRKAYLETLLTQQKQQYELPLLSKSGLTNGFYGSQPYGLGMPYSGKQIANSTLPSLGSGNPLFENERISRLNSMMRSSMGGSGGSWHADICNNIEGRFAPSLLDEFKNKKTRPFELPDIIDHVVQFSTDQYGSRFIQQKLETASVEEKTKIFPEIIPHARALMTDVFGNYVIQKFFEHGTESQRKELANQLTGHVLPLSLQMYGCRVIQKALEVVDVDQQGQMVSELNGAIMKCVRDQNGNHVIQKCIECVPQDKIQFIVSSFYGQVVALSTHPYGCRVIQRVLEHCDDQNTQQIIMEEIMQSVSTLAQDQYGNYVIQHIVEHGKPHERTTIISKLAGQIVKMSQQKFASNVIEKCLAFGSPEERQILVNEMLGTSDENEPLQAMMKDPFGNYVVQKVLETCDDRSLELILSRIKVHLNALKRYTYGKHIVSRVEKLITTGGEECKD

SEQ ID NO: 222841 - protein, 369 aa, Glycine max
  Coding DNA Sequence Number=SeqID_106063
  Homolog annotation: Hit_ID=Q10AA4; Match level="QueryCoverage=30%, HitCoverage=35%, E-value=2e-39, Identity=67%"; Hit description=OTU -like cysteine protease family protein, putative, expressed
  Pfam annotation: Domain name=OTU; Domain location=263-369; Score =62.3; E_value=1.5e-15; Accession=PF02338.9; Description=OTU-like cysteine protease
MIPDLSQVEYVTEGFCQHQYVDSDEAVAQAYQEELWQLDSMVASGISNFENEGMQGSVYTQDWPQSSNGNDNLGNESCQNSVGESYNMKEVGNYGPTPSERKNDVHENDVCGSSSGSVEVPATATSDDFWDSLEISDESLDGEVGKRLNQMVPIPKITAICGYSSVCTIAGQAMRPVPSSDSLCSASFLEFPVRQNCWVKRRRGAADGGKRLGFSFLGEGHVPKTNEKIPSDDEEISDHQRLLDRNLVFLRLQLYDLIECKVQGDGNCQFRSLSDQLYRSPDHHKFVREQIIQQLKYYPDLYAGYVPLAYSDYLRNMSKSGEWGDHVTLQAAADWPYPCICKEAISGFELMTNRSPRHKFTVVPGLSLK

SEQ ID NO: 222842 - protein, 356 aa, Glycine max
  Coding DNA Sequence Number=SeqID_106064
  Gene Ontology: Mol. function=protein kinase activity; Cellular component=integral to membrane; Biological process=protein amino acid phosphorylation
  Homolog annotation: Hit_ID=Q1SE30; Match level="QueryCoverage=90%, HitCoverage=73%, E-value=1e-124, Identity=69%"; Hit description =Protein kinase
  Pfam annotation: Domain name=Pkinase; Domain location=22-329; Score= -7.2; E_value=3.9e-08; Accession=PF00069.15; Description=Protein kinase domain
  Pfam annotation: Domain name=Pkinase_Tyr; Domain location=44-327; Score=-51.0; E_value=2.4e-09; Accession=PF07714.7; Description =Protein tyrosine kinase
  Pfam module annotation: Pfam domain module=Pkinase::Pkinase_Tyr; Domain location=22-329::44-327
VKNLCASLSSLKDTLPENPNIYHFSEISAATANFSAPRLSSSSWRCVIRHREVVVSRRDFRRQIDIPELSRRLALICRSHHSSLLKLLGASVSGAVIFLVNEFVPGASLADCLRNRRNPSFTDLNTWISRMQIASDVAHGLDYIHNFSGSGSDSGSGSGSGFVHKHIKSSSIVITEENLRARICHFGVSGLCGEAVAGDGDPSGGRTVRIEGRRGYMAPEFQISGVATKKSDVYAFGVVVLELLSGEEAVKFEFNDDGGYRRISVVETAKIAAEENGGVRKWVDTRLRDSFPVNVAERMIRVGLECVGDDPNERPDMGWVSDEVSKLYLDLVGPTYMIADMKEKVKFEALKSANWA

SEQ ID NO: 222843 - protein, 182 aa, Glycine max
  Coding DNA Sequence Number=SeqID_106065
  Homolog annotation: Hit_ID=Q1SE29; Match level="QueryCoverage=88%, HitCoverage=80%, E-value=9e-57, Identity=67%"; Hit description=Zinc finger, Zim17-type
  Pfam annotation: Domain name=zf-DNL; Domain location=98-162; Score =96.1; E_value=1e-25; Accession=PF05180.3; Description=DNL zinc finger
MKNYLILSLSLIYSLVCEKSWYSPTSAILNSYGFHQRGVMTHTNPIKPVCEDVENNEADTLKSSPNPDEVATSISVNETSSVKFSAKSSLKTSSRHDLAMVFTCKVCETRSIKTACRESYEKGVVVARCGGCNNLHLIADHLGWFGEPGSVEDFLAARGEEVKRGSVDTLNLTLEDLAGRKP

SEQ ID NO: 222844 - protein, 356 aa, Glycine max
  Coding DNA Sequence Number=SeqID_106066
  Gene Ontology: Mol. function=ATP binding; Cellular component =membrane; Biological process=anion transport
  Homolog annotation: Hit_ID=Q1SE25; Match level="QueryCoverage=99%, HitCoverage=99%, E-value=1e-160, Identity=79%"; Hit description =Anion-transporting ATPase
  Pfam annotation: Domain name=ArsA_ATPase; Domain location=80-356; Score=181.6; E_value=2e-51; Accession=PF02374.6; Description=Anion -transporting ATPase
  Pfam annotation: Domain name=CbiA; Domain location=82-332; Score= -15.8; E_value=0.0015; Accession=PF01656.13; Description=Cobyrinic acid a,c-diamide synthase
  Pfam module annotation: Pfam domain module=ArsA_ATPase::CbiA; Domain location=80-356::82-332
  Subcellular localization annotation: CTP_CleavageSite=46; ConfidenceScore=5.57e-01
MACRSVLSSSPHITNSMAIKEGVLSFAPNPPLLLRLPKAVTFLSFSASTKPPTKSFQVRSVAGTTEAASGFDEMISGTKRKYYMLGGKGGVGKTSCAASLAVKFANNGHPTLVVSTDPAHSLSDSFAQDLTGGALVPVEGPDYPLFALEINPEKFREEFQNAAQKKGGTGVKDFMDGMGLGMIADQGHTLRLLSLPDFLDASIGKILKLRQKIASATSAIKSVFGQEETRQNAADKLEKLRERMIKVRELFRDTDSTEFVIVTIPTVMAVSESSRLSASLKKENVPVKRLIVNQILPPSTSDCKFCAMKRKDQMRALDIVQNDPELSSLSMIQAPLVDVEIRGVPALKFLGDIIWK

SEQ ID NO: 222845 - protein, 1159 aa, Glycine max
  Coding DNA Sequence Number=SeqID_106067
  Gene Ontology: Mol. function=nucleoside-triphosphatase activity; Cellular component=integral to membrane; Biological process=transport
  Homolog annotation: Hit_ID=Q1SE23; Match level="QueryCoverage=98%, HitCoverage=99%, E-value=0.0, Identity=73%"; Hit description =Lipocalin; AAA ATPase
  Pfam annotation: Domain name=ABC2_membrane; Domain location=909-1106; Score=-14.4; E_value=0.0085; Accession=PF01061.14; Description=ABC-2 type transporter
  Pfam annotation: Domain name=ABC_tran; Domain location=579-769; Score= 129.5; E_value=9.4e-36; Accession=PF00005.17; Description=ABC transporter
  Pfam module annotation: Pfam domain module=ABC2_membrane::ABC_tran; Domain location=909-1106::579-769
MCRWSTNPMHLRVHIIVVLSLFLGMIQLQCQQVNDYDQIDSPAVLPLLTQLVYSQISNLTSILSQEISKESTFCVKDPDADWNQAFNFSSDLGFLASCIKKTRGDIAKRLCTAAEVKFFLNSLLEKSVSANYLKPNKNCNLTSWVPGCEPGWACSVPSSQKVDLKNSKEIPARTLNCQACCEGFFCPHGITCMIRNFCDEESISLKHIGINCNNASDCLDVSQKLSLMLLFCLIVLEACPLGSYCPLATLNKTTGVCEPYLYQLPPMQTNHTCGGANVWADVSSSSEIFCSAGSYCPTTTKRIPCSSGHYCRMGSTSEKRCFKLSSCNSNTATQNMHAYGIMLIAALSTLLLIIYNCSDQVLTTRERRVAKSREAAARSARKTANARQRWRFAKDATKKGAMGLQAQLSRTFKKDAANLEKVKILNQATSEVGVELLSHSRPTTSSMVATSSMATKEKGKEPSSLMLMIHEIENDPDINDNLHTEIETRDTGVRENVPKGKQPHTHSQIFKYAYSQLEKEKAQQKENKKLTFSGVIKMATNTDKRKRPLMEISFKDLTLTLKAQNKHILRYVTGKIKPGRITAVMGPSGAGKTTFLSALAGKALGCLVTGSILINGRNESIHSFKKITGFVPQDDVVHGNLTVEENLWFSAQCRLSADLSKPEKVLVVERVIEFLGLQSVRNALVGTVEKRGISGGQRKRVNVGLEMVMEPSLLILDEPTSGLDSASSQLLLRALRREALEGVNICMVVHQPSYALFKMFDDLILLGKGGLTVYQGSAKKVEEYFSGVGINVPERINPPDYFIDILEGITTPGGGSGLSYKELPVRWMLHNGYPIPLDMRQNAVQFDMSQSVNSANEIDSNGSGHVGKTFAGELWQDMRNNVELKREKIRLNFFKSKDLSNRETPGVFKQYKYFLIRVGKQRLREARIQAIDYLILLLAGACLGSLSKSSDQTFGAAGYTHTVIGVSLLCKIAALRSFSLDKLHYWRESDSGMSSLAYFLSKDTIDHFNTLIKPVVYLSMFYFFTNPRSTFADNYVVLLCLVYCVTGIAYALSIFFEPGAAQLWSVLLPVVLTLIATQPKDSKVLKNIANLCYSKWALQALVVANAERYQGVWLITRCGSLLKTGYNLHDWSLCISILILMGVICRAIAFFCMVTFRKK

SEQ ID NO: 222846 - protein, 76 aa, Glycine max
  Coding DNA Sequence Number=SeqID_106068
MVRKQIHSQSLLVINGGVGMVKALVEINDIDNGDDVADVLHGADDYAMNGTFVERKGKSLWFQAFTNSMFGGGKER

SEQ ID NO: 222847 - protein, 70 aa, Glycine max
  Coding DNA Sequence Number=SeqID_106069
MKKPPISKPLQILLLLCSSNTKADLARWDGHASARGGLESELLPQRTDLNRDADYMLSNVATSSASAILW

SEQ ID NO: 222848 - protein, 179 aa, Glycine max
  Coding DNA Sequence Number=SeqID_106070
MGSESYPEVHQNSKAFFSSSSPILLEPLAHGSGDWSLPREDCITPRHSTRFFTDMIDSRSFDDNKDDVKKLKSQDHFMITKMMTFKNEFKIESRTLQGSRANLISRIKNQDSRFKYSRIIKIKIQDSKIQESREDLIKISIKKFFKTLSSTRSFHKIIPKEFYSLVIDYQIIVIDYKWF

SEQ ID NO: 222849 - protein, 127 aa, Glycine max
  Coding DNA Sequence Number=SeqID_106071
MRGFATNVYLRKTLEKPKRGKVDKGVALAPTYPQAKGHFGEVAARPGELKLSAEAMSSPRRVGFFTMKLFGGPSEPEGSLGENTPTMWDQHRLKGALKPSVFTPKAYTPKSSSGPLPPDSGPNQKIF

SEQ ID NO: 222850 - protein, 390 aa, Glycine max
  Coding DNA Sequence Number=SeqID_106072
  Gene Ontology: Mol. function=nucleic acid binding; Cellular component= chromatin; Biological process=DNA integration
  Homolog annotation: Hit_ID=Q1S7C5; Match level="QueryCoverage=96%, HitCoverage=30%, E-value=2e-95, Identity=50%"; Hit description =Integrase, catalytic region
MSKRKSGGTGNKYKARLVAKGFLRQLGYDYNETLSLVSEPITIRILLTLAITQKWSLKQLDVNNALINRILEEDIYMTQPPGFEISNKHIVCKLHKAIYGLKQAPRSWFERLKATLLHFHFKSSKCDPSFFIYIDSNNIVVYMLVYVDDIIITENNSSFFKSLVTKLNSEFSLKDLRSLDYFLGIEVKSQPNGVPILTQSKFIRDLLSKTKMDEANPISSPSCKLTKSRYESFPNPTHYRRSIYGAAIFFGSNLVSWWSEKQIVVSRSSTKVECCSLALETSKDLAAAKVTRIKFLLPKLHIAHATLSIFCDNISTVAFAHNPMIHPRTKPMESNLFFVKEKVLAKKVQVIHVLAINKKADILTKALTPSNFSTYKFKLRRVERHFANHS

SEQ ID NO: 222851 - protein, 182 aa, Glycine max
  Coding DNA Sequence Number=SeqID_106073
  Gene Ontology: Mol. function=RNA-directed DNA polymerase activity; Biological process=RNA-dependent DNA replication
  Homolog annotation: Hit_ID=Q1T5Q8; Match level="QueryCoverage=47%, HitCoverage=12%, E-value=6e-13, Identity=46%"; Hit description=RNA -directed DNA polymerase
MLRGVHVGGCWIEEPSRVKEEIKLFFKRRFEEVKWERDLGWMGSNSSLFIGQQLNDLSVARFEEDEVRAAMWDCSDLLRILDELHDNGVFSKGSNASFLTLIPKSPIDEFIPQREHRQGNPLASFLFNIVVEGLTGLMREAQEKNLFQGFMVGRNNVDINLLQYADDMVFFGKTILVNVKAI

SEQ ID NO: 222852 - protein, 289 aa, Glycine max
  Coding DNA Sequence Number=SeqID_106074
  Homolog annotation: Hit_ID=UPI000034F09D; Match level="QueryCoverage =84%, HitCoverage=12%, E-value=9e-75, Identity=64%"; Hit description =SPK1 (SPIKE1)
  Subcellular localization annotation: CTP_CleavageSite=80; ConfidenceScore=5.68e-01
MLHLRQRRDAVAPATTRWRNTVVLRLQQPPPPPRPKRSRRIWSSGRTSTSSSIATPRIGSRMRTSTDTTTPSERRRFITRYMKAPTLTLKPLLHSVTSGILRHNTINSMWVEMRLAGARQTKGDDISEDDIPSTSGRQFMEGADGDLLPSDVPKHIGQSLLPAYEPAFDWENERALIFGQRIPETPVLHGMKISVKVQSLQFQAGLAEPFYGTMCLYNRERREKLSEDFYFHVLPTEMQNAKITCEPRAVFYLDAPSASVCLLIQLEKHATEEGGVTASVYSRKDPPRI

SEQ ID NO: 222853 - protein, 383 aa, Glycine max
  Coding DNA Sequence Number=SeqID_106075
  Gene Ontology: Mol. function=RNA-directed DNA polymerase activity; Cellular component=membrane; Biological process=RNA-dependent DNA replication
  Homolog annotation: Hit_ID=Q1RXD8; Match level="QueryCoverage=86%, HitCoverage=34%, E-value=2e-33, Identity=28%"; Hit description=RNA -directed DNA polymerase
MVCKLKKAIYGLKQAPRAWYERLTKWKLGKWKWKLFQNQGELWVRVIESKYGRWRNLNEARSANNESTWWRDLKIVAQHPQQDQLLNSSIVWKVGRGDKFKFWEDTWTGEDNKLLEKYPRLYSISVQQNYFILQMRDFKDSGWEWDFKWRRPLFDNEIDMAVSFLQELEGNRIRSHRADQWVWVADPSGQYTVRSAYNVLREDLLQEDQDGEFKELWKVKVPSKVAVFAWRLLKDRLPTRDNLRRKHVELQDFMCPFCRTIEESASHLFFHCSKVFPIWCEMLSWVNLVGVFPHHPRHHFLQHIYGAFEGIQLDRWKGWWLALTWTIWKHRNSIVFSNSAFNTNKVVDDAVFLLWTWLKNLEKDFTTHYNQWSSNLTEGFFRR

SEQ ID NO: 222854 - protein, 408 aa, Glycine max
  Coding DNA Sequence Number=SeqID_106076
  Gene Ontology: Mol. function=RNA-directed DNA polymerase activity; Cellular component=nucleus; Biological process=RNA-dependent DNA replication
  Homolog annotation: Hit_ID=Q1S7B8; Match level="QueryCoverage=61%, HitCoverage=37%, E-value=2e-46, Identity=39%"; Hit description=RNA -directed DNA polymerase
MPFIIDKRQSAFIEGRHLLHSAVIANEVVEEARRGQKLCIVFKVDYEKAYDSVSWDFLLYLLRRMGFHSKWIRWMEGCLKSASISVFVNGSPSHEFIPQRGLRQGDPLAPFLFNIVAEALNGLVREAIGKNLYRGFSVGSNNVDISILQVPKKVVDKLVRIQRKFLWGGALDHTLAWVKWDIVCLPKDKGGLGIKDVNTFNLALLAKWKWHLFQHQGQLWARVASHHLEHGEALQRSTVWRVGCGDKIKLWEDDCIGDSGALATKYPRLRSLFDNEIDVAIAFLKDMEIQQIQPESTYIAMREAPLEVIEDTAYAELWKMKAINSLKNVDSTALLQFLHPILNMLLHLIGNGGETLQESVDDAERNHFLVNYVDCAFDDFGGRQPPVYPGLSTVWGSLARSKVLASSL

SEQ ID NO: 222855 - protein, 101 aa, Glycine max
  Coding DNA Sequence Number=SeqID_106077
MPSGKRTRTIRNCICKRSIIKTPFTELETEFEEDALKTELETEFEEDALKTGSETSEEMIRELVKSINTNQPLKQDLFRDLRFDQAKLRNKLKKHKLSPQN

SEQ ID NO: 222856 - protein, 116 aa, Glycine max
  Coding DNA Sequence Number=SeqID_106078
  Gene Ontology: Mol. function=DNA binding; Cellular component =mitochondrion; Biological process=DNA integration
  Homolog annotation: Hit_ID=Q1T4S3; Match level="QueryCoverage=82%, HitCoverage=6%, E-value=7e-31, Identity=64%"; Hit description=Zinc finger, CCHC-type
MVQLSLFQFLLLMLLSIGWLVVGALQYITVTRPKPNYSVNKVCQFMSEPMEEHWKAVKCILRYLKGTIDYGLSLKSASQREAYTLEAFCDTDWRMDMVDRRSISGGCILFGPNPVS

SEQ ID NO: 222857 - protein, 232 aa, Glycine max
  Coding DNA Sequence Number=SeqID_106079
MGGKDLWFEFKKWGDVMKRQMKGMETNRVNKDHQHKEAAAIEKLVERETKRAIHVPYHGEIEPKSKAWIQDGLDYVLGDSVTRMGCGKHHKDRKGEMVSYVEDLQRLDRARVLIKTSWPPTINHTITASINGVDYVVMIVEELCYNYLRCNCNIGSYVESFEEISSDGSEVGLDLMLEEAQVLQKLKKAELDLNKLEKGDNEQLNDEEEKLRKQLQEELWVAAISIESIARQ

SEQ ID NO: 222858 - protein, 113 aa, Glycine max
  Coding DNA Sequence Number=SeqID_106080
MAAYALVVLYRLRSEINLPIMRELVPHYLQDAGRERLDYLEDGKSVFRLRLRLCSSLYPINERIRDFFLEYDRHTLRTSPPWGSELLETHVDIILYMLLLMVSQFSTDSSGVQ

SEQ ID NO: 222859 - protein, 92 aa, Glycine max
  Coding DNA Sequence Number=SeqID_106081
MEGEIDIAAKFMEGVAVQVQQDSWSWEADPSGSYTVGSTFKLLSRHVTDENKDGVFIDLWKLKVPKFAMRMRPTFSSAVLKPCHYGGNDYLC

SEQ ID NO: 222860 - protein, 146 aa, Glycine max
  Coding DNA Sequence Number=SeqID_106082
MKLAKYRLKAQVEKDKAPEWRRMKAQVEKDEGPEAETLSRLLITYQGNPCGVYPDLSSFTGSGVIQTSVACINDPLLLRFTSSGIRASALDTTYQGNPCGVYLDLSSFTGSGVYPDLSSFTGSGVYPDLSSFTGSGVIQIFVACIK

SEQ ID NO: 222861 - protein, 107 aa, Glycine max
  Coding DNA Sequence Number=SeqID_106083
  Subcellular localization annotation: CTP_CleavageSite=3; ConfidenceScore=5.15e-01
MASASHNPPPPPSLPMNNEVPMNDVNSSNTTLEAQANDAAQASNNAAQSIDSNYNNGSNHFLNNGREGGRNFSCGGRGRGRGYGDGRGGRGGRYSNIQCQICHKIGS

SEQ ID NO: 222862 - protein, 62 aa, Glycine max
  Coding DNA Sequence Number=SeqID_106084
  Homolog annotation: Hit_ID=Q1SU13; Match level="QueryCoverage=71%, HitCoverage=9%, E-value=2e-10, Identity=71%"; Hit description=IMP dehydrogenase/GMP reductase
MYLYINIRNERNNDGLKRKILELDLVEAWVRTRMNNKACGFGSNGNFEGRHNADEEVVRVVA

SEQ ID NO: 222863 - protein, 107 aa, Glycine max
  Coding DNA Sequence Number=SeqID_106085
MVVVVATMLAMKIEVVMTTKVRCDDSGGSGMVVVVEVGQQWLHEGRVAMVAHGMMMVARLWWRDGGVVKMVLRWWWCPEEKNRKRIGEVKRSMGVAEKREKRGVGVE

SEQ ID NO: 222864 - protein, 109 aa, Glycine max
  Coding DNA Sequence Number=SeqID_106086
  Gene Ontology: Mol. function=RNA-directed DNA polymerase activity; Biological process=RNA-dependent DNA replication
  Homolog annotation: Hit_ID=Q1SYP9; Match level="QueryCoverage=80%, HitCoverage=9%, E-value=3e-16, Identity=47%"; Hit description=Myb, DNA-binding
MEVFLLYMLGRLGFHEKWIGSNEVVEEAKRKKKCTLFGYEKVYDSVNWEFFTCLRLSFHEKWIRWIRGCLVSSKVLVLVNGNLTSEFEVTKGLRQGDPIALFLFNIVAN

SEQ ID NO: 222865 - protein, 179 aa, Glycine max
  Coding DNA Sequence Number=SeqID_106087
EDTQVVIRMHSFAIRPTQSPENEPVDTQRLTSSFAETSSKDGESDDMRRYRTSSDTQVVIRTYSFAIRKTQSPTSEPTDTQILTSSSDDMRRYPSETNAIIYTFCQLEENEPVDTQRLTSSFAETSSKDGESDDMRRYPTSSDTQVVIRTYSFAIRKTQSPAEISEWLSIQTISVNPDP

SEQ ID NO: 222866 - protein, 35 aa, Glycine max
  Coding DNA Sequence Number=SeqID_106088
MHGIMLGKHEGVWVESAYWTLKRLLQNSLGDLCSV

SEQ ID NO: 222867 - protein, 129 aa, Glycine max
  Coding DNA Sequence Number=SeqID_106089
  Subcellular localization annotation: CTP_CleavageSite=63; ConfidenceScore=5.10e-01
MTYHKRLDRLTSNFVCWIPYVELLTSPCSSSALKVLTHIVIVGPQSRSSSSLVLCPPSSLRPRWSSFVQQALLHVTTLSRVYGASTILRRIVSLITLPDPPVLLVHSIAMPQPPAPAAADADMPRHAMI

SEQ ID NO: 222868 - protein, 97 aa, Glycine max
  Coding DNA Sequence Number=SeqID_106090
  Homolog annotation: Hit_ID=Q2R2A3; Match level="QueryCoverage=68%, HitCoverage=5%, E-value=2e-13, Identity=76%"; Hit description =Ubiquitin carboxyl-terminal hydrolase family protein, expressed
MAWVLLDVEFCPKNETLADVKLRIQKKLQVPDVEFSKPCFNYFLGVELSREGIYMVLGSNILDWNTMTVLQKGPMQSTRVPMHSEAKGSFHKMLQSR

SEQ ID NO: 222869 - protein, 383 aa, Glycine max
  Coding DNA Sequence Number=SeqID_106091
  Gene Ontology: Mol. function=nucleic acid binding; Cellular component= proton-transporting two-sector ATPase complex; Biological process=DNA integration
  Homolog annotation: Hit_ID=Q1RWN2; Match level="QueryCoverage=100%, HitCoverage=29%, E-value=1e-140, Identity=64%"; Hit description =Peptidase S8 and S53, subtilisin, kexin, sedolisin; Integrase, catalytic region; Zinc finger, CCHC-type
  Pfam annotation: Domain name=zf-CCHC; Domain location=147-164; Score =27.2; E_value=3.2e-05; Accession=PF00098.13; Description=Zinc knuckle
MRQKFQGSTKVKRAQLQALRREFEILSMKDNETVNEYFSRTLAIANKMTTHGESMGQTKVVEKVLRSMTSKFNYVVCSIEESNDVTALTIDELQSSLLVHEQRMQYTLEKDEEQALKVSSAGRGGNRGRGRNGGRGRGRGRQSKELVECYRCHKLGHYQNECPTWEEGANYAEFNEKEEVLLMAQESSKEEVYDESNVEMWFLDSGCSNHMVGRKDWLFNFDDSFRDFVKLGDNSKMPVMGKGNLKLYIGGLVQVVTEVYYLPGLMNNLLSIGQLQQKNLTIVFSNDLCKVYHENRGLIMSTQMSVNRMYIIHASVLTPMCMKVANMSQSQLWHHRYGHLNYKGLRVLAKKEMVKGLPEIEETEEICEDCIIGKQHRDSIPKT

SEQ ID NO: 222870 - protein, 34 aa, Glycine max
  Coding DNA Sequence Number=SeqID_106092
MAYPTSIMGAAALVSNQNCPRIMRLMWRCSSTDL

SEQ ID NO: 222871 - protein, 95 aa, Glycine max
  Coding DNA Sequence Number=SeqID_106093
  Gene Ontology: Mol. function=chlorophyllase activity; Biological process=chlorophyll catabolic process
  Homolog annotation: Hit_ID=O22527; Match level="QueryCoverage=63%, HitCoverage=20%, E-value=2e-10, Identity=56%"; Hit description =Chlorophyllase-1
MAQRTQPVLVITDVFQISNGKQLNVAYLSARLTKQHFLIFSQSLDLNIPVAVIGTGLGPEKANFLFPPCAPHGENHKELKPTCAHFVATKYGHAG

SEQ ID NO: 222872 - protein, 97 aa, Glycine max
  Coding DNA Sequence Number=SeqID_106094
MAGAGDNGGVYHQLDGSQRLLLDVMTTQMQCLLNRNNEELYRRIERLEQQLNPNAGRPYGGNTRVSDGSNRIEGQDRIEGVKLNVSSFKSRSDLDTY

SEQ ID NO: 222873 - protein, 81 aa, Glycine max
  Coding DNA Sequence Number=SeqID_106095
MDRGVWEAIVNGPYIPKVVVDGKEVEKDFSYWTPKKIGMLNIMLKQKCVELNQMYVNNGTEDNIEVHEILFEGLRVGSVCS

SEQ ID NO: 222874 - protein, 115 aa, Glycine max
  Coding DNA Sequence Number=SeqID_106096
MPQPHHHQADYGYNPQKESLKRLTLTSHTSMGRTIGHITSQCSTKKTMIMRSQDIYSSQDEATTSPSSSESEEAKGEESSEEIYPQEEGKPLMVKKECKEVSVSSKRLAKKGGIL

SEQ ID NO: 222875 - protein, 97 aa, Glycine max
  Coding DNA Sequence Number=SeqID_106097
  Subcellular localization annotation: CTP_CleavageSite=61; ConfidenceScore=5.19e-01
VSATKNRNTELKEPKINTNHGSRTKTRNLNHRKSNLASIASLIGGNSKKIMLTTFSTRHVRRYMEKNEETTMEENVKLKINGGLRSTYLKLLCSDTT

SEQ ID NO: 222876 - protein, 60 aa, Glycine max
  Coding DNA Sequence Number=SeqID_106098
MCSEIGLRTQQQCNLTLSKSVFCVGFILGTHIPSEFYKKQNYPIEARSATVPWAEPRSIK

SEQ ID NO: 222877 - protein, 111 aa, Glycine max
  Coding DNA Sequence Number=SeqID_106099
  Homolog annotation: Hit_ID=Q9ZU41; Match level="QueryCoverage=41%, HitCoverage=12%, E-value=2e-09, Identity=60%"; Hit description =Predicted by genscan and genefinder
MASYKLKGSIWTQNGVSESQVVNSLLQAADNWLRLLQVNHPDYQFFVSHGTYNRFFCVTRYNVGSKSVYLMNTLLLGERKLDATVQYSTTSKVRMELLAVSVACLVRINLR

SEQ ID NO: 222878 - protein, 479 aa, Glycine max
  Coding DNA Sequence Number=SeqID_106100
  Gene Ontology: Mol. function=protein serine/threonine kinase activity; Cellular component=nucleus; Biological process=protein amino acid phosphorylation
  Homolog annotation: Hit_ID=Q9C6K9; Match level="QueryCoverage=91%, HitCoverage=45%, E-value=7e-49, Identity=47%"; Hit description=Wall -associated kinase, putative
  Pfam annotation: Domain name=Pkinase; Domain location=22-289; Score= -7.0; E_value=3.8e-08; Accession=PF00069.15; Description=Protein kinase domain
  Pfam annotation: Domain name=Pkinase_Tyr; Domain location=28-289; Score=-6.4; E_value=4.4e-12; Accession=PF07714.7; Description =Protein tyrosine kinase
  Pfam annotation: Domain name=RIO1; Domain location=320-465; Score= -96.8; E_value=0.079; Accession=PF01163.12; Description=RIO1 family
  Pfam module annotation: Pfam domain module=Pkinase::Pkinase _Tyr::RIO1; Domain location=22-289::28-289::320-465
MVKSGGREWRENGEELGRLLQNEWVPPLGCALGKLEDGREITIQCFNEDKHHMLQQFINETVILNYLPHKNIVSIYGCASHHKESLLVHEYLSNGNLSAHLQSEIAENSTQPWLTRLDIAIDIANALDYLHYYGIIHRNVKSSNILLDVNFCAKLANLHLSQKLPDGVPVYATHVTGDIIGTCGYMDSELAYGRLSVKNGVYSFGVVLCELLSLTLAKCWVLNEEDNLATLLSRKIENQALVELLDPRLGFDTNLKIKWMMTAITELALLCMKCPQELRPNMEQVLETLDGIKQGRHETNSIKEATNNFDTCLGKGGYGTVYYGKLKDGQEVAIKCFHDESETEKTIKQFMKETEILILLHHQNLVSLYVRTSRHSNKHKIVYEYISNGTLSKHLHESSRGKLPWHTRLNIAIETATALVYLHDSAIIHCDVKGSNILLDDNFTFKVADFGFSRSLPDYVTHVSTVPVGTGGSCSFTLA

SEQ ID NO: 222879 - protein, 631 aa, Glycine max
  Coding DNA Sequence Number=SeqID_106101
  Gene Ontology: Mol. function=protein serine/threonine kinase activity; Cellular component=nucleus; Biological process=protein amino acid phosphorylation
  Homolog annotation: Hit_ID=Q9C9P0; Match level="QueryCoverage=89%, HitCoverage=22%, E-value=1e-67, Identity=47%"; Hit description =Protein kinase, putative
  Pfam annotation: Domain name=Pkinase; Domain location=346-617; Score =126.4; E_value=7.8e-35; Accession=PF00069.15; Description=Protein kinase domain
  Pfam annotation: Domain name=Pkinase; Domain location=43-312; Score =24.1; E_value=5.4e-10; Accession=PF00069.15; Description=Protein kinase domain
  Pfam annotation: Domain name=Pkinase_Tyr; Domain location=347-617; Score=109.7; E_value=8.5e-30; Accession=PF07714.7; Description =Protein tyrosine kinase
  Pfam annotation: Domain name=RIO1; Domain location=359-504; Score= -95.5; E_value=0.063; Accession=PF01163.12; Description=RIO1 family
  Pfam module annotation: Pfam domain module=Pkinase::Pkinase::Pkinase _Tyr::RIO1; Domain location=346-617::43-312::347-617::359-504
MEKFAILISHILPHLHPASQRSCNIRNYLMRLRRDIFVCCFTSTSSDTMQKEKHRKLEDGREITIQRFNGDQRYLLQQFINETIILNYLPHKNIVSIYGCASHHEESLLVTEYLSNGNLAAHLHSEKDEKITLPWLKRLDIAFDIANALNHLHNYGIIHRNVKSSNIFLDANFCAKVGNLLLSQKLPDGVPVHATHVTGDRAGSSGYMDPEYLTKGQLSVKNDVYSFGVVLCELLSSTLAKDWFLNEEDNIATVLSKKMENQALVELLDRRLGFDSNLKIKQVMTATAELAFMCMKCPQELRPNTEQVLEILNGIKPGRIETGSYSTKDISALKIFHNAELEEATNNFDNFLGKGGYGSVYYGKLKDGREVAVKCFHEENETEETIKQFMKETDILGLLHHQNLVSLYGRTSRNCDKPMLVYEYISNGTLTKHLHESSHGKLPWHTRLNIAIETAAALVFLHDSAIIHRDVKGSNILLDENFTVKVADFGFSRSLPDHATHVSTIPVGTRAYIDPDYYESGRVSDKSDVYSFGVVLFELISSIRPSSLEGTDDDTLAQYAKRKILNNQLNEVVDPSFRFGSDKNIMEMITAVAELAFQCVQCPKEFRPSMKQLLQTLQGIREGTWGFNQIT

SEQ ID NO: 222880 - protein, 300 aa, Glycine max
  Coding DNA Sequence Number=SeqID_106102
  Gene Ontology: Mol. function=protein kinase activity; Cellular component=nucleus; Biological process=protein amino acid phosphorylation
  Homolog annotation: Hit_ID=Q1RZG3; Match level="QueryCoverage=70%, HitCoverage=33%, E-value=2e-23, Identity=31%"; Hit description =Protein kinase
MALPLLPPLSSIINTLFFFTLFFPKYVWSDVEGYSACEPFSCGEIDNIRYPFWSSDHQQSYCGHPKFKLDCQQDNVTIDMMSQRFHVIDIDQTSKVLKMARLDLWDDPCTNEYSNVKLDSDFFNYTSNDDDYTLLYDCGPPVTYTSSVNIKGTISFSCPIDSGFRDAFFVSSTDVGNLKDLGCKHSINVSVLREAVKDALQVENVLEKGFEVGWIGVDEGQCDGCIKSGGRCGHNVSKDAFTCLCPNQQSYDEVCSKSQTSSPLAAPTPKPTPEQELSPPFGPKFQEKSPHAPSMYSSFS

SEQ ID NO: 222881 - protein, 50 aa, Glycine max
  Coding DNA Sequence Number=SeqID_106103
MGTCTQEAPQFKARPRTGVSINVENKDTVIEYGDVVHGICWKGVEVRILI

SEQ ID NO: 222882 - protein, 661 aa, Glycine max
  Coding DNA Sequence Number=SeqID_106104
  Gene Ontology: Mol. function=protein serine/threonine kinase activity; Cellular component=nucleus; Biological process=protein amino acid phosphorylation
  Homolog annotation: Hit_ID=UPI0000162DEA; Match level="QueryCoverage =92%, HitCoverage=95%, E-value=1e-171, Identity=52%"; Hit description= ATP binding / kinase/ protein kinase/ protein serine/threonine kinase/ protein-tyrosine kinase
  Pfam annotation: Domain name=Pkinase; Domain location=337-609; Score =157.2; E_value=4.1e-44; Accession=PF00069.15; Description=Protein kinase domain
  Pfam annotation: Domain name=Pkinase_Tyr; Domain location=337-609; Score=128.7; E_value=1.6e-35; Accession=PF07714.7; Description =Protein tyrosine kinase
  Pfam module annotation: Pfam domain module=Pkinase::Pkinase_Tyr; Domain location=337-609::337-609
MILQISFHYNKPQLCIITTILFLATTVLSSNPKFEACSPRSCGTGPPIKYPFWIPYEQEPFCGYPHFGITCMDKNPILRTSNYEFLVKDIYYSNSSFTVANIDVYEDKCPVPLYNYTFDQTPFTYSSENWNLSFFYNCSTEPIDYPTYEVDCAKNATHFSFAVFHKEALEHKNYSLNECQFMVNTPLNINESVNISSLLRMNYTEILKMGFVLNWTAPDCHYCEKSGGRCGFDGNQFLCFCKDKSYLKSCGSDPRKLRLIIGVVSGVVGALGMGIIGFLCYRRKKNRYAISYIQSRSLSSDPSSKDTEKGVQSFTQSFVPGVPLFLYDELEEATNYFDSSKELGEGGFGTVYFGKLRDGRSVAVKRLYENNFKRVAQFMNEIKILAKLVHPNLVKLYGCTSRHSRELLLVYEYIPNGTVADHLHGQRSKPGKLPWHIRMKIAVETASALNFLHHKDVIHRDVKTNNILLDSDFCVKVADFGLSRLFPDHVTHVSTAPQGTPGYVDPEYHQCYQLTKQSDVYSFGVVLVELISSLPAVDITRHRHEINLSNMAINKIHNQALHELVDPTLGFESDFKVRKMINAVAELAFQCLQSSKEMRPSMEEVVETLKDIQSDGKHKSQPEVMDITSTADDVVLLKDDPPPPSPDSNAVSKSTTPNASG

SEQ ID NO: 222883 - protein, 60 aa, Glycine max
  Coding DNA Sequence Number=SeqID_106105
MKRRQEKKRNCVESKFENIDEDKTKVQAIDNQLFAFLHDEEVGASPYHITSQKLNPHKGK

SEQ ID NO: 222884 - protein, 134 aa, Glycine max
  Coding DNA Sequence Number=SeqID_106106
  Homolog annotation: Hit_ID=Q1SZP3; Match level="QueryCoverage=66%, HitCoverage=73%, E-value=7e-07, Identity=33%"; Hit description=Actin- binding, actinin-type
  Pfam annotation: Domain name=Self-incomp_S1; Domain location=36-132; Score=-22.3; E_value=0.044; Accession=PF05938.2; Description=Plant self-incompatibility protein S1
MVFPHPFFTFFLLFLSLYCLSTSTLNARPYSHKPHTVVDILNDLPNNPKVQLELRCDEGSSFYLKLGHRHNHTLTADQDSECTAMWLPWFTTWDAYHAVRDKGHHSVYWSVRKDGFYHSWDGSNWKLLEDWYSE

SEQ ID NO: 222885 - protein, 443 aa, Glycine max
  Coding DNA Sequence Number=SeqID_106107
  Gene Ontology: Mol. function=mannosyl-oligosaccharide 1,2-alpha -mannosidase activity; Cellular component=membrane; Biological process=metabolic process
  Homolog annotation: Hit_ID=Q93Y37; Match level="QueryCoverage=99%, HitCoverage=68%, E-value=1e-161, Identity=67%"; Hit description =Endoplasmic reticulum alpha-mannosidase, putative
  Pfam annotation: Domain name=Glyco_hydro_47; Domain location=146-443; Score=102.3; E_value=1.4e-27; Accession=PF01532.11; Description =Glycosyl hydrolase family 47
  Subcellular localization annotation: CTP_CleavageSite=29; ConfidenceScore=5.42e-01
MSKSLPYSTKDVHYDNAKFRPRSFFKVVTQNLLTSNLRRDCGSCSTGKFLFLLLIFGVAYLMLAHASSSGVVSDDQAIVNRKSFYANSSIVNGAGKIKRLWRRPPRLPPRFSPDETGTGNGNGHVLGNPDVVRSMWIARQKKVKEAFIHAWSGYKKFAMGYDELMPLSQHGIDGLGGLGATVVDALDTAMIMGLDEVVAEAGSWVEEQLSERISKKGQVNLFETTIRVLGGLLSAYHLSGGEKGTNLTHAGPKPAVYLEIAKDLADRLLSAFTASPTAIPFSDVILHDKSAHPAPGGLSSTSEVSTLQLEFNYLSQISGDQKYSLEAMKVMEHMKTLPKIEGLVPIYISPHSGEFSGENIRLGSRGDSYYEYLIKVWLQSGASSNTNTSFLYEMYKEAMNGVRHLLVRKSIPNGLVFVGELPYGSNSGFSPKMDHLIIYLGLQ

SEQ ID NO: 222886 - protein, 544 aa, Glycine max
  Coding DNA Sequence Number=SeqID_106108
  Gene Ontology: Mol. function=RNA-directed DNA polymerase activity; Cellular component=integral to membrane; Biological process=RNA -dependent DNA replication
  Homolog annotation: Hit_ID=Q2QT48; Match level="QueryCoverage=76%, HitCoverage=56%, E-value=1e-141, Identity=53%"; Hit description =Intron maturase, type II family protein, putative, expressed
  Pfam annotation: Domain name=Intron_maturas2; Domain location=320 -469; Score=-24.9; E_value=0.0023; Accession=PF01348.12; Description =Type II intron maturase
MSFRKIVEHFQYRRGTLSSFSRPLATHSPQPAEQNHDPHSLMKQDPIEICTSLWVKTFSSSNLTGFLSNFDLWLLAYQRSCAHATGTFPPRNAVHTPVLHSLPPLQTQAPRRYPIRQALLPGPRRSGDSVDDPRTGYLWFLKGDLTEFLDRVDPNVVMRYLEKGTRDKKILGLIKSALDGENEKLRDVSLKEENVDELRRLKKRRATKKRILKDNEPKPDPYWLRTFFSFSPEEAAKVPDYGHCGILSPLLANVCLNELDHWMEEKIVEFFRPWHFLIGIRGPREDAAELRKKIVAFCESVFGVRLDNSKLEIEHVTRGIQFLDHIICRRQCIREFRRLQLVKGDKDPEPLPCNPMLYSGQAHTNFQMNKFLETMADWYGYADNRKKVVGFCAYVVRSTLAKLYAARYRLKSRAKVYGIASRNLSRPLRESSNNSAPEYSDLLRMGLVDAIEGVQFSHMSLIPSCDYTPFPRNWIPDERVLHEYIKLENPKFFCELLRSVEQKGLSLPQDEISQMVCDYKTLGVRYFQSNKDKEIKSELEEITE

SEQ ID NO: 222887 - protein, 197 aa, Glycine max
  Coding DNA Sequence Number=SeqID_106109
  Gene Ontology: Mol. function=drug transporter activity; Cellular component=membrane; Biological process=multidrug transport
  Homolog annotation: Hit_ID=Q1SD91; Match level="QueryCoverage=99%, HitCoverage=45%, E-value=2e-86, Identity=70%"; Hit description=Multi antimicrobial extrusion protein MatE
  Pfam annotation: Domain name=MatE; Domain location=1-113; Score=10.9; E_value=0.00049; Accession=PF01554.9; Description=MatE
MASALSTLCGQAYGAKEYVMMGVHLQRSWIVMSITSLFLLPVFIFTRPILMLLGQDENIAEVAGNISLWSIPMIFAFIASFTCQNFLQSQSKNTIISFLAAFSIVIHLFLSWLLTIQFKLEIPGAMTSTNLAFWIPNIGQLIFITCGWCSDTWKGFSFLAFKDLWPVVKLSLSSGIMLCLNINGWEMMISLGFMAAA

SEQ ID NO: 222888 - protein, 404 aa, Glycine max
  Coding DNA Sequence Number=SeqID_106110
  Homolog annotation: Hit_ID=Q9FL37; Match level="QueryCoverage=21%, HitCoverage=65%, E-value=3e-20, Identity=51%"; Hit description =Arabidopsis thaliana genomic DNA, chromosome 5, P1 clone:MPL12
  Pfam annotation: Domain name=DUF538; Domain location=299-401; Score =7.3; E_value=5.1e-06; Accession=PF04398.3; Description=Protein of unknown function, DUF538
  Pfam annotation: Domain name=DUF616; Domain location=2-210; Score =174.6; E_value=2.4e-49; Accession=PF04765.4; Description=Protein of unknown function (DUF616)
  Pfam module annotation: Pfam domain module=DUF538::DUF616; Domain location=299-401::2-210
MQGNADSFGGNLNTLLRFSYFDHQNDSTEVPCGFLNNFPISESDRIAMEKCGSVVVTIVTLKGLEHQGLGSINSREYKIGVWRIVKTWAISKHPYYVHTMEEAMASARWKKLLDVNALKEQMETYCENGLQPWSPNKQPYASDVPDSALILRRHGLGSNLFSCLIFNELEAFNPRDQLPFAFVRDHMEPNLKLNMFEVEVFEQVAVEYRHNLKSSDGTIVKKLSSSGRTKRAHPDLLVTVIEKISSSQLKSTSLVPKRSRDTHLGTIDNCYKEYFNFTTKASITSNLKYIFTRCCSLPAKIEHHREEAEIYEGEALCMQKSRLLLDEILLPRGLLPLENIVEMGYNRPTGFVWLKQRNKKEHRFATIGRTVSYETEVTAFVEEHRMRVKTKELFKFDLYLNQIL

SEQ ID NO: 222889 - protein, 56 aa, Glycine max
  Coding DNA Sequence Number=SeqID_106111
MTYKNIQGHQQLCGSKGSLNCKHHEPHDEGSSIKSMLYKLLVNLRSGVFMLQIDGF

SEQ ID NO: 222890 - protein, 60 aa, Glycine max
  Coding DNA Sequence Number=SeqID_106112
MGAWTLAIIHQMLGIDEAREHWQEFIVVRDPAFRREIDFEQFKRHVERLRQANARQNAEI

SEQ ID NO: 222891 - protein, 124 aa, Glycine max
  Coding DNA Sequence Number=SeqID_106113
MKKHEILSQVLFEGASAVSGADGYILELQSTMDFSKKRWIKTWALAPRAWAQAWTWARPWAPYRAWAWAIFLTHKSKEKAGTKDGTRYFSILRIDKISHILPTTWSKRKITKLFYSFSSTKGEE

SEQ ID NO: 222892 - protein, 68 aa, Glycine max
  Coding DNA Sequence Number=SeqID_106114
ELLRDKYQEDKVEELLRDKYQEDKVEEFNALGKGKPNRKLVVTLKCLCKSPKSKYMLFTTCTYKSGLT

SEQ ID NO: 222893 - protein, 67 aa, Glycine max
  Coding DNA Sequence Number=SeqID_106115
MWGGTSPVGSDLELQSQRKNHFKMGFPFADGIRVLAFVICSPLRRFCCPLLRGKDEDSLHGPRFKVA

SEQ ID NO: 222894 - protein, 85 aa, Glycine max
  Coding DNA Sequence Number=SeqID_106116
MSPSTSVPNHDSPLFLRQEKQKPQPTKLIAATDGHNDNTVDANDRIVLLFVARLKGVIRILEGTIFKYAEVQEILERRGKGENLE

SEQ ID NO: 222895 - protein, 57 aa, Glycine max
  Coding DNA Sequence Number=SeqID_106117
MEWIRKKKVASLWRAEWKGFDSKSECVWMENDDDNEGVRVGLKAVTKEIHSHTLEGN

SEQ ID NO: 222896 - protein, 369 aa, Glycine max
  Coding DNA Sequence Number=SeqID_106118
  Gene Ontology: Mol. function=transferase activity, transferring acyl groups, acyl groups converted into alkyl on transfer; Cellular component=intracellular; Biological process=branched chain family amino acid biosynthetic process
  Homolog annotation: Hit_ID=Q39891; Match level="QueryCoverage=99%, HitCoverage=66%, E-value=1e-148, Identity=70%"; Hit description =Probable 2-isopropylmalate synthase
  Pfam annotation: Domain name=HMGL-like; Domain location=36-313; Score= 361.5; E_value=1.4e-105; Accession=PF00682.9; Description=HMGL-like
MATKTSTNGTHHSLPEYIPNRIPDPHYVRILDTTLRDGEQAPGAAMTSDQKLQIARQLAKLGVDVIEGGFPSASQEDFNAVKMIAQEVGNNCDADGYVPVIAALCRCNERDITRAWEALKYAKRPRLMPFIAVSPIHMEYKLNKTKEEVLQIATDMIKFARGLGCTDIQFCSEDAARSDREFLYQILEEVIKAGATTLGIGDTVGITMPFEIRELVAGIKANVPGAENVIISIHCHNDLGHATANTIEAARAGAMQLEVTINGIGERAGNASLEEVVMALKCRGDHVLGGLYTGINTRHLLKTSKMVEEFSGMYLQPHKAVVGDNAFLHESGVHQAGLLKHRGTYEILSPEDIGHEKSNGVNMVLGKLR

SEQ ID NO: 222897 - protein, 76 aa, Glycine max
  Coding DNA Sequence Number=SeqID_106119
MIHFNDEWINKEEYKVELEHPQGEDDGGIDNAEFVGNVGGSSSDQTLNALDLDNLVLFEPDVDDAEECRSKYDMKF

SEQ ID NO: 222898 - protein, 399 aa, Glycine max
  Coding DNA Sequence Number=SeqID_106120
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q8L837; Match level="QueryCoverage=86%, HitCoverage=87%, E-value=1e-126, Identity=62%"; Hit description=Beta- 1,3-glucanase-like protein
  Pfam annotation: Domain name=Glyco_hydro_17; Domain location=32-349; Score=341.1; E_value=1.9e-99; Accession=PF00332.9; Description =Glycosyl hydrolases family 17
MVTFFRNLAFSYAFLAIFLSAGIGVFLGVESFGINYGQVANNLPQPDKVLELLSTLNLTKTRIYDTNPQILTSFSNSNIEIIVTVENEILSQLDDPQQALQWVNSRIVPYLPETKITGVQVGNEVFTDDDITLIEHLVPAVVNIHNALAQLGYSNIKVSTPSSLAVLDQSYPPSAGSFKSEISGIMYQFLNFLSSSKSPFWINAYPYFAYKDEPNGISLNYVMFNPNAGMVDPYTNLHYDNMLYAMVDAVSFAIAKMGFKGIEVRVSETGWPSKGDANEVGATPMNAATYNRNLLRRQMAGEGTPLNPRMRLEVYLFALFNEDLKPGPTSERNYGLFRPDESMTYNVGLSALATSSATTSSSSSISLASSGTKIKVTPWEYKSLVNWMFVFVLISTLYG

SEQ ID NO: 222899 - protein, 369 aa, Glycine max
  Coding DNA Sequence Number=SeqID_106121
  Gene Ontology: Mol. function=diacylglycerol kinase activity; Cellular component=intracellular; Biological process=protein kinase C activation
  Homolog annotation: Hit_ID=Q9FJY7; Match level="QueryCoverage=87%, HitCoverage=63%, E-value=1e-46, Identity=29%"; Hit description =Selenium-binding protein-like
  Pfam annotation: Domain name=PPR; Domain location=108-142; Score=4.6; E_value=2.1; Accession=PF01535.11; Description=PPR repeat
  Pfam annotation: Domain name=PPR; Domain location=250-284; Score =41.9; E_value=2.1e-09; Accession=PF01535.11; Description=PPR repeat
  Pfam annotation: Domain name=PPR; Domain location=285-318; Score =10.5; E_value=0.43; Accession=PF01535.11; Description=PPR repeat
  Pfam annotation: Domain name=PPR; Domain location=321-355; Score=9.8; E_value=0.51; Accession=PF01535.11; Description=PPR repeat
  Pfam module annotation: Pfam domain module=PPR::PPR::PPR::PPR; Domain location=108-142::250-284::285-318::321-355
MLIHELILAKAHCKNILFGRTLIAPQPHSRIEIMQNHLRNPSNSHHMVKTGLCNAPFTLSKLLAASILDMDYVASIFSYIQTPNLFMFNTMLRGYSVSNFPNKAISATVNNALLHFHCVCKRIEDALKLFDEFPEGNDLVSWNTLMGGCVSVSQPCLCCHCLESFVSCWELCKKWNQGMKPNSSILSGLLSTCPASGSVQVVHHVASFVEEQKLKLDVVLGTALVDVYAKCGFLDEAMDIFERMEDKDVKSWTAMISGLGVHGQPNNVIRLFNRMEKEGFRPNEVTFLAILTACSHGGLVVEGTEMFKHMVQEYRFSPQVKHYGCLIDLLGRAGMLLEAHKLIDSLPIKGDKTAWQHCFLLAESMEMLN

SEQ ID NO: 222900 - protein, 128 aa, Glycine max
  Coding DNA Sequence Number=SeqID_106122
  Homolog annotation: Hit_ID=Q1RXS1; Match level="QueryCoverage=47%, HitCoverage=16%, E-value=2e-07, Identity=40%"; Hit description=Zinc finger, CCHC-type; Peptidase aspartic, catalytic
  Pfam annotation: Domain name=zf-CCHC; Domain location=58-75; Score =22.8; E_value=0.00017; Accession=PF00098.13; Description=Zinc knuckle
QQLKRKLTSKSYGSHTYPKKDQGQGILGAAPSKTKDDKGKTIEKQPRKASMQEKTSSIKCFKCLGRGHITSQCPTKKTMIMRSQDIYSSQDEVNTSLLQPTLQRGDNARLTGESSKEGKCAESPPTFI

SEQ ID NO: 222901 - protein, 230 aa, Glycine max
  Coding DNA Sequence Number=SeqID_106123
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=2e-34, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSQSLAFSKGWTLGGLHTLNFRGLHALTFRRLHVLAFRGLHVLAIRGQHVLAFRRLHVLAIRGLHVLAIRGLQALAYRGLHVLLAFRGLHVFSFRGLHVLAFRGLHALAFRGLHVLAFRGLHALTFRGLHVLTFRGLHALPIRGLHILAIRGLHTLAFRGLHILTFRGLHILTFRGLHVLTFRGLHVLTFRGLHVLAVRRLHVLAFSGLHVLTFRGLHALASRGSWSCQL

SEQ ID NO: 222902 - protein, 514 aa, Glycine max
  Coding DNA Sequence Number=SeqID_106124
GALGDKAADVSRAALSAVKAVDYEETKRKSLATASGLVNNAKDMGSRVADSVREFDFDEAKESASSFSKRSIDKLHKYFRTTFEVDKSTFEMVNDIRRRLPTPVSSIDDIYDQCRKEAARRAIAAFMLGGILDQQSQAKYDKLTDSYDFYRKDRQKYMGDYGGMAPKAGTPDGAVFENGYNPDEPLIFARDKANTVTVDHVTSRQEIFQNTLLKIGLTDEQFGAVVNDPRNLKYMHRSLNSQKNGHDMYDWLANNSRPHPTDDGKLIVTIKGSKTEHVVDKKAVDAAYAESKEAIRAGQIQAVKEISTTVALTGATMAAQQVVGLIVVETIDVFMDELKRVKLVSGDGLLNELAQSKERISAALNQRFEERNLWDRAKSLGLEAGVAGALSVIPQILISLIVKMPAFVYAIIRESTLSVVRCIRVLVSNVFDKLAALQVIMLGPASAVAGVYVERVISQGISSVPLLNRFNSQVSGILSGMMITAIPLAAIYTFEQNKNALVLKLRGHGDLPAC

SEQ ID NO: 222903 - protein, 125 aa, Glycine max
  Coding DNA Sequence Number=SeqID_106125
MHKALRANAPLPYPQMVTLFLHHFQIPLDDEPFVQVKRSFAIGVGAVTSFGYRKDRDGQWMKKDTLPPQDERTPSPPPQRDDSSALMNEVLSELRGLCTYVGARFDSLDGRFEGMDTRITSLKRM

SEQ ID NO: 222904 - protein, 403 aa, Glycine max
  Coding DNA Sequence Number=SeqID_106126
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=4e-49, Identity=29%"; Hit description= UPI00006A17C9 related cluster
MSSSNNPRTKLGYHRVHALDNKRLHALAFRAPHIHAFRGLHVLAFRGLHILSFRGPHALTFRGLHVLAFRGLHVLAFRGLHVLAFKGLHILAIRGLHVLAIRGLHVLEFRGLHVLVFRGLHALTFRGLHVLTFRGLHALVFRGPQILAFRGLHVVTFIGLDVLGFRGLHTLAFRGLDALTIRRLPALALLSEKNNILAIRGLHVLAFRGLHALEFRGLHVLAFRGLHILAFRGLHVIAFRGLHVLAFRGLHVLAFRGIHALAFRGQHVLAFKGLHVHAIRGLYILAFRGLHVLAFRGLHVLAFRGLHVLAFRGLHILAFRGLHALSTNRLHALAFRGPHILTFRGLHVLAFRGIHILAFRGMRVLAIRGLDVLEFRGLHGFAFRGLHVLALPSEYYTCSPSED

SEQ ID NO: 222905 - protein, 263 aa, Glycine max
  Coding DNA Sequence Number=SeqID_106127
  Homolog annotation: Hit_ID=Q9FGR0; Match level="QueryCoverage=37%, HitCoverage=7%, E-value=5e-19, Identity=50%"; Hit description =Probable cleavage and polyadenylation specificity factor 160 kDa subunit
MTMSISHSLILFIFTMNNELSISFQLTIPPIQFKQIAIKNKKVIERGSEQRTSTSSLAIKWTEGGPVVAHEFEGGPGDAVEEGAATGVSGGLGRLVLLEADGVDFEDVGGSDDEVGEGANVVAGAGGPLDVDVVELERDEVRAGVGEEPDGAIVDVDGALHHLRSSVSATKEKREYESVRVRGSAEWRPAGRKVQELGFAKGSCLEVNKDPLIDYLEHLIDYIVLELFPDVGKNTLIDYLDNLIDYFVESINYLVDLIDYKRL

SEQ ID NO: 222906 - protein, 49 aa, Glycine max
  Coding DNA Sequence Number=SeqID_106128
MGSHFPPPFVIPNPSCLLPYTMVQEAKWSTGSKNPNLDPITFGRSLFWK

SEQ ID NO: 222907 - protein, 100 aa, Glycine max
  Coding DNA Sequence Number=SeqID_106129
  Pfam annotation: Domain name=VQ; Domain location=7-37; Score=39.6; E _value=1.1e-08; Accession=PF05678.4; Description=VQ motif
MEAPKIVQIETRYVQTDAANFRDVVQSLTGKNSSTDWIGQNAESSYSSKRGFSHEPKKLVGATATASNGTKEATTLLPSSYSMQMNNVSSFKNFDGFIWR

SEQ ID NO: 222908 - protein, 118 aa, Glycine max
  Coding DNA Sequence Number=SeqID_106130
MACHRPFESSAWIRVESSSGEHETFVISYTIMCPRICGGCTCCIGLRRRHPGPPVRGRAWQILGDSSARKTRWSWKKLHNPSITHGDGVGVEGLYVECPVSSLKSQFSCGRQDIVDVQ

SEQ ID NO: 222909 - protein, 685 aa, Glycine max
  Coding DNA Sequence Number=SeqID_106131
  Gene Ontology: Mol. function=nucleic acid binding; Cellular component= chromatin; Biological process=DNA integration
  Pfam annotation: Domain name=zf-CCHC; Domain location=24-41; Score =11.5; E_value=0.013; Accession=PF00098.13; Description=Zinc knuckle
  Pfam module annotation: Pfam domain module=RVT_2::zf-CCHC; Domain location=368-547::24-41
MGADLLIPEEEVADLVMYIEEAEIMCQVCYKFGHSAADCYHKFNPNYVAQQYNQNHFGNQNRNYSYQRPNSEPQNNNSQSQHNAQAPQAYLANNLMNEVPTSGNKHAFLGNDQGLPIISTSSTVFQFPFAFNVDSSILLRGALKQAGLYVFSNLLNSFVKSIVGVVAASVHASMPLSYWDHAFHTEVYLINRLPSAYHKNTIPYEMIFNKYPDYSFLKGTIFLPRDAVFNESSFPFSVAKPHVSSPPSSVPSQLLPLGVLPIPTAHPNPPSHSMESLESLSSLSQPVELNSPQLVPTEQATSSVLTNDESSPSALPSTPPPQPQNTHSMQTRPKSGIVRPRLHPTLLLITADPTSVKHALSSPEWKEAMQQEYIALMANNTWSLIPLPSGRKAIGCKWVFRVKQNPDGSLKSMVCKLKKAIYGLKQAPRAWYERLTKTLLTFGFVQSKCDPSLLVFKTDSECLYLLIYVDDIIITGSSPVLIQKLITKQNVVFALKQLENLDYFLGIEVKHLSNGSLLLSQAKYICDLLGKAKMVDAKPILTPLSSDLKLIKHGTTKLVLVPAADATLYQSVVGALQYITVTRLELSYSVNKVCQFMSKPVEEHWKDVKHILRYLKGTIDYGLSLKSAPQGEPYTLEAFCDAYWGMDMVDRRSISGGCIFFGPNPVSWWSKKQSSVARSTTEAEC

SEQ ID NO: 222910 - protein, 70 aa, Glycine max
  Coding DNA Sequence Number=SeqID_106132
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q9LSU0; Match level="QueryCoverage=74%, HitCoverage=21%, E-value=4e-11, Identity=60%"; Hit description =Proteasome subunit alpha type 3
MPHTILFGTSDSNTRSSIYGVHDEAKDKDFELEMSWVCDESNRQHEKVPDELLEEAKAAAKAALEEMDAD

SEQ ID NO: 222911 - protein, 58 aa, Glycine max
  Coding DNA Sequence Number=SeqID_106133
MWQYGYEAVMNVKKSHCMREKYNYWLGVIHGSIGNSEDGILNMLKPWFQLQLLRYVLV

SEQ ID NO: 222912 - protein, 155 aa, Glycine max
  Coding DNA Sequence Number=SeqID_106134
  Gene Ontology: Mol. function=RNA-directed DNA polymerase activity; Biological process=RNA-dependent DNA replication
MDGVQMVNMNGTSQPNWVAGVWLQNTSPLLLERFVKGIVLAFLLWWKPKLEEIKLRRFPKLIKGFIRSRSIYDCTCVTSEEASNLLNKSVWRQLCFESVYPQIQLGLFAESPSVNGKPAGYYFCKRGVRQGDALSPLLFCLVKEALSHQCPKDIY

SEQ ID NO: 222913 - protein, 367 aa, Glycine max
  Coding DNA Sequence Number=SeqID_106135
  Gene Ontology: Mol. function=protein binding; Biological process=red or far red light signaling pathway
  Homolog annotation: Hit_ID=Q69NY4; Match level="QueryCoverage=99%, HitCoverage=100%, E-value=1e-121, Identity=52%"; Hit description =Kelch repeat containing F-box protein family-like
  Pfam annotation: Domain name=F-box; Domain location=51-98; Score =39.2; E_value=1.5e-08; Accession=PF00646.23; Description=F-box domain
  Pfam annotation: Domain name=Kelch_1; Domain location=157-203; Score =46.4; E_value=9.7e-11; Accession=PF01344.15; Description=Kelch motif
  Pfam annotation: Domain name=Kelch_1; Domain location=205-251; Score =6.9; E_value=0.64; Accession=PF01344.15; Description=Kelch motif
  Pfam annotation: Domain name=Kelch_2; Domain location=157-203; Score =13.5; E_value=0.63; Accession=PF07646.5; Description=Kelch motif
  Pfam annotation: Domain name=Kelch_2; Domain location=205-251; Score =0.6; E_value=32; Accession=PF07646.5; Description=Kelch motif
  Pfam annotation: Domain name=Kelch_2; Domain location=254-294; Score =1.5; E_value=24; Accession=PF07646.5; Description=Kelch motif
  Pfam annotation: Domain name=Kelch_2; Domain location=307-355; Score =3.2; E_value=15; Accession=PF07646.5; Description=Kelch motif
  Pfam module annotation: Pfam domain module=F-box::Kelch_1::Kelch _1::Kelch_2::Kelch_2::Kelch_2::Kelch_2; Domain location=51-98::157 -203::205-251::157-203::205-251::254-294::307-355
MQRVRFSSQQAPVHKLGDPQMTLSPKFRLAVIQSALANPSPELELSLREEPLIPGLPDDVALNCLLRLPVQSHSSCRAVCKRWHMLLGNKERFFTNRKQFGLKDPWLFVFAYHKCTGKIQWQVLDLTHFSWHTIPAMPCKDKMQNNRWTVMNRMITARSFFASGVIDGMIYVAGGNSTDLYELDSAEVLDPFNGSWHPIAYMGTNMASYDAAVLNGKLLVTEGWLWPFYVSPRGQVYDPRTNNWENMAVGLREGWTGSSVVVYGHLFVVSELERMKLKVYEPENDSWEAIEGPPLPEQICKPFAVNACDCHIYVVGRNLLVAVGHITRLNPKESCKEKWNFSVRWHVIDAPESLSDLTPSSSQVLFA

SEQ ID NO: 222914 - protein, 157 aa, Glycine max
  Coding DNA Sequence Number=SeqID_106136
MEHANGGEAGENESQHGGEEARREETKGAEEEEVRWEANLKWKIVGCTANGGRRKRGRRKAFLKYIIFYFLNEGTLTASNGPYWLQPNPNTLLPALQIIGAFPNLSMSSSPTVKHVKQERTLWWPSGRWLFMKGNDDTQTLLEPMLKITNDVFLKSV

SEQ ID NO: 222915 - protein, 237 aa, Glycine max
  Coding DNA Sequence Number=SeqID_106137
  Pfam annotation: Domain name=zf-C2H2; Domain location=19-41; Score =16.4; E_value=0.1; Accession=PF00096.16; Description=Zinc finger, C2H2 type
MNTSSAFDKENAKGKEKCNCCSYCDRAFDNYEGLEDHKKMHEAEFKRLVNQSNPFHNSMDITKPIFGYGNVSMKTLYGGTTINPCVTKGNCYGDNNRGDHNSLFMTSSYSFTRTNNASLVASLPNKEIDPCVMKGNCYGGNSRGDHNSLFMPSNYSFTSSNNASLVAPIPTKGIPCVTKGNCYGGNSQGDRNSLFIPPNYSFTRTNNESLVATIPTKGTIPFSQSHTKCKFWYKSSI

SEQ ID NO: 222916 - protein, 263 aa, Glycine max
  Coding DNA Sequence Number=SeqID_106138
  Gene Ontology: Mol. function=chromatin binding; Cellular component =chromatin; Biological process=chromatin assembly or disassembly
  Homolog annotation: Hit_ID=Q1SAV4; Match level="QueryCoverage=58%, HitCoverage=39%, E-value=4e-45, Identity=58%"; Hit description =Integrase, catalytic region
  Pfam annotation: Domain name=Chromo; Domain location=102-152; Score =27.7; E_value=4.1e-05; Accession=PF00385.14; Description='chromo' (CHRromatin Organisation MOdifier
MKAAADKHRRDVSFEVGDWVYVRLRPYRQTSLAPTYSKLAKRFYGPFRITARIGPVAYRLLLPASSRIHPAFHVSLLKPHQGSFPASPATLPEQSTDNNPLIHPIAILDCKMDSSSTPPVRRVLVQWDGLPPEEASWESWDELSVLHNLADKVVFDEGGVDSNTATDQHLDTGRPKRECIEEHLSFSITPLSPSSSLGPYQLVRPAFLPSAMPEHHTRQVTTDKLEEAVKTLSQDNSTLNNKIDTIHASLAAKIEALFDRFAA

SEQ ID NO: 222917 - protein, 92 aa, Glycine max
  Coding DNA Sequence Number=SeqID_106139
MSNRYLVLPQILVYMDMLGSWNIKANDPGENLTISISVHHPEHGNYFTASLKAKKLCSSPESDHAVFFWLMPHKVAVWIYWHTMISFLWQAI

SEQ ID NO: 222918 - protein, 64 aa, Glycine max
  Coding DNA Sequence Number=SeqID_106140
  Gene Ontology: Cellular component=integral to membrane
  Homolog annotation: Hit_ID=Q9FFX0; Match level="QueryCoverage=84%, HitCoverage=12%, E-value=8e-13, Identity=61%"; Hit description =Arabidopsis thaliana genomic DNA, chromosome 5, P1 clone:MBB18
GPVFAIIGAWLMYQIQNKHVIASDASENLFQKAVIMTALIFILSHFGPIDEWYSIHYSENAVYS

SEQ ID NO: 222919 - protein, 629 aa, Glycine max
  Coding DNA Sequence Number=SeqID_106141
  Pfam annotation: Domain name=DDT; Domain location=332-393; Score=9.5; E_value=0.059; Accession=PF02791.7; Description=DDT domain
MGRMQKRCSSWVIGHVQNVETFATAVFAAKASGFKSVSEMLVSKTAESNDLELNKVNKVLLSKETTKEKKQKCVNNLSSGKVPVSTAVSPMKQIASEKELVVVLSGEIGKENSSDGKLDPVTSQKTSTKKSKKTKREELKEISNENNVGSAGKKKSLKRPKICKEVPSEEAKGKVNDDTKVCNGVSKKKKVDSNHDTAHVSMDSPEAQAANGLLLFGKVAKGNPFSEVQTQVHRNHGTVFGDPANDSIGPAVTLAPKHYLFNSKHPDMKHMLGDNWNNTVLVDGNAGAKFQVGIATFPNVGMNLAMQKIEEEIPFPPGTELTEILDIELPPEDIGNALQLLEFCRVFGKALDLKKGEADAILRELVRKQNLRRGQNTLVVQFQIRVLTLILTDSGNESPSLTTSNGNNSWLKPLEDLITKSNHILKDFPLDWLQEGVSGYSNLDLSKKLTLLNFLCDEALATDKLRSCIEDKNSRHVEEVKEAKTRIAAAKEKEKGLRQKLQNETVKAVLSNATPLKMEKHDALLKKMKSEVAQAHAEVLELKGTIPKVKHSSDAMRIEPEFLDNNGQVFWNKFSKRKQYADIKIQDETATAPYEKWFVYGPEKKDEADKYISSRAKRLSHKVVYMLSQ

SEQ ID NO: 222920 - protein, 472 aa, Glycine max
  Coding DNA Sequence Number=SeqID_106142
  Gene Ontology: Mol. function=protein binding; Cellular component =anchored to membrane; Biological process=protein amino acid phosphorylation
  Homolog annotation: Hit_ID=Q1SBD8; Match level="QueryCoverage=76%, HitCoverage=77%, E-value=3e-54, Identity=36%"; Hit description =Unnamed protein product; contains similarity to elicitor-inducible receptor EIR gene_id:T5M7.12
  Pfam annotation: Domain name=LRR_1; Domain location=109-132; Score =10.1; E_value=3.7; Accession=PF00560.23; Description=Leucine Rich Repeat
  Pfam annotation: Domain name=LRR_1; Domain location=134-156; Score =17.0; E_value=0.066; Accession=PF00560.23; Description=Leucine Rich Repeat
  Pfam annotation: Domain name=LRR_1; Domain location=158-180; Score =19.1; E_value=0.016; Accession=PF00560.23; Description=Leucine Rich Repeat
  Pfam annotation: Domain name=LRR_1; Domain location=182-204; Score =11.4; E_value=2.1; Accession=PF00560.23; Description=Leucine Rich Repeat
  Pfam annotation: Domain name=LRR_1; Domain location=206-228; Score =14.8; E_value=0.32; Accession=PF00560.23; Description=Leucine Rich Repeat
  Pfam annotation: Domain name=LRR_1; Domain location=230-252; Score =14.7; E_value=0.34; Accession=PF00560.23; Description=Leucine Rich Repeat
  Pfam annotation: Domain name=LRR_1; Domain location=254-276; Score =5.1; E_value=32; Accession=PF00560.23; Description=Leucine Rich Repeat
  Pfam annotation: Domain name=LRR_1; Domain location=278-300; Score =12.3; E_value=1.4; Accession=PF00560.23; Description=Leucine Rich Repeat
  Pfam annotation: Domain name=LRR_1; Domain location=302-324; Score =15.9; E_value=0.15; Accession=PF00560.23; Description=Leucine Rich Repeat
  Pfam annotation: Domain name=LRR_1; Domain location=326-351; Score =11.0; E_value=2.5; Accession=PF00560.23; Description=Leucine Rich Repeat
  Pfam annotation: Domain name=LRR_1; Domain location=82-107; Score =4.9; E_value=35; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =109-132::134-156::158-180::182-204::206-228::230-252::254-276::278 -300::302-324::326-351::82-107
MVMQEEELLGLFEVMHTLVDDPDWAQAHPQPCTDTPWPGIECEVSNEPQIFHVTKIHIGPDILSPPCKSSAYLSQSLLKLTYLKTLSIFNCFVSSPVNLPSTLFGPFSTLEHLALQSNPTLSGEIPPSLGAVASLRVLSLSQNSFQGSIPRQIGGLVSLEQLDLSYNNFSGQIPKEIGGLKSIAILDLSWNEIEGNLPSSLGQHQLLQKMDLSSNMLTGKIPPDLGNLKRLVLLDLSHNCIGGPIPEALSNLELLEYFLIDDNPIKSEIPHFIGNLSKLKSVSFSGCGLIGSIPNSFSSLKNLTALSLDNNSLSGSVPPKLALLPNLDQLNISHNMLNGVLQLPDEFIGKLGKRLDVRGNTELCISNKPKKKNLSSYLEISSCVNMKPRNGKSYAKGPPEDPAGIKPSLYRSNISNSSSSSSWLDLQPLERESGRNAALSVSDINEHAATTLVAANTKKMYTSELVLVERIL

SEQ ID NO: 222921 - protein, 159 aa, Glycine max
  Coding DNA Sequence Number=SeqID_106143
MLDKQGVVGLAKPTDRPDHDVDDPLFLMTLTIPQLFLKPLHMTETSMRAGNVDVAHWQMIIILPKENVVIWFCSLHNRPDNYLKGIINRSVLFVNTFALALVRNINILIVQQASIFVFNGALKGLNDTPQSKSKVAARWIVVKCNRQKGSTKCGYYVMH

SEQ ID NO: 222922 - protein, 422 aa, Glycine max
  Coding DNA Sequence Number=SeqID_106144
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q9ZPL9; Match level="QueryCoverage=88%, HitCoverage=100%, E-value=1e-115, Identity=62%"; Hit description =Nodule-enhanced protein phosphatase type 2C
  Pfam annotation: Domain name=PP2C; Domain location=151-408; Score =232.4; E_value=9.6e-67; Accession=PF00481.12; Description=Protein phosphatase 2C
  Subcellular localization annotation: CTP_CleavageSite=23; ConfidenceScore=5.20e-01
MVIYGPNQRRNPASENTCPPTSRNSTKTKITESNLCHATSLHAKTIMKTPKRHSPPPNSSLRVESDSGEIVTRFKNGRRRRIKIKRMKYTCQTKIRVRNDAGAGGVSQLLAVDSEGEKREIHENVEISLSLASSSSEEEERLSSKQNDGVLSYGSASVIGSRKEMEDAVSEEIGFAAKCDFFAVYDGHGGAQVAEACRERLYRLVAEEMERSASHVEWDWRGVMEGCFRKMDCEVAGNAAVRTVGSTAVVAVVAAAEVVVANCGDCRAVLGRGGEAVDLSSDHKPDRPDELIRIEEAGGRVINWNGQRVLGVLATSRSIGDQYLRPYVISKPEVTVTKRSSKDEFLILASDGLWDVMSSEVACQVVRKCFHGQIRRVCDGVGNHQNRATEAAGLLAEIALAKGSRDNTSVIVVELRGSVTTD

SEQ ID NO: 222923 - protein, 34 aa, Glycine max
  Coding DNA Sequence Number=SeqID_106145
MAYFSPSVVLDYWEKQFISFGKTTRLSMAPVKRL

SEQ ID NO: 222924 - protein, 156 aa, Glycine max
  Coding DNA Sequence Number=SeqID_106146
METTAAGATSNSLYGDFEPYRRWHTEEGQQTLEESGTVASCNAVSVREGPFPARASLGTGRACWFLRAWQRVNGGCRRRRAESTTKCSSLTHHEAHQGKDILLALLENPILVSASNCLKANSERKFSVSDVSSPERSKWVYIFQREYATIDPALVD

SEQ ID NO: 222925 - protein, 1034 aa, Glycine max
  Coding DNA Sequence Number=SeqID_106147
  Gene Ontology: Mol. function=RNA-directed DNA polymerase activity; Cellular component=chromatin; Biological process=chromatin assembly or disassembly
  Pfam annotation: Domain name=RVP_2; Domain location=289-413; Score= -41.4; E_value=0.0017; Accession=PF08284.2; Description=Retroviral aspartyl protease
  Pfam annotation: Domain name=zf-H2C2; Domain location=964-1005; Score= 19.9; E_value=0.00082; Accession=PF09337.1; Description=His(2)-Cys(2) zinc finger
  Pfam module annotation: Pfam domain module=RVP_2::RVT_1::Retrotrans _gag::zf-H2C2; Domain location=289-413::489-679::104-189::964-1005
MADHGTRKTTTDCLEEAITRLNNSQASLTDRYTDLSGKVDAILDHLRLHDSGRNATNTANHQNHPRNSVKIDIPRFDGRDPLGWIFKLTQLFQYHNTPEEERVTVASLYLDGTALSWYQWMFSNGLITSWESFLEALESRFAPTFYEDPKGALFKLTQKGTVNDYLTEFERLANRVKLRDKAVLAPRNPFPPKPSPPFNPNPTIKAKPPFVQRTPAEIAFRRERGLCYNCDEKWSTNHRCKGRVMLLIADEQTSTTEESILELEQTPPSAIDDKPEPSPDSTCSHISLHALSGLPSTDTFRLYGTIKNTQLTILIDSRSTHNFLQPRIAQFLKLPVQATRSLQVLVGNGSTLDCNQVCSETLVTVQGHQFLVSFHLLQINGADAVLGIDWLKKLGPITTDYTSGIMNFTHQGQEVSLAADATCGPEPVSATQLKQFLQTGSTSAFYQLSVQPVTRTETAPAQHPLPSIQHLLLRYNHLFQSPSRLPPPRQVVHRITLAPSTAPINVRPYRYPHFQKNEIEKQVSELLSAGLIRPSLSPYSSPVLLVKKKDGTWRLCVDYRALNTLDLRQGFHQILMHEEDVEKTAFRTHNGHFEYLVMPFELSNAPSTFQSAMNNLLQPFLRRFVTVFFDDILVYSSSLSSHLQHLETIFETLQHGEFYLKQSKCSFAQETIEYLGHVVSGKGVTPEPSKIQAMVQWPNPRTAKELRAFLGLTGFYRKFIKGYATIAAPLTSLLCKDAFTWTSESQEAFSQLKFAMTNAPVLALPNFSTPFVIETDASATAIGAVLTQSGHPLAYFSKSLTPCLTQASTYIRELHAIVAAVRKWRQYLLGRPFTILTDHKSIRELMTQIIQTPEQHYYLSKLLGYDYSIQYKAGSSNVVADALSRPPSSTGQLLILSVPQLDFLNDIRKSLESLPEFQQLMHSIQSNPANHPGYTLCNNLVLFQGRIWLNSNNPCIPSLLSEYHTTPLGGHLGVAKTTHRVQSNFFWTNLKHDVRRFIKECSVCQQNKNSSKRPTGLLQPLPLPTGIDTLKGYT

SEQ ID NO: 222926 - protein, 177 aa, Glycine max
  Coding DNA Sequence Number=SeqID_106148
  Gene Ontology: Mol. function=sequence-specific DNA binding; Cellular component=exocyst; Biological process=exocytosis
  Homolog annotation: Hit_ID=Q40156; Match level="QueryCoverage=98%, HitCoverage=54%, E-value=1e-21, Identity=60%"; Hit description =L.esculentum protein with leucine zipper
MTWQDLEEKIKKWIKASNIALKIFFPSERRFCDRVFFGFASASDFSFKEFCRWKGCSESSTCLRRCVTYFWSLRLCFLISLVCRSGMKRLRFGRVHYQRSSWNKVLGILKFDSNGSMPPISLAKSTKEKLKSFNTVFEEICREQSSWFVFDEQLREEIRISLEKILLPAYGNFVARF

SEQ ID NO: 222927 - protein, 111 aa, Glycine max
  Coding DNA Sequence Number=SeqID_106149
  Subcellular localization annotation: CTP_CleavageSite=35; ConfidenceScore=5.07e-01
MLTCGWTPTIRSQLSCFLSLDWAQLSHKTESTFCRVEVAPPSLFLSHVSSPVLNLCLSLGCVEVTSSVTLHTFLCHLQQVKAPSSVTATHSAHPLICHKTSNSIVPMSEDN

SEQ ID NO: 222928 - protein, 727 aa, Glycine max
  Coding DNA Sequence Number=SeqID_106150
  Gene Ontology: Mol. function=sequence-specific DNA binding; Cellular component=nucleus; Biological process=regulation of transcription, DNA-dependent
  Homolog annotation: Hit_ID=Q93V99; Match level="QueryCoverage=99%, HitCoverage=98%, E-value=0.0, Identity=76%"; Hit description =Protodermal factor2
  Pfam annotation: Domain name=Homeobox; Domain location=58-114; Score =72.6; E_value=1.2e-18; Accession=PF00046.19; Description=Homeobox domain
  Pfam annotation: Domain name=START; Domain location=245-465; Score =288.4; E_value=1.3e-83; Accession=PF01852.10; Description=START domain
  Pfam module annotation: Pfam domain module=Homeobox::START; Domain location=58-114::245-465
MFDSHPHLLDMSPHKTTACSESDLGKACRDDEYETKSITDAMDAPSGDDQDPNPRPKKKGYRRHTQRQIEEMEAFFKQFPHPDDKQRKELSRELGLEPLQVKFWFQNKRTQMKTQHERNENAILKTENEKLRAENNRYKEALSNATCPNCGGSAALGEMSFDEQHLRIENARLREEIDRISGIAAKYVGKPVTSSYSNLSSLNNNHVPVGKYGSQSGTVGEMYGGSDLFRSLPAPADADKPMIVELAVAAMEELTRLAQAGDPLWVPSNHHSEILNEEEYLRTFPNRGLGPKPLGLRSEASRESVVVIMNHINLIDILMDVNQWSTVFCGIVSRALTLEVLSTGVAGNYNGALQVMSSEFQVPSPLVPTRENYFVRYCKQQPDGIWAVVDVSLDNLRPNTISRSRRRPSGCLIQELPNGYSKVTWIEHVEVDDRAVHSIYRPLVNSGLAFGAKRWVATLDRQCERLASSMANNIPAGDLCVITSAEGRKSMMKLAERMVMSYCTGVGASTAHAWTTLSATGCDDVRVMTRKSTDEPGRPPGIVLSAATSFWLPVPPNRVFDFLRDENSRNEWDILSNGGLVQELAHIANGRDPGNCVSLLRVNSANSSQSNMLILQESCTDSTGSYVVYAPVDIVAMNVVLSGGDPDYVALLPSGFAILPDGPPALNGGPMHEVGSGGSLLTVGFQILVDSAPTAKLSLGSVATVNSLIKCTVERIKVAVIRDNNNT

SEQ ID NO: 222929 - protein, 1276 aa, Glycine max
  Coding DNA Sequence Number=SeqID_106151
  Gene Ontology: Mol. function=RNA-directed DNA polymerase activity; Cellular component=chromatin; Biological process=chromatin assembly or disassembly
  Pfam annotation: Domain name=Chromo; Domain location=1169-1222; Score= 22.5; E_value=0.0015; Accession=PF00385.14; Description='chromo' (CHRromatin Organisation MOdifier
  Pfam annotation: Domain name=RVP; Domain location=350-454; Score= -12.6; E_value=0.066; Accession=PF00077.10; Description=Retroviral aspartyl protease
  Pfam annotation: Domain name=RVP_2; Domain location=332-468; Score= -36.7; E_value=0.00072; Accession=PF08284.2; Description=Retroviral aspartyl protease
  Pfam annotation: Domain name=rve; Domain location=957-1118; Score =51.0; E_value=4.1e-12; Accession=PF00665.16; Description=Integrase core domain
  Pfam annotation: Domain name=zf-H2C2; Domain location=898-939; Score =10.4; E_value=0.015; Accession=PF09337.1; Description=His(2)-Cys(2) zinc finger
  Pfam module annotation: Pfam domain module=Chromo::RVP::RVP_2::RVT _1::Retrotrans_gag::rve::zf-H2C2; Domain location=1169-1222::350 -454::332-468::594-763::103-193::957-1118::898-939
MADHTTRRTTTDRLEEAITRLSTCQSTLTDKYAELSDKVDSILDHLRLKETTQNPPSSNSQFTQRNPVKLDIPRFDGRDLLGWIFKISQLFEYQNTPEEERITVASFYLDGAALSWYQWMFRNGFITSWSGFLQALESRFAPTFYDDPKGALFKLTQRGNVNEYLTEFERLANQVIGLPPPFLLSCFISGLTPKIRREVLALQPISLPQAIALAKLQEDKLRDRRMTTRPNFTSPSSNSRPNNPIQSSSLPSSSSQQRTKPPFIQRTPEEMAFRRERGLCYNCDDKWNPGHRCKGGILLLIADNPVTEEDTREVSLDSITTNEEDLPDQSQPTSDDTHPHISLHALSGLPSSETFRLSSIIKHARITILIDSGSTHNFLQPRIAQFLHLPTQKTTPFQVLVGNGSVLDCNQICPNTQLSIQGNSFDVTFHLLPISGADAVLGIAWLKQFGPIITDYTSFIMRFNHLGQAIELRADIAIGPEPASTTQVKRLIRTGSTSALLHLRILPTHQPEPSTTHLPHPIPAINTLLTRYQKLFQTPNHLPPPRDVVHRINTHPATAPMNVRPYRYPHFQKTEIEKQVSNLLSAGLIRPSTSPYSSPVLLVKKKDGTWRLYVDFRSLNVVTIRDRFPIPTIDELLDELGQASWFSKLDLRQGFHQILMHELDNEKTAFHTHHGHYEYLVMPFGLCNAPSTFQGAMNSVLTPFLRRFATVFFDDILVYSDSLPSHISHLETIFQTLLQGQYYLKQAKCLFAQEQLEYLGHVVSGRGVEPEPSKSLRELMTQIIQTPEQHYYLSKLLGFDYNIQYKTVATNKVADALSRIPQTTAQLMILSIPHLDFIDELRQTLQQSPEFQSLLTKVRDEPTAYPDYRLHNNLFFFQGRIWLNSDNPFIPSILLENHATPLGGYLGVAKTTHRLESSFFWSGIRQDTKRFVKECKICQQIKSTTRRPAGLLQPLPIPAGVWEDLSMDFITHLPSSHGFTVILVIVDRYSKGVHLGALPTGFSAFKVASLFLELVCKHHGFPRSIVSDRDPVFLSSFWKELFRLSGTRLRMSTAYHLQTDGQTEETMKQYADAKREDVSFTPGQWVYVKLKPFRQRSVTGANHSKLPKRFFGPFQITARIGEVAYKLQLPDDSRIHPVFHCSLLRPHYGPPPSNTAPWPLQIVSQRPVPRPLCILDSKFDTSTTPPTRLVLTQWAGQPPEDTTWEPWLDLQEAYHLEDEVVSGGEGIDSNRDPQGEDSSSNLHEPSPESNSQSNRDEPGPARPTRITHRPTYLNDY

SEQ ID NO: 222930 - protein, 651 aa, Glycine max
  Coding DNA Sequence Number=SeqID_106152
  Gene Ontology: Mol. function=GPI anchor binding; Cellular component =anchored to membrane; Biological process=root hair cell differentiation
  Homolog annotation: Hit_ID=Q1T3K3; Match level="QueryCoverage=93%, HitCoverage=87%, E-value=0.0, Identity=74%"; Hit description =Phytochelatin synthetase-like conserved region; Carbohydrate- binding
  Pfam annotation: Domain name=Phytochel_synth; Domain location=226 -406; Score=360.7; E_value=2.4e-105; Accession=PF04833.5; Description= Phytochelatin synthetase-like conserv
MPSPLLSLSLVLLFLISCGNIHECEAQDTEALPPAAETCNGVFISYDFLTRRKEFPRVKNATAQSWAFNSTATVLNTGKDVVKAWRLFIGFQHDEILISASGGNLIDGTDFPALVGNGTTFVGSSVPDLDSSINTAQDLTQISAMIQLIGTQFGVRPPTIPMPKTIKLVNDGYKCPLPTTRKGSMYACCKKDPKFKAVLRKTKFLPRQQGDLTISYDVNQVYENNYMVEVTMENNHLLGRLDHWNLTWEWTRGEFIYSMKGAFTRVIEYSGCIYGAAGQYYKDMDFSKVVNCQKNPIISDLPPEKANDTEIGKIPHCCKNGTLLPILMDPSKSKSVFQMQVFKVPPDLNKTAIFPPEKWKITGILNPEYRCGAPIRVDPAQSQDPRGLEATVIAISSWQIVCNITKPTKRSTRCCVSFSAYYNESIVPCNTCACGCDENNRRCNPNSPAMLLPPEALLVPFENRTKKTVAWAKLKHFKVPTKLPCADNCGVSINWHVVSDFKGGWSARITMFNWQHTNFENWFTALQFKKKTALGYEKVYSFNGTFLPKLNHTIFLQGTQGSNFLLALDNGTNPKVPGKAQSVLSFTKKFAPGMKIAKGDGFPSRVFFNGEECSIPTRFPVGNGNQHNADSLNLHLLLALVLAFTMSIILY

SEQ ID NO: 222931 - protein, 257 aa, Glycine max
  Coding DNA Sequence Number=SeqID_106153
  Pfam annotation: Domain name=DUF761; Domain location=21-253; Score= -124.2; E_value=0.0068; Accession=PF05553.2; Description=Cotton fibre expressed protein
MAKPLYLEEDYKPKDYTPKAKSLSFFASIFSLFIYICVFYTFNLSPYSLLNNNIFWFFMSNTLILIIAADYGASSSNKHKQDLYEEYVQHSQARNCVSSSYVPKYDHEQFDKECIYPKQEQGSELIEKKKETISDQDIIPERVLGIVTVLNQPNKPSECSNEKKPTLHLQVDDGSEKFEEIKAVPTRIYRRSKSDRPNRAKHVVSEERVNKVQRSETKKVEANVVEEENEFSMMSNEDLNRRIEDFIQKFRSQATRN

SEQ ID NO: 222932 - protein, 55 aa, Glycine max
  Coding DNA Sequence Number=SeqID_106154
MKKPSHHESKDTLQQQIVYSFGDHYYFRKELRILNLLTGNEIFWAMIDMDEIMQF

SEQ ID NO: 222933 - protein, 160 aa, Glycine max
  Coding DNA Sequence Number=SeqID_106155
  Gene Ontology: Mol. function=serine-type endopeptidase activity; Cellular component=chloroplast; Biological process=proteolysis
  Homolog annotation: Hit_ID=Q2QM57; Match level="QueryCoverage=99%, HitCoverage=51%, E-value=2e-69, Identity=78%"; Hit description =Protease Do-like 5, chloroplast, putative, expressed
  Pfam annotation: Domain name=Trypsin; Domain location=1-146; Score= -14.1; E_value=7.3e-05; Accession=PF00089.16; Description=Trypsin
VFLVDAKGNSFDREGKIIGFDPAYDLAVLKVDVDGYEIKPVVLGQSNDLRVGQSCFAIGNPYGYENTLTTGVVSGLGREIPSPNGGAIRGAIQTDAAINAGNSGGPLIDSYGHVVGVNTATFTKKGTGVSSGVNFAIPIDTVVRTVPYLIVYGTPYSNRF

SEQ ID NO: 222934 - protein, 100 aa, Glycine max
  Coding DNA Sequence Number=SeqID_106156
  Subcellular localization annotation: CTP_CleavageSite=64; ConfidenceScore=5.01e-01
MVATKFPDFEVSFTDGKTMKLPIRVSDRAVDSDKSSVPKASLVCLSFRASSQEMINSWSVPFTEAFRKSNDVHLYQHIAVISLPKCLASCFGISEEKDDE

SEQ ID NO: 222935 - protein, 162 aa, Glycine max
  Coding DNA Sequence Number=SeqID_106157
MELNMFRSIENKIEINLQPLYCTARSNPPLSCAKTFRSNATKGVAAIDHHIVEVGFLVEEDWEILVVGVGVTHQIRHVIEPIKSGVTRATWRKTPLPLAARLNPPLPVAAKQERGVLAARTSGGIGSAVGLAQGAGETAMSREPTFQACRACFCSPLFRDAA

SEQ ID NO: 222936 - protein, 221 aa, Glycine max
  Coding DNA Sequence Number=SeqID_106158
MANVSLPRTIKWDEVTLHAKWVMDKATPSFPRPAPTIAQIRQDNSGKRYKDRLNLSRRRHRNHGYFKETTKKGSRALFSTDPTSWVLNILLQLKASTMCGGLITNGGSSWWSPVVVGRGGGGSMVWVRVLGRKEVKNMCFYTIVRIYNLQDSLSELVSLSEISLLPLSETFTLSKISLLARIALSELVLLSKLLPLERIALSCLVSLSELFQRRSIKHHIT

SEQ ID NO: 222937 - protein, 37 aa, Glycine max
  Coding DNA Sequence Number=SeqID_106159
MDAEFTERCLPRSLLEWGFNDSQVSKCKVVARWILVK

SEQ ID NO: 222938 - protein, 315 aa, Glycine max
  Coding DNA Sequence Number=SeqID_106160
  Homolog annotation: Hit_ID=Q47522; Match level="QueryCoverage=13%, HitCoverage=53%, E-value=9e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLLPFPDHHPSPSSIYLAHPPAEGASFLWFAEPLRRVWRQPRPAEGTVSFEKADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 222939 - protein, 89 aa, Glycine max
  Coding DNA Sequence Number=SeqID_106161
MTMQNMQFQQETRASIQSLTNQMGQLATQLNQQQPQNSDRFTFSICPESQKCESKEKQHIPLPFPPREISNKKMEEAEKEILETFRKVE

SEQ ID NO: 222940 - protein, 167 aa, Glycine max
  Coding DNA Sequence Number=SeqID_106162
  Gene Ontology: Mol. function=transferase activity, transferring glycosyl groups; Cellular component=integral to membrane; Biological process=GPI anchor biosynthetic process
  Homolog annotation: Hit_ID=Q6ASS8; Match level="QueryCoverage=94%, HitCoverage=88%, E-value=7e-41, Identity=53%"; Hit description =Phosphatidylinositol N-acetylglucosaminyltransferase subunit, putative
  Pfam annotation: Domain name=PIG-P; Domain location=45-164; Score =169.3; E_value=1e-47; Accession=PF08510.2; Description=PIG-P
MESPHSVNSPRRTLSLSKKQRATVSFFDPDDITSGFGLSGDHGPKPSEVYGFVGSITTVVATVIFLVWAYAPESWLQSVGISYYPSRYWALAVPTYVMVTIVLVLGFYIGLNFISTPSPASLNTVFDEFSRDPLSLECSLEEDEKPIEPISDIGIGRINDIMFNNAT

SEQ ID NO: 222941 - protein, 98 aa, Glycine max
  Coding DNA Sequence Number=SeqID_106163
MWISIGPSITYYPRWVSIPHPYTIHSQYRIQFEKSCNRVYGLNLDALLNCFISGLNPDICQKIAILKPTTLSNAIVLDKLIEDKVKATHARTPHSNLV

SEQ ID NO: 222942 - protein, 70 aa, Glycine max
  Coding DNA Sequence Number=SeqID_106164
MALVMGPLLGRIASARAITEQGKQTLCSLRKYDNTVLHALSMALQLLVDDMGQPSLKNIYYNGKYTFKWS

SEQ ID NO: 222943 - protein, 38 aa, Glycine max
  Coding DNA Sequence Number=SeqID_106165
MTVKKRLSHEALKVTVELSSSVGLSVHPPLSVASVCLA

SEQ ID NO: 222944 - protein, 51 aa, Glycine max
  Coding DNA Sequence Number=SeqID_106166
MHSVDKRPPTGLFKAIVDAVVNLEKHRRNAGKDWIASWLHFGDGPPSVAPS

SEQ ID NO: 222945 - protein, 74 aa, Glycine max
  Coding DNA Sequence Number=SeqID_106167
MEEKAGTKMEEAIHKREKKQVHLRSKHDHLENSTILEITQQRFRISSHLPFLVFCSINGTPGAQICEEGVRLRL

SEQ ID NO: 222946 - protein, 74 aa, Glycine max
  Coding DNA Sequence Number=SeqID_106168
MEEIDPTLASSSLVLFAQIMMQNVLVWMSYFAPNTSGSDKLWSEKLNLHQNIWTVSSGMLPTTHLASSHAHGRA

SEQ ID NO: 222947 - protein, 532 aa, Glycine max
  Coding DNA Sequence Number=SeqID_106169
  Gene Ontology: Biological process=regulation of transcription
  Homolog annotation: Hit_ID=Q8LP36; Match level="QueryCoverage=26%, HitCoverage=93%, E-value=6e-41, Identity=66%"; Hit description =PlCYC4 protein
  Pfam annotation: Domain name=TCP; Domain location=61-307; Score =139.4; E_value=9.9e-39; Accession=PF03634.4; Description=TCP family transcription factor
MEEDEIQACKFPRVGNGRSSDQYQEEEEEGGDLRLRKGVGVGGGGGGGGSDASTNHFHQSSWHHSSRIIRVSRASGGKDRHSKVMTSKGLRDRRVRLSVTTAIQFYDLQDRLGYDQPSKAVEWLIKAASEAISELPSLNNPFPDTPKQLSDKKRPTSGGGQQQQQIQQGHFDDADGDTSYPQNQSQNLSLSKSACSSTSETSKGSGLSLSRSEIRVNRVKARERARERAAKEKEKEKEKEKEKEKESESSIAHHHHHHHVNNNNHMSHTASFTELLTGGIGSTVTVNPNTTTTTTTTTTSPNGSSVHQIHDGHDHETNLFNKGRQQQQQHHWSQTVTPMDYFSTGLLVGPSSSSARTQQHQHQSSSAHFQLGHAHALPISPFSGENHSEQLQHFSFMPDHLNNIPAHHVVTSSSASHQPNGGDNNYNLNFSISTSTGLAGYNNRGTLQSNSPSSSFLPHHLQRFQPLDGSSNLPFFIGAAAPSSAPPTMDNNNNNNSNNHHHLQFSPVFDGRLQLCYGDGTRHSDHKGKGKN

SEQ ID NO: 222948 - protein, 157 aa, Glycine max
  Coding DNA Sequence Number=SeqID_106170
  Gene Ontology: Mol. function=ATPase activity, coupled to transmembrane movement of substances; Cellular component=integral to membrane; Biological process=transport
  Homolog annotation: Hit_ID=Q42093; Match level="QueryCoverage=99%, HitCoverage=10%, E-value=6e-41, Identity=55%"; Hit description =Multidrug resistance-associated protein 2
MTFEPLDWYCRPVANGVWTRSVENAFGAYTPCAVDSLVISVSNLILLGLCIYRIWLIKKDFTVKRFHLRSNLYNYILGLLALYCVAEPLYRLILGISVLNLDGQTQFAPFEIVSLIIEALAWCSILILIGIETKVYIREFRWGCCNVQSHHFCEGVI

SEQ ID NO: 222949 - protein, 135 aa, Glycine max
  Coding DNA Sequence Number=SeqID_106171
MVIVEEGDEDREHDGEWEWRGTVLIMGTLCVLRVLESGFGVVGGFELGLCNGLEVQRFGFLFWVYAAFVASLVEENGCVPQRDGEEAHGVERRGGRRTLWSSMLKRKRKDMKPSGKFTVKGGSVSGWMLPEELAT

SEQ ID NO: 222950 - protein, 176 aa, Glycine max
  Coding DNA Sequence Number=SeqID_106172
  Homolog annotation: Hit_ID=Q9C8G9; Match level="QueryCoverage=83%, HitCoverage=8%, E-value=9e-46, Identity=59%"; Hit description =Multidrug resistance-associated protein 1
MSHQQSLVIYSKFLCSLLRILDPPVFSVLYLYISEVVGQKWMYRERIECFIAVYGDVLFGILLLVYVPTLDPYPGYTPIGSDMITDAAYDELPGGDMICPERNANILSKIMFSWMNPIMKLGYQRPLTEKDIWKLDTWERTETLINKFQKCWVEESRKPKPWLLRALNASLGGRYG

SEQ ID NO: 222951 - protein, 187 aa, Glycine max
  Coding DNA Sequence Number=SeqID_106173
  Gene Ontology: Mol. function=isomerase activity; Cellular component =integral to membrane; Biological process=protein folding
  Homolog annotation: Hit_ID=Q1S1L9; Match level="QueryCoverage=64%, HitCoverage=19%, E-value=4e-57, Identity=91%"; Hit description =Peptidylprolyl isomerase, FKBP-type; Tetratricopeptide-like helical
  Pfam annotation: Domain name=FKBP_C; Domain location=69-161; Score =32.0; E_value=2.1e-06; Accession=PF00254.18; Description=FKBP-type peptidyl-prolyl cis-trans i
MGSMGSMNVKPKRKRRKSCVLSDIIVQYIADMKNWNLLPYLEPLLWLCCICKLFANPQFRTFLHVVREGQGWESPREPYEVKAWISAKTVTGKLIMSHTEGEPYFFTFGKSEVPKGLEMAIGTMVREEKAVIYVTSQYLTESPLMPVIEGYDEVHFEVELVHFIQVRDMLGDGRLIKCRIHDGKGGD

SEQ ID NO: 222952 - protein, 110 aa, Glycine max
  Coding DNA Sequence Number=SeqID_106174
  Gene Ontology: Mol. function=solute:hydrogen antiporter activity; Cellular component=integral to membrane; Biological process =regulation of pH
  Homolog annotation: Hit_ID=Q1S3D8; Match level="QueryCoverage=94%, HitCoverage=12%, E-value=1e-38, Identity=72%"; Hit description=WD-40 repeat
QSEAKWDLMLDDEVLKSVKGYYGTIENVSYEKVSIEQPSETTAFVSDIANRHDFFIVGRRNGIKSPQTAALESWTEFSELGVIGDLLASSDTNTNASILVVQQQQMPKSS

SEQ ID NO: 222953 - protein, 98 aa, Glycine max
  Coding DNA Sequence Number=SeqID_106175
MALSVSLFTASALAAPLNPGDRNYIQNQQQQRLQQDQQQRDALWNAAAPQATACSGKGNATKYASMASTRDRWPCRFPNSTVLQRGLHFTSRKAGSGV

SEQ ID NO: 222954 - protein, 51 aa, Glycine max
  Coding DNA Sequence Number=SeqID_106176
MTENVSQFVRLIVKECNDSIPRAFAKRNTQWLSARKNPEEDELSGSLSAPL

SEQ ID NO: 222955 - protein, 152 aa, Glycine max
  Coding DNA Sequence Number=SeqID_106177
MEESNRENNKDHISQSRGSALDGEEHIGEWRNPIGKITKITFPSEEGSALDGEEHIGEWRNPIGKITKITFPSQEGSVLDGEEHIGEWRNPIGKITKITFPCQEGSALDGEEHVGEWKNPIGKITKITFPSQEGPLLTVKNTLENGGIQSGK

SEQ ID NO: 222956 - protein, 123 aa, Glycine max
  Coding DNA Sequence Number=SeqID_106178
  Gene Ontology: Mol. function=ribonuclease H activity; Biological process=DNA integration
  Homolog annotation: Hit_ID=Q1SYR3; Match level="QueryCoverage=99%, HitCoverage=5%, E-value=7e-36, Identity=60%"; Hit description=RNase H, putative
PALTRRIARWQVLLSEFDIVYVTQKVVKGSALADYLAQQPIDDYQPMHPEFPDEDIMALFDQEGEVEDKDKWTMSFDGASNVWGHGIGAVLVSLDKQYFPFTTRLCFDCTNNVAKYEAYASGI

SEQ ID NO: 222957 - protein, 52 aa, Glycine max
  Coding DNA Sequence Number=SeqID_106179
MAKRMDNSRRRMSCIEALSESQLAKHTVFTFRKLPCYGELNPQLVLPMGYLM

SEQ ID NO: 222958 - protein, 189 aa, Glycine max
  Coding DNA Sequence Number=SeqID_106180
  Gene Ontology: Mol. function=RNA-directed DNA polymerase activity; Biological process=RNA-dependent DNA replication
  Homolog annotation: Hit_ID=Q1SYR3; Match level="QueryCoverage=56%, HitCoverage=6%, E-value=5e-28, Identity=52%"; Hit description=RNase H, putative
MKSGKLLDFVVSQKWIKVDPDKVKVILQMPEPHTEKQVYEFLGRLNYISRQCLMNPHVLVPPVPGRPFILYMIVLDESMGCVLGQHNESGRKEYVIYYLRLFVHWHGHHTVEAKLHDESRLIQRCFDDNKDDDKGDDKKLKGQSKNEFKMFKIESRTLQDSSGMLISRIKDQDSRIKIQDSRFKNQEKT

SEQ ID NO: 222959 - protein, 192 aa, Glycine max
  Coding DNA Sequence Number=SeqID_106181
  Gene Ontology: Mol. function=protein dimerization activity; Biological process=proteolysis
  Homolog annotation: Hit_ID=Q35QX3; Match level="QueryCoverage=97%, HitCoverage=42%, E-value=6e-46, Identity=50%"; Hit description =Similar to Acetylornithine deacetylase/Succinyl-diaminopimelate desuccinylase and related deacylases
MNALYQLKGEVEQRVSAMPAPPHYQGQPLTALLTLAAAHGGSKGSTIPERFELLVNRRYAPEEPFADVWQELTQCVDKAMQGSAASDVTLQLIGHLAPVADPTGPHWPRWQAALSQGFGFPPAEFKAWGSATSSDMGWVQQAGIQEILLGGLARPDNRIHAADEYTTMADVIALSQSILAYLANDFQPTQGN

SEQ ID NO: 222960 - protein, 294 aa, Glycine max
  Coding DNA Sequence Number=SeqID_106182
  Homolog annotation: Hit_ID=UPI0000E47346; Match level="QueryCoverage =86%, HitCoverage=13%, E-value=8e-09, Identity=24%"; Hit description =PREDICTED: similar to Golgi-associated microtubule-binding protein isoform 3, partial
MDHVRAFSSPHFLSSSTSNFNGQQDIEECGLEGLATNVKLLLKLIQDHNGSSTKENDERKFHRVNGMMFILDEARNRIQKIQSTTQRRAELRRCNTDLRPNIPAPKDRKPPSDVPIDEKERLKRELNASLVARQSLQAMCSSLGKEKQIMAAELARKAQELTEMEDFIGDLKAQNDMLMEKLHEQKEKKGNGVEMECNIVLRERNKALSEQLQKSIDGYRSMKRRLRDIQEENRQIRDTMEQMEEEVDAGIDRNIGRFKERNMRTNEIKEEISALEHMLDSLKMKVSKYTQKKT

SEQ ID NO: 222961 - protein, 311 aa, Glycine max
  Coding DNA Sequence Number=SeqID_106183
  Gene Ontology: Mol. function=protein binding; Biological process =metabolic process
  Homolog annotation: Hit_ID=Q8LAJ5; Match level="QueryCoverage=86%, HitCoverage=87%, E-value=2e-65, Identity=50%"; Hit description=F-box protein family, AtFBL20
  Pfam annotation: Domain name=F-box; Domain location=12-60; Score =35.4; E_value=2e-07; Accession=PF00646.23; Description=F-box domain
  Pfam annotation: Domain name=LRR_1; Domain location=110-134; Score =6.2; E_value=20; Accession=PF00560.23; Description=Leucine Rich Repeat
  Pfam annotation: Domain name=LRR_1; Domain location=136-158; Score =8.1; E_value=8.7; Accession=PF00560.23; Description=Leucine Rich Repeat
  Pfam annotation: Domain name=LRR_1; Domain location=192-215; Score =5.3; E_value=29; Accession=PF00560.23; Description=Leucine Rich Repeat
  Pfam module annotation: Pfam domain module=F-box::LRR_1::LRR_1::LRR _1; Domain location=12-60::110-134::136-158::192-215
MSSSKEAAAEERNWLDLPRDVLCTIFQKLGATEILTRAQGVCSVWRAISKEPLLWRTIDMRNLGDIGLDFHLLAMCHRAIDYSSGHLLHINVEYFGTDDLLHHITHSTSNLRSLRLACCYQISDEGLCEIAEKLPQLEELDISISNLTKDPLEAIGQCCPHLKTLKFNMEGYRRPHIECDEEAFAIAETMPGLHHLQLFGNKLTNEGLLAILDGCPLLESLDLRQCFNVNLAGSLGKRCAEQIKELRLPCDPTDDYPFEAEIDYGSLDEDYPSGISDIDFLSDDDYDYYEFSGGSDFSEYDDDHPDYYDHF

SEQ ID NO: 222962 - protein, 62 aa, Glycine max
  Coding DNA Sequence Number=SeqID_106184
MWITQGLMVQQHCIFSVRGWGRPLRVFNMGKSDSERLLQLASPMSSGEATPHFCAWGMGFDN

SEQ ID NO: 222963 - protein, 1384 aa, Glycine max
  Coding DNA Sequence Number=SeqID_106185
  Gene Ontology: Mol. function=metal ion binding; Cellular component =intracellular; Biological process=DNA repair
  Homolog annotation: Hit_ID=Q6ZLQ1; Match level="QueryCoverage=36%, HitCoverage=85%, E-value=1e-174, Identity=48%"; Hit description =Putative pentatricopeptide (PPR) repeat-containing protein
  Pfam annotation: Domain name=BRCT; Domain location=1174-1255; Score =33.5; E_value=7.4e-07; Accession=PF00533.16; Description=BRCA1 C Terminus (BRCT) domain
  Pfam annotation: Domain name=PPR; Domain location=118-152; Score =50.8; E_value=4.5e-12; Accession=PF01535.11; Description=PPR repeat
  Pfam annotation: Domain name=PPR; Domain location=153-187; Score=0.2; E_value=7.1; Accession=PF01535.11; Description=PPR repeat
  Pfam annotation: Domain name=PPR; Domain location=17-51; Score=31.7; E_value=2.5e-06; Accession=PF01535.11; Description=PPR repeat
  Pfam annotation: Domain name=PPR; Domain location=219-253; Score =47.0; E_value=6.4e-11; Accession=PF01535.11; Description=PPR repeat
  Pfam annotation: Domain name=PPR; Domain location=254-288; Score =17.3; E_value=0.056; Accession=PF01535.11; Description=PPR repeat
  Pfam annotation: Domain name=PPR; Domain location=290-324; Score=7.7; E_value=0.9; Accession=PF01535.11; Description=PPR repeat
  Pfam annotation: Domain name=PPR; Domain location=356-390; Score=1.6; E_value=4.8; Accession=PF01535.11; Description=PPR repeat
  Pfam annotation: Domain name=zf-C3HC4; Domain location=539-576; Score= 32.2; E_value=1.9e-06; Accession=PF00097.15; Description=Zinc finger, C3HC4 type (RING finger)
  Pfam annotation: Domain name=zf-MIZ; Domain location=535-579; Score =3.2; E_value=0.00045; Accession=PF02891.10; Description=MIZ zinc finger
  Pfam module annotation: Pfam domain module=BRCT::PPR::PPR::PPR::PPR::P PR::PPR::PPR::zf-C3HC4::zf-MIZ; Domain location=1174-1255::118 -152::153-187::17-51::219-253::254-288::290-324::356-390::539 -576::535-579
MSYAYNVFTVIHNPNVFTWNTIIRGYAESDNPSPAFLFYRQMVVSCVEPDTHTYPFLLKAISKSLNVREGEAIHSVTIRNGFESLVFVQNSLLHIYAACGDTESAYKVFELMKERDLVAWNSMINGFALNGRPNEALTLFREMSVEGVEPDGFTVVSLLSASAELGALELGRRVHVYLLKVGLSKNSHVTNSLLDLYAKCGAIREAQRVFSEMSERNAVSWTSLIVGLAVNGFGEEALELFKEMEGQGLVPSEITFVGVLYACSHCGMLDEGFEYFRRMKEECGIIPRIEHYGCMVDLLSRAGLVKQAYEYIQNMPVQPNAVIWRTLLGACTIHGHLGLGEIARSHLLNLEPKHSGDYVLLSNLYASERRWSDVQVIRRSMLKDGVKKTPGYSLVELGNRVYEFTMGDRSHPQSQDVYALLEKITELLKLEGYVPHTANVLADIEEEEKEQALSYHSEKVAIAFMLLNTPPGTPIRVMKNLRVCADCHMAIKLIAKIYDREIVIRDRSRFHHFRGGSCSYIAIAIAMGDLERMAIELKCPICWSLLDSAVSLTCNHLFCNSCIFKSMKSASACPVCKIPFTRREVRPAPHMDNLVSIYINMEASSGVNTFVTQNAPVTNLSDGEKECEGDADSGKMKAGGTHEGRPQEKKTRKKKKSKKTVQASMESSGSEFAKPSFPAKKRVHVPQNLLSETPMKNLKIGDSLSEINKEKEGTEKEKDGEMLSQQTDEDQIIDGSTPNPPSFSDLKDSDDEVHSNVDLMDEVQNKSSVNLFDSEMFEWTQRPCSPELFSSPSKMQVMDTYEDDENQEELVASSLELEANLPRVDADNMEFENPKEGNRMADEVPPSVCFPQIRSSDDLNGIKKSTKRRKARDKNKQEQIGEPKNSFDEMYVEVTQEQALDNSSNLGKGSRRGKRVCFNTSPIPTPITACTVPNTLGVQSIGEMKKAKNIDILPCKQENEKHYAQEISGKSQMKISGKQNINQMNEFAGSDSSIFSLRTDNNGKDSNRRQCKSKYSRKTIYCSKELETTKRQKLSSACISKTKNNEEILPIESIHQGPDVRDLNDTSKEKHCPLMDQTVLRKCENLVKNYQCVFCLSSEESEASGPMVHYLDGRPVTSDYEGGSKAPHLVVMRKAVAGAFMFLVPSGLLNVDGIRKTLSCYALCMLPPCCPVKVQDPKKGARNAQLVREKPMEREVVSEFERVSKATVLKNWDSSVTHVIASTDENGACRRTLKVLLGILEGKWILNIEWIKACMKEMGPIDEECYEINVDIHGIRDGPRLGRLRVLNKGYLQNLVVAAGGIILHRKPVSGDQESTSPDMHTYQTLIIYSLELPDKCKPSKKDTICSQRRHDAEVLASSTGSNVASNTWVLNSIAACKLQYLAQ

SEQ ID NO: 222964 - protein, 176 aa, Glycine max
  Coding DNA Sequence Number=SeqID_106186
MGLMEEDPKITGFTVINGDLLILATETRVYRRKYANTDTNPKFALLPTQIVFVSVDQGLHVCLVKLVVVKEIDYRYEHTDFNCTFFKFLLLLMILQVLAGSLLRLVCFGFQKKNHYTTKFRSSTFNRRQPNSLLHVSDKYKLQKVNALHKGSRCRRRSCSLHLPISLKQHYYIEYL

SEQ ID NO: 222965 - protein, 175 aa, Glycine max
  Coding DNA Sequence Number=SeqID_106187
  Gene Ontology: Mol. function=signal transducer activity; Cellular component=membrane; Biological process=signal transduction
  Homolog annotation: Hit_ID=Q6D415; Match level="QueryCoverage=96%, HitCoverage=25%, E-value=3e-27, Identity=39%"; Hit description =Putative methyl-accepting chemotaxis citrate transducer
MGLVSRLRNVRITRKLAAGFGIVLLLVALATALSVQRFNQIHDIYQKTNLIYDINIEVFQAKINRLKYLYGEDKAGGTMTDYVTHAQQLTQQAQQLPWTADARGLLNDVASHLARFQHSITAMTQATQQLNELRSQLDALSQQDMTSRYTGLIRTPVSTPEVTNQIYQLLFAISN

SEQ ID NO: 222966 - protein, 109 aa, Glycine max
  Coding DNA Sequence Number=SeqID_106188
MKDLNNGEVKNPSALEDGESGGEGGNGGEKEREGEAGAGVGGGDKGEGGGEEEVGREEEEKGEKGGWHFANSFGETGMDGISPIPLTKPAGISCEDSGGTGMALYHVNK

SEQ ID NO: 222967 - protein, 238 aa, Glycine max
  Coding DNA Sequence Number=SeqID_106189
  Gene Ontology: Mol. function=protein binding; Biological process =protein modification process
  Homolog annotation: Hit_ID=Q1S0J6; Match level="QueryCoverage=87%, HitCoverage=53%, E-value=6e-34, Identity=36%"; Hit description =Ubiquitin; Apoptosis regulator Bcl-2 protein, BAG
  Pfam annotation: Domain name=ubiquitin; Domain location=73-154; Score= 9.2; E_value=0.03; Accession=PF00240.13; Description=Ubiquitin family
MKKKPSARENSSSSSSTAAREEESEWEMRPGGMLVQKRTANTDAAVTRNLRLRIAYGALRYEICVSSIATFGKTSSGSKVAVSVQHYESSLQMLRAHCENDLTGEVKKVLCGETGLEVDEQKLVYRGRERENGEYLDVCGVKDRSKVVLIQDPSSIERRFIQMRINSKIQTAHRAINNVAVQLDQLADQVSAIEKSISNGVKVPEVQITTLIEMLMRQAIKLESISAEGGASAQKNLQ

SEQ ID NO: 222968 - protein, 56 aa, Glycine max
  Coding DNA Sequence Number=SeqID_106190
MDRPARISGFRLSACFSCSADGLKWLSTRLSPSPNPLTHAKCKGGAKHDIAISEPI

SEQ ID NO: 222969 - protein, 375 aa, Glycine max
  Coding DNA Sequence Number=SeqID_106191
  Gene Ontology: Mol. function=transferase activity; Cellular component= mitochondrion; Biological process=protein amino acid phosphorylation
  Homolog annotation: Hit_ID=Q5SMM9; Match level="QueryCoverage=84%, HitCoverage=82%, E-value=2e-86, Identity=48%"; Hit description =Pentatricopeptide (PPR) repeat-containing protein-like
  Pfam annotation: Domain name=PPR; Domain location=220-254; Score =34.1; E_value=4.7e-07; Accession=PF01535.11; Description=PPR repeat
  Pfam annotation: Domain name=PPR; Domain location=255-289; Score =32.3; E_value=1.7e-06; Accession=PF01535.11; Description=PPR repeat
  Pfam annotation: Domain name=PPR; Domain location=290-324; Score =19.5; E_value=0.012; Accession=PF01535.11; Description=PPR repeat
  Pfam annotation: Domain name=PPR; Domain location=325-359; Score =34.9; E_value=2.8e-07; Accession=PF01535.11; Description=PPR repeat
  Pfam module annotation: Pfam domain module=PPR::PPR::PPR::PPR; Domain location=220-254::255-289::290-324::325-359
  Subcellular localization annotation: CTP_CleavageSite=42; ConfidenceScore=5.75e-01
MATILRRFFTIRSVSAYSLTPFTRPQPSLPLTRPLLLHARPSSSSTSPSRTPSEKQFETWVQALKPGFTPSDVAQALQAQSDPDLALDIFRWTAQQRNYKHTHHTYLIVIKHLIAGRRYHHAETLIEEVIAGAIDDASIPLYNSIIRFCCGRKFLFNRAFDVYKKMLNSNDCKPNLETYSLLFNSLLRRFNKLNVCYVYLHAVRSLTKQMKASGVIPDTFVVNMIIKAYAKCLEVDEAIRVFREMGLYGCEPNAYSFGYIAKGLCEKGRVDQGLGFYREMREKGFVPSTSTFVIIVCSLAMERRLEDAIELLFDMLGQSRSPDHLTYKTVLEGLCREGRVDEAFELLDECKKRDVSMGEKTYKSLLNDLYVICRE

SEQ ID NO: 222970 - protein, 88 aa, Glycine max
  Coding DNA Sequence Number=SeqID_106192
  Homolog annotation: Hit_ID=Q9LJX0; Match level="QueryCoverage=63%, HitCoverage=4%, E-value=2e-19, Identity=85%"; Hit description =Multidrug resistance protein 11
MHHFQTNNSRVNTVRGSVLDSAHAIGTGQENRLIDQGHQLSLKGFAGDTAKAHAKTSMIAGEGVSNIRTVAAFNAQNKMLSVFCHELR

SEQ ID NO: 222971 - protein, 55 aa, Glycine max
  Coding DNA Sequence Number=SeqID_106193
MIQALPWEAQWFTMWEAASAENGDGVKNAMVKGLRSSMVKTEESKQGKCDNLRDR

SEQ ID NO: 222972 - protein, 515 aa, Glycine max
  Coding DNA Sequence Number=SeqID_106194
  Gene Ontology: Mol. function=galactosyltransferase activity; Cellular component=membrane; Biological process=protein amino acid glycosylation
  Homolog annotation: Hit_ID=Q1SGZ2; Match level="QueryCoverage=94%, HitCoverage=71%, E-value=0.0, Identity=78%"; Hit description =Glycosyl transferase, family 31; Arginase/agmatinase/formiminoglutama se; Concanavalin A-like lectin/glucanase
  Pfam annotation: Domain name=Gal-bind_lectin; Domain location=195 -408; Score=142.1; E_value=1.5e-39; Accession=PF00337.12; Description= Galactoside-binding lectin
MKRLKTEPPSSRRFRLSHFLFGVGVLYLVFISCNFSQFTKVVSSLSGDESYDGIGLDKVATIEDTEDADLSKPFVSSVYKDAFHWRLVDDRDQDAPLRPKEEPMKEEDHGTESVKQILDAYGRITGEILRQRNRTGDLSVLERMADEAWTLGLKAWKELEQVGDKGAGESSIIEGRTKSCPSWISMNRADLLKGDGLMFIPCGLAAGSSITVVGTPHYAHKEYAPVLARSRKGDGLALVSVSQFVVELQGLKSVEGEDPPKILHLNPRLRGDWSKRPVIEHNNCYRMHWGTAQRCDGLPSEVAEEMLVDGFRRCEKWMRNDIVDSKESKTTSWFKRFIGRKQKPEVTWPFPFAEGRMFVLTLRAGVDGYHINVGGRHMTSFPYRTGFTLEDATGLVVKGDLDVHSVYATSLPTSHPSFSPQRVLEMSETWKASALPKHAVKLFIGVLSASNHFAERMAVRKTWMQAAAIKSSDVVVRFFVALEHPVKMSAFGLFIRGVPCYEITLGLFYIIPRMS

SEQ ID NO: 222973 - protein, 610 aa, Glycine max
  Coding DNA Sequence Number=SeqID_106195
  Gene Ontology: Mol. function=signal transducer activity; Cellular component=membrane; Biological process=response to light stimulus
  Homolog annotation: Hit_ID=Q1SGZ1; Match level="QueryCoverage=92%, HitCoverage=93%, E-value=0.0, Identity=80%"; Hit description =BTB/POZ; NPH3
  Pfam annotation: Domain name=BTB; Domain location=22-133; Score=10.0; E_value=0.0005; Accession=PF00651.21; Description=BTBPOZ domain
  Pfam annotation: Domain name=NPH3; Domain location=209-472; Score =380.1; E_value=3.3e-111; Accession=PF03000.5; Description=NPH3 family
  Pfam module annotation: Pfam domain module=BTB::NPH3; Domain location= 22-133::209-472
MNMPSCIPMHVTPVDIVAGVCTTGLPSDVTIEVGEISFLLHKFPLLSRSGLLKKLIAESSKEDGSSCVLQLHDVPGGAKTFKDITRFCYGVKLEITSLNVVSLRCAAEYLQMTENYGEGNLVAQTEAFLNEIFSNWPDSIKALETCEEVQPFAEDLHIVSRCIDSLAMKACSDPNLFHWPVAGSNCKQNQADNSALWNGISSEKPSQLHDWWFYDVSLLSLSLYKRLIIAIEVKGMKSEVVAASLIYYLRRFLPLMNRQSSFTDTSHATIPNTSEADQRALLEEIVELLPSKRGVTSSKHLLRLLRTAMILSASSSCKENLEKRVGAQLDQAALVDLLIPNMGYSVETLYDIDCIQRILDHFMSIYQPASVAASPCIIEQGALIAGADALTPMTMVANLVDGYLAEVASDTNLNLTKFQALAVAIPDYARPLDDGIYHAIDVYLKVHPWLTDSEREQLCRLMNCQKLSLEASTHAAQNERLPLRVIVQVLFFEQLRLRTSISGWFFVSDNLENGQHHSGNFGLTNSDTRQGETAEGNENLRERLLDLEKECSSIRNELQKLTKTKKSWSIFPKRFGFRKKSDFSNHKESKSNDTKTSSSNTNGKPDHENG

SEQ ID NO: 222974 - protein, 610 aa, Glycine max
  Coding DNA Sequence Number=SeqID_106196
  Gene Ontology: Mol. function=ATPase activity, coupled to transmembrane movement of substances; Cellular component=integral to membrane; Biological process=anthocyanin accumulation in tissues in response to UV light
  Homolog annotation: Hit_ID=Q9LJX0; Match level="QueryCoverage=96%, HitCoverage=96%, E-value=0.0, Identity=60%"; Hit description =Multidrug resistance protein 11
  Pfam annotation: Domain name=ABC_membrane; Domain location=35-316; Score=157.3; E_value=3.9e-44; Accession=PF00664.13; Description=ABC transporter transmembrane region
  Pfam annotation: Domain name=ABC_tran; Domain location=391-574; Score= 210.8; E_value=3.2e-60; Accession=PF00005.17; Description=ABC transporter
  Pfam module annotation: Pfam domain module=ABC_membrane::ABC_tran; Domain location=35-316::391-574
MAEAAEPNKALPEAEKKKEQTLPFYKLFSFADKCDWMLMISGSIGAIIHGSSMPVFFLLFGEMVNGFGKNQMNLKKMTEEVSKYALYFVYLGLVVCISSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIINQKPTIVEDPSEGKCLAEVNGNIEFKDVTFSYPSRPDMFIFRNFSIFFPAGKTVAVVGGSGSGKSTVVSLIERFYDPNEGQVLLDNVDIKTLQLKWLRDQIGLVNQEPALFATTILENILYGKPDATMAEVEAATSAANAHSFITLLPNGYNTQVGDRGVQLSGGQKQRIAIARAMLKNPNILLLDEATSALDAGSENIVQEALDRLMVGRTTVVVAHRLSTIRNVDTIAAHMKYSLPRQAPMPHSFGSKKWLEIGTSPTHQLAGHGHLA

SEQ ID NO: 222975 - protein, 458 aa, Glycine max
  Coding DNA Sequence Number=SeqID_106197
  Subcellular localization annotation: CTP_CleavageSite=49; ConfidenceScore=5.10e-01
MASIHANLVPNLSFNHFQTPPSSYLVGAGIVQRGVSLRNCRRKVPCIIKCEKKDDEVEHIQNVSVERPPYYSYLDSTSGQLEPASGARASIPGQEYWPEGTASRVRAARAPAPTAESSTSPSYGTKPGSRRKNYKTTVPAAAASSQPIVESNGTGSGGSSEVLIESLEESQDDVSDFVVYQSEPEEEELSEYEFDKKLGLPHPFIDPKVNKPIEGTLSNDELWWNWRQPEKEQWSRWQRRKPDVETTRVLKAIQIYVKVINFIFDKVFLNAMAETGQIKLHGEHPTLTETALYRARREIYKEERLQAEQERLERDGPIAYYSEWVKAWKRDTSREAIQKHFEETGEDETTQLIEMFCHQTDREYRIMMGTDVRIQRDPLAMRMREDQIKQIWGGDPVYPTVNYIQDPNEVIDYRGPDFHEPTPNMVSYLKEKGKLISREEFDKIMAKEKTEQIEMSCI

SEQ ID NO: 222976 - protein, 185 aa, Glycine max
  Coding DNA Sequence Number=SeqID_106198
MKLEPANDRLEAPAFTAVRTRRSCAVKAPATATEVAITRKKLAPNGTRDISGGCNDNVSDMGGDDSNLDDVSGHGGGGSINGGDSYYDIDHSCNGSDRGDIVGSGGGGDNDNAVAITLMMVVVVITIEDEGGWMVVVMTAVIVVAPSGGGDGCGGDNDGDGGSNTDDDGSVSDDGGSGNDVGGDS

SEQ ID NO: 222977 - protein, 174 aa, Glycine max
  Coding DNA Sequence Number=SeqID_106199
  Homolog annotation: Hit_ID=O04214; Match level="QueryCoverage=38%, HitCoverage=20%, E-value=6e-23, Identity=74%"; Hit description =Putative G protein coupled receptor
MAVGMSGQTFVSDTRDNMRALNRWGYYPLILIGSWAFGTINHIHDFFEPNHKIFWLTFLDVGTAALMSYVLSSRRTSPGAAVKLCLGDLLVMGSNPETASLHMQGVLEWFDSNLSRMLYLLNDYSLGNRKQEGLFNSIAYGLNSSVRRAICERLDNLMLTQLLLVFYLLPLPPP

SEQ ID NO: 222978 - protein, 352 aa, Glycine max
  Coding DNA Sequence Number=SeqID_106200
  Gene Ontology: Mol. function=GTPase activity; Cellular component =microtubule; Biological process=cell division
  Homolog annotation: Hit_ID=Q1SLG1; Match level="QueryCoverage=99%, HitCoverage=57%, E-value=1e-117, Identity=58%"; Hit description =Dynamin central region; Dynamin; Dynamin GTPase effector
  Pfam annotation: Domain name=Dynamin_M; Domain location=50-331; Score= 72.4; E_value=1.5e-18; Accession=PF01031.10; Description=Dynamin central region
PNCIILAISPANQDIATSDAIKIAREVDPSGERTFGVVTKLDLMDKGTNAVEVLEGRQYRLKHPWVGIVNRSQADINKNVDMIVARKKEREYFETSPEYGHLAHKMGAEYLAKLLSEHLEYVIRMKIPSIISLINKAIDELNAELDRIGRPIAVDSGNVEKVVMEADGYQPHLIAPEQGYRRLIEGSIGYFKGPAEASVDAVTLLTLFLDLFKMDFLESTHRAAIAPAMAAIQPAIWSTMAATLNFSTTASPVHLILKELVRKSIAATEELKRFPTLQADIAAAANDALERFREESRRTVTRMVDMESGYLTVEFFRKMHLEPEKNADQKNPNRSNPNPPVDSYTDNHLSKI

SEQ ID NO: 222979 - protein, 259 aa, Glycine max
  Coding DNA Sequence Number=SeqID_106201
  Gene Ontology: Mol. function=nucleic acid binding; Biological process= DNA integration
  Homolog annotation: Hit_ID=Q1S7C5; Match level="QueryCoverage=72%, HitCoverage=33%, E-value=4e-17, Identity=41%"; Hit description =Integrase, catalytic region
  Subcellular localization annotation: CTP_CleavageSite=18; ConfidenceScore=5.21e-01
VTSPTVSSPSASIENSVSVENSASSQPVSVDNFVSNDNLPSIGGSNAGSVEHSDSNPDHDMQQEYSALINNNIWDLVSLPPNKKAIGCKWVFRIKENSDGSLNRYKARLVAKVKAQPDNSLVLIQSKYIRDLQKTRMTEAQSVVGALQYTTITRPEISFAVNKVNLFLLEVFVMLTRPQMLMTEEYRSLAQVTAEILWIQILLSELERVLTRQLIVNHIPGLDQWADALTKSLSPTRFQFLKGKLNVIDSSSKSRPPSV

SEQ ID NO: 222980 - protein, 236 aa, Glycine max
  Coding DNA Sequence Number=SeqID_106202
  Gene Ontology: Mol. function=ribonuclease H activity; Biological process=RNA-dependent DNA replication
  Homolog annotation: Hit_ID=Q1STA3; Match level="QueryCoverage=58%, HitCoverage=38%, E-value=3e-27, Identity=41%"; Hit description =Ribonuclease H
MNGGDWRIPSLPDAKFPVVTVAIKNIIIPIDSQVDSLVWTPLVLGELFFKDAFMLVNPSMRVLPSTKIIWRSSIPPSKSFLFWRPVRGKMPTDENLWNRGCVVVSACPHCYRDYETSDHLFLSCPFAIELPKWLSSVIHFGNSDGAARGTPGLAASGGLFRDYMEVDFCFNAELHAVMLMIEFAERLQGHTWWDELPSFFKDDFYRNRVGLPFYKFCYIVKLLDLDCMLLVDYFYY

SEQ ID NO: 222981 - protein, 124 aa, Glycine max
  Coding DNA Sequence Number=SeqID_106203
  Gene Ontology: Mol. function=GTPase activity
  Homolog annotation: Hit_ID=Q1SLG1; Match level="QueryCoverage=32%, HitCoverage=6%, E-value=3e-11, Identity=80%"; Hit description =Dynamin central region; Dynamin; Dynamin GTPase effector
  Pfam annotation: Domain name=GED; Domain location=46-120; Score=-3.9; E_value=0.0058; Accession=PF02212.8; Description=Dynamin GTPase effector domain
MPERGSVCGGRQQRGWQCWIHRREALLIGGSHWRDGCEVAVEVCSQYAHYCSWKRSTAAETITKIKSAIPHPLQHCYCINDTKDQLGALLDEDPALMEKRAQLAKRLELYKQAMDDINSVAWNK

SEQ ID NO: 222982 - protein, 410 aa, Glycine max
  Coding DNA Sequence Number=SeqID_106204
  Gene Ontology: Mol. function=protein-tyrosine kinase activity; Cellular component=membrane; Biological process=protein amino acid phosphorylation
  Homolog annotation: Hit_ID=Q1SQL4; Match level="QueryCoverage=90%, HitCoverage=97%, E-value=1e-175, Identity=81%"; Hit description =Protein kinase
  Pfam annotation: Domain name=Pkinase; Domain location=81-358; Score =118.6; E_value=1.8e-32; Accession=PF00069.15; Description=Protein kinase domain
  Pfam annotation: Domain name=Pkinase_Tyr; Domain location=81-358; Score=138.2; E_value=2.2e-38; Accession=PF07714.7; Description =Protein tyrosine kinase
  Pfam module annotation: Pfam domain module=Pkinase::Pkinase_Tyr; Domain location=81-358::81-358
MSTKRNTWKSVILILSCYKVKCSLEESEKQVLKQGSFQRLCLSDVSNSSSTQAIEDISISFAGSKLYAFTLEELREATNSFSWSNMLGEGGFGPVYKGFLDDKLRSGLKAQTIAVKRLDLDGLQGHREWLAEIIFLGQLRHPHLVKLIGYCYEDEHRLLMYEYMPRGSLENQLFRKYSAAMPWSTRMKIALGAAKGLTFLHEADKPVIYRDFKASNILLDSDFTAKLSDFGLAKDGPEGEDTHVTTRIMGTQGYAAPEYIMTGHLTTKSDVYSYGVVLLELLTGRRVVDKSQSNGRKSLVEWARPLLRDQKKVYSIIDRRLEGQFPMKGAMKVAMLAFKCLSHHPNARPSMSDVVKVLEPLQDYDDVFIGPFVYGMAWWSSVFTIMEGDSSSSMITSELRPEIERSAAAK

SEQ ID NO: 222983 - protein, 79 aa, Glycine max
  Coding DNA Sequence Number=SeqID_106205
SLDEDDSLDGISDTHDEVADMIQPVYKELKIHFGMMLCIITISTRVILMRKTFVVWRCHRVLMLDKNYMLAWILILKMR

SEQ ID NO: 222984 - protein, 170 aa, Glycine max
  Coding DNA Sequence Number=SeqID_106206
MDSSECRPWGSHGLGAPLSMCRSHKVGAFSQNNVTLTGLPMILLSESDLTYPLCGVSCHADCHFVQLKSTKELDCHAKDPHFRIKSTTLGLAHFFIEAIFDIMEDVGALLNLVTIDHFVFAWLKMDPIVDLDAKAIQSTNWGSILLARDMFYGVKPTSRYNKISVEHYNP

SEQ ID NO: 222985 - protein, 51 aa, Glycine max
  Coding DNA Sequence Number=SeqID_106207
MEVVFKKGDHIDHIVNAGAKPPGAKGSWSFGLLEKIEVEDDDSSLEPSPYL

SEQ ID NO: 222986 - protein, 224 aa, Glycine max
  Coding DNA Sequence Number=SeqID_106208
MKLRKKKEDNVISDNRFKLLNEREVFEEKAYLVGIECKNDVQDFGIEESLSELSQMGGGSSGSGKGGEKGVSQGWVNEGGSLRETDNPVSKSYELRQVFVDGPLLCELEQCTLWIIIEGRSEARFQFLEECCPGSDEVIPERDFKDPSHGIVAVKMGYLKLEVRAMVVVGQWGRRWCMAEDDIVEAISGGFGMCVVFCHGATGTMVGRTSLLRDCLVFEVKAPS

SEQ ID NO: 222987 - protein, 97 aa, Glycine max
  Coding DNA Sequence Number=SeqID_106209
MPLRINSNLELLIPIYYAKQNLRILEMVATNERENESKETTRGASTTGVRPSKMHICFDLKDGEDHNVFVDPSTEEELKDEEEAGDYDWIGHKSGNL

SEQ ID NO: 222988 - protein, 1148 aa, Glycine max
  Coding DNA Sequence Number=SeqID_106210
  Gene Ontology: Mol. function=nucleic acid binding; Cellular component= intracellular; Biological process=DNA integration
  Homolog annotation: Hit_ID=Q1S3Z1; Match level="QueryCoverage=99%, HitCoverage=97%, E-value=0.0, Identity=40%"; Hit description =Integrase, catalytic region; Zinc finger, CCHC-type
  Pfam annotation: Domain name=rve; Domain location=376-539; Score =169.2; E_value=1e-47; Accession=PF00665.16; Description=Integrase core domain
  Pfam module annotation: Pfam domain module=RVT_2::rve; Domain location=741-988::376-539
MRALLVHQGLDVALNGKNLPTHLSENEKKELLDKAHNALILSLGDKVLREISKEKSVAAVWLKLESLYMTKSLANRLFLKQRLYTFKMPSGKSLEDHLDEDEDQALLLLSSLPSEYNSLSDTFIYGRDSLSLDEVKAALFSKELKKKLEGGGYQDAEGLYTRGIMKKKDPKNKNGSRSKSRDGRKRSISRKIAQTQGKRSRAIKRVRMEMRTWPQKECNGGQVLLGDNKACKVVGIGVVELRLAYGTIRMLKEVRHVPYLKRNLISLGMLDKQGDTCKAKGGVLKVTMGSLVILKGRLVHGLYLLEGNTTSPSIASSNTASSSAATMTAQTHSQASLRELSKQKLLGKESLDALEFCEHCIYGKAKRLKFAVAEHHSKGTLDYIHSDLWGPAYVFSHSGARYFLSIIDDFSRKVWVFILKSKDEVFAKFKEWKLLVETQTSKKVKKLRTDNGLEFCSNEFNQFCKKNGTERHRTVKGTPQQNGLVERMNRMIMERVICLLSDSNCLGHFWGEAVMTICYLTNRCPSTATNMVTPKKMWSGHPPNLKNLRVFGCVAYARIRQGKLESRAYKCMFLGYPQGVKGYRLWCMDKGHPRVLISRDVVFKESEMYHLKEDSSKGKAVWMQESVQLEVESVAGSSSTRGGRPLLGSTGAEVERPEHGSSGARVKTQGEEQEAGIMRSDLQDYLLSRDRERRVSNPLNRVGCADMVAFALNVAEHIEGSEPKSYVDAVNRKHSKEWTTAMQEEIDSLHKNGTWVLVDKPKASKLVSYRWLYKLKEEIPRVEKVRKGINYNEIFSPVVKHSSIKMVLALVIQQDMELDQLDVKTGFLHGELDEEIHMMQPEGFIEEGTNDKVCLLKKSLYGLKQSPRQWYKRFDTFIVGIGFTRSEYDNCVYSKVALDGAVTYLLLYVDDMLIAFICKANIEEVKVLLEREFEMKNLGVASKILGMQITRDRVQGVLCVDQRSYVAKVLKTLNMDQSKAVLTPMAQHFKLSHQHSPQTKEEATYMEKVPYANAVGSLMYLMICTRPDLAYAVNLVSRYMGKPGKYESSMDDVVGFVDSDYVGCLDTRRSLTGYVFKFCGNTAIKEVVCMKGMATNLHTKVKVLREVIAKGEIVVEKMHTEDNPTDALMKALPGPKFKHCVQIMKVEG

SEQ ID NO: 222989 - protein, 140 aa, Glycine max
  Coding DNA Sequence Number=SeqID_106211
  Homolog annotation: Hit_ID=Q9SK36; Match level="QueryCoverage=86%, HitCoverage=76%, E-value=3e-34, Identity=58%"; Hit description =Expressed protein
MGNQYHQATDGLLSLFTKANHDLSMVHHRLEKEFQQVYPDNANPMKLVSRIKKVQEDISILKGQCHELLAAKQDLIDKAQRVLVENRNLVQRMQPSLGISPSGEDDAAFTNFKQELGKSSIPEWHFLLLHSSIQPPAPAL

SEQ ID NO: 222990 - protein, 122 aa, Glycine max
  Coding DNA Sequence Number=SeqID_106212
  Gene Ontology: Mol. function=hydrolase activity, hydrolyzing O -glycosyl compounds; Cellular component=vacuole; Biological process =carbohydrate metabolic process
  Homolog annotation: Hit_ID=P23535; Match level="QueryCoverage=100%, HitCoverage=35%, E-value=2e-61, Identity=93%"; Hit description =Glucan endo-1,3-beta-glucosidase, basic isoform precursor (EC 3.2.1.39) ...
  Homolog annotation: Hit description=((1->3)-beta-glucan endohydrolase) ((1->3)-beta- glucanase)
  Pfam annotation: Domain name=Glyco_hydro_17; Domain location=1-122; Score=-45.4; E_value=2.1e-08; Accession=PF00332.9; Description =Glycosyl hydrolases family 17
MGNNLPPANEVIDLYRSNNIRRMRLYDPNEAALQALRNSGIELILGVPNSDLQGLATNVDTARQWVQRNVLNFWPSVKIKYVAVGNEVNPVGGSSWQAQYVLPAVQNVYQAIRAQGLHDQIK

SEQ ID NO: 222991 - protein, 190 aa, Glycine max
  Coding DNA Sequence Number=SeqID_106213
  Gene Ontology: Mol. function=nucleic acid binding
MSDEISLILHHNGKFIQNANGALEYVGGEFCVWKEVETNLVNVWTAQELCKACRIYVKFVSIYYLVSGIGLQRLENDRDVLSICQIGLADPEKKVLVYLENDDPKGGPVNDIGPVIKVHGMPINCSAENVIEVVVEECTQNGIKDMDVDGAKGGSDDEMKYLELVYKMQKLKLLKQELKQNMKLLELKLK

SEQ ID NO: 222992 - protein, 45 aa, Glycine max
  Coding DNA Sequence Number=SeqID_106214
MGAIYRLDRNIFFLILQVRNSFLVHLHVDERECRVLTLKGWRPWD

SEQ ID NO: 222993 - protein, 267 aa, Glycine max
  Coding DNA Sequence Number=SeqID_106215
  Gene Ontology: Mol. function=hydrolase activity, hydrolyzing O -glycosyl compounds; Cellular component=vacuole; Biological process =carbohydrate metabolic process
  Homolog annotation: Hit_ID=P23535; Match level="QueryCoverage=92%, HitCoverage=70%, E-value=1e-115, Identity=81%"; Hit description =Glucan endo-1,3-beta-glucosidase, basic isoform precursor (EC 3.2.1.39) ...
  Homolog annotation: Hit description=((1->3)-beta-glucan endohydrolase) ((1->3)-beta- glucanase)
  Pfam annotation: Domain name=Glyco_hydro_17; Domain location=1-266; Score=431.9; E_value=8.5e-127; Accession=PF00332.9; Description =Glycosyl hydrolases family 17
  Subcellular localization annotation: CTP_CleavageSite=43; ConfidenceScore=5.05e-01
MGDNLPLANEVTFKALPPSTAQQWVQSNVLNFWPSVKIKHVVVGNEINPVGSSSEFAQYVLPAIQNIYQAIRAQGLQDLIKVTTAIDMTLLGNSYPPSQSYFRTDVRSYLDPIIGYLVYANAPLLANVLPYFSYSNNPIDISLSYALFNSTNVVVWDGQYGYQNLFDAMLDAVHVAIDNTGIGYVEVVVSESGWPSDGGFAATYDNAHVYLENLILRAKRGSPRRPSKPTETYIFDMLDENLKSPEIEKHFGLFFPNKTKKYPFGFV

SEQ ID NO: 222994 - protein, 124 aa, Glycine max
  Coding DNA Sequence Number=SeqID_106216
  Gene Ontology: Mol. function=serine-type endopeptidase activity; Biological process=response to DNA damage stimulus
  Homolog annotation: Hit_ID=P0AG11; Match level="QueryCoverage=91%, HitCoverage=82%, E-value=1e-39, Identity=65%"; Hit description =Protein umuD (EC 3.4.21.-) [Contains: Protein umuD']
  Pfam annotation: Domain name=Peptidase_S24; Domain location=35-102; Score=64.5; E_value=3.3e-16; Accession=PF00717.13; Description =Peptidase family S24
RVACGFPSPAQDYVEDRLDLNRLAVRHPSATYFIKVSGDSMIGAGIGDGDLLVVDRSLTAGHGDIVVASVAGEFTVKELQTRPVLRLLPHNVRYQPITFQSEEELQIFGVVTHTLKTHKHVRAG

SEQ ID NO: 222995 - protein, 76 aa, Glycine max
  Coding DNA Sequence Number=SeqID_106217
  Gene Ontology: Mol. function=DNA-directed DNA polymerase activity; Biological process=DNA repair
  Homolog annotation: Hit_ID=UPI00005F9C03; Match level="QueryCoverage =97%, HitCoverage=17%, E-value=2e-18, Identity=59%"; Hit description =COG0389: Nucleotidyltransferase/DNA polymerase involved in DNA repair
MGEPYFKFKEKRFPSRVYVFSSNYALYADLSSRVMQTLTDLAPAIEIYSIDEAFVNVSGVSNCLALEAFGHQMRTQ

SEQ ID NO: 222996 - protein, 262 aa, Glycine max
  Coding DNA Sequence Number=SeqID_106218
  Gene Ontology: Mol. function=protein dimerization activity; Cellular component=endoplasmic reticulum; Biological process=proteolysis
  Homolog annotation: Hit_ID=O50173; Match level="QueryCoverage=99%, HitCoverage=63%, E-value=1e-93, Identity=65%"; Hit description =Indole-3-acetyl-aspartic acid hydrolase
MLRPLPACITPTFTRDAPSLCVAMLCNAMAACTAASRALRPSSGLPPGVCGHAGKVHVEFGGRHKIIAAADHRPGRHAGANMDGGEIVHVIQRSGGHHGTRAARPFFCRLEDQLEGAAELRVILLKYLRQPQTNRSVAVVCAGVHHPGIAGGKPVAERAVALIGWARAAGIQGRDNPGKPALKRRQPFLRRALGTGAGKFSRQDGLIGQAHSAFGIHHVAPHRQLITQRVQGFCDLRRGTKLHPAGFSKLVKIATPCAQLRG

SEQ ID NO: 222997 - protein, 103 aa, Glycine max
  Coding DNA Sequence Number=SeqID_106219
  Subcellular localization annotation: CTP_CleavageSite=54; ConfidenceScore=5.13e-01
MMTTKDYDKSDEQKAQENQRTSISRKSRTSQTFQESRRIQDSRRKPTNKNQDSRSQESRSRFKTQDSRMKKRLNQDVTLQKGFDSFKWVLSFSKRYNSSGWLS

SEQ ID NO: 222998 - protein, 124 aa, Glycine max
  Coding DNA Sequence Number=SeqID_106220
MCHVWSTIDTWKSKCTRAALKKLNLVEDRSIPRVQAHFFPKNICVSWSLALMWEVVEAKNRKDELDSGPAPPDKVRVEAFVPVFRMVVLKLEQRELSYPNFVRGPLLDDMRPFFGPREVLGTHH

SEQ ID NO: 222999 - protein, 207 aa, Glycine max
  Coding DNA Sequence Number=SeqID_106221
  Homolog annotation: Hit_ID=O49444; Match level="QueryCoverage=26%, HitCoverage=19%, E-value=2e-10, Identity=52%"; Hit description =Copper-binding protein-like
MEKAFAWTEGLNGINSSDSCMIKSDNSYEAWIPLLFKVLPCWANSSEETPVLSPLVPVSLLGSSKGEDQKQKVVTKQSPKKVNLVAALVRGMLVKDALMQLELTIKRAAKTVYQENYSCFLIGNSELPNSEENYVLKEECRASILSYPIPIHDKWFPSQTRQLTAVLLGTKLDSLVIQLSIHYDCYPCLKMKASLRVEDVARVWDPC

SEQ ID NO: 223000 - protein, 240 aa, Glycine max
  Coding DNA Sequence Number=SeqID_106222
MDPGHHEVRYDHEDNHRVFLVDGVDALEVLVREVNVDVPDDVVAHAVVAVVFVCLDLPLFFYLLPGSCAAPLDVLLYLVMSDPDLGSFVLGSRMGTSRLNTSSRIVTDKGGRGHAVRLAGGILRTKLFNEGVEVVYGPWFAYVRKASRCSFGSVVPLYPSRLSGFHPKGMPASIMHVACVSEVLFPLGAFKQGVGKLLVSLGMSNMSLQLSVCVCHNYQMRMGVFEKGLVFEARSTANHG

SEQ ID NO: 223001 - protein, 72 aa, Glycine max
  Coding DNA Sequence Number=SeqID_106223
  Gene Ontology: Mol. function=ribonuclease H activity; Biological process=DNA integration
MAYGRQNLQMRCFQDVHSPHGEGPKGAQTVKIDRRSVWHVCKVMASSTSPGKVEGVYLECWPVVVSSHRFGG

SEQ ID NO: 223002 - protein, 412 aa, Glycine max
  Coding DNA Sequence Number=SeqID_106224
  Gene Ontology: Mol. function=protein binding; Cellular component =integral to membrane; Biological process=homophilic cell adhesion
  Homolog annotation: Hit_ID=Q4K3M9; Match level="QueryCoverage=98%, HitCoverage=27%, E-value=3e-65, Identity=38%"; Hit description=Rhs family protein
  Pfam annotation: Domain name=RHS_repeat; Domain location=109-145; Score=27.4; E_value=5.1e-05; Accession=PF05593.4; Description=RHS Repeat
  Pfam annotation: Domain name=RHS_repeat; Domain location=11-48; Score= 11.4; E_value=1.5; Accession=PF05593.4; Description=RHS Repeat
  Pfam annotation: Domain name=RHS_repeat; Domain location=171-207; Score=8.0; E_value=4.2; Accession=PF05593.4; Description=RHS Repeat
  Pfam annotation: Domain name=RHS_repeat; Domain location=244-281; Score=17.3; E_value=0.054; Accession=PF05593.4; Description=RHS Repeat
  Pfam annotation: Domain name=RHS_repeat; Domain location=295-335; Score=30.5; E_value=5.8e-06; Accession=PF05593.4; Description=RHS Repeat
  Pfam annotation: Domain name=RHS_repeat; Domain location=342-388; Score=2.8; E_value=20; Accession=PF05593.4; Description=RHS Repeat
  Pfam annotation: Domain name=RHS_repeat; Domain location=57-95; Score= 12.8; E_value=1; Accession=PF05593.4; Description=RHS Repeat
  Pfam module annotation: Pfam domain module=RHS_repeat::RHS _repeat::RHS_repeat::RHS_repeat::RHS_repeat::RHS_repeat::RHS_repeat; Domain location=109-145::11-48::171-207::244-281::295-335::342 -388::57-95
NQNGESYHFEWGADSLLLAQVGLDGVATSYDYDAAGRAVARTFAAGHPQAITHRFAFSPAGQLMARITPEGQTRYDYTAAGQLASVAQHLPLGENQWSREAEQAITFAYDKAGRVIAEQGDQGSLAWQYDALGNCTALTLPDGRQLKQLYYGSGHLLSIALDNLPVSEFTRDTLHRELSRSQGGLTTRSDYDRLGRLVRRDVFDGEAQRPAPRRWSRRRDFDYGNNLIREQRDDNPFSQTLWHYDSAGRLLVQEGAQPGNDTWRWDGAGNPLDRSAAAAVTHNRVTQLNGIRWRYDVHGRTSEKDDGQTRWRYRYDDEHRLIEVVSEPRDRNKPQVQVSFRYDPLGRRISKRVQRLLHGKPAGAATLTRFVWDGFRLLQEIHDDVPLTYVYSDANSYEPLARIDGNEGAEIF

SEQ ID NO: 223003 - protein, 177 aa, Glycine max
  Coding DNA Sequence Number=SeqID_106225
  Gene Ontology: Mol. function=transferase activity
  Homolog annotation: Hit_ID=Q6WB12; Match level="QueryCoverage=79%, HitCoverage=30%, E-value=2e-19, Identity=36%"; Hit description =Anthocyanidin 3-O-glucoside-3'',6''-O-dimalonyltransferase
MTMITPSSKLTLTKGNKSWVRAEETKNKRVMLALNVDCRARLEPPIPPTYFGNCVGARLAIAETREILGEDGLIVVVDALNDALGSLKDGALSGAENWSRWLLESFSDDVRIIGVAGSPRFEAYSNDFGWGRPKKVEMASIDRTGALCLSDSIEFLQPGGSTSSRAAATAVELQFAL

SEQ ID NO: 223004 - protein, 80 aa, Glycine max
  Coding DNA Sequence Number=SeqID_106226
MHERKRNSWGSEEKARMENCTRGSALGNHEAWLQTLWWRMHERKRNSWGSEEKARMENCTRGSALGNHEAVAPNSLVEDA

SEQ ID NO: 223005 - protein, 152 aa, Glycine max
  Coding DNA Sequence Number=SeqID_106227
MENCTRGSALGNHEAWLQTLWWRMHERKRNSWGSEEKARMENCTRGSALGNHEAWLQTLWWRMHERKRNSWGSEEKARMENCTRGSSLGNHEAWFQTLWWRMHERKRNSWGSEEKARMENCTRGSSLGNHEAWFQTLGWRMHERKRNSWGSK

SEQ ID NO: 223006 - protein, 425 aa, Glycine max
  Coding DNA Sequence Number=SeqID_106228
  Gene Ontology: Mol. function=hydrolase activity; Cellular component =endoplasmic reticulum; Biological process=cell division
  Homolog annotation: Hit_ID=UPI00005DC1CF; Match level="QueryCoverage =99%, HitCoverage=77%, E-value=1e-116, Identity=50%"; Hit description= hydrolase/ protein serine/threonine phosphatase
MDRWQESFNRFRHIFGLNAQGKYTDMPVYYIPGNHDIGYESLHSLKPEVFQHAIAQLLMPKVIRRYEETFGIRNYRFTVGKVDFIAVDAQTLDGHPQNLLTSQTWDFVKNISADDVVHPRVLLTHIPLYRRDDTYCGPDRSSPIINQRIRHSLNGNTNDISMSENIGELRAGTIVRKLILSGHDHDQCTVSHQSKSGPVNEHTLGTISWQQGNLYPSFMLLSVDNSTHPNASIPKEALLTHLCYLPMQTHIYIWYIVLFILTLLAALFWPTSGTSFWHQCCGLFGYCKQLIACIFSRSETKEKDEDANYEYEMMWDAEGTMHLVKKTLNASTVNSNDQSLGERGYVVMRAAARKNTAQEGDLSVNVDMASGIGLDPVAKMPPRTGKSKTKIIVQRLIRTLRMLTVISAVNVPLYMMLLFKDWIDK

SEQ ID NO: 223007 - protein, 61 aa, Glycine max
  Coding DNA Sequence Number=SeqID_106229
  Subcellular localization annotation: CTP_CleavageSite=33; ConfidenceScore=5.30e-01
MSPPPLGPHNHSQTHLKLSGRLPLQAPVSILPRAQPRSVALSGWLTKPEDWLSERVKINTS

SEQ ID NO: 223008 - protein, 159 aa, Glycine max
  Coding DNA Sequence Number=SeqID_106230
  Gene Ontology: Mol. function=nucleic acid binding
  Homolog annotation: Hit_ID=Q10N14; Match level="QueryCoverage=73%, HitCoverage=40%, E-value=4e-13, Identity=35%"; Hit description=RNA recognition motif family protein, expressed
SNIVMLFAGGSNGGVVKNNASSPPAINHVQPYYYPVRTTAALPFHNHTLPFYGYAPTYIVTDVNYNYNQKLCYGSGGTYMNGQHVYPRQAIVGANTLMPMYPLYQYHHPTETIGVPAHNFYPTASWAPMTIMSKPSSIVPHTGASHGNMSVSFYCTAVT

SEQ ID NO: 223009 - protein, 208 aa, Glycine max
  Coding DNA Sequence Number=SeqID_106231
MSDLGGECHCVSALGLECHSALDRFSVCSTRALECGLFPTSPKQLSDSSDKIGWVSLNNVEFDSNIFRHLKDHFFKSDPTLVERVNKAILEQLVTSLDTWLILSLSSASDPLVALDGKVPNLVLRPLMKQVGPTSGTVPLFAATPPVGEGGQLAGEVCPIVVGAEAAGLMATTGRLSIVQDVHPAPPIVKAPATVATPASSPPPTIVV

SEQ ID NO: 223010 - protein, 71 aa, Glycine max
  Coding DNA Sequence Number=SeqID_106232
MDWEVISIGGSSYEDTCRGASNSESYSTERPFAVVEEPFPITVILPLSASGGVRRSSGDRDVRRLPVFDVA

SEQ ID NO: 223011 - protein, 271 aa, Glycine max
  Coding DNA Sequence Number=SeqID_106233
  Subcellular localization annotation: CTP_CleavageSite=35; ConfidenceScore=5.35e-01
MAPVASPSNVLATVTSPSSSSRPRVSLYHLYTFSDADSLWGATYKLEQKTPVGFVSAFDKNLIRSAGMQSATDFSKVFLQRTFGNLEENGLRHQETMQKVASLEAEVARWRATARTLWRVKHPKDLEAEKMDLGGKMETMAAEKNGLAKAAKEREANRELEEELLLYKKKASFFAKDLDLGLFDPFKDVKDDVLLDEEDIAVEEEADDEGQHRKQDFVDVEEYIPRADVGFCKNMYQGHTLGFGDVTSKGRPWVFGLTKGGPWVYQAFDQG

SEQ ID NO: 223012 - protein, 60 aa, Glycine max
  Coding DNA Sequence Number=SeqID_106234
MLAMEPSPTVTEVEMSDSTGAWTMMIGGKEEVIVEGDNVRELRAVEQRLMLQFFCACACT

SEQ ID NO: 223013 - protein, 115 aa, Glycine max
  Coding DNA Sequence Number=SeqID_106235
MYSDNGGNNDDSNTDDDDGTSFVVQVKGTSTWVVVTENKRGYISCGSVLVEATSTSLFKENKGGPLDPTDDNDSGGSNENSSGENNGNGGNSDSDDDRNSNDGGSDNDINGNDVM

SEQ ID NO: 223014 - protein, 133 aa, Glycine max
  Coding DNA Sequence Number=SeqID_106236
  Homolog annotation: Hit_ID=Q9LE80; Match level="QueryCoverage=97%, HitCoverage=52%, E-value=4e-29, Identity=50%"; Hit description =Arabidopsis thaliana genomic DNA, chromosome 3, P1 clone: MJK13
MLGFFKEKLVKAPKEVNNPASLNSCSKPKPSHEILKDFMPYNSSNAFSMCFGNDALLAYSPLNKPFIHHSGLDNIYCVFLGGLHNLSMVNKQYGLSKGTNEAIFITKVYRTLHDRGPHPADQVVEELEGSFDL

SEQ ID NO: 223015 - protein, 44 aa, Glycine max
  Coding DNA Sequence Number=SeqID_106237
MVLDPRLVLVLFIGTCILAINGDTDPNDVVFELSAMCCVCYVAG

SEQ ID NO: 223016 - protein, 233 aa, Glycine max
  Coding DNA Sequence Number=SeqID_106238
  Homolog annotation: Hit_ID=Q1RTB4; Match level="QueryCoverage=65%, HitCoverage=36%, E-value=1e-09, Identity=28%"; Hit description=IMP dehydrogenase/GMP reductase
MARIAKEKTKALADQGKWASFIDVLALLVFGVVLFPNMDGLVDLAAIDAFLTCHHSKESPSRTSFVMKIDPSIPYKVIACVPRKGRKIGSNSSLGFSNVPLMGTRGCINYNLVLAIRQLDYPMRGAPLEESITPFITWGFSDPNARILQRVHKAWRAVQKKDKELRGSRNGINVSYHKWLKAQMQELDWLLKVKVSSEEGAKIPEESEEVQALKVELERAQVVKEKFKTTSIK

SEQ ID NO: 223017 - protein, 422 aa, Glycine max
  Coding DNA Sequence Number=SeqID_106239
  Gene Ontology: Mol. function=protein-tyrosine kinase activity; Cellular component=integral to membrane; Biological process=protein amino acid phosphorylation
  Homolog annotation: Hit_ID=Q1SUC1; Match level="QueryCoverage=99%, HitCoverage=52%, E-value=1e-177, Identity=76%"; Hit description =Protein kinase
  Pfam annotation: Domain name=Pkinase; Domain location=78-389; Score =85.2; E_value=2e-22; Accession=PF00069.15; Description=Protein kinase domain
  Pfam annotation: Domain name=Pkinase_Tyr; Domain location=78-389; Score=104.4; E_value=3.3e-28; Accession=PF07714.7; Description =Protein tyrosine kinase
  Pfam module annotation: Pfam domain module=Pkinase::Pkinase_Tyr; Domain location=78-389::78-389
MNSMQTSSVIDLKTFDTSATPISLKPPPFDRHKSFDEDEFSNKPVIVNKPTKVKKTVTAPTNVKSYSIADLQIATGSFSVEQLLGEGSFGRVYRAQFDEGKVLAVKKIDSSVLPNDMSDDFVELVSNISQLHHPNVTELVGYCSEHGQHLLVYEFHKNGSLHDFLHLPDEYSKPLIWNSRVKIALGIARALEYLHEVCSPSVVHKNIKSANILLDTDFNPHLSDSGLASYIPNANQFPCLSPKSLSCYLKHRQCTSHPTFVGCWLGVRGLGNWHEVLNNNAGSGYEAPEVGLSGHYTLKSDVYSFGVVMLELLSGRKPFDSSRPRSEQALVRWATPQLHDIDALAKMVDPTLEGLYPVKSLSRFADVIALCVQPEPEFRPPMSEVVQALVRLVQRTNMSKRTFGTDQGGSNRGGDDQDTQDM

SEQ ID NO: 223018 - protein, 503 aa, Glycine max
  Coding DNA Sequence Number=SeqID_106240
  Gene Ontology: Mol. function=nucleoside-triphosphatase activity; Cellular component=protein complex; Biological process=protein catabolic process
  Homolog annotation: Hit_ID=Q9SSB5; Match level="QueryCoverage=99%, HitCoverage=100%, E-value=0.0, Identity=81%"; Hit description=26S protease regulatory subunit 7
  Pfam annotation: Domain name=AAA; Domain location=233-468; Score =241.8; E_value=1.4e-69; Accession=PF00004.19; Description=ATPase family associated with various cellular activities (AAA)
  Pfam annotation: Domain name=AAA_2; Domain location=229-409; Score= -39.7; E_value=0.0096; Accession=PF07724.4; Description=ATPase family associated with various
  Pfam annotation: Domain name=AAA_3; Domain location=233-365; Score= -22.5; E_value=0.094; Accession=PF07726.2; Description=ATPase family associated with various
  Pfam annotation: Domain name=AAA_5; Domain location=233-355; Score= -22.0; E_value=0.084; Accession=PF07728.4; Description=ATPase family associated with various
  Pfam module annotation: Pfam domain module=AAA::AAA_2::AAA_3::AAA_5; Domain location=233-468::229-409::233-365::233-355
MAIEHEDDLKDEKNPRPLDEDDIALLKTYGLGPYSTSIKKAEKEIKDMAKKVNDLCVYTGCPNCMDWMLLTLVHLLKCLLPVVTIGIKESDTGLAAPSQWDLVSDKQMMQEEQPLQVARCTKIINPNSEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRLVDFIVRACLCNASLSIMMMHSKCPFKFIFSLLLTWAYGHVFLSTISRPDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 223019 - protein, 84 aa, Glycine max
  Coding DNA Sequence Number=SeqID_106241
MGHNRNAYPYSLPPNYMPPTMHVPNENVNHVILVTVEGQQPQPIGGTHEEPRECAQGDLDPYPTFTTEGPTYNAMPQPNTAGAP

SEQ ID NO: 223020 - protein, 106 aa, Glycine max
  Coding DNA Sequence Number=SeqID_106242
MMHAPNSTTRMQCGTYGQIMDKCLVKLQTKFREDPTVNEGWTTFLPRQLHPRAKPSFPELSTFRRGIHRAKRALLAKLPYLVYFLNCMVLLSAASKELSAKPCGRP

SEQ ID NO: 223021 - protein, 314 aa, Glycine max
  Coding DNA Sequence Number=SeqID_106243
  Gene Ontology: Mol. function=zinc ion binding; Cellular component =integral to membrane; Biological process=ubiquitin cycle
  Homolog annotation: Hit_ID=Q1SR68; Match level="QueryCoverage=99%, HitCoverage=96%, E-value=2e-73, Identity=50%"; Hit description=Zinc finger, RING-type
  Pfam annotation: Domain name=zf-C3HC4; Domain location=109-150; Score= 33.5; E_value=7.6e-07; Accession=PF00097.15; Description=Zinc finger, C3HC4 type (RING finger)
MSASDNAWGESDTIEITGKIMVVAIIFLFMVVVFVLVLHLYAKWFWWSMEENATPQPRHRRRRRRRFVFAPGQDSVIYETHQVGLDPSVLKSLPVLVFQPEDFKEGLECAVCLSEIVQGEKLRLLPKCNHGFHVDCIDMWFHSHSTCPLCRNPVAFESSKCEESNVSGNSDSSSSSYEENSGGVSGLEPSNFPTNVLVWGNQTQVSSIGVSLEEKEEEEEEGTSQSQQPPCSTPPTASSSASSNVNGRCHGMLVIDIPSECTSSSLSPSGSRCAEEEVKSPMAATLRSFKRLLSRDKKLSPCSPSSVDVEQAQS

SEQ ID NO: 223022 - protein, 188 aa, Glycine max
  Coding DNA Sequence Number=SeqID_106244
MAKFDPEIVMEFYANAWPTEEGVRDKCSWVSVHVAHLISDAIYQFAGIMPPRHPVDPEKSNRALGFPTLITGLCQFYGVSPKEDQQQPAADAPLPPLEEVPSLRSISDHLRRIELQMHNGVRTPVLSLGLPPNSSGPRWPSLGTRPILRREKDPWGPLGVRKELRRITTWLTCWTSSLDEAELHDRDR

SEQ ID NO: 223023 - protein, 106 aa, Glycine max
  Coding DNA Sequence Number=SeqID_106245
LITGLCQLFGVPVTPRWRTADPDAPPPPHQADPARSFDTERLQSQGFAPFPCPTPDQFRAKVAWPRDWPEAQAGEAPAEAPDDADEARMDEEMTDLLDFLGGSGAT

SEQ ID NO: 223024 - protein, 106 aa, Glycine max
  Coding DNA Sequence Number=SeqID_106246
MTEARQKGVRKGRSLPPNSPRRARLLPPEATAFWGKNLEGPTFEEVTKNSRITQQHLLLVSATLQNFTDRVTLLPFDSRRISGLTYCATKGAKYLEAANQRLHVIK

SEQ ID NO: 223025 - protein, 131 aa, Glycine max
  Coding DNA Sequence Number=SeqID_106247
  Homolog annotation: Hit_ID=Q6ZRT7; Match level="QueryCoverage=56%, HitCoverage=61%, E-value=2e-07, Identity=34%"; Hit description=CDNA FLJ46115 fis, clone TESTI2037085
MSILTLGSKREENFQSKKKRRKISNQRESKKKREGKFPIKGKKKRKEIPNQRVGESKKKRKEIPNQRVGESKKKRKKIPNQRMGESKKGKERKFLIKETRRNVQKGLLTRQYLNNTELSPNEQKKEKETMT

SEQ ID NO: 223026 - protein, 87 aa, Glycine max
  Coding DNA Sequence Number=SeqID_106248
MVIMGDGERSWNVGNGFGRKKEKKMTFFLSYTKAKAETLKLAKILLKHKHLDNEGKLELLHMMSNVMSRNKIGLHNAQGKIKCLMKK

SEQ ID NO: 223027 - protein, 112 aa, Glycine max
  Coding DNA Sequence Number=SeqID_106249
DARKKAQAIQKQNTTPHVLSHGGYEYLENKLTDEKRKKKLEEAAQSGSTNTVIDPPSPIRRQVKWKMTRTKETGQMTSEAAKEIAEKISRCHDQEILWIGSKDLPHIFLYGS

SEQ ID NO: 223028 - protein, 243 aa, Glycine max
  Coding DNA Sequence Number=SeqID_106250
  Gene Ontology: Mol. function=small conjugating protein ligase activity; Cellular component=endoplasmic reticulum; Biological process=protein modification process
  Homolog annotation: Hit_ID=Q1SR70; Match level="QueryCoverage=84%, HitCoverage=86%, E-value=1e-103, Identity=87%"; Hit description =Ubiquitin-conjugating enzyme, E2
  Pfam annotation: Domain name=UQ_con; Domain location=9-157; Score =119.6; E_value=8.7e-33; Accession=PF00179.16; Description=Ubiquitin -conjugating enzyme
MAEKSCIKRLQKEYRALCKEPVSHVVARPSPSDILEWHYVLEGSEGTPFAGGYYYGKIKFPPEYPYKPPGISMTTPNGRFMTQKKICLSMSDFHPESWNPMWSVSSILTGLLSFMMDNSPTTGSVNTTTAEKQRLAKSSLSFNCKNATFRKMFPEYVEKYNQQQLSEQAAPERVSSDTSPDKSSRPVLEKKLESNGEDMRRVDGLKEGNEMMNMEAAFYYGLNLLLCVYVASFLVVNVKKLHA

SEQ ID NO: 223029 - protein, 390 aa, Glycine max
  Coding DNA Sequence Number=SeqID_106251
  Gene Ontology: Cellular component=cytoplasm; Biological process =vesicle docking
  Homolog annotation: Hit_ID=Q1SR77; Match level="QueryCoverage=99%, HitCoverage=44%, E-value=1e-138, Identity=69%"; Hit description=AMP -dependent synthetase and ligase
  Pfam annotation: Domain name=Sec10; Domain location=1-378; Score =69.8; E_value=8.8e-18; Accession=PF07393.2; Description=Exocyst complex component Sec10
  Subcellular localization annotation: CTP_CleavageSite=51; ConfidenceScore=5.13e-01
MEELRAESQQISDSSGSIGRSKGASVVSSQQQISVTVVTEFVRWNEEAISRCNLFASQPATLATHVKAVFTCLLDQVSQYIADGLERARDSLTEAANLRERFVLGTSVTRRVAAAAASAAEAAAAAGESSFRSFMIAVQRSGSSVAIIQQYFANSISRLLLPVDGAHAAACEEMATAMSSAEAAAYKGLQQCIETVMAEVERLLSAEQKATDYRSPDDGMAPDHRATSACTRWMSLEIRTETSISTDDIDIFYDLYLCIVVAYLSRVLESAFTALEGLNKQAFLTELGNRLHKVLLNHWQKYTFNPSGGLRLKRDITEYGEFLRSFNAPSVDEKFELLGIMANVFIVAPESLSTLFEGTPSIRKDAQRFIQLRDDYKAAKLASKLSSLWS

SEQ ID NO: 223030 - protein, 342 aa, Glycine max
  Coding DNA Sequence Number=SeqID_106252
  Gene Ontology: Mol. function=aspartyl esterase activity; Cellular component=cell wall; Biological process=cell wall modification
  Homolog annotation: Hit_ID=Q43111; Match level="QueryCoverage=96%, HitCoverage=60%, E-value=1e-168, Identity=88%"; Hit description =Pectinesterase-3 precursor
  Pfam annotation: Domain name=Pectinesterase; Domain location=58-329; Score=589.6; E_value=2.8e-174; Accession=PF01095.10; Description =Pectinesterase
FASNSLAIVTKDPRIAFEVRFTDSPPAAARVSGVARRGGAEAASGEQQRNDARTLWWRVTVADSSGRSEGRYVENIDLDKNTWNVFIFGDGKEKTVVVGSRNFMDGTPTFETATFAVKGKGFIAKDIGFVNNAGASKHQAVALRSGSDRSVFFRCSFDGFQDTLYAHSNRQFYRDCDITGTIDFIFGNAAAVFQNCKIMPRQPLPNQFNTITAQGKKDPNQNTGIIIQKSKFIPLGNNLTAPTYLGRPWKDFSTTVIMQSDIGSFLKPVGWISWVSNVEPVSTIFYAEYQNTGPGADVSQRVKWAGYKPTLTDVEADKFTVQSFIQGPEWLPNAAVEFDSTL

SEQ ID NO: 223031 - protein, 403 aa, Glycine max
  Coding DNA Sequence Number=SeqID_106253
  Homolog annotation: Hit_ID=Q1RTC8; Match level="QueryCoverage=86%, HitCoverage=79%, E-value=1e-123, Identity=64%"; Hit description =Remorin, C-terminal region
  Pfam annotation: Domain name=Remorin_C; Domain location=347-401; Score=-24.7; E_value=0.1; Accession=PF03763.4; Description=Remorin, C-terminal region
MSFEAISFLTHFFLLLLFVTQEALLTESNMSLYGKSKDDPFADDFPDPLCKLNLKETSEFVKSLPLPMPNGRAESRGHSVSQQRRLLDSPSTPGRPVFTFSSGLPRKSFPSKWDDAEKWLMSTSCHDSPAHNNNTTKVLVSDSSKVTTRQQQSDDDVGFKQQMEGFSEKSRVTEERVSSKAVPNFPWSPLDHHHNTLSAFHGVKDIVLKDKFTDSIEPVLPNLRYLEPAKEGFLFRNQGDGAMQDACTEVVQHRDIGTEMTPLGSSTTSRCHTPVKISSPPRHNTPASRSGPLALASSACTLDVIQLEECHFSKLQLGTQYDIVPLNWSSSEEEEKEISKSLRHNGSHKADSDCIAAAWEEEEKTKCCLRYQREEAKIQAWVNLQNAKAEARSRKLEVFHCHS

SEQ ID NO: 223032 - protein, 1799 aa, Glycine max
  Coding DNA Sequence Number=SeqID_106254
  Gene Ontology: Mol. function=phosphatidylinositol phosphate kinase activity; Cellular component=mitochondrion; Biological process =phosphatidylinositol metabolic process
  Homolog annotation: Hit_ID=Q1RTC2; Match level="QueryCoverage=99%, HitCoverage=99%, E-value=0.0, Identity=77%"; Hit description =Chaperonin Cpn60/TCP-1; Phosphatidylinositol-4-phosphate 5-kinase; Zinc finger, FYVE/PHD-type
  Pfam annotation: Domain name=FYVE; Domain location=31-103; Score =75.7; E_value=1.4e-19; Accession=PF01363.12; Description=FYVE zinc finger
  Pfam annotation: Domain name=PIP5K; Domain location=1532-1767; Score =186.9; E_value=4.8e-53; Accession=PF01504.9; Description =Phosphatidylinositol-4-phosphate 5-Kinase
  Pfam module annotation: Pfam domain module=FYVE::PIP5K; Domain location=31-103::1532-1767
MDAVDKTFSELVSIVKSWIPWRSEPVNVSRDFWMPDQSCRVCYECDSQFTLFNRKHHCRLCGRIFCNKCTTNSVPAPFSNQRNSWDELEKIRVCNYCYKQWEQGIVAFDNSIPVSNLDNSASGSTSSVASSKTSATANSSNITLCSMPYSVGSYQPMQQGSVLNLHKSPVKGKDPDTDREGLSALGGRSDLVADLGDPLPKQYRFSINRSDDDEDEYGVYRSDSDMRDYPQVNNYYVQAELHGIGNIDGSQKVDLDGENTNAKLPSNYSFDTQDLEGAQVIAKNEDEPYICDENEAPSSLYVSEDVDAEPVDFENNGLLWLPPEPEDEEDEQEAILFDDDDDHDGNATGEWGYLRSSSSFGSGEYRHRDRSSEEHKNVMKNVVDGHFRALVSQLLQVENLPVEDNDKNSWLEIVTSLSWEAATLLKPDMSKGGGMDPAGYVKVKCIACGSRIESVVVKGVVCKKNVAHRRMTSKVDKPRLLILGGALEYQRVTNLLSSVDTLLQQEMDHLKMAVAKIASHQPNILLVEKSVSRYAQEYLLAKDISLVLNVKRPLLERVARCTGTQIVPSIDHLSSQKLGYCETFHVEKFLEDLNSAGQGADKDELKKVKHVVQYGVFAAYHLALETSFLADEGVSLPEIPLNSLALPDKSSSIQRSISTVPGFGIADNEKPQGLEPYTEPQRTKSLTAADLASSTCGTGPCLSNGASQSMALGSSLNYSTALYSSIVASGNSIPESHHNKLLSCTSRDTNEMNSKQTVVEETSRVDNTLVVGDDPTVEDPGSSEKLYQGMSADTPQNGDSKISKNQLSGSGSLSPKDVQNHPENLEITNEEPVPEKEEFPPSPSDHQSILVSLSSRCVWKGTVCERSHLFRIKYYGSFDKPLGRFLRDHLFDQSYRCHSCEMPSEAHVHCYTHRQGTLTISVKKLPEIILPGERDGKIWMWHRCLRCPRINGFPPATQRIIMSDAAWGLSLGKFLELSFSNHAAASRVASCGHSLHRDCLRFYGFGRMVACFRYASIDVHSVYLPPHTLIFDYGNQDWIQQESDEVVNRAELLFSEVLNGLSQIGEQRSNALQVSNGHKSPELRRQVAELEGMLQKEKLEFEETLQKILNQEKRNGQPGIDVLEINRLWRQLLFQSYMWDHRLIYAANLVNSNYESGSSSPISEDKEKPTDENQMSINSIHGDPKLNGSPSHGGGSVVVDGKISHDASHQEIDMVKNKNLEKDDESDLPNSKSINDQSNLLEPELGVGRALSDGPFPVIPSLSETLDAKWTGENHSGYGIQKDNSSVNPDILMADALTTSAQKETYYLGDRTEDQNGSKSFYSSFKGHDNMEDSSNWLGMPFLNFYRQFNRNLFASTQKFDTLVDYNPVYVSSFRKQELQGGARLLLPIGVNDTVIPVYDDEPSSIIAYALMSPEYHFQLNDEGERPREGNEFTSSYFSDSGTLQSFSSVDETAFDSQKSFGSIEEMIFSMSGSRNSSILDPMLYTKAMHARVSFGVDGPLGKVKYSVTCYYAKRFEALRRVCCPSELDYIRSLSRCKKWGAQGGKSNVFFAKTLDDRFIIKQVTKTELESFIKFGPEYFKYLSESIGTGSPTCLAKILGIYQVTSKHLKGGKESRMDVLVMENLLFRRTVTRLYDLKGSSRSRYNADSTGKNKVLLDQNLIEAMPTSPIFVGNKAKRLLERAVWNDTGFLASVAVMDYSLLVGVDEEKHELVIGIIDFMRQYTWDKHLETWVKASGILGGPKNTSPTVISPKQYKKRFRKAMTTYFLMLPDQWSPSIIPSHSQSDFGEDNTQPRTPAE

SEQ ID NO: 223033 - protein, 471 aa, Glycine max
  Coding DNA Sequence Number=SeqID_106255
  Gene Ontology: Mol. function=sugar porter activity
  Homolog annotation: Hit_ID=Q1RTB8; Match level="QueryCoverage=87%, HitCoverage=66%, E-value=0.0, Identity=81%"; Hit description=Sugar transporter superfamily
MLIFSQVVQPDPQQLCTSGTPKNLPIHEFTSNPVNPTLIPPTCNPKCEVHQKWLETCKHGNKLQLDDQTRLFLYQLVGTWGQILFPKPWKEFRLWYDENKAKGNKPFLEGMVTTGWYKKMGERIWTPWFIKFIQSRGYFNIYTNLLHERALSVSHRDAGVNYGKTAGPDSKLLEEKSLDFNILEVQPLRSLRWYDFCFREVHPGKVATNLEELGSLLHSLQKQDSVFLVNLFGVSDAISRNLLCHFERLDIRNYILMGPPSDSLFDLARRGHPVINVDKFISSVGLSKFTSQGLSFETIKGILAKTYAIKKCIENRYNTWVMDGSMLLTSDLFLSESEDSNGDFFVANNLELFYAKSSSSSQKIWVDGFVSKVVAMAESLAGKDSATHGSLSFVYVVIKLLEQNGARIRRVDENSFATKIGSGSETSLRDKKLVYWSSEMELNSIQKWLDEFNLWSIDSDLSCTAVVCHKS

SEQ ID NO: 223034 - protein, 205 aa, Glycine max
  Coding DNA Sequence Number=SeqID_106256
  Gene Ontology: Mol. function=translation initiation factor activity; Cellular component=eukaryotic translation initiation factor 2B complex; Biological process=cellular metabolic process
  Homolog annotation: Hit_ID=Q8W4G0; Match level="QueryCoverage=91%, HitCoverage=40%, E-value=3e-66, Identity=72%"; Hit description =Putative translation initiation factor EIF-2B alpha subunit
  Pfam annotation: Domain name=IF-2B; Domain location=10-204; Score =54.5; E_value=3.5e-13; Accession=PF01008.8; Description=Initiation factor 2 subunit family
ALEYEDFNSAKSRLLERAEKFGEISFKVNHSRTLARACVRAFIHSHHHFLNSVDSLFASQARKIIAMLSQDFIFDGCTILVHGFSRVVLQILKLAAQNNKLFRVFCTEGRPDRTGLRLSNELAKLDVPVKLVIDSAVAYTMDEVDMVFVGADGVVESGGIINMMGTYQISLVAKSMSKPVYVAAESYKVSLQPTEISECGVKLLL

SEQ ID NO: 223035 - protein, 245 aa, Glycine max
  Coding DNA Sequence Number=SeqID_106257
  Gene Ontology: Mol. function=endonuclease activity
  Homolog annotation: Hit_ID=Q1T6I5; Match level="QueryCoverage=84%, HitCoverage=47%, E-value=2e-70, Identity=63%"; Hit description =Calcium-binding EF-hand; Endonuclease/exonuclease/phosphatase
  Subcellular localization annotation: CTP_CleavageSite=45; ConfidenceScore=5.06e-01
MSGIQVVAAGAKFNLRRGNGSSHNVVNSYSSDGDLCRINKSGCFSSAAEVDRDPSCVSFTTFNILAPIYKRIDPQNQGLRESDFRSFWLDRNNRILDCLLYESSSIMCLQEFWVGNEELVNMYEEKLGDAGYHLFKLPRTNNRGDGLLTAIRKECLRVMDYKELLFNDCGDRVAQLLHVQSVTPLLQNPKGCVPQEFLIVNTHLLFPHDSSLCVVRLNQVYQILQYVELYQRENRLKPMPIILCG

SEQ ID NO: 223036 - protein, 167 aa, Glycine max
  Coding DNA Sequence Number=SeqID_106258
  Gene Ontology: Mol. function=sequence-specific DNA binding; Cellular component=nucleus; Biological process=regulation of transcription, DNA-dependent
  Homolog annotation: Hit_ID=Q9FKK2; Match level="QueryCoverage=67%, HitCoverage=39%, E-value=2e-11, Identity=29%"; Hit description=MADS -box protein-like
  Pfam annotation: Domain name=SRF-TF; Domain location=23-75; Score =69.0; E_value=1.5e-17; Accession=PF00319.9; Description=SRF-type transcription factor (DNA-binding and dimerisation domain)
MASFGANTVTKPIKKRKRTIEIKKVEQINRRYVTFSKRKLGLFNKLTELSVLCQVEAAVIITSQNGKLYTCGYPDADAVVRRYLSGGLSRGLDSESKKRQQDAIETLRPEYEATQNHLKEEQKRLQEIKETRKSSLCFPSWWISPPRVWVWRILNSSRLLWNVLSLT

SEQ ID NO: 223037 - protein, 193 aa, Glycine max
  Coding DNA Sequence Number=SeqID_106259
MVGKDLGSTDDPMMCKFKTSTPSRHMTCLPNYTPPNVAYIPDEDVNNSTPILIKSQQPQSDHAHVSRPVEETHGMPHHNLADFEPCLGYATEGQAVGGIPLQNTLEGPQCHPQPQPSHSTAVKNPHAMAEMGKRKGSGPLKEMGAYAKDEELLIHSFQENLTGVAVTWYTTLEPSRVHSWKDLMVAFVRAVSV

SEQ ID NO: 223038 - protein, 117 aa, Glycine max
  Coding DNA Sequence Number=SeqID_106260
MRGTGTREVAHKPRQDFSIQKVKFFLLVAEYEVTSREKTKFRSFSSLFHVAFLLPPSPPLLSIKAPKSLSISTPNCKGKPFSESWSTPLHCGTSNFRKLVEMMVRVNLGLNVKMVVM

SEQ ID NO: 223039 - protein, 62 aa, Glycine max
  Coding DNA Sequence Number=SeqID_106261
TVKNEITSWQLANAKLAEVGGRLKNNGMKKKHETHAAGIIVKEDIIVLSRRYVGSGIREYGC

SEQ ID NO: 223040 - protein, 114 aa, Glycine max
  Coding DNA Sequence Number=SeqID_106262
  Gene Ontology: Mol. function=zinc ion binding; Cellular component =intracellular
MEKVLQRLFILSSSTHTWDAFHLARASFELYCVQNNQVLPSDSDDANSEMGPHLLGDRLKINVDPPEIDEEDDDESSPGSLPAIKIHEDEVNLRFLICGAPSTVVSFFGILLPV

SEQ ID NO: 223041 - protein, 133 aa, Glycine max
  Coding DNA Sequence Number=SeqID_106263
  Gene Ontology: Mol. function=protein binding; Cellular component =integral to membrane; Biological process=defense response to fungus
  Homolog annotation: Hit_ID=Q1SWI6; Match level="QueryCoverage=75%, HitCoverage=44%, E-value=7e-27, Identity=59%"; Hit description =Leucine-rich repeat, plant specific
  Pfam annotation: Domain name=LRRNT_2; Domain location=26-66; Score =47.6; E_value=4.3e-11; Accession=PF08263.3; Description=Leucine rich repeat N-terminal domain
MNSSIYILVFVQLWLFSLPCRESVCIPSERETLLKIKNNLIDPSNRLWSWNHNNTNCCHWYGVLCHNVTSHVLQLHLNTSDSAFYHDHDGYLYSDFDEEAYEKSQFGGVISPCLADLKHLNYLDLSGNEFLGE

SEQ ID NO: 223042 - protein, 287 aa, Glycine max
  Coding DNA Sequence Number=SeqID_106264
  Gene Ontology: Mol. function=sequence-specific DNA binding; Cellular component=nucleus; Biological process=regulation of transcription, DNA-dependent
  Homolog annotation: Hit_ID=Q9FKK2; Match level="QueryCoverage=46%, HitCoverage=45%, E-value=1e-16, Identity=34%"; Hit description=MADS -box protein-like
  Pfam annotation: Domain name=SRF-TF; Domain location=23-75; Score =68.4; E_value=2.3e-17; Accession=PF00319.9; Description=SRF-type transcription factor (DNA-binding and dimerisation domain)
MASSGANTATKPIKKRKRTIEIKKVEQINRRHVTFSKRKLGLFNKLTELSILCQVEAAVIITSQNGKLYTCGYPDADAVVRRYLNGGLPRRLDSACKKRQQDAIETLRLEYEATQNHLKEEQKRLQEIKETRKSSLRFPSWWNLPTEGMGLEDLEQFKTSLERLKFNLVGALQEKQMNSVPSMPHAAMLPPMSSTMVPPMPSTVVPPVPHAAMVPPMSSTMVPPMPHAAMVPPMMPPQFQSMPLLSAQRLSGNQVQDDYWRSAAIASTSSTFASNGFGSLKSYGYTT

SEQ ID NO: 223043 - protein, 137 aa, Glycine max
  Coding DNA Sequence Number=SeqID_106265
MCAQHVRVCAQRNLCHRSQREECKCISELLENETETSFELKAATCRHRHTRTLRKRRRWSYERGRLDSDVAQFRSFLRRRKTPFRETTEELRRCTASFGCRELPIKEKRRGNGGVRERNRNCENPNAMDGLGLEDED

SEQ ID NO: 223044 - protein, 284 aa, Glycine max
  Coding DNA Sequence Number=SeqID_106266
  Gene Ontology: Mol. function=sequence-specific DNA binding; Cellular component=nucleus; Biological process=regulation of transcription, DNA-dependent
  Homolog annotation: Hit_ID=Q1SEL3; Match level="QueryCoverage=55%, HitCoverage=69%, E-value=5e-19, Identity=34%"; Hit description =Transcription factor, MADS-box
  Pfam annotation: Domain name=SRF-TF; Domain location=26-78; Score =64.7; E_value=3e-16; Accession=PF00319.9; Description=SRF-type transcription factor (DNA-binding and dimerisation domain)
MDSSSRAKTVNAATMQNKKRGKIEIKEVEQRNRRYVTFSKRKLGLFNKLTELSVLCQVETAVIITSQNGKLYSCGYPDPDAVVRRYLTGGPPLRRNRAIKREQQEFVEQQRLEYEAVQNQLKEEKKRLQEIKGTQNNNGFCFAAPWWNLPTEGMGLEDLEQFKTSLERLKFNLVGALQEKQMNSVPSMPHAAMLPPMPSTVVPPVPHAAMVPPMSSTMVPPVPHAAMVPPMMPPQFQNMSLLRAQRLSGNQVQDDYWRSAAIASTASTFASNVFGSLKNYGYTT

SEQ ID NO: 223045 - protein, 142 aa, Glycine max
  Coding DNA Sequence Number=SeqID_106267
  Gene Ontology: Mol. function=zinc ion binding; Cellular component =integral to membrane
  Homolog annotation: Hit_ID=UPI00001633C9; Match level="QueryCoverage =63%, HitCoverage=38%, E-value=1e-17, Identity=38%"; Hit description =ubiquitin-protein ligase/ zinc ion binding
MEGTSWAFMFSIPEDNLLVDDFYFSALYDAEEIQENISMVKCPHTKCKQVVEPQHCRLVITKEVFERWENAPCENLVLASQKFYCPFKDCSAMLVAWHAGIDGSEFRSLKQDERGREDLKMWLSILLCLILLETAPYVFDFQ

SEQ ID NO: 223046 - protein, 333 aa, Glycine max
  Coding DNA Sequence Number=SeqID_106268
  Gene Ontology: Mol. function=zinc ion binding; Cellular component =integral to membrane; Biological process=protein modification process
  Homolog annotation: Hit_ID=UPI00001633C9; Match level="QueryCoverage =81%, HitCoverage=89%, E-value=3e-70, Identity=46%"; Hit description =ubiquitin-protein ligase/ zinc ion binding
  Pfam annotation: Domain name=C1_4; Domain location=192-232; Score= -12.4; E_value=0.083; Accession=PF07975.2; Description=TFIIH C1-like domain
  Pfam annotation: Domain name=IBR; Domain location=168-230; Score =43.0; E_value=1e-09; Accession=PF01485.11; Description=IBR domain
  Pfam annotation: Domain name=zf-C3HC4; Domain location=100-149; Score= 5.5; E_value=0.042; Accession=PF00097.15; Description=Zinc finger, C3HC4 type (RING finger)
  Pfam module annotation: Pfam domain module=C1_4::IBR::zf-C3HC4; Domain location=192-232::168-230::100-149
MEGTSSAPTTLPSTPEDNRLLVDDFFFSALYDAEEVFPISDEKYAEELQLQEVLYSSTVSSTGVTKEVIQIDVDVDCDTPLRILKGKQKETGESSQQVYCGICMDAKYGEEMFRNQNCSHSFCDDCIGRYVATKVQENISMVKCPHPKCKGVIEPQYCRSFIPKEVFDRWENALCENLVLGSQKFYCPFKDCSAVLINDAEEIVTVSECPHCNRLFCAQCKVSWHAGVDCKEFQNLKEYEREREDLMVMELAKNKSWKRCPKCIFYVERIDGYVAMNFAMPVDPLGVVVCTMNVDLVKNCWKQFLNESSCKSLVILVSLLEVCHLNALRGCSN

SEQ ID NO: 223047 - protein, 123 aa, Glycine max
  Coding DNA Sequence Number=SeqID_106269
MEKMEGGFPRLASFVCNCEPFSEEELQAIEASLSNPNNKRPYPFNARASSFSPHTGWLWSFIIVVQLYQRMCLIDVVRIRCLNHNFCCPFKDCSAMLIPDVEEVVTVSKCPHCKSARFHGMLK

SEQ ID NO: 223048 - protein, 248 aa, Glycine max
  Coding DNA Sequence Number=SeqID_106270
  Gene Ontology: Mol. function=zinc ion binding; Cellular component =integral to membrane; Biological process=ubiquitin cycle
  Homolog annotation: Hit_ID=UPI00001633C9; Match level="QueryCoverage =75%, HitCoverage=62%, E-value=5e-57, Identity=51%"; Hit description =ubiquitin-protein ligase/ zinc ion binding
  Pfam annotation: Domain name=C1_4; Domain location=89-129; Score= -11.2; E_value=0.059; Accession=PF07975.2; Description=TFIIH C1-like domain
  Pfam annotation: Domain name=IBR; Domain location=65-127; Score=41.1; E_value=3.8e-09; Accession=PF01485.11; Description=IBR domain
  Pfam module annotation: Pfam domain module=C1_4::IBR; Domain location= 89-129::65-127
MDAKYGEEMFRNQNCSHSFCDDCIGRYVATKVQENISMVKCPHPKCKGVIEPQYCRSFIPKEVFDRWEDALCENLVPGSQKFYCPFKDCSAMLINDAEEIVTVSECPHCNRLFCAQCKVSWHAGVECKEFQNLKEYEREREDLMVMELAKNKNWKRCPKCSFYVERIDGYVIMNFAMPVDPLGVVVSTMNVDLVKNCWRQVRNVIGICMLVNNTCLDRYTSSCVEVNFTIRKMIYAYRKKLSLDVKNA

SEQ ID NO: 223049 - protein, 58 aa, Glycine max
  Coding DNA Sequence Number=SeqID_106271
  Gene Ontology: Mol. function=rRNA binding; Cellular component =nucleolus; Biological process=rRNA processing
  Homolog annotation: Hit_ID=Q2V9A2; Match level="QueryCoverage=81%, HitCoverage=14%, E-value=4e-19, Identity=89%"; Hit description =Putative RNA processing factor 1-like
MGDGSTLSAFTFTMSNECGPRFTLKLISLQHGTFDTKGGEYEWVHKPEMDTSRRRFFL

SEQ ID NO: 223050 - protein, 94 aa, Glycine max
  Coding DNA Sequence Number=SeqID_106272
MEKSDKKTFKGKKGKKAYITWEDSDMDSSSDSENEVINLSLMAKNYESEEEKGHSASTCYFRKNGSSIGKIVWVPKGSLVKTNIQGPKKIWVPK

SEQ ID NO: 223051 - protein, 146 aa, Glycine max
  Coding DNA Sequence Number=SeqID_106273
MSLDEASESNVMAVRICVVIPFQLLIAMIYYGLQSDIRVKTLARRNSPESSMINFERRDRLLSLLGDPEEKLWPFVFVMGFILILRASRYIMSFNHESESNVMAVRICLIVSTNKALIQDFFKIKPCLTMKGFKSFKAHVIDYQYM

SEQ ID NO: 223052 - protein, 90 aa, Glycine max
  Coding DNA Sequence Number=SeqID_106274
MGLGIRFEGGVYRNNARQSIRGAPDSMVEDAGMTINSWGSGLDGGGCMNDNRFMGLGRNSARQAIRGAPDSMVEDAGITINSWGSGERFE

SEQ ID NO: 223053 - protein, 42 aa, Glycine max
  Coding DNA Sequence Number=SeqID_106275
VIKRTASAHSLSERSALSHNPLMRAKRSRFALSERAQTNPTI

SEQ ID NO: 223054 - protein, 173 aa, Glycine max
  Coding DNA Sequence Number=SeqID_106276
MDNKCKTVQLSLKADGVSDMYCARANNKRYGSATLKCDVAVSSEAVVASCDAVLRDSNAELWGIMYGLQMAAEAKMEHLHVAADSLHPVMLVDDCIQSEDQFHEQISKIWKMKGSLTSCTFGHIGRDDNCLANKFAKFGFSLNLDCIFFQAVPSFASTVTKEVFMSDSMLNSS

SEQ ID NO: 223055 - protein, 311 aa, Glycine max
  Coding DNA Sequence Number=SeqID_106277
  Gene Ontology: Mol. function=protein serine/threonine kinase activity; Cellular component=integral to membrane; Biological process=protein amino acid phosphorylation
  Homolog annotation: Hit_ID=O49318; Match level="QueryCoverage=78%, HitCoverage=60%, E-value=2e-56, Identity=37%"; Hit description =Putative receptor-like protein kinase
  Pfam annotation: Domain name=LRRNT_2; Domain location=73-113; Score =51.6; E_value=2.6e-12; Accession=PF08263.3; Description=Leucine rich repeat N-terminal domain
  Pfam annotation: Domain name=LRR_1; Domain location=121-144; Score =4.4; E_value=43; Accession=PF00560.23; Description=Leucine Rich Repeat
  Pfam annotation: Domain name=LRR_1; Domain location=146-168; Score =16.9; E_value=0.071; Accession=PF00560.23; Description=Leucine Rich Repeat
  Pfam annotation: Domain name=LRR_1; Domain location=170-192; Score =20.3; E_value=0.007; Accession=PF00560.23; Description=Leucine Rich Repeat
  Pfam annotation: Domain name=LRR_1; Domain location=194-216; Score =13.1; E_value=1; Accession=PF00560.23; Description=Leucine Rich Repeat
  Pfam annotation: Domain name=LRR_1; Domain location=218-240; Score =8.4; E_value=7.5; Accession=PF00560.23; Description=Leucine Rich Repeat
  Pfam annotation: Domain name=LRR_1; Domain location=242-264; Score =6.6; E_value=16; Accession=PF00560.23; Description=Leucine Rich Repeat
  Pfam annotation: Domain name=LRR_1; Domain location=266-288; Score =6.3; E_value=19; Accession=PF00560.23; Description=Leucine Rich Repeat
  Pfam annotation: Domain name=LRR_1; Domain location=290-309; Score =8.9; E_value=6.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=73-113::121 -144::146-168::170-192::194-216::218-240::242-264::266-288::290-309
MVLGIVEYDFKFIEPTPTLNFENNHFQVVFDLLHTNQYLIDWYEMAGDIKEGRAGCSVIFLLLTLLLCSTEGLNTEGQILLDLKKGLHDKSNVLENWRFTDETPCGWVGVNCTHDDNNNFLVVSLNLSSLNLSGSLNAAGIGGLTNLTYLNLAYNKLTGNIPKEIGECLNLEYLYLNNNQFEGPIPAELGKLSVLKSLNIFNNKLSGVLPDEFGNLSSLVELVAFSNFLVGPLPKSIGNLKNLVNFRAGANNITGNLPKEIGGCTSLILLGLAQNQIGGEIPREIGMLANLNELVLWGNQLSGPIPKEIGN

SEQ ID NO: 223056 - protein, 717 aa, Glycine max
  Coding DNA Sequence Number=SeqID_106278
  Gene Ontology: Mol. function=protein serine/threonine kinase activity; Cellular component=integral to membrane; Biological process=protein amino acid phosphorylation
  Homolog annotation: Hit_ID=O49318; Match level="QueryCoverage=99%, HitCoverage=92%, E-value=0.0, Identity=45%"; Hit description =Putative receptor-like protein kinase
  Pfam annotation: Domain name=LRR_1; Domain location=120-142; Score =7.2; E_value=13; Accession=PF00560.23; Description=Leucine Rich Repeat
  Pfam annotation: Domain name=LRR_1; Domain location=144-167; Score =8.1; E_value=8.9; Accession=PF00560.23; Description=Leucine Rich Repeat
  Pfam annotation: Domain name=LRR_1; Domain location=168-190; Score =16.0; E_value=0.14; Accession=PF00560.23; Description=Leucine Rich Repeat
  Pfam annotation: Domain name=LRR_1; Domain location=192-214; Score =17.7; E_value=0.041; Accession=PF00560.23; Description=Leucine Rich Repeat
  Pfam annotation: Domain name=LRR_1; Domain location=216-238; Score =10.1; E_value=3.7; Accession=PF00560.23; Description=Leucine Rich Repeat
  Pfam annotation: Domain name=LRR_1; Domain location=24-47; Score=7.5; E_value=11; Accession=PF00560.23; Description=Leucine Rich Repeat
  Pfam annotation: Domain name=LRR_1; Domain location=265-287; Score =11.6; E_value=1.9; Accession=PF00560.23; Description=Leucine Rich Repeat
  Pfam annotation: Domain name=LRR_1; Domain location=48-70; Score=5.6; E_value=26; Accession=PF00560.23; Description=Leucine Rich Repeat
  Pfam annotation: Domain name=LRR_1; Domain location=72-94; Score=6.1; E_value=20; Accession=PF00560.23; Description=Leucine Rich Repeat
  Pfam annotation: Domain name=LRR_1; Domain location=96-118; Score =14.7; E_value=0.33; Accession=PF00560.23; Description=Leucine Rich Repeat
  Pfam annotation: Domain name=Pkinase; Domain location=419-692; Score =160.5; E_value=4.3e-45; Accession=PF00069.15; Description=Protein kinase domain
  Pfam annotation: Domain name=Pkinase_Tyr; Domain location=419-692; Score=121.0; E_value=3.4e-33; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=120-142::144-167::168-190::192-214::216-238::24 -47::265-287::48-70::...
  Pfam module annotation: Domain location=72-94::96-118::419-692::419 -692
MYQLQLFDNSLSGVIPQGLGLRSPLWVVDFSDNKLTGRIPPHLCRNSSLMLLNLAANQLYGNIPTGILNCKSLAQLLLLENRLTGSFPSELCKLENLTAIDLNENRFSGTLPSDIGNCNKLQRFHIADNYFTLELPKEIGNLSQLVTFNVSSNLFTGRIPREIFSCQRLQRLDLSQNNFSGSFPDEVGTLQHLEILKLSDNKLSGYIPAALGNLSHLNWLLMDGNYFFGEIPPHLGSLATLQIAMDLSYNNLSGRIPVQLGNLNMLEFLYLNNNHLDGEIPSTFEELSSLLGCNFSFNNLSGPIPSTKIFQSMAISSFIGGNNGLCGAPLGDCSDPASHSDTRGKSFDSSRAKIVMIIAASVGGVSLVFILVILHFMRRPRESTDSFVGTEPPSPDSDIYFPPKEGFTFHDLVEATKRFHESYVIGKGACGTVYKAVMKSGKTIAVKKLASNREGNNIENSFRAEITTLGRIRHRNIVKLYGFCYQQGSNLLLYEYMERGSLGELLHGNASNLEWPIRFMIALGAAEGLAYLHHDCKPKIIHRDIKSNNILLDENFEAHVGDFGLAKVIDMPQSKSMSAVAGSYGYIAPEYAYTMKVTEKCDTYSFGVVLLELLTGRTPVQPLEQGGDLVTWVRNHIRDHNNTLTPEMLDSRVDLEDQTTVNHMLTVLKLALLCTSVSPTKRPSMREVVLMLIESNEREGNLTLTQTYHDLPSKDGM

SEQ ID NO: 223057 - protein, 782 aa, Glycine max
  Coding DNA Sequence Number=SeqID_106279
  Gene Ontology: Mol. function=identical protein binding; Cellular component=cellulose and pectin-containing cell wall; Biological process=negative regulation of enzyme activity
  Homolog annotation: Hit_ID=Q8LGA0; Match level="QueryCoverage=96%, HitCoverage=97%, E-value=0.0, Identity=70%"; Hit description =Subtilisin-like serine protease
  Pfam annotation: Domain name=PA; Domain location=364-473; Score =107.1; E_value=5.3e-29; Accession=PF02225.12; Description=PA domain
  Pfam annotation: Domain name=Peptidase_S8; Domain location=114-613; Score=61.9; E_value=2e-15; Accession=PF00082.12; Description =Subtilase family
  Pfam annotation: Domain name=Subtilisin_N; Domain location=30-106; Score=70.4; E_value=5.9e-18; Accession=PF05922.7; Description =Subtilisin N-terminal Region
  Pfam module annotation: Pfam domain module=PA::Peptidase _S8::Subtilisin_N; Domain location=364-473::114-613::30-106
MAPPYPSLLILLFLLTSQVTCYGSEKEKSKTFIIQVQHEAKPSIFPTHKHWYDSSLSSISTTASVIHTYHTVFHGFSAKLSPSEAQKLQSLAHVITLIPEQLRSPHTTRSPEFLGLTTADRTGLLHETDFGSDLVIGVIDTGIWPERQSFNDRGLGPVPSKWKGKCVAGENFPASSCNRKLIGARWFSGGYEATHGKMNETTEFRSPRDSDGHGTHTASIAAGRYVSQASTLGYAKGVAAGMAPKARLAVYKVCWSDGCYDSDILAAFDAAVSDGVDVASLSVGGVVVPYHLDVIAIGAFGAASAGVFVSASAGNGGPGGLTVTNVAPWVTTVGAGTLDRDFPANVKLGNGKIVPGISIYGGPGLTPGRMYPIVYAGVGQFGGGGGSGGVDGYSSSLCLEGSLDPKFVKGKIVVCDRGINSRAAKGEEVKKNGGVGMILANGVFDGEGLVADCHVLPATAVGATGGDEIRSYIGNSRTPATATIVFKGTRLGVRPAPVVASFSARGPNPESPEILKPDVIAPGLNILAAWPDHVGPSGVPSDGRRTEFNILSGTSMACPHVSGLAALLKAAHPDWSPAAIRSALMTTAYTVDNKGDPMLDESTGNVSSVFDYGAGHVHPVKAMNPGLVYDISTSDYVNFLCNSNYTTNTIHVITRRNADCSGAKRAGHSGNLNYPSLSAVFQLYGKKRMATHFIRTVTNVGDPNSVYKVTIKPPRGTVVTVKPDTLNFRRVGQKLNFLVRVQIRAVKLSPGGSSVKSGSIVWSDGKHTVTSPLVVTMQQPLD

SEQ ID NO: 223058 - protein, 118 aa, Glycine max
  Coding DNA Sequence Number=SeqID_106280
  Gene Ontology: Mol. function=magnesium ion binding; Cellular component=integral to membrane; Biological process=photosynthesis, light harvesting
  Homolog annotation: Hit_ID=P10708; Match level="QueryCoverage=64%, HitCoverage=28%, E-value=2e-29, Identity=72%"; Hit description =Chlorophyll a-b binding protein 7, chloroplast precursor
MHVTQLTWENLSCGGSDNVSHKDLVSWSDKCEPPNSDFSISQKNGSLLGSTKASFLSGRKLKVNSFTAPVGARSSTTVCAVAEPDRPLWFPGSTPPPWLDGSLPGDFGFDPLGLGSDL

SEQ ID NO: 223059 - protein, 69 aa, Glycine max
  Coding DNA Sequence Number=SeqID_106281
MQEYTSSVIYSKLKPATKCGNLLEKVEEHHHKLGKRKREREREKRKWGWTDGHIKEVTSYKKVGESKTS

SEQ ID NO: 223060 - protein, 306 aa, Glycine max
  Coding DNA Sequence Number=SeqID_106282
  Gene Ontology: Cellular component=integral to membrane
  Homolog annotation: Hit_ID=A0DRP2; Match level="QueryCoverage=73%, HitCoverage=79%, E-value=6e-15, Identity=26%"; Hit description =Chromosome undetermined scaffold_60, whole genome shotgun sequence
  Pfam annotation: Domain name=DUF1295; Domain location=67-287; Score =217.5; E_value=3e-62; Accession=PF06966.3; Description=Protein of unknown function (DUF1295)
MASGRNLKNAVIAFLVPLPSIFFYLSFLNHYDSANSPLFWSTLWSWCYHHPLLLANALFFLNVNVLFWAIGLIQSSHWMIDPYWTVIPVMLVHYYATHPLAHYDWWRSRIVILLTWVWSARLTHNYFRRERWQWGAREDWRFTEMSQQYGKQWWWVSFFAVYVSQQNTLNLLVELLVFFDCCSIELSVFLLLYEFVSRNNKLKGLGKPVVFVLDSGLWYYCRHPNYFGEQLWWWGLVVFAWNLGHGWTFIGALVNTMCLAYVTRLVEDRMLKQKSRAEAFRVYQKKTSVWVPWFKSSPSGVKNKNA

SEQ ID NO: 223061 - protein, 277 aa, Glycine max
  Coding DNA Sequence Number=SeqID_106283
  Gene Ontology: Mol. function=magnesium ion binding; Cellular component=integral to membrane; Biological process=photosynthesis, light harvesting
  Homolog annotation: Hit_ID=P10708; Match level="QueryCoverage=88%, HitCoverage=91%, E-value=1e-132, Identity=88%"; Hit description =Chlorophyll a-b binding protein 7, chloroplast precursor
  Pfam annotation: Domain name=Chloroa_b-bind; Domain location=54-222; Score=313.2; E_value=4.6e-91; Accession=PF00504.12; Description =Chlorophyll A-B binding protein
  Subcellular localization annotation: CTP_CleavageSite=39; ConfidenceScore=5.64e-01
SQKNGSLLGSTKASFLSGRKLKVNNFTAPVGARSSTTVCAVAEPDRPLWFPGSTPPPWLDGSLPGDFGFDPLGLGSDPESLRWNVQAELVHCRWAMLGAAGIFIPEFLTKIGILNTPSWYTAGELEYFTDTTTLFVVELFFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAMQFYRLSLPSEKGWNNSMIASLGETLGNLFN

SEQ ID NO: 223062 - protein, 422 aa, Glycine max
  Coding DNA Sequence Number=SeqID_106284
  Gene Ontology: Mol. function=hydrolase activity; Cellular component =endoplasmic reticulum; Biological process=traversing start control point of mitotic cell cycle
  Homolog annotation: Hit_ID=Q9M3Z3; Match level="QueryCoverage=79%, HitCoverage=82%, E-value=1e-158, Identity=81%"; Hit description =Putative PTS protein
  Pfam annotation: Domain name=Metallophos; Domain location=78-335; Score=53.6; E_value=6.5e-13; Accession=PF00149.18; Description =Calcineurin-like phosphoesterase
MKTYLVLFLKHLSFKWKGKIGKMNKCPMKTWVGWQQVCLSYPVFVLKLLYLLATLTPSGHSYKTSIPTNTTTEPEPKVADMHYANGKTTHCLNVLPSQNFSCSDLNTTIFLNRMIKAEKPNLIVFTGDNIFAFDSSDSAKSLDAAFAPAIASNIPWVAVLGNHDQEGTLSRSGVMNHIVGMKNTLSKFNPPEVHSIDGFGNYNLEVGGVEGTDFENKSVLNLYFLDSGDYSQVSTILGYDWIKPSQQLWFQRTSAELRKAYISKPVPQKHAAPGLAYFHIPLPEYASLDSSNMTGVKLEPAGNGISSPSVNSGFFTTLLAAGDVKAVFTGHDHLNDFCGNLMNIQLCYAGGFGYHAYGKAGWSRRARVVVASLEKTEKGSWGDVKSIKTWKRLDDQHLTGIDGEVLWSKSTGGLSIRYACWT

SEQ ID NO: 223063 - protein, 231 aa, Glycine max
  Coding DNA Sequence Number=SeqID_106285
  Homolog annotation: Hit_ID=O80734; Match level="QueryCoverage=99%, HitCoverage=36%, E-value=5e-28, Identity=36%"; Hit description =Expressed protein
MSARLMKKVLNEQHHLPQHVSEEEEEEENDSEPITRSSINPFDLLNDNDSEPEDQGDELMSTNEILTSYDDKEESASLKPTAEVSTSNPKLKKKKKKKNKDSAVANKMDDKELDLILEDLSLNVDTSAEQPVSTKDKNKSVKQHAASVLQVDPKYLNAENELRRIFGSKVVKSFESSNQVGSSRQMRGVRGRVHYNLKKSVLVTPSDNWLRCDDSLVMQFLEIKNGYNYFR

SEQ ID NO: 223064 - protein, 98 aa, Glycine max
  Coding DNA Sequence Number=SeqID_106286
MKRMRGRVEEEEEKQREGENRSGRGSKELKGELERKGNGEMRVKGREMHEIRERDIGDGKGKGCMEDYVLERSIERNHIIFQDGAVDFEKEVILLAPT

SEQ ID NO: 223065 - protein, 64 aa, Glycine max
  Coding DNA Sequence Number=SeqID_106287
MEAISKWIKGLDICGKVTLKIKLWEIAYPDLNSMCAPPEKIKTKGMSEDSWSLIRNHLQKELGQ

SEQ ID NO: 223066 - protein, 220 aa, Glycine max
  Coding DNA Sequence Number=SeqID_106288
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=1e-14, Identity=30%"; Hit description= UPI00006A17C9 related cluster
VDPWVLVPITFRGLHVLAIRGLHALTFRGLHVLALRGLHALTLEDFMSSPSEGYTPSPWVLVTLTVERTTRPRLERTTRPPIRGLPRGLHVLTIRGLHALTSRGLHVLALRGLHALTLGLHVLTIRGLHALTSRGLHVLTLRGLHALTSRGLHVLALRGLHALTLGLHVLTLGTSYPHRQRATRPHLERTTRPRQQRGLHALTSRGLHVLALRQATRPHI

SEQ ID NO: 223067 - protein, 45 aa, Glycine max
  Coding DNA Sequence Number=SeqID_106289
MSWSALSGIASLLLPGGRTTHYVFSIPLVINESSNCNIKQGNDKA

SEQ ID NO: 223068 - protein, 81 aa, Glycine max
  Coding DNA Sequence Number=SeqID_106290
MPTSSPQATYNPLDFFCLREREESKEFSNCVFLNSLKRETQKNSGEQGLEARKLRKLFGKGRRRKMRSKGFKISQKLFKKF

SEQ ID NO: 223069 - protein, 205 aa, Glycine max
  Coding DNA Sequence Number=SeqID_106291
  Gene Ontology: Mol. function=transporter activity; Cellular component= membrane; Biological process=sulfur metabolic process
  Homolog annotation: Hit_ID=Q88HX5; Match level="QueryCoverage=78%, HitCoverage=50%, E-value=3e-35, Identity=46%"; Hit description =Periplasmic aliphatic sulfonate-binding protein, putative
  Pfam annotation: Domain name=NMT1; Domain location=53-205; Score= -38.5; E_value=0.00026; Accession=PF09084.1; Description=NMT1THI5 like
MRLAALFAGVALALASLQPLLAADKVTLRLGDVKGDRFAALKASGELNNLPYDLKLTAFDSGAPVQEALNAGALDVGFTGDLPFLFVYAAGAPVKAVGAWQNNPDSIALLTRPDAGIHRLQDLKGKQIAVNRGGWGHYLLLGLLERAGLTPQDVTLRFLGPVDGRAALTSGAVAAWAPWEPYIATSTAIDGTVRVPDGGGKGIMS

SEQ ID NO: 223070 - protein, 118 aa, Glycine max
  Coding DNA Sequence Number=SeqID_106292
  Homolog annotation: Hit_ID=Q47522; Match level="QueryCoverage=31%, HitCoverage=45%, E-value=7e-15, Identity=100%"; Hit description=LacZ protein
MRKEKIPHQAPFAIQAAQLLGRAIGAGLFAITPAGERGMCCKAIKLDVRLSSKASISLPYYCWVEAIPHVQPIILPPCILNNIPDSYPQKKEKGHARCTQQHCWCTQQLGEWAKLPLR

SEQ ID NO: 223071 - protein, 129 aa, Glycine max
  Coding DNA Sequence Number=SeqID_106293
VDSRGSHIEEAKEEESSEEIYPQEEGQPLMVKEECKEVSVSSKRYLAPIVRQFVKFRDMPELKRKHRCTIREKAVASGGSHLARLGELGGKHLPHFPINSGRNEEEFRSALLPFFDVLRSFVIVLWSST

SEQ ID NO: 223072 - protein, 133 aa, Glycine max
  Coding DNA Sequence Number=SeqID_106294
  Subcellular localization annotation: CTP_CleavageSite=31; ConfidenceScore=5.32e-01
MQRQSRSSASLFFEGFNVFRPRLSQSSFPPRLSSLSAYRDNQETIKVIYLFFKDFNVFRPRLSQSSLPQGLSSPLACGDHQGPWLTQATRKLRVEVTSSPGRARLLLEEANNSSRRAELAWVSWYATSTPHSL

SEQ ID NO: 223073 - protein, 153 aa, Glycine max
  Coding DNA Sequence Number=SeqID_106295
MRGASSKEIITPFITQGFIDAKAKILQKIRKAWNRVERKDKDLRGSSNSVIGGYHKWLKSRTQGITWLPKLKSLSGKEAEISEESEEVQALKVELEESRVVNEKLRVVVTRVRKKCDELKDINMTTVEALEREIKKGPKGRMEQEQVPRGFVG

SEQ ID NO: 223074 - protein, 81 aa, Glycine max
  Coding DNA Sequence Number=SeqID_106296
MAGGNLPTEKCVWLSGVRLEVGQRVVSGYFICLPHRLSDMCMPRLRLLALKGYRRGVVIVLIGHMYSIGWCIVERQVIRWE

SEQ ID NO: 223075 - protein, 122 aa, Glycine max
  Coding DNA Sequence Number=SeqID_106297
MQLQLDAQSKQMQLQLDAQSTNLIKELAMFSSSNLDCDCNLSLFFVTILGLAPFFMKGLVLVWFKWLHTTNQLTTWPEFTRTIRKYTFNIGYLEHSTSVLKPMLKVPMLNVSMLTLVLENRC

SEQ ID NO: 223076 - protein, 260 aa, Glycine max
  Coding DNA Sequence Number=SeqID_106298
MGGAVTLLDIPGGGNKVVMWDATLFGLFNEDFPLYIKHEDLSEIAHGGQCLNISITQLHMTRTSMRAGNADVYGYLEPQSIQRFDQSQFESKSYLKNWMQNSKRDAYLGAYLNGAHWQMVVILPNENVVIWFCSLHNRPDNYLKGIINSALKGLDDTQQSKSKPTARWIVVKVNEHITQVPNVEVETEANTEVEDTRFELTTEFAEVMDHIPLTQQSQPFLRDLSTFPDAIQKDMTILEGLLSLAVMGTCWRSKWIARDS

SEQ ID NO: 223077 - protein, 69 aa, Glycine max
  Coding DNA Sequence Number=SeqID_106299
MAIICLRMSSGSPPLDDKRAQNDHNFPLRAIGHDCVWMAKRVSMTEIVGRLTKARLLLLRILNEELRPT

SEQ ID NO: 223078 - protein, 70 aa, Glycine max
  Coding DNA Sequence Number=SeqID_106300
MVVVGDGESAWDVINGFGRKKGEEMAFFLSYPKAKAENAQVRKGLGHGSVAHTTDIFSKIPTVRSWTRVL

SEQ ID NO: 223079 - protein, 54 aa, Glycine max
  Coding DNA Sequence Number=SeqID_106301
MLISTTTLFLPQADFYYYSVFKHNLHSKTPKTETGETLNGKTETEHTLNKTPGH

SEQ ID NO: 223080 - protein, 110 aa, Glycine max
  Coding DNA Sequence Number=SeqID_106302
MASRKRKAPASASQAHYDRSRFTSQEAWDCYSDIVIGKKILPERNVMIYHTEFDEFKTKLERRNWHKELTNFLDGSNDVALVKEFYANLYDLEDKSPKQVRVVEANFIAS

SEQ ID NO: 223081 - protein, 55 aa, Glycine max
  Coding DNA Sequence Number=SeqID_106303
MGAKHLPRTKERSHVTKQRILGCLPVAFSVCPELGKGRRSISRDPSLYSRPSLST

SEQ ID NO: 223082 - protein, 105 aa, Glycine max
  Coding DNA Sequence Number=SeqID_106304
MSLATLFGKLQEYEMELMKLYQHEENDKKKKEITLKASSSSIHEENDREDSNEKNLEEDDDFSLFLKRFNKFMRNKGNQRRSNFNPKKKGEDSSLVPKCYECDQP

SEQ ID NO: 223083 - protein, 95 aa, Glycine max
  Coding DNA Sequence Number=SeqID_106305
MITRLNLKSIEIHVSEFSQNLRVNGSYFLEISAADKLLPSDVEILRSTGPQRLKGCLVLAWHSYVATVTIKRDARSNFRIKANARARHLCLSHLN

SEQ ID NO: 223084 - protein, 464 aa, Glycine max
  Coding DNA Sequence Number=SeqID_106306
  Gene Ontology: Mol. function=nucleic acid binding; Cellular component= intracellular
  Pfam annotation: Domain name=G-patch; Domain location=419-463; Score =54.9; E_value=2.7e-13; Accession=PF01585.13; Description=G-patch domain
MYQCKETTKENPQQIYDGNNNEDHPSFLESKFETNQQIGTLADEAPADTPNSVSSPTCEDPPPPPSEWLEDTLIDLYLSGYKNIEVSEADAVTVPFETDDRYNSLAADAYSKTYEVEGEWILEPGDENGLADNRSTVDEGIPYSNTYELEEGEWIPDMEDEYGIADRSTIDEAISLDEEKWRAQYGQVTESGKDLVSEVPIVDLWDWEMVTGSKRDGKDKMARLVGRLVKPSAKQHPSIPFSGGKLRSAPICEAHLDLQYWDFQYRARGQLYRLRNPSAKYVASLSTYDSSNPTEHWDFPQLSPNRKIKRHSKSSESSASALDETPIEKDLSALPSQLSASKSCGLGKLREYNDMENNSKLKIKHQYRDRAAERRILHGGFGMGPGQKNLSDIYNTPSSPVDDCPQEATAEALEMSFGAGSYARKLLKSMGWKEGEGLGSSTKGLVEPIQPVGNVGTSGLGWSR

SEQ ID NO: 223085 - protein, 222 aa, Glycine max
  Coding DNA Sequence Number=SeqID_106307
  Gene Ontology: Mol. function=hydrogen ion transporting ATP synthase activity, rotational mechanism; Cellular component=nucleus; Biological process=ATP synthesis coupled proton transport
  Homolog annotation: Hit_ID=Q1SKF0; Match level="QueryCoverage=94%, HitCoverage=63%, E-value=3e-32, Identity=46%"; Hit description =FKBP12-like protein
MASPTHFDDDFDFGGGFGGRHSGNKRSSPDYDDEDYDNDPFAPKKAITKAEEASGVTTGMILSLRESLQNCKDTLATCQHSLQSSISIATSSLLELRVVDGNPSHIGLNQWPQYREEKLIKIIAFSRMNLRLQNQRFRVGILHLKISHPYLPGSLQALKSSEESLREQLEKAKKKEAAFIVTFAKREQEIAELKSAVRDLKVQLKPPSMQNPTGFPASFEAL

SEQ ID NO: 223086 - protein, 63 aa, Glycine max
  Coding DNA Sequence Number=SeqID_106308
MTEEDDEGAESEGCEGGQEFCEEGYVFGFGGFHEQVRIPARGSSYQDLRSQHHSRCWTTGSCR

SEQ ID NO: 223087 - protein, 598 aa, Glycine max
  Coding DNA Sequence Number=SeqID_106309
  Gene Ontology: Mol. function=protein dimerization activity; Cellular component=nucleus; Biological process=regulation of transcription, DNA-dependent
  Homolog annotation: Hit_ID=Q1SGY6; Match level="QueryCoverage=99%, HitCoverage=69%, E-value=0.0, Identity=74%"; Hit description =Transcriptional factor B3; Auxin response factor; Aux/IAA_ARF _dimerisation
  Pfam annotation: Domain name=Auxin_resp; Domain location=232-315; Score=195.0; E_value=1.8e-55; Accession=PF06507.4; Description=Auxin response factor
  Pfam annotation: Domain name=B3; Domain location=105-210; Score=63.0; E_value=1e-15; Accession=PF02362.12; Description=B3 DNA binding domain
  Pfam module annotation: Pfam domain module=Auxin_resp::B3; Domain location=232-315::105-210
MRLSSAGFSPPPQEGENRVLDSELWHACAGPLVSLPAVGSRVVYFPQGHSEQVAVSTNKEVDAHIPNYPSLPPQLICQLHNMTMHADAETDEVYAQMTLQPLNPVLTKAVFAARAKGGIPASGAGHPKAAEKVFPPLDFSQQPPAQELIARDLHGNEWKFRHIFRGQPKRHLLTTGWSVFVSAKRLVAGDSVLFIWQNQLLLGIRRANRPQTVMPSSVLSSDSMHLGLLAAAAHAAATNSRFTIFYNPRASPSEFVIPLAKYVKAVYHTRVSVGMRFRMLFETEESSVRRYMGTITGISDLDPVRWQNSHWRSVKVGWDESTAGDRQPRVSLWEIEPLTTFPMYPSPFPLRLKRPWPPGLPSFHGMKDDDFGPNSPLLWLRDPDRGLPSLNFQGIGINPWMQPRFDPTMLNMQTDMYQAAAVQDMRSLDPSKQHSASLLPFQQPQNFPNRTAALMQAQMLQQSQPQQIFGNTQENQHSPQSQAHLQQHLQHQHSFNSQHHHHHQQQQQRQQHQVVDNQQISSAVSTMSQFVSAPQPQSPPMQVISSMCQQQNFSDSNGNTVTTIVSPLHSILGSFPQDETSHLLNLPRTSSWIPVQNS

SEQ ID NO: 223088 - protein, 304 aa, Glycine max
  Coding DNA Sequence Number=SeqID_106310
  Gene Ontology: Mol. function=protein kinase activity; Cellular component=cytosol; Biological process=protein amino acid phosphorylation
  Homolog annotation: Hit_ID=Q60DP4; Match level="QueryCoverage=90%, HitCoverage=26%, E-value=2e-76, Identity=53%"; Hit description =Calcium binding EGF domain containing protein
  Subcellular localization annotation: CTP_CleavageSite=24; ConfidenceScore=5.02e-01
MATSNGFVDGTSPESALIFLGSGCSSMVPNVMCLLQPSDPPCPVCVQSLSIPPERNPNYRCNTSLLIDYCGDANAGDRKYILIDVGKTFRETVLRWFVAHRIPRVDSIILTHEHADAVLGLDDVRAVQAFSPTNDIDPTPIYLSQHSMDSIAEKFPYLVQKKRKEGAEIRRVAQIDWNIIADDCNKPFLASGLKFTPLPVNCHNLCLQWLCMERITSVWAFFLVRKTGWLIYLMFPGFLLVQSMSGSHNVHLCFPQTLETVKRLCPKQTLLIGMTHEFDHHKDNEFLMEWSKRLKHVTMYTAYC

SEQ ID NO: 223089 - protein, 86 aa, Glycine max
  Coding DNA Sequence Number=SeqID_106311
  Gene Ontology: Mol. function=structural constituent of ribosome; Cellular component=ribonucleoprotein complex; Biological process =translation
  Homolog annotation: Hit_ID=O22860; Match level="QueryCoverage=71%, HitCoverage=89%, E-value=3e-27, Identity=93%"; Hit description=60S ribosomal protein L38
  Pfam annotation: Domain name=Ribosomal_L38e; Domain location=13-80; Score=150.9; E_value=3.3e-42; Accession=PF01781.8; Description =Ribosomal L38e protein family
MAVIACVVLSMQPKQIHEIKDFLLTARRKDARSVKIKRSRDVVKFKVRCSKYLYTLCVFDPEKADKLKQSLPPGYTFDYMYAKCQW

SEQ ID NO: 223090 - protein, 275 aa, Glycine max
  Coding DNA Sequence Number=SeqID_106312
MACSVPFNNKNLDISFFVFKPTIVIIDDLVHGLKHFSLTTESLGCVQSSIFRSIHGNMIIWYGAWQRRSSKEKEELTSTLRTLLGYPLSILDRTSKTDTTDIVPIFIAEKSMLSNISSMAVLIEHSFLEAYGGESRDGSSTAKFSTGDIISLNSAVTTTNDLNDLCYAVLAILRSRFAKMEGITAGLCFKGQSKPRVVCIHVWKSLHFCYSWILNSDHRNWMMPYLERFSINMKYDIFRVVYVRGDNVVDLNCISTHQMLENGKESSRQGQVMQN

SEQ ID NO: 223091 - protein, 789 aa, Glycine max
  Coding DNA Sequence Number=SeqID_106313
  Gene Ontology: Mol. function=transcriptional elongation regulator activity; Cellular component=mitochondrion; Biological process =regulation of transcription, DNA-dependent
  Homolog annotation: Hit_ID=Q1SGX3; Match level="QueryCoverage=99%, HitCoverage=99%, E-value=0.0, Identity=75%"; Hit description =Tetratricopeptide-like helical
  Pfam annotation: Domain name=PPR; Domain location=197-231; Score =18.8; E_value=0.02; Accession=PF01535.11; Description=PPR repeat
  Pfam annotation: Domain name=PPR; Domain location=232-266; Score =29.1; E_value=1.5e-05; Accession=PF01535.11; Description=PPR repeat
  Pfam annotation: Domain name=PPR; Domain location=267-301; Score =24.0; E_value=0.00054; Accession=PF01535.11; Description=PPR repeat
  Pfam annotation: Domain name=PPR; Domain location=302-336; Score =42.0; E_value=2e-09; Accession=PF01535.11; Description=PPR repeat
  Pfam annotation: Domain name=PPR; Domain location=337-371; Score =12.9; E_value=0.22; Accession=PF01535.11; Description=PPR repeat
  Pfam annotation: Domain name=PPR; Domain location=373-407; Score =37.0; E_value=6.4e-08; Accession=PF01535.11; Description=PPR repeat
  Pfam annotation: Domain name=PPR; Domain location=408-442; Score =33.7; E_value=6.5e-07; Accession=PF01535.11; Description=PPR repeat
  Pfam annotation: Domain name=PPR; Domain location=443-477; Score =50.6; E_value=5.2e-12; Accession=PF01535.11; Description=PPR repeat
  Pfam annotation: Domain name=PPR; Domain location=478-512; Score =24.0; E_value=0.00053; Accession=PF01535.11; Description=PPR repeat
  Pfam annotation: Domain name=PPR; Domain location=513-547; Score =36.3; E_value=1e-07; Accession=PF01535.11; Description=PPR repeat
  Pfam annotation: Domain name=PPR; Domain location=548-582; Score =15.3; E_value=0.11; Accession=PF01535.11; Description=PPR repeat
  Pfam annotation: Domain name=PPR; Domain location=583-617; Score =32.0; E_value=2.1e-06; Accession=PF01535.11; Description=PPR repeat
  Pfam annotation: Domain name=PPR; Domain location=618-652; Score =40.6; E_value=5.3e-09; Accession=PF01535.11; Description=PPR repeat
  Pfam annotation: Domain name=PPR; Domain location=653-686; Score =20.0; E_value=0.0084; Accession=PF01535.11; Description=PPR repeat
  Pfam annotation: Domain name=PPR; Domain location=687-720; Score=8.3; E_value=0.77; Accession=PF01535.11; Description=PPR repeat
  Pfam annotation: Domain name=PPR; Domain location=721-755; Score =11.4; E_value=0.34; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR; Domain location =197-231::232-266::267-301::302-336::337-371::373-407::408-442::443 -477::478-512::...
  Pfam module annotation: Domain location=513-547::548-582::583 -617::618-652::653-686::687-720::721-755
  Subcellular localization annotation: CTP_CleavageSite=41; ConfidenceScore=5.27e-01
MPLLRFNHYLLPKLLASHFHANNNFSSIALSLHYATSSVFSASYSTTNLRHQTEGKYSNFGNFNDDLGKVGPGFQESLSFAASVSDGAEEEEGSSDDDESLEFINSFHGSNDKQTQNIASIEIDDSEFRHPVVREVCRLITLSSAWNPNFEGRLRHLLRSLKPSLVCAVLRSQADERVALNFFYWADRQWRYSHHPLVYYTLLDVLSKTKLCQGARRVLRLMTRRGIELSPEAFGCVMVSYSRAGKLRNALRVLTLMQKAGVEPNLSICNTTIYVLVKGCKLEKALRFLERMQVTGIKPDIVTYNSLIKGYCDLNRIEDALELIAGLPSKGCPPDKVSYYTVMGFLCKEKKIEQVKCLMEKMVQDSNLIPDQVTYNTLIHMLSKHGHADDALAFLKEAEDKGFHIDKVGYSAIVHSFCQKGRMDEAKSLVIDMYSRSCNPDVVTYTAIVDGFCRLGRIDEAKKMLQQMYKHGCKPNTVSYTALLNGLCHSGKSLEAREMINVSEEHWWTPNAITYGVVMHGFRREGKLSEACDLTREMVEKGFFPTPVEINLLIQSLCQNQKVVEAKKYLEECLNKGCAINVVNFTTVIHGFCQIGDMEAALSVLEDMYLSNKHPDAVTYTALFDALGKKGRLDEAAELIVKMLSKGLDPTPVTFRSVIHRYCQWGRVDDMLNLLDRMVKRKPFRTIYNHVIEKLCDFGNLEEAEKLLGKVLRTASKLDANTCHVLMESCLKKGVALSAYKVACQMFRRNLTPDLKLCEKVTKKLVLDGNLVEADKLMLRFVERGIQQK

SEQ ID NO: 223092 - protein, 251 aa, Glycine max
  Coding DNA Sequence Number=SeqID_106314
  Gene Ontology: Mol. function=carbon-sulfur lyase activity; Cellular component=vacuole
  Homolog annotation: Hit_ID=Q1S4J9; Match level="QueryCoverage=99%, HitCoverage=56%, E-value=1e-121, Identity=84%"; Hit description =Alliinase EGF-like; Allinase, C-terminal
  Pfam annotation: Domain name=Alliinase_C; Domain location=1-250; Score=318.4; E_value=1.3e-92; Accession=PF04864.4; Description =Allinase, C-terminal domain
MTDHLKSGLYKWGGDAESYEKEGPYIELVTSPNNPDGHVRRSKVNRSQGFLVHDLAYYWPQYTPISAPADHDLTLFTVSKSTGHAGMRIGWALVKDQEVAKKMTKFIELNTIGVSKDSQLRAAKVLRAVSDSWELGNSKESESFFKFSHKLMANRWKQLRLVVESSELFSLPKFSPAFCTFFNQVLEPQPAFVWLKCEGNVEDCESFLRGHNILTRSGTHFGVSPKYVRISMLDTDENFNQFLDRLSAIMS

SEQ ID NO: 223093 - protein, 62 aa, Glycine max
  Coding DNA Sequence Number=SeqID_106315
  Gene Ontology: Mol. function=sugar porter activity
  Homolog annotation: Hit_ID=Q1S4J6; Match level="QueryCoverage=92%, HitCoverage=10%, E-value=1e-22, Identity=84%"; Hit description =Ribosomal protein L11; Sugar transporter superfamily; Tetratricopepti de-like helical
SGMLAETVAQQLFESSPADNVYSVMLSNIYAGDGRWDDVKKLRDKMTGGLRKMPGLSWIEGS

SEQ ID NO: 223094 - protein, 58 aa, Glycine max
  Coding DNA Sequence Number=SeqID_106316
MVPVDMRIEHHLTVDLLIDHPVQVDAARSKNSVKAKWHDSKCVCHPTVLQFMGAVDMF

SEQ ID NO: 223095 - protein, 159 aa, Glycine max
  Coding DNA Sequence Number=SeqID_106317
MKHRTNEITISYTKRKVCPTVIKEKDIDVRFYDRIKLSSEHICDELFQWGNVCFFTFQRKLPQSKIQMSIIFLFLTGHQHCINSVLGIHSLSYFKQYQQIVCPAVKNGLHEIEDEISTSTTILRPQISPAFQALIGPKTIQKRQDIQACRVYLKDAIMQ

SEQ ID NO: 223096 - protein, 314 aa, Glycine max
  Coding DNA Sequence Number=SeqID_106318
MAFEDNTHHLSASETRPAPPHISTRPIAGIKDQRIIFLPSSQSNRNYPLVIDDSSRVFGKNQQEAMAGQQETKHGQGQSVESSTLVAGAQMFHKKGNKEKGETSGATETRKSSARVARDEVEAKDSFRPRVNFKNQEGSEDITEEAPREQDLAVTSGPTKRMGLLNYTPTGKACNVGLNPKNNKIRAESTWQVYSRQRRCQKKSQMGHSFSTTVTEIHRSSLPPQLPQNTAQHRTAYNASQDPIIATPVNSGDLEANSDSEIQHIQEAAHIWSTAKQLGASGREEQNMIIEKIKHMEERDKTEAERRGDSRRNQ

SEQ ID NO: 223097 - protein, 164 aa, Glycine max
  Coding DNA Sequence Number=SeqID_106319
MVHVNPATGKADGPHKKKLRTYLGIVAHDKAKFDIPEAYDCRTNKKDVREKAQAIQKQNTDPHVLSHGGYEYLEQKLMAEKIKKKLEEAAQSGSIEGVIDPPSPIRRHVKWKMGRHRENWADDDSLEEQASQGSFVPYGRQDLLTAAIGQPEHPGRVRAEPVSP

SEQ ID NO: 223098 - protein, 392 aa, Glycine max
  Coding DNA Sequence Number=SeqID_106320
  Gene Ontology: Mol. function=DNA binding; Biological process =regulation of transcription
  Homolog annotation: Hit_ID=Q1S588; Match level="QueryCoverage=96%, HitCoverage=82%, E-value=2e-83, Identity=50%"; Hit description=Myb -like DNA-binding domain, SHAQKYF class, putative
  Pfam annotation: Domain name=Myb_DNA-binding; Domain location=274 -325; Score=41.7; E_value=2.5e-09; Accession=PF00249.21; Description =Myb-like DNA-binding domain
MTLEGIFIEPTSTTTAPDLSLHISPPTISSLNSNYEPHESNFPSRTTTVSQQAHTELSLGRNFTSETPIPTPHNPYYQSQNHFHHLHHHHHNNNNTSTSVNTTSVVTSTTSTTPLNHINYGVSLLDVSSSDTLRPIKGIPVYHNRSFPFVATMDHARDNLNNNNNNNKDHYHHHKMCLYNHHNMPSYPSLSSSTATPSPSPYFVDPMSLLNNGSTMAACRAATATRFNGFSGDAFKSHHPLHQYGVGPSEASSGFMRSRFLQKLPNKRSMRAPRMRWTSTLHARFVHAVELLGGHERATPKSVLELMDVKDLTLAHVKSHLQMYRTVKTTDKPAASSGHSDGSGEDDLSPMVSTADRGGLRQFPNHRGRPEWAAQQDMDYSSTTTTLWSNSS

SEQ ID NO: 223099 - protein, 178 aa, Glycine max
  Coding DNA Sequence Number=SeqID_106321
MGGRCSECLFWLITVRMRILTEALWEGKIEAHNQIVLIRWLHPRKSVSSSKERAYFICERKMPSVNRAISIPKNKAVVNLVNHCLEPRECDLCGQEDLLGAVGELDGDGFYDLKQDFVIGNLVAGRKIKGWVGFLYTVWLVTRKSLGLAKQSLSVTGSAITTYSAAWGTRNLAHKNSI

SEQ ID NO: 223100 - protein, 243 aa, Glycine max
  Coding DNA Sequence Number=SeqID_106322
  Gene Ontology: Mol. function=nucleic acid binding; Cellular component= intracellular
  Homolog annotation: Hit_ID=Q39263; Match level="QueryCoverage=99%, HitCoverage=100%, E-value=1e-39, Identity=40%"; Hit description=Zinc finger protein 4
  Pfam annotation: Domain name=zf-C2H2; Domain location=106-128; Score =19.5; E_value=0.012; Accession=PF00096.16; Description=Zinc finger, C2H2 type
MKPNFDLEVEACAEYESEVSSQVASNVSIQETSIGPCSDSLTNISNITNPIGIHPNSDAISLDLSLNFKNSEPGGRDSIGFSFSSTSESSNEPASQTTAATIPRVFSCNYCQRKFFSSQALGGHQNAHKRERTLAKRAMRMGFFSERSLGIKAHSSLHHGFLPTMRPPEIKSNARYDQGYLGHPIFLEDDESDLLWPGSFRQVAEAGDSHQNFILTGSSNMSFTEVNPPVDIENSTPDLTLKL

SEQ ID NO: 223101 - protein, 961 aa, Glycine max
  Coding DNA Sequence Number=SeqID_106323
  Gene Ontology: Mol. function=protein serine/threonine kinase activity; Cellular component=integral to membrane; Biological process=protein amino acid phosphorylation
  Homolog annotation: Hit_ID=P43298; Match level="QueryCoverage=97%, HitCoverage=99%, E-value=0.0, Identity=69%"; Hit description =Putative receptor protein kinase TMK1 precursor
  Pfam annotation: Domain name=APH; Domain location=590-769; Score= -5.2; E_value=0.013; Accession=PF01636.13; Description=Phosphotransfer ase enzyme family
  Pfam annotation: Domain name=LRRNT_2; Domain location=23-56; Score =30.1; E_value=7.8e-06; Accession=PF08263.3; Description=Leucine rich repeat N-terminal domain
  Pfam annotation: Domain name=LRRNT_2; Domain location=321-360; Score =23.6; E_value=0.00069; Accession=PF08263.3; Description=Leucine rich repeat N-terminal domain
  Pfam annotation: Domain name=LRR_1; Domain location=107-129; Score =9.4; E_value=4.9; Accession=PF00560.23; Description=Leucine Rich Repeat
  Pfam annotation: Domain name=LRR_1; Domain location=131-154; Score =5.4; E_value=28; Accession=PF00560.23; Description=Leucine Rich Repeat
  Pfam annotation: Domain name=LRR_1; Domain location=182-204; Score =7.1; E_value=13; Accession=PF00560.23; Description=Leucine Rich Repeat
  Pfam annotation: Domain name=LRR_1; Domain location=232-253; Score =7.2; E_value=13; Accession=PF00560.23; Description=Leucine Rich Repeat
  Pfam annotation: Domain name=LRR_1; Domain location=255-278; Score =15.5; E_value=0.19; Accession=PF00560.23; Description=Leucine Rich Repeat
  Pfam annotation: Domain name=LRR_1; Domain location=280-301; Score =5.6; E_value=26; Accession=PF00560.23; Description=Leucine Rich Repeat
  Pfam annotation: Domain name=LRR_1; Domain location=363-385; Score =2.2; E_value=1.1e+02; Accession=PF00560.23; Description=Leucine Rich Repeat
  Pfam annotation: Domain name=LRR_1; Domain location=387-409; Score =15.2; E_value=0.23; Accession=PF00560.23; Description=Leucine Rich Repeat
  Pfam annotation: Domain name=LRR_1; Domain location=411-432; Score =7.2; E_value=13; Accession=PF00560.23; Description=Leucine Rich Repeat
  Pfam annotation: Domain name=LRR_1; Domain location=60-82; Score=3.5; E_value=63; Accession=PF00560.23; Description=Leucine Rich Repeat
  Pfam annotation: Domain name=LRR_1; Domain location=84-105; Score =17.8; E_value=0.039; Accession=PF00560.23; Description=Leucine Rich Repeat
  Pfam annotation: Domain name=Pkinase; Domain location=587-863; Score =145.9; E_value=1.1e-40; Accession=PF00069.15; Description=Protein kinase domain
  Pfam annotation: Domain name=Pkinase_Tyr; Domain location=587-863; Score=114.7; E_value=2.7e-31; Accession=PF07714.7; Description =Protein tyrosine kinase
  Pfam module annotation: Pfam domain module=APH::LRRNT_2::LRRNT_2::LRR_ 1::LRR_1::LRR_1::LRR_1::LRR_1::LRR_1::LRR_1::LRR_1::LRR_1::LRR_1::LRR_ 1::Pkinase::Pkinase_Tyr; Domain location=590-769::23-56::321-360::107- 129::...
  Pfam module annotation: Domain location=131-154::182-204::232 -253::255-278::280-301::363-385::387-409::411-432::60-82::84-105::587- 863::587-863
MKALALLAIIVFTLLVRSQEEEDYDDASVMLALKNSLNPPGWSDPDPCKWARVLCSDDKRVTRIQIGRLNLQGTLPTTLQKLTHLEHLELQYNNISGPLPSLNGLTSLRVFLASNNRFSAVPADFFAGMSQLQAVEIDSNPFEPWEIPQSLRNASGLQNFSANSANVGGSIPEFFGSDVFPGLTLLHLAMNNLEGTLPLSFSGSQIQSLWLNGQKSVNKLGGSVEVLQNMTFLTDVWLQSNAFTGPLPDLSGLKSLRDLSLRDNRFTGPVPVASFVGLKTLKVVNLTNNLFQGPMPVFGDGVVVDNVKDSNSFCLPSPGDCDPRVDVLLSVVGVMGYPPRFAESWKGNDPCAYWIGITCSNGYITVVNFQKMELSGVISPEFAKLKSLQRIVLADNNLTGSIPEELATLPALTQLNVANNQLYGKVPSFRKNVVVSTNGNTDIGKDKSSLSPQGLVPPMAPNAKGDSGGVSGIGGKKSSSHVGVIVFSVIGAVFVVSMIGFLVFCLFRMKQKKLSRVQSPNALVIHPRHSGSDNESVKITVAGSSVSVGAASETRTVPGSEASDIQMVEAGNMVISIQVLKNVTDNFSEKNVLGQGGFGTVYRGELHDGTRIAVKRMECGAIAGKGAAEFKSEIAVLTKVRHRHLVSLLGYCLDGNEKLLVYEYMPQGTLSRHLFDWPEEGLEPLEWNRRLTIALDVARGVEYLHGLAHQSFIHRDLKPSNILLGDDMRAKVADFGLVRLAPEGKASIETRIAGTFGYLAPEYAVTGRVTTKVDVFSFGVILMELITGRKALDETQPEDSMHLVTWFRRMSINKDSFRKAIDSTIELNEETLASIHTVAELAGHCGAREPYQRPDMGHAVNVLSSLVELWKPSDQNSEDIYGIDLDMSLPQALKKWQAYEGRSQMESSASSSLLPSLDNTQTSIPTRPYGFADSFTSADVLHTSSMINFTPSLALVVKDFC

SEQ ID NO: 223102 - protein, 117 aa, Glycine max
  Coding DNA Sequence Number=SeqID_106324
  Gene Ontology: Mol. function=zinc ion binding
  Homolog annotation: Hit_ID=Q7X6Y7; Match level="QueryCoverage=84%, HitCoverage=14%, E-value=7e-20, Identity=43%"; Hit description=Male meiotic MMD1
MSFALIEACKKRKRLPKFFRFNSFGDPGVVPIAPSGPFRDNVRVFLQNAGELEGYTVSGNPLWCILLIHDNSNAMAPLYTIEEHVDHSSHPFCDHCRCVGSFPISPCWVRFGLVADS

SEQ ID NO: 223103 - protein, 91 aa, Glycine max
  Coding DNA Sequence Number=SeqID_106325
MRPLSFRNNKLGGKRAETDSVPFIIQEQQAEWVNTQRQILHPLSFRNNKLGGKRAETDFVPFIIQEQQAEWVNAQRQILRPLSFRNSKLSG

SEQ ID NO: 223104 - protein, 150 aa, Glycine max
  Coding DNA Sequence Number=SeqID_106326
  Gene Ontology: Mol. function=nucleic acid binding; Biological process= DNA integration
MTLEDYSNSTTPQYFTSIARPDGNLFHRLPSEDPYAHLATYIEICNTVKIVRVPEDVVCLNLFSFSLAGEAKRWLHSFKGNSLRTWDEVVEKFLKKYFLVSKTTKGKVEISSFLQHPNESLSKALDRFHGLLRKTPTHGFSEPVQLNIKK

SEQ ID NO: 223105 - protein, 218 aa, Glycine max
  Coding DNA Sequence Number=SeqID_106327
MTVNKKMILLLSMVLMQELGLNLQKAPKSLTGRRTNAHGSFVLHGRDDILNTTIGRPKHPGRVRVAGIGVTIIQYFGHASCDSNTSSASIHQKTLAEIIGNLKEKWRTKVEDENKNLQEAWRKKVEKENKCSLEIIKQELKQAIKLELSQIASQHSPPLEALDIQVLVAHMSTKGSCAEADTNPLVSEPSDVHMDTMSLYVVGEQPTQLVALGKLYDN

SEQ ID NO: 223106 - protein, 169 aa, Glycine max
  Coding DNA Sequence Number=SeqID_106328
  Gene Ontology: Mol. function=transition metal ion binding; Biological process=cytoskeleton organization and biogenesis
MAYYKVIEVIWELDYSEFRVLVFKCLWVNGNTKVRQDKMGFTLDDLQKVGYNDDPFIMASQASRVFYVQDPCDSRGSVILQGRTTCIGDRIDGSTLDVNKMLTFSQQMHLINGEDEEDDREKKLPILHYNWNDVPESLKNVVWDDILGKLDILKGANAKKKMMSTIATK

SEQ ID NO: 223107 - protein, 80 aa, Glycine max
  Coding DNA Sequence Number=SeqID_106329
MGKGNIKTTIPKTKNAKEFMDLVEERSQTTDKSLARTLMSILISMKFDGSRTMHEHVIEMAKIAARLKTLRMVVNKNFFV

SEQ ID NO: 223108 - protein, 116 aa, Glycine max
  Coding DNA Sequence Number=SeqID_106330
  Homolog annotation: Hit_ID=Q8VZA1; Match level="QueryCoverage=39%, HitCoverage=8%, E-value=6e-13, Identity=71%"; Hit description =Laccase (Diphenol oxidase)-like protein
  Pfam annotation: Domain name=Cu-oxidase_3; Domain location=35-105; Score=-43.6; E_value=0.096; Accession=PF07732.5; Description =Multicopper oxidase
MASLGGSMFVLTFLFVFVGLMSSSSEAAIKKYQFDIQVTNVSRLCHAKPIVTVNGRFLGPTVYVREGEILRCSNSLASFRFLWFFHKRKCLLLREKVSGAMDELELGWPWSLEYWK

SEQ ID NO: 223109 - protein, 170 aa, Glycine max
  Coding DNA Sequence Number=SeqID_106331
  Gene Ontology: Biological process=protein modification process
  Homolog annotation: Hit_ID=Q2HV31; Match level="QueryCoverage=78%, HitCoverage=22%, E-value=2e-46, Identity=71%"; Hit description =Prefoldin
  Pfam annotation: Domain name=DUF827; Domain location=17-155; Score= -101.2; E_value=0.0066; Accession=PF05701.2; Description=Plant protein of unknown function (DUF827)
MTDHSIRNPSICICKVFCGVLISNLCDLQKVLEKETQLLLAQTELKNIKKQLQSAENTKSKILFELDKAKVTLQELRMKLNSARESKQSAIEAAEAMNNKAKQLEQALSQKAIGYEAWKQKLEHERKEYTTTVKKKVDASKQQLNKIRQYFDTPFQARLAAFQTLLVVTN

SEQ ID NO: 223110 - protein, 77 aa, Glycine max
  Coding DNA Sequence Number=SeqID_106332
MEEKMHGVQDLNQIVEDQNNILQTQFNEAHEDDAKDKELKVAGTVEDDVTSDNKLEATSSPFANEPNVTHSLENDAK

SEQ ID NO: 223111 - protein, 42 aa, Glycine max
  Coding DNA Sequence Number=SeqID_106333
MDNDGEYWCNYSAFKIMARGILSWERDLKKAEEMGHDACIKS

SEQ ID NO: 223112 - protein, 737 aa, Glycine max
  Coding DNA Sequence Number=SeqID_106334
  Gene Ontology: Mol. function=voltage-gated potassium channel activity; Cellular component=integral to membrane; Biological process=potassium ion transport
  Homolog annotation: Hit_ID=Q84LA0; Match level="QueryCoverage=99%, HitCoverage=91%, E-value=0.0, Identity=71%"; Hit description=Shaker -like potassium channel
  Pfam annotation: Domain name=Ank; Domain location=519-551; Score =38.6; E_value=2.2e-08; Accession=PF00023.20; Description=Ankyrin repeat
  Pfam annotation: Domain name=Ank; Domain location=552-584; Score =27.3; E_value=5.4e-05; Accession=PF00023.20; Description=Ankyrin repeat
  Pfam annotation: Domain name=Ank; Domain location=587-619; Score =27.8; E_value=3.7e-05; Accession=PF00023.20; Description=Ankyrin repeat
  Pfam annotation: Domain name=Ank; Domain location=620-653; Score=7.1; E_value=2.9; Accession=PF00023.20; Description=Ankyrin repeat
  Pfam annotation: Domain name=Ion_trans; Domain location=15-222; Score= 75.1; E_value=2.1e-19; Accession=PF00520.21; Description=Ion transport protein
  Pfam annotation: Domain name=Ion_trans_2; Domain location=150-228; Score=30.0; E_value=8.3e-06; Accession=PF07885.6; Description=Ion channel
  Pfam annotation: Domain name=cNMP_binding; Domain location=340-451; Score=63.0; E_value=9.7e-16; Accession=PF00027.19; Description =Cyclic nucleotide-binding domain
  Pfam module annotation: Pfam domain module=Ank::Ank::Ank::Ank::Ion _trans::Ion_trans_2::cNMP_binding; Domain location=519-551::552 -584::587-619::620-653::15-222::150-228::340-451
MEFGFFRGLPENLFILDIIGQIAFLVDIVLQFFVAYRDSQTYRTVYKRTPIALRYLKSNFIFDLLGCMPWDIIYKACGRKEEVRYLLWIRLYRVRKVTDFFHKLEKDIRVNYIITRIVKLIVVELYCTHTAACIFYYLATTLPESQEGYTWIGSLKLGDFSYSHFREIDLWKRYTTSLYFAIVTMATVGYGDIHAVNMREMVFIMVYVSFDMILGAYLIGNMTALIVKGSKTEKFRDKMTDLMKYMNRNRLGRDIREQIKGHVRLQYESSYTEASVIQDIPISIRAKISQTLYLPYIEKVSLFKGCSSEFIRQITLTLKHEYFHAIGPAGKPEMVIRLHEEFFLPGEVIMEQGNVVDQLYFVCHGVLAWDKLSDAEFSYLFVLYHLKKEEVGTAEDGTEETVSLLQPNSSFGEISILCNIPQPYTVRVCELSRLLRLDKQSFTNILDIYFYDGRKVLNNLLEGKESFRDKQLESDITFHIGKQEAELALKVNNAAFNGDLYQLKGLIRAGADPNKTDYDGRSPLHLAASRGYEDITLFLIQERVDVNIKDNFGNTPLLEAVKNGHDRVASLLVREGASMKIENADYDYRSPLHIAAAEGLYFMAKLLLEGGASVFTKDRWGNTPLDEARMCGNKNLIKLLEDAKSAQLSEFPSQEYTDKMHPKKCTVFPYHPWDPKDNRRHGIVLWIPHSIQELIKSAAEQIEFSGDACILSEDAGKVTDVDMIKDGQKLYLVHETH

SEQ ID NO: 223113 - protein, 94 aa, Glycine max
  Coding DNA Sequence Number=SeqID_106335
MEVESSKTTIPKPLVRRKKADETQEAAATSEKSLEATSEPSEPVADTTSPQQAAESSTPEDQTTPVLSLNTSPTAIPVLYLTDEEDVQTQDTQD

SEQ ID NO: 223114 - protein, 127 aa, Glycine max
  Coding DNA Sequence Number=SeqID_106336
QTQVDVPSTCTTKDVPSNVLRQRSQAVTPLILCEWGYKRILRREMGDTKEFRRLVPCSFGKERRETQKEFRQLVLGEFFLAKGEENEKMNNTSFQGLENQKTSESFWYKEEEEELQRDFKACKGLFE

SEQ ID NO: 223115 - protein, 216 aa, Glycine max
  Coding DNA Sequence Number=SeqID_106337
  Gene Ontology: Mol. function=DNA binding; Biological process=DNA integration
  Homolog annotation: Hit_ID=Q8U751; Match level="QueryCoverage=76%, HitCoverage=54%, E-value=1e-80, Identity=91%"; Hit description=IS3 family transposase
RGQFSGDTSPRDRCVRDRCQAFARHVIDNVEDAESSAAGELVVDEIQRPAGIGLRFNQDRCTRANRTPPGFALANGKTFLAIEPVDAINAGRLSVPPKQDEQSPVSETPSLIGEVAQLRPQFYLRRSAGPISHHLPICRYNLAGPPFRKTHDGLQMRDGVAFGGGPYHFFARSSRSAAASNICSASSFFSLAFSSSSAFSRFASETSMPPYLAFQL

SEQ ID NO: 223116 - protein, 224 aa, Glycine max
  Coding DNA Sequence Number=SeqID_106338
  Gene Ontology: Mol. function=nucleotide binding; Cellular component =integral to membrane; Biological process=protein folding
  Pfam annotation: Domain name=CENP-B_N; Domain location=136-188; Score= 15.8; E_value=0.0054; Accession=PF04218.3; Description=CENP-B N -terminal DNA-binding domain
  Pfam annotation: Domain name=Transposase_8; Domain location=139-216; Score=120.2; E_value=5.9e-33; Accession=PF01527.10; Description =Transposase
  Pfam module annotation: Pfam domain module=CENP-B_N::Transposase_8; Domain location=136-188::139-216
VEGKITRLEAEELWKPLITRLRRPIERVIRDSETDPSSLSQIVLVGGASRMPLLKTMTTRLFGRFPLSHPNPDHAIAIGTAVQSALHARHEALDEIIMTDVCPYTLGIASVEQAYGLNELLMSPIIEQSGPLKDGRMKKQRFTEEQIIAVLKEQEAGAKVADLCRKHGISEATFYNWKAKYGGMEVSEAKRLKALEDENARLKKLLAEQMLDAAALRELLAKKW

SEQ ID NO: 223117 - protein, 59 aa, Glycine max
  Coding DNA Sequence Number=SeqID_106339
MTRLDRTVEGVTDETCPRMEMQISRAEGRVGERERAKRVEVEVTRVEARGEVGGRWKWS

SEQ ID NO: 223118 - protein, 608 aa, Glycine max
  Coding DNA Sequence Number=SeqID_106340
  Homolog annotation: Hit_ID=Q1T4I1; Match level="QueryCoverage=94%, HitCoverage=98%, E-value=0.0, Identity=65%"; Hit description=IQ calmodulin-binding region
  Pfam annotation: Domain name=IQ; Domain location=121-141; Score=21.5; E_value=0.0031; Accession=PF00612.17; Description=IQ calmodulin -binding motif
  Pfam annotation: Domain name=IQ; Domain location=147-167; Score=4.0; E_value=15; Accession=PF00612.17; Description=IQ calmodulin-binding motif
  Pfam annotation: Domain name=IQ; Domain location=99-119; Score=31.2; E_value=3.5e-06; Accession=PF00612.17; Description=IQ calmodulin -binding motif
  Pfam module annotation: Pfam domain module=IQ::IQ::IQ; Domain location=121-141::147-167::99-119
MGKSPGKWIKTVLFGKKSSKSNISKGREKIVNKKAVVASNELENGLSLDPTPNEIATKEEDLELENEESENILPENQERDINGSVDPDAPPDPEKIRQEEAATKAQAAFRGYLARRAFRALKGIIRLQALIRGHLVRRQAVVTLCCMYGIVKLQALVRGGRIRQSNVGFEIHEKCNLFKPLDGKLGEPVGISTKISKLSANTFIRKLVASSITIMALRLQYVSGDPNSVLSWLERWSASYFWKPVPQPKKIRDSKSHRKHGNISNGEAQITKSKRTTRKLPIANFEPALVQTNPEFEKPKRNFRKIPHQVLDPELENPQSELEKVKRSLRKIHNPVVENAVQPEVEIETPKEHLEIATVIPSHAVSEQAIITPDDKIEQEETLTIFNVPDVEISPRPSVNMEVYDIPSNYQVSVESKPLSETPIKDRNTSHGKVKNELGNLPETIFKDENSLLTNGDLSYNDLTGNENQKPTRKASNLTKQENGDDGLKNSPKLPSYMAATESAKAKLRAQGSPRFGQDETEKNNTAGSGRHSLPSSTNKKISSYSPKTQRSVPAGGKGGNKSDRTVPSSKAGNGKRWFSGIEHEEAENRVGSSVMEVVEMIGPLYEL

SEQ ID NO: 223119 - protein, 753 aa, Glycine max
  Coding DNA Sequence Number=SeqID_106341
  Gene Ontology: Mol. function=RNA-directed DNA polymerase activity; Cellular component=chromatin; Biological process=chromatin assembly or disassembly
QHCPQGVGVPELVPMFPRGVLRWESKPLNQCQLGTAIQLQQRDMEDQVDLERSRQLEAVSHWTNENEHPIINRELDIASMNVCKLFHGSLALARCQIRVESEPLCGTVIDNSSEVLFENAIEDLRLVVCLRVTTREVVKFAYNVHEEGGYLVRSVMWGNDTKMNPFENLSTTTRIVVKPFDNGRPEIKCRDKPPRSKMVWAMAMKSFRNSHVTTNGCLMKFFQQKLGEGTVCQEQNLVIEEDEIMKSLELFHEFKIGKRQRIQLTGGNPGESINNDIGGARLVLDCVIIAHEFGKVFETLVIRKNHKRMTHKVVSPLAHCRCYGVKRIAPMATLKASNSKVKGSEKSGVAKIGVPIIHCFRASKVRWASECHINWSFLSNKGLAMPLLPESCLRLGPCRQSTRYAPGLTLTGAELGTRVVTTRGMDDEAGVQKSQLCVEGLGLFLEQLDPEDNISTVKGKLEEVKGELVALNNNVNLGHIVSQGQKFSNATLDEVMGTFAIHENADLGKRWCIVSTSWWLRVGVVPVRGFIVISDEKMEARLAAVPYDPLLVTLAENEATKEERRGKAHDPVREHPEGHHNMKGRSVIHALEAWQATMAPLIVEELTNFEDPAHGILAIEARHLELYGDCKGGQAVRDGVEPNFHGGMVLACYSLLEAVNSCLTSIVFKHGVKGASGRRNCQSLASIEYNRTIREWQLHEITEVLGPHACSLGPGIVCVASWITIICIIGLNKWMKTCLVHQGRLLRFEATIM

SEQ ID NO: 223120 - protein, 967 aa, Glycine max
  Coding DNA Sequence Number=SeqID_106342
  Gene Ontology: Mol. function=nucleoside-triphosphatase activity; Cellular component=integral to membrane; Biological process=transport
  Homolog annotation: Hit_ID=Q84K47; Match level="QueryCoverage=98%, HitCoverage=97%, E-value=0.0, Identity=64%"; Hit description=ABC2 homolog 1
  Pfam annotation: Domain name=ABC_tran; Domain location=558-740; Score= 167.7; E_value=2.8e-47; Accession=PF00005.17; Description=ABC transporter
MATTLTGISLVALQFKALLKKNLLLSWRNKRASLLQLLSPLIFIFLIFAIDKAIKAQTSTSSSYKSVTDPPMEPSPPITPCEDKFFIKLPCYDFVWSGHASPTFQTIVARIMNNNPGRPIPPSKVKSFKEKSEVDAWLLSNPMRCPGALHFSERNDTVISYGLQTNSTSLQRRGKYEDPTASFQLPLQLAAEREIARYLIGDADFSWNVFLREFAHPSMNPFSAVASIGPAFFLAIAMFNFVLQISSLVTEKELKLRQAMNMMGLYDFAYWFSWLIWEAVVTILSSLLIVLFGMMFQFRFFLDNSFVVLFVLFFLFELNMTGLAFMISAFIRKSSSATTVGFSIFIVGFVTQLVVQQGFPYTDSFSKTIRNVWSLFPPNLFAQGIKVLSDAVATSEDKGISWSKRGECALNDSDCVITIDDIYKWLAATFFLWFVLAIYFDNIIPNASGVRKSILYFLNPSYWMGKGGQKVKEGGVCSCIGSAPRQEQSTPDDEDVLEEENKVKQQLTEGLLDANVAVQIRGLAKTYPGTRSIGCCFKCKRTSPYNAVKGLWVNFAKDQLFCLLGPNGAGKTTAINCLTGVTPVTDGDALIYGHSIRSSTGMSNIRKLIGVCPQFDILWDALSGQEHLQLFATIKGLSPASIKSITQTSLAEVRLTDAAKVRAGSYSGGMKRRLSVAIALIGDPKLVILDEPTTGMDPITRRHVWDIIENAKRGRAIVLTTHSMEEADILSDRIGIMAKGSLRCIGTSIRLKSRFGTGFIANISFNGNNIEHSPANGDAISTERREAVKKFFKNHLDVVPKEENHNFLTFVIPHDREALMTNFFSELQDREEEFGISDIQLGLTTLEEVFLNIARQAELESAAAEGRLVTLTLTSGESVQIPIGARFVGIPGTESAENPTGFMVEVYWEQDDTGALCIAGHSQKVPIPNGVQLSSSPSVRHRRYLGRSGTVHGVVIDPSQVSSVAFQ

SEQ ID NO: 223121 - protein, 105 aa, Glycine max
  Coding DNA Sequence Number=SeqID_106343
NPLLLQEVVALLDSEELKFKLVERGAAEDDEDGLLLEVRSRVMVGCEGEDESAAGWDRSAVVMAVEGLVPECEVDEPDNSMDAAAEVVEAMAVAESGRGWLWLPS

SEQ ID NO: 223122 - protein, 287 aa, Glycine max
  Coding DNA Sequence Number=SeqID_106344
  Gene Ontology: Mol. function=sequence-specific DNA binding; Cellular component=nucleus; Biological process=regulation of transcription
  Homolog annotation: Hit_ID=Q1T4J9; Match level="QueryCoverage=96%, HitCoverage=47%, E-value=6e-75, Identity=55%"; Hit description=DNA -binding WRKY
  Pfam annotation: Domain name=WRKY; Domain location=239-287; Score =61.2; E_value=3.4e-15; Accession=PF03106.6; Description=WRKY DNA -binding domain
MEFGSERSGHEVKDEKRSESSVGDEEDRREQEIVTQEPPLSTTERSTVEAGPNASSLTKKEEAVDELEVAKAEMGEVMEENQRLKTCLNRILNDYRALQMQFHNIVEQETKDSSDQKVNNNNDQYQIDESNLVSLSLGRLPTRNNNKVPNNKPLKEEAEKEDKEGLSLGLDCKFETSKSGISTTEYLPIHQSPNNSVEEVPKEEAAGESWQPGKGIKTARDATGEDEVSQQNPAKKARMNDGCQWRKYGQKISKGNPCPRAYYRCTVAPSCPVRKQMCRSSIKTAYA

SEQ ID NO: 223123 - protein, 727 aa, Glycine max
  Coding DNA Sequence Number=SeqID_106345
  Gene Ontology: Mol. function=hydrolase activity, hydrolyzing O -glycosyl compounds; Biological process=carbohydrate metabolic process
  Homolog annotation: Hit_ID=Q5BMA5; Match level="QueryCoverage=99%, HitCoverage=96%, E-value=0.0, Identity=59%"; Hit description =Putative endo-1,4-beta-xylanase
  Pfam annotation: Domain name=CBM_4_9; Domain location=12-164; Score =70.2; E_value=6.8e-18; Accession=PF02018.8; Description=Carbohydrate binding domain
  Pfam annotation: Domain name=CBM_4_9; Domain location=182-341; Score =94.9; E_value=2.5e-25; Accession=PF02018.8; Description=Carbohydrate binding domain
  Pfam annotation: Domain name=Glyco_hydro_10; Domain location=381-671; Score=220.7; E_value=3.4e-63; Accession=PF00331.11; Description =Glycosyl hydrolase family 10
  Pfam module annotation: Pfam domain module=CBM_4_9::CBM_4_9::Glyco _hydro_10; Domain location=12-164::182-341::381-671
TTSTGCVSAGDDNIIVNPQFDDGLKNWSGRSCKIMLHDSMNDGKIVPKSGKFFASATERTQSWNGIQQEITGRVQRKLAYEVTALVRIFGNNVSTADVRATLWVQTPDLREQYIGIAKLATDKDWITMQGKFLLNGSPSKVVLYLEGPPPGTDILLNNLVLKHAANTPPSTPPDVKNVAFGVNIIENSNLADSTNGWFPLGNCTLSVKTGSPHIIPPMARDSLGPHELLSGRYILVTNRMQTWMGPAQTITDKVKLFVTYQVSAWVRIGSAGSSGPQNVNVALGVDNQWVNGGQTQVSDDMWHEIGGSFRIEKQPSKVMVYVQGPASGVDLMVAGLQIFPVDRHTRFRYLKIQTDKIRKRDVILKFSGLDSGSYANTSVKVIQTHNDFPIGTCISRTNIDNEDFVNFIVKHFNWAVFGNELKWYWTEPQQGNFNYKDADDMLSLCQKHKIQTRGHCIFWEVDETVQQWIKSLNKNDLMTAVQNRLNGLLTRYKGKFSHYDVNNEMLHGSFYQDRLGKDIRANMFKTASQLDPSATLFVNDYHVEDGCDTRSCPDKYIHHILDLQEQGAPVGGIGIQGHIDCPIGPIVSSSLDKLGILGLPIWFTELDVSSVNEYVRADDLEVMLREAMAHPTVEGLMLWGFWELFMSRDHSHLVNAEGDINEAGKRFLALKQEWLSHSRGHVDEQGQYNFRGFHGTYNVQVVTPSKKISKTFVLDKGDSPLVVSIDL

SEQ ID NO: 223124 - protein, 131 aa, Glycine max
  Coding DNA Sequence Number=SeqID_106346
MADLGGGFAKKRHRIAVAWRVWDGGRHSHGGRGGYGGVAKNGGICLVFVCAVIQNSSASLPHPAAPSRCRDRRHPHSPRTQPPPPATPLHEDEGQLRASPGNAASRDRDTSSFCLVKKTKKTKTQTRVSQP

SEQ ID NO: 223125 - protein, 216 aa, Glycine max
  Coding DNA Sequence Number=SeqID_106347
  Gene Ontology: Mol. function=pseudouridylate synthase activity; Biological process=RNA processing
  Homolog annotation: Hit_ID=Q2RQY9; Match level="QueryCoverage=43%, HitCoverage=26%, E-value=4e-15, Identity=47%"; Hit description =Pseudouridine synthase
  Pfam annotation: Domain name=PseudoU_synth_2; Domain location=2-99; Score=-31.8; E_value=0.0048; Accession=PF00849.12; Description=RNA pseudouridylate synthase
MQNLLDWNEACEATYQRYWALVIGTPKEKEGIIHAPLSKVLLNDGKTERIILAHHSSVEPRQEAVTEYRVLGPQINGCSWVELRPLTYRKHQLRVHCAEALGTPIVGDYKYGWFVHSRWKQMPRVDIEPTTGKPYKLRRPEGLDVQKGSVLSKVPLLHLHCRELVLPNIVKFMHVLNNSSEELRTSLREQPDVLRFVATMPSHMRISWNLMSSYLV

SEQ ID NO: 223126 - protein, 122 aa, Glycine max
  Coding DNA Sequence Number=SeqID_106348
  Gene Ontology: Mol. function=hydrolase activity, hydrolyzing O -glycosyl compounds; Biological process=carbohydrate metabolic process
  Homolog annotation: Hit_ID=Q5BMA5; Match level="QueryCoverage=95%, HitCoverage=12%, E-value=7e-25, Identity=50%"; Hit description =Putative endo-1,4-beta-xylanase
MAGNISGPSGSKGANILLNHDFSSGLTSWHLNSCTGYVISSKSGTQGGIPMDLDANYAVITDRKECWQGLEQDITNKISIGSTYTVSACVGVSGVSQGSSDVLATLKLEHHDSATRYLFIGR

SEQ ID NO: 223127 - protein, 272 aa, Glycine max
  Coding DNA Sequence Number=SeqID_106349
  Gene Ontology: Mol. function=pseudouridylate synthase activity; Biological process=RNA processing
  Homolog annotation: Hit_ID=Q69K07; Match level="QueryCoverage=54%, HitCoverage=34%, E-value=9e-07, Identity=27%"; Hit description =Ribosomal large subunit pseudouridine synthase C-like
  Subcellular localization annotation: CTP_CleavageSite=68; ConfidenceScore=5.23e-01
MGGARASPFASSLPYGFLAGPNRLWLRGGGLAHLTALAMKSFMHYSRIQPPRPVSVEPVISVSNNIARLDAPKEGPKPRQLLSLPPFPGHPLPDKSSISGSRQRDYVTAVNWIKYYFKGTWGSVIESHFREGLVQMEADDSSTQKEEQMKPMRKIRPNEVMKRGARVHVPVSICETRISKRYDAIPSGTLYPNADEIKYLQRLDSAIIVLNKPPKLPVKGSLPVHNSMDALAAAALSYDYDEGPKLEQIYLRHSPITVTKTVEIPYTSKKEI

SEQ ID NO: 223128 - protein, 293 aa, Glycine max
  Coding DNA Sequence Number=SeqID_106350
  Gene Ontology: Mol. function=DNA binding; Cellular component=nucleus; Biological process=regulation of transcription
  Homolog annotation: Hit_ID=Q09GS2; Match level="QueryCoverage=37%, HitCoverage=53%, E-value=4e-31, Identity=53%"; Hit description =Transcription factor MYBJ7
  Pfam annotation: Domain name=Myb_DNA-binding; Domain location=14-97; Score=35.1; E_value=2.4e-07; Accession=PF00249.21; Description=Myb -like DNA-binding domain
MGRAPCCDKANVKRGPWSPEEDATLKNYVETHGTGGNWIALPKKAGQTSNMEALLKKRTTSFAPSMLRWEAGIWSAIASKLPGRTDNDVKNYWNTKLKKKIMARKVTLKTLTHNDTLPSTSTPSSLTNNQNVKTSQNSPFPSQNQNSPPSVLPVLDANNALFITNNEKSIISFDQTHHGLYSPQVMDDVVSQIGASSRIINNNNNNNPMLSLSQEGSSSISDSSSIAMNNNNVSHPEQQHASDESMEMLMDFGFGFPFDFANGPNCHYERVGEFATSSYPEWVDFSYADIKPH

SEQ ID NO: 223129 - protein, 167 aa, Glycine max
  Coding DNA Sequence Number=SeqID_106351
  Gene Ontology: Mol. function=metalloendopeptidase activity; Cellular component=cytosol; Biological process=proteolysis
  Homolog annotation: Hit_ID=Q0WVU4; Match level="QueryCoverage=80%, HitCoverage=14%, E-value=3e-54, Identity=72%"; Hit description =Putative zinc protease
MVTKEYQNLKYQQPYQQAMYYCSLILQDQTWPWIEQLDILPALQVEDLAKFVPAMLSRTFLEFYIAGNIESHEAQSIVKHIEDVLFNFSKPLCKPLFSSQHLENRVVKLESGMNYFYPSECLNPEDENSALVHYIQICVAPQTGMHQSIKISFWTGKANCYIMPVST

SEQ ID NO: 223130 - protein, 36 aa, Glycine max
  Coding DNA Sequence Number=SeqID_106352
ALLISCNVKRDKEAAGSGKGVKVKAINHHYAKPTTE

SEQ ID NO: 223131 - protein, 362 aa, Glycine max
  Coding DNA Sequence Number=SeqID_106353
  Homolog annotation: Hit_ID=Q9FJJ1; Match level="QueryCoverage=62%, HitCoverage=47%, E-value=4e-34, Identity=43%"; Hit description =Arabidopsis thaliana genomic DNA, chromosome 5, TAC clone:K19B1
  Subcellular localization annotation: CTP_CleavageSite=59; ConfidenceScore=5.08e-01
MEEPVMEQQPSAAASSGNTTRLRLQKYALRSVNKSKEDKSETPNCSNPTSETKRGRSVGASSVSKSVSVLDFSGKDKSGSAKPPRRLSIPAKTPATSRPKLGGNIIPITETTTGRNAFGQGRSKTPISDISKTSTRTKLNLLTSASYWLNQIKLSESAAKHSISLGFFKLALEAGCEPLGPMQEGLKSYVGRYQLDGLEETVIALFESYNISESMEQLQVSETISHVPEEGTRSSDDDVHSSSSTVGTRKLKPKCLNTDSAQLTPSTESTKKETSQKSNPGSRLRGNLSTNTTTPGPALDNRNNRLVKKSEKPSKQEPNKEKGMSNNYMIFFLLTVTASTPKGDKENMETPTTEENSVTEVV

SEQ ID NO: 223132 - protein, 48 aa, Glycine max
  Coding DNA Sequence Number=SeqID_106354
MKKSTSFEDDVINDALAFFIQDQGEAFKYECAWHEVRNQAKWLAMYGE

SEQ ID NO: 223133 - protein, 138 aa, Glycine max
  Coding DNA Sequence Number=SeqID_106355
  Homolog annotation: Hit_ID=Q9FMX9; Match level="QueryCoverage=42%, HitCoverage=12%, E-value=4e-13, Identity=70%"; Hit description =Serine carboxypeptidase II-like protein
ALGVAKPSVVSYLSQEILAEQKADRVHRIPAQPLVKFNNMVVISLSMKLKEEHCSIGFSRPLTNQNKNPFSYGSMENHKPEGQEAVAGLTQPNNAKPIADSSFSKAKPEDSMDSQFKPPEASQLVFVFTILFMFGCSN

SEQ ID NO: 223134 - protein, 71 aa, Glycine max
  Coding DNA Sequence Number=SeqID_106356
MGVLKRLEGQKLRELREERKNKKKEEEMKPRCYRIATAIIPYVIFWFCILRATVGVPLVIMCTLIFSIYHR

SEQ ID NO: 223135 - protein, 143 aa, Glycine max
  Coding DNA Sequence Number=SeqID_106357
MTVATLFGKLREYEFELGRLKDEEEVEKMKKGLILKTSTSHHKASDKDLSKNSDSENLNFLQGHIKANCPTYLKKQQGGNKKQKKPFKRRRTYIGWGDDGASSSSDSSEEEEANLCLMADIDKDETKSNISEYLNLIQTMTIY

SEQ ID NO: 223136 - protein, 125 aa, Glycine max
  Coding DNA Sequence Number=SeqID_106358
MTKLRVTITKTLYQASDEHKESMGCLTLDKLFVMSGGLALRKWMMDRDTLGYSGRRGLTLPILMGFETMLFELGDEGLVYNVSVIENQGDHSYMLSKEMEEYQELLKQLELTSEEESDDSSEDTS

SEQ ID NO: 223137 - protein, 156 aa, Glycine max
  Coding DNA Sequence Number=SeqID_106359
MCHTFPLSLKSIVLKWFQSLPPRSIDLWLDLREKFRPAFATNKERLKMKTDIYGRDSKSHRENTFIVQQGSKSYRYLRDRGGNYRTRYDRSNYDEQKERTRSVDRYQRRESYRECSLRYKHKNLARETENHVQTIHQGNSNTRDKLESSETRNNSP

SEQ ID NO: 223138 - protein, 96 aa, Glycine max
  Coding DNA Sequence Number=SeqID_106360
MTGLSLLSLTIGSWYCVVGGILEVVSNPWRFILVKWFCDVDLVSPIGIDRVLIEKDLLVDLYSDLEASILDEKEFLLLKMSYRMSRHHASEHADYI

SEQ ID NO: 223139 - protein, 64 aa, Glycine max
  Coding DNA Sequence Number=SeqID_106361
MSLVQPYNPGNGNFDQQHFIGMKDSGIRILCMEDVIMKLRCPKKHLFLVDDALEENARITHEQT

SEQ ID NO: 223140 - protein, 83 aa, Glycine max
  Coding DNA Sequence Number=SeqID_106362
MRIKRSFKVVMGPWTRLVVSFKTRKGKQGSKRLSNELIQGKSIWLEAYENKIASIISKYACELGSINKNQAKAIVQAINELSN

SEQ ID NO: 223141 - protein, 107 aa, Glycine max
  Coding DNA Sequence Number=SeqID_106363
MTKARQKGGTEKRRTNEERLKIFVKSLTETSRKRYRSASAWIFFTETIFLTNFKKKKEKLATPARPGELGCFLQNFPPSGELPGRPKWAWLLFAPPVYEIHPLAYFC

SEQ ID NO: 223142 - protein, 46 aa, Glycine max
  Coding DNA Sequence Number=SeqID_106364
SRLTSFSMAKVTKETMAETHNTTASEPPTPVVENDAVRSGLRKERR

SEQ ID NO: 223143 - protein, 417 aa, Glycine max
  Coding DNA Sequence Number=SeqID_106365
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q22FF0; Match level="QueryCoverage=75%, HitCoverage=66%, E-value=8e-57, Identity=35%"; Hit description=MBOAT family protein
  Pfam annotation: Domain name=MBOAT; Domain location=118-392; Score =146.8; E_value=5.6e-41; Accession=PF03062.9; Description=MBOAT family
MATSVNKIGHWKRKELCRIGHDVLAADPNAHSVLFCEKDVSDAQWRNLRGNIPVLTLVFAIFTLLANFMRAFNLRVKGMSIVWLLFSLAYLSYLHGACIVFILSIATGNFLLVKLSCNSGHFWTITGAALGGTYVSTLMFVTVVLRMISFGFDFHWSNQNSHFDQEKHYQHCHICKSGKSCYQVLQERSLHNDNFGYITYLCYLVYAPLYIAGPILNFNAFASQIDVPQNTNSVRNVTLNGFRWVLNFMWLKFLLIWRFFRFWSLINGIEAPENMPKCINNCHNLEGFWKNWHASFNKWLVRYIYIPLGGSKKKLLNVWVVFTFVAIWHDLEWKLLSWAWLTCLFFIPELVLKSAAKAFQAQSSFGECIFRELSAVAGAVTITCLMGSVYDATSNPVEPIDPVRGLLYNKFDVQFYT

SEQ ID NO: 223144 - protein, 104 aa, Glycine max
  Coding DNA Sequence Number=SeqID_106366
  Gene Ontology: Mol. function=endonuclease activity; Biological process=DNA catabolic process
  Homolog annotation: Hit_ID=Q9ZR88; Match level="QueryCoverage=91%, HitCoverage=29%, E-value=2e-16, Identity=45%"; Hit description =Bifunctional nuclease
MEYYKIQVVAIVSLMLVLPNTQGWGEDGHAIISRIAQVTNYFHSLYEVLCCASKFIDSAVDAVKNLLPEYAQNDLGNVCSWADRVRFYLHWSGPLHFADTPGNL

SEQ ID NO: 223145 - protein, 241 aa, Glycine max
  Coding DNA Sequence Number=SeqID_106367
  Gene Ontology: Mol. function=receptor activity; Cellular component =integral to membrane; Biological process=anti-apoptosis
  Homolog annotation: Hit_ID=Q5F2L4; Match level="QueryCoverage=96%, HitCoverage=94%, E-value=1e-62, Identity=51%"; Hit description =Putative receptor associated protein
  Pfam annotation: Domain name=UPF0005; Domain location=25-241; Score =69.7; E_value=9.6e-18; Accession=PF01027.11; Description =Uncharacterised protein family UPF0005
MGKHDIEAGLPHAQGDALYPYMIESPQLRWGFIRKVYAIISLQLLFTAAFASFFIFFTPARNFARYNQYRIWVFFGAAIFSIILLFVLSKFYKKHPVNLFLLGLYTLCMSVTVGFACSFVDAKIVLEAAFLTGVVTASLTIYTFWAVKRGSDFSFLGPFLFASIMVMLLFALIQVFYPLGPIGRMMIACIGAIVMCGFIVYDTDDLIKRYTYDDYIWAAISIYGDVISLFIYLLTILNELF

SEQ ID NO: 223146 - protein, 70 aa, Glycine max
  Coding DNA Sequence Number=SeqID_106368
MEEEEDVHHLFYACQVTASIWRQVIAWVGVNLVMPQTFGQLFKQFGGLLPGRKSRRVKHILWHATCCFWG

SEQ ID NO: 223147 - protein, 474 aa, Glycine max
  Coding DNA Sequence Number=SeqID_106369
  Gene Ontology: Mol. function=glutamine-tRNA ligase activity; Cellular component=soluble fraction; Biological process=tRNA aminoacylation for protein translation
  Homolog annotation: Hit_ID=P52780; Match level="QueryCoverage=98%, HitCoverage=61%, E-value=0.0, Identity=82%"; Hit description =Glutaminyl-tRNA synthetase
  Pfam annotation: Domain name=tRNA-synt_1c; Domain location=4-256; Score=296.1; E_value=6.4e-86; Accession=PF00749.11; Description=tRNA synthetases class I (E and Q), catalytic domain
  Pfam annotation: Domain name=tRNA-synt_1c_C; Domain location=258-449; Score=288.5; E_value=1.3e-83; Accession=PF03950.8; Description=tRNA synthetases class I (E and Q), anti-codon binding domain
  Pfam module annotation: Pfam domain module=tRNA-synt_1c::tRNA-synt_1c_ C; Domain location=4-256::258-449
MACGTSRYDDTNPEAEKKEYIDHIEEIVQWMGWKPFKITYTSDYFQELYELAVELIKKGHAYVDHQTPDEIKEHREKKLNSPWRDRPISESLKLFEDMKNGSIEEGKATLRMKQDMQSDNYNIEYHTFCKLSFTQFPPGVDTIFLLLCTLEFETRRASYYWLLHALSIYQPYVWEYSRLNVSNTVMSKRKLNRLVTEKWVDGWDDPRLMTLAGLRRRGMTPTAINAFVRGIGITRSDGTLISVERLEYHVREELNKTASRAMVVLHPLKVVITNLEANSVIEVDAKKWPDAQADDASAFYKISFSNVVYIEHSDFRMQDSKDYYGLAPGKSVILRYAFPIKCTEVILADDNETILEIRAEYDPSKKTKPKGVLHWVAQPSPGVDPLKVEVRLFERLFLLENPAELDNWLGDLNPNSKVIIPNAYGVSSIQNAKVGDNFQFERLGYFVVDQDSTSEKLVFNRTVTLKDSYSKGGK

SEQ ID NO: 223148 - protein, 101 aa, Glycine max
  Coding DNA Sequence Number=SeqID_106370
MTLRQHESNDLHLDFCVFFSNQYFIEEAKEHHLDEDALIPHDVAPCKACMMQAPLELVGLGSSSSMDSFASWKINGSGMEKKEREETSLQGEDESRRSSPP

SEQ ID NO: 223149 - protein, 238 aa, Glycine max
  Coding DNA Sequence Number=SeqID_106371
  Gene Ontology: Mol. function=helicase activity; Biological process =protein amino acid phosphorylation
  Homolog annotation: Hit_ID=Q1SN45; Match level="QueryCoverage=99%, HitCoverage=14%, E-value=2e-46, Identity=43%"; Hit description=AAA ATPase
MADDIVFNHRRQGIQLTDKEKMHLCLTEIENLLQANRKILRDFPSMSYPLGYAANPHQNNLIYNELAYDRDILATEFDKCYQSLTDEQASIFNKIMHVVATQSGGVYFLYGYGGTGKTFVWKTLSSAILSTGGIVLTVASSGIASILLSGGRTTHSKFAILVPATQNSTRNIHQGSDLAELLHITKLIIWDEAPMCHRYSIEALDKSLQDIMHNGNPFGGKVIVFGGDFHQILPVVPR

SEQ ID NO: 223150 - protein, 73 aa, Glycine max
  Coding DNA Sequence Number=SeqID_106372
  Gene Ontology: Mol. function=DNA binding; Biological process=DNA integration
  Homolog annotation: Hit_ID=Q8FC53; Match level="QueryCoverage=86%, HitCoverage=28%, E-value=9e-23, Identity=89%"; Hit description =Transposase insF for insertion sequence IS3A/B/C/D/E/fA
MSRRGNCHDNAVAESFFQLLKRERIKKKIYGTREEARISVGMARAIRCHQLNTKTNIINGSKVSRLSVAIQHY

SEQ ID NO: 223151 - protein, 111 aa, Glycine max
  Coding DNA Sequence Number=SeqID_106373
  Subcellular localization annotation: CTP_CleavageSite=73; ConfidenceScore=5.19e-01
MKPNSKIESGGHMNENPVPGTPKKSGEWRIALRVRSSLTIPSTSRGGPVPAFVPFNEVGKPVMPAALMNRPTRGERRFAYWALAECILAYYVGTDEGVSEVLHVAREKKLH

SEQ ID NO: 223152 - protein, 121 aa, Glycine max
  Coding DNA Sequence Number=SeqID_106374
  Gene Ontology: Mol. function=protein-tyrosine kinase activity; Cellular component=integral to membrane; Biological process=protein amino acid phosphorylation
  Homolog annotation: Hit_ID=Q6R2K3; Match level="QueryCoverage=70%, HitCoverage=11%, E-value=4e-25, Identity=66%"; Hit description =Strubbelig receptor family 3
  Pfam annotation: Domain name=LRRNT_2; Domain location=50-90; Score =27.9; E_value=3.7e-05; Accession=PF08263.3; Description=Leucine rich repeat N-terminal domain
MGCAFFLLDASVIEFTERSGLEWKRVKIYEQLLLVYLLICTIQTSSAATDPTDVAAINSLYIALGSPVLPGWVASGGDPCGEGWQGILCNGSFIQKIVLNGANLGGELGDKLSTFVSISVM

SEQ ID NO: 223153 - protein, 89 aa, Glycine max
  Coding DNA Sequence Number=SeqID_106375
MAKGAEFVYARLPLDSLLLNDKGHKICLCAFITQFAKSEWQRAQNSSMCVYHSSSVRITASHRARRLWMKKGTEDDVSLYVLSCFESYR

SEQ ID NO: 223154 - protein, 74 aa, Glycine max
  Coding DNA Sequence Number=SeqID_106376
MRVVYVVSLHFKTCNAGVHFPWKQLLVNRSEIPLMMLQSPSPEELNFLREIYAYKTLTEIAVIQFKMKTNMNRK

SEQ ID NO: 223155 - protein, 295 aa, Glycine max
  Coding DNA Sequence Number=SeqID_106377
  Pfam annotation: Domain name=DUF1639; Domain location=186-235; Score =127.2; E_value=4.6e-35; Accession=PF07797.4; Description=Protein of unknown function (DUF1639)
MAMGPERSKPLHNFMLPCLKWGSQRHLRCTKHPSDSSTEDRRSPAPREFDSPPLTNADTRTRLTRPRFLFGDEGIDAVREKLMLDLKTEADKMKDAILGKEVSEYNNDDVEMNDAPPQPEEEAPPPVSGVRTWNLRTRRAPAAGGKGVRIDERRGGGGSPLRMKSPKLRGSPEKEERRAVKFSLMLAKKEIEEDFMRMVGHRPPRRPKKRPRNVQKQLDTLFPGQWLSEVCADSYKVPDDAETRKITYALGYYFAFDATIISGFIHCSRGGNCSELGFGPTAACKARMQAHPTSK

SEQ ID NO: 223156 - protein, 94 aa, Glycine max
  Coding DNA Sequence Number=SeqID_106378
  Subcellular localization annotation: CTP_CleavageSite=45; ConfidenceScore=5.27e-01
VVVAAQLTQASSARASTRRHRLLLEDPGRPKLRNHPFFGFRNVTNCALTRPFNSRYVAELHGLPNDGCQVPRSGQAGVAPQQTDDPRTKLGYDN

SEQ ID NO: 223157 - protein, 138 aa, Glycine max
  Coding DNA Sequence Number=SeqID_106379
MLLGAPSMSLVVIPKGSRPKTHDGGGRKEEHNWNGSNKRLGKYMYTLKIRVSLEERRIRPHFQLDGCPRGYWKWKKEGGSKRNMGYKWGCHIYRGKVGNMVRKLVSMEERDNRGIEGVKRYHQGRDDEMLFMKMLSLI

SEQ ID NO: 223158 - protein, 50 aa, Glycine max
  Coding DNA Sequence Number=SeqID_106380
MMIWEQRAKLIMATARWVLKHPVYGIVILRTTFLKENSTRFQNSNKHYRQ

SEQ ID NO: 223159 - protein, 590 aa, Glycine max
  Coding DNA Sequence Number=SeqID_106381
  Homolog annotation: Hit_ID=Q2UCQ7; Match level="QueryCoverage=30%, HitCoverage=23%, E-value=8e-13, Identity=30%"; Hit description =Uncharacterized conserved protein
  Pfam annotation: Domain name=NAF1; Domain location=191-366; Score =195.5; E_value=1.3e-55; Accession=PF05492.3; Description=NAF1 domain
MASQHENGSIIDPNPFGVETVMASQHENGSEIDPNPTVVETAMACLHEKGSEIDPNPTGVEAHEAEAEKFGTLGCAVPIEEGLEKITLVGPSLSVEENLVKDDSEIEIESESESENSESESSSSDSGSGSSSNSSSGSSSCSDSEDDDDDKDDDVEVEEGEISDSDEEKMVSWSIVDEDGDEDGDVGGGGGPIRSKNELQNLPPVPPRRCDFGTTPSNGAQLELLCRNIIERVLISVGILIGQTLGAQVIVEGVEKHDPLNEGSILWLTESQKPLGLIDEIFGPVKNPYYVVRYNSESEVPTGINEGTLISFVPEFADHVINNKDLYRKGYDASGADDEELSDEMEFSDDEKEAEYKRMQKQTKRGANDQNHGKKKNNRKKFSPKDVAAPSAPAAPSVPMLHHGNCPPFSSIAQGHLGGTTPLPPLNAAPNFATNGVWTTGTTFPHQQQSPMLPNGFPTNGMPWYPQNPQISPQFPMPGIPFQQQLHPNQGSLPTTMLPGMQLNMFAQSQYAAGLAGQNQIAFGMGSPFPQSQPPIFAAQQGFPSTELCSERNLNFHSNGAPSQFHPRPNANRGRKTFHGAGRKGWRPPK

SEQ ID NO: 223160 - protein, 153 aa, Glycine max
  Coding DNA Sequence Number=SeqID_106382
  Gene Ontology: Mol. function=DNA binding; Cellular component=nucleus; Biological process=regulation of transcription, DNA-dependent
  Homolog annotation: Hit_ID=Q8GZA8; Match level="QueryCoverage=72%, HitCoverage=46%, E-value=4e-46, Identity=72%"; Hit description =Protein ULTRAPETALA1
MYMLCQVVFVPYKLTPSAFEKHSGRETARKWKNNVWVIVNGEKVPLCKTVLLKYYNQVSKAANGSHRSQNGRACHRDEFVRCTSCNKERRFRLRTKEECRIHHDALADANWKCSDLPYDNYQCFNLARSGNNTGTPKWKRDENILKLAFDKFI

SEQ ID NO: 223161 - protein, 78 aa, Glycine max
  Coding DNA Sequence Number=SeqID_106383
  Gene Ontology: Cellular component=integral to membrane; Biological process=protein transport
  Homolog annotation: Hit_ID=Q9M5P1; Match level="QueryCoverage=70%, HitCoverage=22%, E-value=5e-15, Identity=66%"; Hit description =Secretory carrier membrane protein
MSYSASTQTNYGCTLCYVVDRGILAAIDVLGDNALVGIFYFIGFGPFLSRQVYMYFRGSGKAAVLKREAARGTMMAAL

SEQ ID NO: 223162 - protein, 99 aa, Glycine max
  Coding DNA Sequence Number=SeqID_106384
  Subcellular localization annotation: CTP_CleavageSite=76; ConfidenceScore=5.11e-01
MQQGEPYIPIVGFLDPNYSIKVVNQNKLLSDIVSAPTTPLCVAQRLFSFTFVSPNAKWILRIPLRLRYSSACGGPAASNGGSWWPPVVVGGGGGVSKVV

SEQ ID NO: 223163 - protein, 192 aa, Glycine max
  Coding DNA Sequence Number=SeqID_106385
  Gene Ontology: Cellular component=integral to membrane; Biological process=protein transport
  Homolog annotation: Hit_ID=Q9SKT3; Match level="QueryCoverage=73%, HitCoverage=50%, E-value=3e-52, Identity=68%"; Hit description =Putative secretory carrier-associated membrane protein
  Pfam annotation: Domain name=SCAMP; Domain location=104-192; Score =92.1; E_value=1.6e-24; Accession=PF04144.4; Description=SCAMP family
MARCLPLLSAEKLWVAEKSEGNCLSAAYCLFNNTGSVPSSNSRLSPLPPEPYDRGATIDIPLNNAKDAKAKEKELQAKEAELKRREQELKRREDAIARAGIVIEEKNWPPFFPIIHHDIAKEIPVHLQRIQYIAFTTWLGLVLCLLWNIVAVTTAWIKGEGPTIWFLAIIYFISGAPGSYVLWYRPLYRAMR

SEQ ID NO: 223164 - protein, 44 aa, Glycine max
  Coding DNA Sequence Number=SeqID_106386
MKTNREGINLDRFFVEGIGIVATHGIGEKALESTASSLSYSVCF

SEQ ID NO: 223165 - protein, 214 aa, Glycine max
  Coding DNA Sequence Number=SeqID_106387
  Homolog annotation: Hit_ID=Q2HRX8; Match level="QueryCoverage=48%, HitCoverage=15%, E-value=2e-08, Identity=45%"; Hit description=IMP dehydrogenase/GMP reductase
MVRTRGLGRALARVIGRGRQDEHDAVDVTWRRRPTASVRRQRVHIAVDEGVSQVTEDVPHMAKDVPQMTEDVPHMADDVPQMSEDAPQMTADVDATVAEDLGRNGAKGSHADEGFPGGPRDPSVLTSFAEHVADAIWTGQERPELKLVSHGRKVALIGRPVPKIEAGCRHKIKSIDRVLSCNRRSWTYIRICGEEAQRDQHLPPSSRRVDDHTR

SEQ ID NO: 223166 - protein, 201 aa, Glycine max
  Coding DNA Sequence Number=SeqID_106388
  Homolog annotation: Hit_ID=Q651V0; Match level="QueryCoverage=42%, HitCoverage=11%, E-value=2e-23, Identity=60%"; Hit description =Putative leucine-rich repeat transmembrane protein kinase 1
  Pfam annotation: Domain name=LRR_1; Domain location=24-46; Score =10.5; E_value=3.1; Accession=PF00560.23; Description=Leucine Rich Repeat
  Pfam annotation: Domain name=LRR_1; Domain location=48-70; Score =14.9; E_value=0.3; Accession=PF00560.23; Description=Leucine Rich Repeat
  Pfam annotation: Domain name=LRR_1; Domain location=72-91; Score =10.1; E_value=3.7; Accession=PF00560.23; Description=Leucine Rich Repeat
  Pfam module annotation: Pfam domain module=LRR_1::LRR_1::LRR_1; Domain location=24-46::48-70::72-91
  Subcellular localization annotation: CTP_CleavageSite=55; ConfidenceScore=5.35e-01
MYFGVSDLSSNNIGGNIPSSLPVTLRNFFLAANQFTGSIPASLSTLTGLTDIDLSQNNLSGKLPPSMDNLLALTTLNVENNQFAGPIPPKLLSIPAFRQAGNPFNVSGSTTTPASSPRSPAIAPPGTPVSGTPPSSGRVPTKQADGPTAANESHTGKSKKSTKRVDLFSLFQGVAEENGMTEDPSDIKLVHMEVKDKVLGI

SEQ ID NO: 223167 - protein, 350 aa, Glycine max
  Coding DNA Sequence Number=SeqID_106389
  Homolog annotation: Hit_ID=Q10K64; Match level="QueryCoverage=96%, HitCoverage=92%, E-value=1e-113, Identity=57%"; Hit description =Nodulation protein, putative, expressed
  Subcellular localization annotation: CTP_CleavageSite=20; ConfidenceScore=5.00e-01
MAVVLKDMCFFNNKDILVIKPQKKSPLLLRMSVLIFSMVCGVFICSVCLKQISTHARTMLMELQIEKPSRSSSSRLNLKNDVPLLHYPKPVSFNRSECAGNPVRFFAILSNQRSGSGWFETLLNSHINVSSNGEIFSVRERRVNVSTIVQTLDKVYNLDWLSSASKNECSAAIGFKWMLNQGLMEHPKEIADYFNSRSVSVIFLFRRNLLRRMVSMLANSYDRYAKLLSGTHKSHVHSTEEADTLSKYKPTINSTSLLADLKDIEMRTAKVLEYFNTTRHMILYYEDLMRNCTKLKDVQEFLGLPQMELTSRQVKIHRGPLSDHIKNWDDVNRTLTGTVYESFLHADYSS

SEQ ID NO: 223168 - protein, 55 aa, Glycine max
  Coding DNA Sequence Number=SeqID_106390
MDNNPLELLDIDNLDLPSFIRPTNQSSSNSTRLIPSPIGVLQAAMMNRQSRIGKC

SEQ ID NO: 223169 - protein, 110 aa, Glycine max
  Coding DNA Sequence Number=SeqID_106391
MELPETHQYQFLPLFHLLDHPHYFPPMISVRETFDCYQVFQNSALVDFMSLKLPYFPELVKVFYNNLKIQDDVLYSKVHNIPIVVDQSLVYSLTKLPSQGVPFEGNLVDD

SEQ ID NO: 223170 - protein, 79 aa, Glycine max
  Coding DNA Sequence Number=SeqID_106392
MALGVMAARPDKLLLHPEASQRLAWVSQGSEKSLEWPFCPPLWVFFIFLIKTSNDHLFRTITGLQRHKLTSKDQKITKG

SEQ ID NO: 223171 - protein, 291 aa, Glycine max
  Coding DNA Sequence Number=SeqID_106393
MTSKLAIAADKDNVRDTDRKKAQAIQKQNTTPHVLPCGGYEYLENKLMEEKKKKQLEEAAQSGSTGTMIDPPSLINRHVKWKMARTKKTGQMMSEVAKEIAHKIDSLEEQASQGSFQYFGPAPRTSRTSSSMAPEDLEQLKQKIRDQLEESITEKVTQQLMFSFSQIQSQFQSQMQSQGIALPPEHKIGPSAAHVNTKESYIDPSGNDPDMGDSDKWSRGTGETTDRPDHDVDDLQYLLTLTIPHLFLKPFQVMWDAIVFRVFNKNFPLYIKHEDLSEIAHGGQCLNISII

SEQ ID NO: 223172 - protein, 286 aa, Glycine max
  Coding DNA Sequence Number=SeqID_106394
  Homolog annotation: Hit_ID=Q849X5; Match level="QueryCoverage=57%, HitCoverage=44%, E-value=1e-50, Identity=62%"; Hit description=HlyF
  Pfam annotation: Domain name=NAD_binding_4; Domain location=113-286; Score=7.7; E_value=3.8e-09; Accession=PF07993.2; Description=Male sterility protein
MLLKQIGQRREIVNTGLAAGNHDVTGGPSLTANDRQQIVAGRRAPLIALFGATNRASLQTNKNGRHAGKVTLALQGLEHLVNRVLHSHLCSGGKKMYLRADKDVTKNVFDDRVTGFLGGAVLENILNNENGINLLLLVRANNDEAALARVKENLRKFNIAEEKLAALTPRQILLGDLSSPETFLSDPRLEQVTHVINSAAVASFGNNPLIWKVNVEGTFKFAQRMSRVAGLQRFLHVGTAMSCTPEPDSLVAESAEFREHAEHLVEYTHSKSTIERLMQCNVRRYR

SEQ ID NO: 223173 - protein, 88 aa, Glycine max
  Coding DNA Sequence Number=SeqID_106395
MDDSTSLLTEVLTKLHDLRAFVGERFDAMDTCFDRMDTRITRLKDDMSFIRRCFDPQVFFGFLMLPKGERTRVEFIMNLGINSNLKGE

SEQ ID NO: 223174 - protein, 68 aa, Glycine max
  Coding DNA Sequence Number=SeqID_106396
MQNSQRDVYLGAYLNSAHWQMVVILPEDNVVIWLCSLHNWPNNYLKGIINRDSVTVKEVNPWMLLDGS

SEQ ID NO: 223175 - protein, 75 aa, Glycine max
  Coding DNA Sequence Number=SeqID_106397
MKKDTYQLEKIPLFFKRILDRFDGLQTYVGERFDALELQVAMRFNVMDSRITKVEGDVTYIRTCFDLPPLPPPSS

SEQ ID NO: 223176 - protein, 218 aa, Glycine max
  Coding DNA Sequence Number=SeqID_106398
  Homolog annotation: Hit_ID=Q338W3; Match level="QueryCoverage=71%, HitCoverage=23%, E-value=5e-43, Identity=53%"; Hit description =Expressed protein
MESTPVNWEALDALLIDFAKSENLIEDSSAPSSSPSPSPSPSSSSYHSRLVIRQIRRAVETGAIDAAVALLRLHAPSILTDHKILFRLHKQKFIELLRKGTAEDRDSAIECLRTALAPCALDAYPVGFVFKEAYEEFKHVLLAFIYDKDDKNSPVANESLCLGNTTIESDCMEKHGLLFIPVFHAKQVLESWEATMTRLLACNVRVDLQVKFEFRMRK

SEQ ID NO: 223177 - protein, 86 aa, Glycine max
  Coding DNA Sequence Number=SeqID_106399
  Subcellular localization annotation: CTP_CleavageSite=35; ConfidenceScore=5.24e-01
MGVKKAGQKRCPSNGRSGVSMVGTTGLIVNNLRVGANMRSKKWRKQQKRNHTREVQAGELIWVFWNVMAGSVDLLVNHLHAGAKMS

SEQ ID NO: 223178 - protein, 621 aa, Glycine max
  Coding DNA Sequence Number=SeqID_106400
  Homolog annotation: Hit_ID=Q338W3; Match level="QueryCoverage=99%, HitCoverage=74%, E-value=1e-116, Identity=41%"; Hit description =Expressed protein
MGEWSEHRRLDLAGFMSSMLRAHLNAYDPIFSMALRYLISIHRVYCLRQGITSPISDLTERLLLEERDPPATPQDILYEVPPFDEIFSYPALSLFLTLFCLVSSLISFPLPNFALDPHFRLPHNQVDIQALAHAVELTRQGAIDSLRFTKGDVFLAFQPILTTVGLTSAPPMAVHLHLAGQRKEMTRFTTLMDLTLNDSNELCRMRLDAPLLDQLVREYCVYRGIVDSASGKQPIPETVKFNPQDPGYCSSRDCSLELDCNASKHSDGETSVTNAQMDGSPENNTDVTSMRRIDFEVRYASELASIHEDCSTSGSQQHEDASVLQRSRLPGNGERSKRKRWRGRYDDNSYMPNASLEENSKQEHSISTIVSTISKEKQGSEKLSVHDISNVEDRYEILLGMKELASKGMAAEAVEEVEFLKLVSSGDYNTALKVACTHLGPLAACDPALLKPLKETLLALLRPNEDALGNALPLHALAASLQVAVGRRLGVEEPQLMKIMRATLYTHNEWFKLQMCKDRFEGLLRLDSLKEANTPFLAPVSTSKSYADSCTNGSSQATVSSGTRMSEDGSSPTQASSRDVICDEGAILKVMEFLALPRADAIHLLAQYNGNAETVIQQIFP

SEQ ID NO: 223179 - protein, 64 aa, Glycine max
  Coding DNA Sequence Number=SeqID_106401
MMEFNTATVIAASTATEVDLTYPSGLNQVNRPASDMMNGSGMEKKEREEMPLQGEDESRRSSPP

SEQ ID NO: 223180 - protein, 189 aa, Glycine max
  Coding DNA Sequence Number=SeqID_106402
  Gene Ontology: Mol. function=DNA binding; Biological process=DNA integration
MEKGYTQLENKNSLPQNEKETLLKMRKDQQALTFIYQGLDEGIFEMVFNVSTSKEAWEILLTSLEDVDKVKKVCLQTLGGKFKSLDMKQFESILDFGNRVIMIVKQMKRYQENMEEAHVVEKVLRSLIAKFDFVICVIEKSKDIESMTVDRLLGSLQAYEERFKRRNDEPLEKVLKAKASLKVKGRDNT

SEQ ID NO: 223181 - protein, 122 aa, Glycine max
  Coding DNA Sequence Number=SeqID_106403
MVATRKILQYFFGREVRRLLVGIVVSKSFMSFNRQISPFGVLLKSIFSYGVVLKDISAGGTFARKVHAWPKQIASGTGKFAVGEGLAIVNGDMHMQGEELATGNGDIHSKGNRQFDWLVPTT

SEQ ID NO: 223182 - protein, 69 aa, Glycine max
  Coding DNA Sequence Number=SeqID_106404
MKQNVAYLDNADARRENTTLKFPGLLNTNGGVVTERNTDEEDDDNTLGGNKCDADDDDDGSIFFETSLD

SEQ ID NO: 223183 - protein, 40 aa, Glycine max
  Coding DNA Sequence Number=SeqID_106405
EVCYGIVERLECHLSLGVVMSGSSTHEVIEECLRMDRSVT

SEQ ID NO: 223184 - protein, 294 aa, Glycine max
  Coding DNA Sequence Number=SeqID_106406
  Gene Ontology: Mol. function=diacylglycerol kinase activity; Cellular component=nucleus; Biological process=protein kinase C activation
  Homolog annotation: Hit_ID=Q9FVC9; Match level="QueryCoverage=87%, HitCoverage=51%, E-value=1e-105, Identity=68%"; Hit description =Diacylglycerol kinase variant B
  Pfam annotation: Domain name=DAGK_cat; Domain location=55-198; Score =96.5; E_value=7.9e-26; Accession=PF00781.14; Description =Diacylglycerol kinase catalytic domain
MVARDCKGFRFLVRSWEIAMGDGNYDRTLREFCIPDYILVPGSEVRSVSHVPACPVIVFINTKSGGQLGGELLVSYSTLLNRNQVFELGKNAPDKVLQKLYATLETLKHNGDNFAAEIQNRLRIIVAGGDGTASWLLGVVSDLKLPQPPPIATVPLGTGNNLPFAFGWGKKNPTTDLQSVETFLNHVKAAKEMKIDSWHIIMRMKAPKEGSCDPIAPLELPHAMHTFNRVSSTDKLNLKGYHTYRGGFWNYFSMGMDAQVSYAFHSERKLHPEKFKNQLYNQSSLNLLDILHSR

SEQ ID NO: 223185 - protein, 134 aa, Glycine max
  Coding DNA Sequence Number=SeqID_106407
  Gene Ontology: Mol. function=diacylglycerol kinase activity; Biological process=protein kinase C activation
  Homolog annotation: Hit_ID=Q9FVC9; Match level="QueryCoverage=97%, HitCoverage=27%, E-value=8e-37, Identity=60%"; Hit description =Diacylglycerol kinase variant B
RDLTLPYVDDGLFEVVGFRDAWHGLVLLAPKGHGTRLAQGAADCTFMRIDGEPWKQPLPKDDDAVVVEISHHDQVSMLATPLCRSKSIYDPSSPSDDREEDDSSEEEPSEDWEERRKFGAAETFKYPDGIDIAQ

SEQ ID NO: 223186 - protein, 148 aa, Glycine max
  Coding DNA Sequence Number=SeqID_106408
GDQSGSQCFARIFQPYEINIGLKEHSNRVTPKAYTPKSPSGPLPPDSVIPPTVPIEFPNAKETEKRLKPPLVLSSCDSFFSHHEYYLKNPNGGTKNKRLQREGFSSKLRHNIKIPNGDNALNWVSNVVFKFHNDLTVNEPEIVIFLRQ

SEQ ID NO: 223187 - protein, 264 aa, Glycine max
  Coding DNA Sequence Number=SeqID_106409
  Gene Ontology: Mol. function=chromatin binding; Cellular component =chromatin; Biological process=chromatin assembly or disassembly
MGYDYEVCYKKGKENTVANALSRVQGYELMVIAVSSISSELMAEIQGSRKMRPHLFELIPQLQQGLKPKSPYIWIEGQLTRKGRIVGMENQVRRFVQQCDICQRFKYDNVATPGLVQPIPIPSQAWSQAYLKLQPYRQNSLADRQSRKLSARYFGPYQIIDKIGVAAYKLKLLPGAQIHLVFHVSQLKKKVGVGDHLGTQLPIPWVSTSLQPLAILDRKMVKRGNRVVTMVLIFNLEDKVVFEGDSVISVIQFVISVIKLFEGC

SEQ ID NO: 223188 - protein, 174 aa, Glycine max
  Coding DNA Sequence Number=SeqID_106410
  Gene Ontology: Mol. function=nucleic acid binding; Biological process= DNA integration
MLGRYQRNPGIEHWKTAKKVLRYLQGMKDHMLTYRRFGHLEVFEYSDSNFAGYMDTRKSTLGYVFLLAGGAISWKIIFFSKINKYSKGAKHMELKYQWWLCGDNGDRKDGGGGSIDANGVGGSIDANCVGGSKGGISGSNDSSDNSDNDSGDDNNIDVGGAEIIVGDAGNNTPS

SEQ ID NO: 223189 - protein, 136 aa, Glycine max
  Coding DNA Sequence Number=SeqID_106411
  Homolog annotation: Hit_ID=Q9LI88; Match level="QueryCoverage=32%, HitCoverage=24%, E-value=3e-11, Identity=71%"; Hit description =Arabidopsis thaliana genomic DNA, chromosome 3, P1 clone:MYF5
MPALITSLRNLPRSFSSDSSSATTTCTLYGDRKKSVLEYAMDGHITEDNSEEEAQEGEGGGLYWAIRGLVGLNCGGEGGGGGFVRKKKERKLLMVDEAAMGESDEDDHGNNVYQLSVIHITVGWKGIDIGVYPIGN

SEQ ID NO: 223190 - protein, 49 aa, Glycine max
  Coding DNA Sequence Number=SeqID_106412
MGSNPENSLSPCTGRPMSKTVGQKKQDVSATKREDDEDNWDLPEGDTLY

SEQ ID NO: 223191 - protein, 65 aa, Glycine max
  Coding DNA Sequence Number=SeqID_106413
MVNESGIIVLQRQMDALEKNFQSQILDIQQAIAAKEDKFVKLQQAMQEKVKESCGESSEKEDKYI

SEQ ID NO: 223192 - protein, 73 aa, Glycine max
  Coding DNA Sequence Number=SeqID_106414
MLFEIQLLTLSTLGFARKYSWREKNELREDSTSGGFNLFSVSDVWEFYRCSRRNNWRNPRKQLEMLLSLAEDT

SEQ ID NO: 223193 - protein, 112 aa, Glycine max
  Coding DNA Sequence Number=SeqID_106415
  Gene Ontology: Mol. function=DNA binding; Cellular component=nucleus; Biological process=regulation of transcription, DNA-dependent
  Homolog annotation: Hit_ID=Q9FGV1; Match level="QueryCoverage=65%, HitCoverage=8%, E-value=3e-32, Identity=85%"; Hit description=Auxin response factor 8
MVEENVGECLCNGLKQIEGSGCVALCKGEKQKKVKLDYMKLSTSGLGQQGHEGGEKKCLNSELWHACTGPLVSLPTAGTHVVYFPQGHNEQVAATTNREIDGHIPNYPSLPP

SEQ ID NO: 223194 - protein, 445 aa, Glycine max
  Coding DNA Sequence Number=SeqID_106416
  Gene Ontology: Mol. function=sequence-specific DNA binding; Cellular component=nucleus; Biological process=regulation of transcription, DNA-dependent
  Homolog annotation: Hit_ID=Q6X7J4; Match level="QueryCoverage=89%, HitCoverage=98%, E-value=3e-51, Identity=76%"; Hit description =WUSCHEL-related homeobox 9
  Pfam annotation: Domain name=Homeobox; Domain location=55-116; Score =56.7; E_value=7.8e-14; Accession=PF00046.19; Description=Homeobox domain
MASSNRHWPSMFKSKPCSPHHQWQHDINASLISTSCHRSPYSSGGGGCEERSPEPKPRWNPKPEQIRILEAIFNSGMVNPPRDEIRKIRAQLQEYGQVGDANVFYWFQNRKSRSKHKLRHLQNSSSKNMNHHHHMNVDQQNHTIPTNSSLPQTTTTAPSSSSSSSSEKSSPKELIIPTTKVFSIGFSDAVPNSPTASVNQTRINDIMLPPPPPVEAFFFPVQQQHDVHHGVTSSSQGFCFSELSNVVHAQQNNVGPCTSLLLSEIVGHGAASAGASKKDKSQMKIMHQPSLLNFCVTTPTTATTSTPTTTTTVVVPPITTTSTTVSSPLMPQLQGIGDPGGAARSTVFINDVAFEVAVGPFNVREAFGDDVVLIHASSGQPVLTNQWGLTLHSLQHGAYIGSGKLKNDDDDDECEVLCLVFFFLLFLIYIYVCLLLGYRLLDRGL

SEQ ID NO: 223195 - protein, 1070 aa, Glycine max
  Coding DNA Sequence Number=SeqID_106417
  Gene Ontology: Mol. function=RNA-directed DNA polymerase activity; Cellular component=chromatin; Biological process=chromatin assembly or disassembly
  Pfam annotation: Domain name=RVP_2; Domain location=229-359; Score= -39.3; E_value=0.0012; Accession=PF08284.2; Description=Retroviral aspartyl protease
  Pfam module annotation: Pfam domain module=RVP_2::RVT_1::Retrotrans _gag; Domain location=229-359::480-649::1-85
MEGKALAWFQWMTGNGQFTLWPVFLQALQTRFAPSQYEDPTRALFKLTQKGSEAQYLLDFEDLANRIVGLPPAFLLSCFVSGLTSEIRREVQAHQPLMLVQAASLACLQEEKLLDVHHPPWSRVLLVTIVPPYTPSPSPRTVTLPPPLPPPGRPAPPPLKCLSLKEIASRREGDLYFNYDEKFHRGHHCASRVFLLIAEEDENPDPHIVLNDPPPDPPGQVDSLDLCPTQISFHSLAGQLAPKTLRMLGSLFGHQVMVLVDSGSTHNFIQQELVTHLNLPCRMTSVPLWVMVGNGQHLQCTSLCEEIVIDVQSSKFTVDLHILPIFDANVVLGIQWLKSLGPVLTNYNMLCMQFIHDDRVVELKGDTDDTLNIIIPSQFRRLARSQAPGLYCHISLLSEATTIPQDLHPAIQSILTKFEHLFQQPNCLPPEHDTDHHIHLLPQIAPINVWPYHYSHFQKCEIEAQVDLMLQKGLIQPSTSPFSSLVLLVKKNDGSWQFCVDYRTLNTITIRDCFPIPTIDELLDELGGARCFSKLDLLQGYHQIRMHSEDMSKTTFCTHNGHYKFRVMPFGLCNAPSSFQATMNNIFRPYLHHFIIVFFDDILIYSTCFDDHLHHLELTFQVEYLGHLVSHRGVEPVASKYAASWGWPDFIAVLFAATPRSQLPWFTSPPWRNLLGLRKLRLLLTSSSKLYPRHRSLPKEPPHNFLQKAISSQTAPRLSVCPRTIRHYSSDKEVVAVRAWLSLHHNHRPSKPQGTVDVGDTGARATHGCIWLPKDLVLIPTLLLEYHTTPTDGHMGAVKTTARLMENFECTPSTLGRLVPGFHHRFAAISWQHCNPGGSGQGSFTARLTAWSLTATPCSNGAGSSSGWSGHTTPPGMRSLALPHSKLHSGANPLTFPNILQVHRLWVLFDEMLTNMEETFQAIRKKLLRAQERMKLTANAKRREVSYQPGEWVMLKLRPRRQVSLKGSLAVRGKLAKRFYGPFQVLKRIRPVAYRLKFPEEAQIHPMFHCSLLKAFKGSPDHIQKVDLPMQFVQHQPVITPLALIDYRRSSENAPWEVLVQWDGLSPDET

SEQ ID NO: 223196 - protein, 341 aa, Glycine max
  Coding DNA Sequence Number=SeqID_106418
  Gene Ontology: Mol. function=exonuclease activity; Cellular component= intracellular
  Pfam annotation: Domain name=Exonuc_X-T; Domain location=134-257; Score=-21.1; E_value=0.062; Accession=PF00929.14; Description =Exonuclease
MNLAGNDNLIKKENIVDVCRALKRELKNTQKEEERKCKEEEKAKRVLVDIVKLAQKRGLKGLSDPSKRSHEVLAAFLKTFSKEEELKFFDNIMRHHLNQYMLERLKDKSHDSPEQGWIVINFKNKPKVIKSTEMVVVDCEMVLCEDETEAVVKVCVLEELVKPNKEIADYRTKITGVSSQDLEAVTCSMADIQFISNCCLDDAKAAMDLVLAKIKHGVDKEFPIALVQEHVSKSELAKLLLHKIPNTVNIETLHKILPGDFKIELKLGSVSYEYLNVMRRGLLPSRKGQGASYSAFAIFKSPQEADEAYENVQGSQLKLYITYEAPTPDTTQTRTRGHLKC

SEQ ID NO: 223197 - protein, 449 aa, Glycine max
  Coding DNA Sequence Number=SeqID_106419
  Gene Ontology: Mol. function=protein serine/threonine kinase activity; Cellular component=integral to membrane; Biological process=protein amino acid phosphorylation
  Homolog annotation: Hit_ID=Q8GZ99; Match level="QueryCoverage=82%, HitCoverage=39%, E-value=1e-131, Identity=62%"; Hit description =Putative receptor protein kinase
  Pfam annotation: Domain name=Pkinase; Domain location=127-396; Score =138.7; E_value=1.6e-38; Accession=PF00069.15; Description=Protein kinase domain
  Pfam annotation: Domain name=Pkinase_Tyr; Domain location=127-396; Score=115.3; E_value=1.7e-31; Accession=PF07714.7; Description =Protein tyrosine kinase
  Pfam module annotation: Pfam domain module=Pkinase::Pkinase_Tyr; Domain location=127-396::127-396
MNTFTQLRPLIKHSLVPCSVFETLYVNLSVSYLLSVLEFVLIGEPKGSKSSSHVGVIVGAVVAVVVFVVLAFFAGRYALRQKTRARRSSELNPFANWEQNTNSGTAPQLKGARWFSFDDLRKYSTNFSETNTIGSGGYGKVYQGTLPSGELVAIKRAAKESMQGAVEFKTEIELLSRVHHKNLVGLVGFCFEKGEQMLVYEHIPNGTLMDSLSGKSGIWMDWIRRLKVALGAARGLAYLHELADPPIIHRDIKSSNILLDHHLNAKVADFGLSKLLVDSERGHVTTQVKGTMGYLDPEYYMTQQLTEKSDVYSYGVLMLELATARRPIEQGKYIVREVLRVMDTSKDLYNLHSILDPTIMKATRPKGLEKFVMLAMRCVKEYAAERPTMAEVVKEIESIIELVGLNPNSESATTSETYEEANAGNAQHPYREEDFSYSGIFPSTRVEPQ

SEQ ID NO: 223198 - protein, 218 aa, Glycine max
  Coding DNA Sequence Number=SeqID_106420
  Gene Ontology: Cellular component=1-2nm peptidoglycan-based cell wall; Biological process=amino acid biosynthetic process
  Homolog annotation: Hit_ID=Q5PND3; Match level="QueryCoverage=72%, HitCoverage=62%, E-value=9e-56, Identity=66%"; Hit description =Protein cysZ
MAIAPTMINIRRKSCIIIFSVVPIPCHHGKLYPLTVFAQLHNCPTLFCCFFAQSAPVTDKKPGLETGASARYPPLRHHPAAGKHCAAGRCVYLAVSAPRPVDSTADVARAGLAAVAELSAVAAVGDFDCAGIQLFLLHHRQLDCRAVLRPAGGAAGRASDRKTPAGQWLARHDERHPAHHEARVTEARLLFAARTGPAAALFYPRLWPDRGAGVVVSV

SEQ ID NO: 223199 - protein, 109 aa, Glycine max
  Coding DNA Sequence Number=SeqID_106421
  Homolog annotation: Hit_ID=P77173; Match level="QueryCoverage=78%, HitCoverage=25%, E-value=1e-07, Identity=42%"; Hit description=Cell division protein zipA
MFRDRPLKRMKSRDDETSEDDDFDDDVEGVREVRVHRVNHAPNGAYGEQESPRQAPQHQYQPPYERQVQQPVRQDEPVHHAPSYAPRPQQPVAPLPACPVAASCCPCSA

SEQ ID NO: 223200 - protein, 57 aa, Glycine max
  Coding DNA Sequence Number=SeqID_106422
  Homolog annotation: Hit_ID=P77173; Match level="QueryCoverage=93%, HitCoverage=16%, E-value=2e-07, Identity=52%"; Hit description=Cell division protein zipA
AAEQQAAAGAARTTAHDEPARPDAQAAAPDAHKEADTGVAAPDEVILAPHMRRSGRD

SEQ ID NO: 223201 - protein, 160 aa, Glycine max
  Coding DNA Sequence Number=SeqID_106423
  Gene Ontology: Mol. function=sugar porter activity; Biological process=phosphoenolpyruvate-dependent sugar phosphotransferase system
  Homolog annotation: Hit_ID=Q2NS98; Match level="QueryCoverage=45%, HitCoverage=12%, E-value=1e-27, Identity=86%"; Hit description=PEP -protein phosphotransferase enzyme I
  Pfam annotation: Domain name=PEP-utilisers_N; Domain location=65-160; Score=91.6; E_value=2.5e-24; Accession=PF05524.3; Description=PEP -utilising enzyme, N-terminal
  Pfam annotation: Domain name=PTS-HPr; Domain location=1-84; Score =126.7; E_value=6.4e-35; Accession=PF00381.10; Description=PTS HPr component phosphorylation site
  Pfam module annotation: Pfam domain module=PEP-utilisers_N::PTS-HPr; Domain location=65-160::1-84
  Subcellular localization annotation: CTP_CleavageSite=69; ConfidenceScore=5.13e-01
MFQQEVTITAPNGLHTRPAAQFVKEAKAFQSEITVTSNGKSASAKSLFKLQTLGLTQGTVVTLSAEGILASPGIAFGKALLLKEDEIVISRKKITDDQVEQEVQRFLDGRSKAAGQLEAIRVKAGETFGEEKAAIFEGHIMLLEDEELEQEIIDLIKKDH

SEQ ID NO: 223202 - protein, 364 aa, Glycine max
  Coding DNA Sequence Number=SeqID_106424
  Gene Ontology: Mol. function=protein serine/threonine kinase activity; Cellular component=integral to membrane; Biological process=protein amino acid phosphorylation
  Homolog annotation: Hit_ID=Q1SW54; Match level="QueryCoverage=81%, HitCoverage=31%, E-value=2e-87, Identity=53%"; Hit description =Protein kinase
  Pfam annotation: Domain name=LRRNT_2; Domain location=25-62; Score =18.2; E_value=0.011; Accession=PF08263.3; Description=Leucine rich repeat N-terminal domain
  Pfam annotation: Domain name=LRR_1; Domain location=114-136; Score =13.7; E_value=0.67; Accession=PF00560.23; Description=Leucine Rich Repeat
  Pfam annotation: Domain name=LRR_1; Domain location=138-160; Score =13.3; E_value=0.86; Accession=PF00560.23; Description=Leucine Rich Repeat
  Pfam annotation: Domain name=LRR_1; Domain location=162-185; Score =8.0; E_value=9.3; Accession=PF00560.23; Description=Leucine Rich Repeat
  Pfam annotation: Domain name=LRR_1; Domain location=193-215; Score =6.5; E_value=17; Accession=PF00560.23; Description=Leucine Rich Repeat
  Pfam annotation: Domain name=LRR_1; Domain location=218-240; Score =11.3; E_value=2.1; Accession=PF00560.23; Description=Leucine Rich Repeat
  Pfam annotation: Domain name=LRR_1; Domain location=242-264; Score =7.4; E_value=12; Accession=PF00560.23; Description=Leucine Rich Repeat
  Pfam annotation: Domain name=LRR_1; Domain location=266-287; Score =16.6; E_value=0.092; Accession=PF00560.23; Description=Leucine Rich Repeat
  Pfam annotation: Domain name=LRR_1; Domain location=289-312; Score =10.7; E_value=2.8; Accession=PF00560.23; Description=Leucine Rich Repeat
  Pfam annotation: Domain name=LRR_1; Domain location=337-360; Score =8.6; E_value=6.9; Accession=PF00560.23; Description=Leucine Rich Repeat
  Pfam annotation: Domain name=LRR_1; Domain location=65-87; Score=2.4; E_value=1e+02; Accession=PF00560.23; Description=Leucine Rich Repeat
  Pfam annotation: Domain name=LRR_1; Domain location=89-112; Score =15.7; E_value=0.17; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1; Domain location=25-62::114-136::138-160::162-185::193-215::218-240::242 -264::266-287::...
  Pfam module annotation: Domain location=289-312::337-360::65-87::89 -112
MDQQHKVIPLLLLLFQVLLVASQTDSQDYSGLNSLTESWSNKPQNWVGPDPCGSGWDGIRCSNSKITQLRLPGLNLAGQLSSAIQSLSELDTLDLSYNTGLTGTIPQEIGNLKKLKSLSLVGCGFSGPIPDSIGSLKQLTFLALNSNRFSGTIPRSLGNLSNIDWLDLAENQLEGTIPVSDDQGRPGLDLLLKAQHFHMGSNKLTGTIPEELFNSSMHLKHLLFDHNQLEGGIPVSLSTVSTLEVVRFDKNALTGGVPANLSKLGNLSEIYLSHNNLNGFLPDFTGMNSLTYVDLSDNDLNASNIPSWVTTLPGLTTVILGQNLLGGTLNLSGYSNSLQLINLEDNEITELDPQNNLPNFELRW

SEQ ID NO: 223203 - protein, 74 aa, Glycine max
  Coding DNA Sequence Number=SeqID_106425
MGQNTKTSRALKVPKRQREEGIEASILYCLHAILVPPQEVLVPPVTELQCHKRLQIRVPKRSSESDESERFQSY

SEQ ID NO: 223204 - protein, 75 aa, Glycine max
  Coding DNA Sequence Number=SeqID_106426
  Gene Ontology: Mol. function=N-acetyltransferase activity; Biological process=metabolic process
  Homolog annotation: Hit_ID=O64815; Match level="QueryCoverage=97%, HitCoverage=19%, E-value=6e-21, Identity=63%"; Hit description =Similar to hookless1
MIRALCGFSHNLAKDRSYEVVATEVLSQEPLRCVISCEEDLLCIKRLGEDYNDGSLGDWTKMLPGFSIFVDPREV

SEQ ID NO: 223205 - protein, 742 aa, Glycine max
  Coding DNA Sequence Number=SeqID_106427
  Homolog annotation: Hit_ID=Q57LR7; Match level="QueryCoverage=37%, HitCoverage=79%, E-value=1e-116, Identity=73%"; Hit description =Cysteine synthase B
  Pfam annotation: Domain name=PALP; Domain location=174-450; Score =331.3; E_value=1.6e-96; Accession=PF00291.15; Description=Pyridoxal -phosphate dependent enzyme
  Pfam annotation: Domain name=Response_reg; Domain location=483-594; Score=116.3; E_value=8.8e-32; Accession=PF00072.14; Description =Response regulator receiver domain
  Pfam annotation: Domain name=Trans_reg_C; Domain location=631-703; Score=46.6; E_value=8.4e-11; Accession=PF00486.18; Description =Transcriptional regulatory protein, C
  Pfam module annotation: Pfam domain module=PALP::Response_reg::Trans _reg_C; Domain location=174-450::483-594::631-703
RVALARALAVEPQILLLDEPFGALDAQEEAMEVADSVVVMSQGNIEQVGAPDDVWREPATRFVLEFLGEVNRFDGEVHGSQFHVGAHRWPLGYTPAHQGDVELFLRPWEVDVSRQSSLETPLPVQVLEISPRGHFWQLVVQPVGWQSEPISVVFAGEQTAPIRGERLFVGLQQARIYQGTTPLRPRLTPDNGSEIWLKLEGNNPAGSVKDRAAWSMIHHAELRGEIQPGDTLIEATSGNTGIALAMIAALKGYRLRLLMPENMSQERQDAMRAYGAELVLVTREQGMEGARDLAQAMAQRGEGKVLDQFNNPDNPLGHYLTTGPEIWQQSHGRMTHFVSSMGTTGTISGVGRYLKEFAPAVKVIGLQPQEGSSIPGIRRWPAAYLPGIFRPELVDEVIDMAQQEAEETMRALAQREGIFCGVSSGGAVAGALRIATAQPGSVVVAIVCDRGDRYLSTGDRVKPAAFPRHSGQNSGNFVREKKMKILLVDDDVELGTMLSQYLIAEGFETQLVLTGSAGIEGALSGHYTAMILDIMLPDMSGIDVLRQVRQNSRLPVIMLTAKGDNIDRVIGLEMGADDYVPKPCYPRELVARLRAVLRRFEDQAPVPDKKEVLRWGDLSLNPATRITEWQGKAFDLTASEFNLLDLLLRAPDRVVSKDELSEKGLGRPREAYDRSVDVHISNIRQKLAALTADSVNIETVRSIDPAGLLDCVCDYQPAAVAGLYLVRKPSRAAGDCGGASDR

SEQ ID NO: 223206 - protein, 73 aa, Glycine max
  Coding DNA Sequence Number=SeqID_106428
MGSKIYPKVNENPKAFFISSSPILLEPFAHGSDPRGEGDILTSCIVAIFHLVLLFVVKKASWYGKLNPLLDLP

SEQ ID NO: 223207 - protein, 274 aa, Glycine max
  Coding DNA Sequence Number=SeqID_106429
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=7e-35, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPKSCEFGMIGPLDESISCLLIRLDPWVLVRIAIRGLHVVAFKGLYALASRGLHVLSFRGLHVLAFKGLHALTLRGLHFLTFRGLHVLASRGLHILAFKGSCTFAFGGLHILASRGLHVLAFRGLHVLVFRGPHALAFRGLHVLAFKGSCTFAFRGLHVLAFKGSCTLTFRGLHVLAFRGPHALTFRGLHVLTFRGLRVLAFKESYTFGFRGLHVPLFKGLHSLALRGQHALTFRGLHVLAIIGIHSLAFKRQHVLNFRGLHAPAFRGLRVLTF

SEQ ID NO: 223208 - protein, 57 aa, Glycine max
  Coding DNA Sequence Number=SeqID_106430
MGRGEKRNRRVRREEEQLVSGERNRRRGKKRNRRVGKYDVVKKGFSSSARANVCGGH

SEQ ID NO: 223209 - protein, 62 aa, Glycine max
  Coding DNA Sequence Number=SeqID_106431
METGEQGTGDEGGSDAEGGVGADLPRRFMECFGKRKRHYIGERKKALEITVAIEEIKKEVSI

SEQ ID NO: 223210 - protein, 107 aa, Glycine max
  Coding DNA Sequence Number=SeqID_106432
  Gene Ontology: Mol. function=nucleotidyltransferase activity; Biological process=metabolic process
  Homolog annotation: Hit_ID=Q45NL2; Match level="QueryCoverage=96%, HitCoverage=47%, E-value=1e-23, Identity=53%"; Hit description =Putative UDP-N-acetylglucosamine pyrophosphorylase
MREPSPVGFEGNDVVPPQALLQRLKDYDQEHAFALCLDLSRIDRIIQCSLRSQGLPVVAIEPVPESSVSTVVERSQEDRERWWKMGLKAIFDGKLAVLLLSGGQANL

SEQ ID NO: 223211 - protein, 100 aa, Glycine max
  Coding DNA Sequence Number=SeqID_106433
  Homolog annotation: Hit_ID=Q9LJZ4; Match level="QueryCoverage=93%, HitCoverage=33%, E-value=1e-19, Identity=50%"; Hit description =Genomic DNA, chromosome 3, P1 clone:MAL21
MEVLYRKLYDKYTRLKSNKLSDLDHLNEEQELKFRNFSSAAEELIEHLMTEKEELLGQVHHLRSELASLRAAKDNQVVDYQRLLMEETRKSESIHRFSGY

SEQ ID NO: 223212 - protein, 158 aa, Glycine max
  Coding DNA Sequence Number=SeqID_106434
  Homolog annotation: Hit_ID=Q5JMX3; Match level="QueryCoverage=74%, HitCoverage=74%, E-value=1e-29, Identity=56%"; Hit description =Putative 28 kDa heat-and acid-stable phosphoprotein
MDWIVDVGLIHQADTQRCVAGTSNRPRTFRQKEAEHEEEPEEVSGDESGEESEEETSKKKGTQGVIEIENPNLVKPKSLKARDVDVGKTTELSRREREEIEKQRAHERYMRLQEQGKTEQAKKDLERLALIRQQREDAAKKREEEKAAKEQKKAEARK

SEQ ID NO: 223213 - protein, 525 aa, Glycine max
  Coding DNA Sequence Number=SeqID_106435
  Homolog annotation: Hit_ID=Q6D8U7; Match level="QueryCoverage=26%, HitCoverage=98%, E-value=5e-64, Identity=81%"; Hit description =Putative GNAT-family acetyltransferase
  Pfam annotation: Domain name=Acetyltransf_1; Domain location=46-124; Score=86.7; E_value=7.4e-23; Accession=PF00583.14; Description =Acetyltransferase (GNAT) family
  Pfam annotation: Domain name=DUF1131; Domain location=130-324; Score =223.8; E_value=3.8e-64; Accession=PF06572.2; Description=Protein of unknown function (DUF1131)
  Pfam annotation: Domain name=Dyp_perox; Domain location=328-525; Score=126.3; E_value=8.5e-35; Accession=PF04261.3; Description=Dyp -type peroxidase family
  Pfam annotation: Domain name=FR47; Domain location=43-131; Score=1.7; E_value=0.009; Accession=PF08445.1; Description=FR47-like protein
  Pfam module annotation: Pfam domain module=Acetyltransf _1::DUF1131::Dyp_perox::FR47; Domain location=46-124::130-324::328 -525::43-131
MEIRSFRQEDFEEVITLWERCDLLRPWNDPELDIERKMNHDPELFLVAEVGGEVVGTLMGGYDGHRGSAYYLAVHPDYQGRGFANALMNRLEKKLIARGCPKIHLMVREENDQVVAFYEKLDYEPVDSLLLGKRLIEDRTPVGTKERSLHESCSSRPAGQRPGAGRLRQFRSLTVTEQGVAGLNSNTAMSESAISAALNNDYQLRQGMRTQNGQVVDFWQALDDGKVKLVINGQRSVERIEVLDSDARSADGSKIGDAFSDKFSKAFDNCKMVAGLDVRDVECRAPGSQHIAYIYSGEWHGPTGLMPSDDTLKSWKISKISIVMSQFQSGILLEHRRFAIWLEARATGDLAALRQGCHAFLQQLAALQQQFPDAGLGAVIAFGDALWRDLQGTDSAPELKAFTPLGKGAAPATQRDLLIHIQSLRHDVNFSLAQAALTAFAGAVAIEEETHGFRWVEDRDLSGFVDGTENPQGEARQQVAIIADGPDAGGSYVFTQRWEHNLPQFNRLAIDKQEAIIGRTKQDNE

SEQ ID NO: 223214 - protein, 460 aa, Glycine max
  Coding DNA Sequence Number=SeqID_106436
MTHGVCCDEEIVNMFEVLFLPARKVKEKAAKLRNSFPKDLFSGSGSKNVLAMTFRQVVLQQIWSFDLTVFQPGEERKMVDLETPREVPASFALSSADEYLISVLAEAICISALQSTQIQFLEKVKGGNRGGFFRWFRKPESVQSKDSAVILSKLFEDEIVENARSLLDNYNLMKDGFKPVKIKSGHHWWKSSCYEKLEKIGGSDFSAWASEYVPAYRLEIDTKILGDSKIGGWKKSAENRWEVLLTHSQMVQLAETLDIYYVDPYSLPNKQLSCGVAAKFANVSNKKGNSFPKFLSLALASGIFLVAISALGQFCLPWLCKERKHSVEHRSLPSSEVDVAINDFFDTQKLEEYCVLAIAKAKGTFGWSGEIKVEDGIGVWIGELPAYLRGEGVDTLSTSENIDADAKVSIQDIASYQVVFSSEGKIVGFQPLSRVAVNHWSVNPLARELYGGKKLSPSRI

SEQ ID NO: 223215 - protein, 454 aa, Glycine max
  Coding DNA Sequence Number=SeqID_106437
  Homolog annotation: Hit_ID=Q5JMX2; Match level="QueryCoverage=93%, HitCoverage=90%, E-value=1e-105, Identity=46%"; Hit description =Putative vascular plant one zinc finger protein
MKKISKSSCKSASHRLFKDKARNHVDDLQESRTIDAALLEEQVHQMLREWKAELNETSPASSLQQGGSLGSFSTDVYRLLQLCEEEDDATSPLVAPKSEPNDQIMQAGAKVIVQEGQHQQEFRLLKECKHSTVGVPNIAANNLDGTALEYHQFDIKDLDHSFYAGTGFCEEGGVPHISSYLPSVCPPPSAFLGPKCALWDCPRPVQGLDWCQDYCSSFHATLALNEGPPGMTPVLRPGGIGLKDNLLFAALGAKAQGKVVGIPECEGAATAKSPWNAPELFDTCVLEGETIREWLFFDKPRRAFESGNRKQRSLPDYSGRGWHESRKQVMNEFGGLKRSYYMDPQPLNLFEWHLYEYEISKCDARALYRLELKLVDGKKSSKAKIVVTSDSVAGLQKHIGSLSAKGRTKLGIGGGVYSASNRVALQLNAPYQYGLTSSPYDDYVVDNTRDYYVT

SEQ ID NO: 223216 - protein, 190 aa, Glycine max
  Coding DNA Sequence Number=SeqID_106438
KIIPERNVQLSFNDFEEFQRQLNRRNWHKKIANLVEGSIDVALVKEFYANFYDPEDKSPKQVKVRGHWIPFDSATLNSFLETLVAIEEGESLPAYARFVLLRPNQQELAACLCILGKGFELNSDGLPLKILRKNLTTLAQTWSVFSFSNLAPTSHTSDINLDRDKLVYALIQKMDMNLGSFISSQITLMA

SEQ ID NO: 223217 - protein, 82 aa, Glycine max
  Coding DNA Sequence Number=SeqID_106439
MMPNQISNCESLNGTLNRQPQAPGTIENTNNLTSASSIVGNGENVSAAGGEILELLDDAIEGSPTGKDEQRGLRVRVRRVKV

SEQ ID NO: 223218 - protein, 221 aa, Glycine max
  Coding DNA Sequence Number=SeqID_106440
  Gene Ontology: Mol. function=intramolecular transferase activity, phosphotransferases; Cellular component=cytoplasm; Biological process=carbohydrate metabolic process
  Homolog annotation: Hit_ID=Q9SM60; Match level="QueryCoverage=91%, HitCoverage=32%, E-value=4e-46, Identity=55%"; Hit description =Phosphoglucomutase, cytoplasmic
MDAGLCSVCGEESFGTGSDRIREKDGIWEVLAWLSILAYKNKDKLEDKLVTVEDIIRQHWTTYGRHYYTQYDYENVDAGAAKELMAYLVKLQSSLSEPETKRALLNKSSEDKIQKYGRSKAGSRVVPYQEDESQDSVPVSIVSKDLQRNDKESEDLQRNDKESEDLWLIRDQLHQIENQQSSLLDLLQHEGASQAFEDAQKKMKSISETVIICSMKVLLNS

SEQ ID NO: 223219 - protein, 119 aa, Glycine max
  Coding DNA Sequence Number=SeqID_106441
  Gene Ontology: Mol. function=oxidoreductase activity; Cellular component=membrane; Biological process=electron transport
  Homolog annotation: Hit_ID=Q2MJ03; Match level="QueryCoverage=99%, HitCoverage=23%, E-value=1e-25, Identity=49%"; Hit description =Cytochrome P450 monooxygenase CYP94C9
MLDLQDVFQRFSFDNIYRFSFGLDPDCLTRQSGFTPVFVKNFDLTLKLFAERATTGSPFVWKLKRLLNLGSRKQLKKAVRVINVLVREVIQQRCKKGFSKNKDLLSRFMNTIHDDDTYL

SEQ ID NO: 223220 - protein, 93 aa, Glycine max
  Coding DNA Sequence Number=SeqID_106442
MELASWTRGSSWWNSPVEMARHGPRGGFVGVSGGSVEDLIACGGDGWWLKFGSCEVDEFVGLVCVRFVGVSGCFTADLVACGGDGLWLGLDLE

SEQ ID NO: 223221 - protein, 81 aa, Glycine max
  Coding DNA Sequence Number=SeqID_106443
MEEEVPLETEKPVRGSMVEDCGGSVEVRDVREKEDREAATNEDEDKIYIRMESEVNPRSWFEHGRRRKVKLREAMDLIMRN

SEQ ID NO: 223222 - protein, 50 aa, Glycine max
  Coding DNA Sequence Number=SeqID_106444
MEGLWSVFGEYELASYGIGRENMVKSLCYGYTTALFAAPFLGVLSDLIIA

SEQ ID NO: 223223 - protein, 77 aa, Glycine max
  Coding DNA Sequence Number=SeqID_106445
MARMLVSMKNLLKFFIFAAMVIVQFSHGVSFKDRCHEFCHNIPKANCDAYCKDNHYQKGECIPPYPAGDSLCCCSGD

SEQ ID NO: 223224 - protein, 197 aa, Glycine max
  Coding DNA Sequence Number=SeqID_106446
  Homolog annotation: Hit_ID=Q337A9; Match level="QueryCoverage=85%, HitCoverage=38%, E-value=5e-11, Identity=28%"; Hit description=Major Facilitator Superfamily protein, expressed
MWKGVDKRIWLLAWAQTCLHFSIGIFWILWAPTVVADGREVHLGLIYPCFLGSRMLGSTAFPCLTSGPSSLRTEDCLVFAYIILALLLSIVAYDYQEVGVLVILFCLFHACVGFVLPSLARLRTMYVPNELRGGMMGFSLAPANAAILLSVVQGGYYRNVGNAALMAFGVCGLLLAAGCMHALKQWGKQPYNNWHKQ

SEQ ID NO: 223225 - protein, 131 aa, Glycine max
  Coding DNA Sequence Number=SeqID_106447
  Gene Ontology: Mol. function=heat shock protein binding; Cellular component=integral to membrane; Biological process=protein folding
  Homolog annotation: Hit_ID=Q1SBZ9; Match level="QueryCoverage=93%, HitCoverage=20%, E-value=3e-67, Identity=91%"; Hit description=Heat shock protein DnaJ, N-terminal
MKHRTLMVKHMHWYEVSEKVSVCECRCTRARLPPSKFWLFEPRCGFHDIGGWYVETYGKDKNGRTMPSQRFWDGLDYSEQADRRLHPAMYLFALAYRTLDLEYAKASKKSFRNVVGAQMFRILHWCKKLVQ

SEQ ID NO: 223226 - protein, 151 aa, Glycine max
  Coding DNA Sequence Number=SeqID_106448
  Gene Ontology: Mol. function=RNA-directed DNA polymerase activity; Biological process=RNA-dependent DNA replication
MTLIRSNIDDDNEATVTHFPSGLNHDIRDVVELQEYVELENLLHKAVQLCSFIVVSGSYTNVASSRLVSKLNLETKPHPRPYKLQWLSEDGEMTVSQQVEGCLSVGRYNDRVLCDVVPLEASHILLGRPWQYDTKAIHDGFTNKISFRHNE

SEQ ID NO: 223227 - protein, 345 aa, Glycine max
  Coding DNA Sequence Number=SeqID_106449
  Homolog annotation: Hit_ID=Q10J01; Match level="QueryCoverage=76%, HitCoverage=83%, E-value=1e-97, Identity=67%"; Hit description =Expressed protein
  Pfam annotation: Domain name=DUF1230; Domain location=103-248; Score =306.1; E_value=6.5e-89; Accession=PF06799.2; Description=Protein of unknown function (DUF1230)
MHLVRIISVLRGLSASDGRCIRSPRGQEASPHNLEAGQNVYCSLIPSARQARPGNSYGSLIIHNHKASKFSHRISIKAKAIKDEMDGETSGSSGRSWDPGLEIEVPFEQRPVNEYSSLKDGILYSWGELGPGSFFLRLGSLWLAVFTVLGGPIAAASFNPSKEPLRFILAAGTGTLFIVSLIVLRIYLGWSYVGDRLLSAVIPYEESGWYDGQMWVKPPEILARDRLLGSYKVKPVVKLLKQTLVGTGALLVTGVMLFIFATPVENFFRTTFTKEEIKSTVQAPKVNTKLLRKEELLKLPVEVITDDDLAAAAAEAADGRPVYCRDRYYRALAGGQYCKWEDLLK

SEQ ID NO: 223228 - protein, 263 aa, Glycine max
  Coding DNA Sequence Number=SeqID_106450
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=cytoplasm; Biological process=protein metabolic process
  Homolog annotation: Hit_ID=Q75ZI4; Match level="QueryCoverage=74%, HitCoverage=80%, E-value=6e-74, Identity=62%"; Hit description =Prolyl 4-hydroxylase
  Pfam annotation: Domain name=2OG-FeII_Oxy; Domain location=160-258; Score=2.1; E_value=0.075; Accession=PF03171.10; Description=2OG -Fe(II) oxygenase superfamily
MNKLDLPSVFLICIFFFLAGFSASSLFSHSQVSLLNTPNHKHEYDLRLRPRPRPRARLLEKSTQEKTEYHLLKAGDSGDDYVTLIPFQVLSWYPRALYFPNFASAEQCESIIEMARGGLKSSTLALRKGETEESTKGIRTSSGVFMSASEDETGILDAIEEKIAKATKIPRTHGEVASFLLYLTDVPEGGETMFPYENGFNRDGNVEDCIGLRVRPRKGDALLFYSLLPNGTIDQTSAHGSCPVIKGEKWVATKWIRNQVQDD

SEQ ID NO: 223229 - protein, 730 aa, Glycine max
  Coding DNA Sequence Number=SeqID_106451
  Gene Ontology: Mol. function=identical protein binding; Cellular component=cytoplasm; Biological process=negative regulation of enzyme activity
  Homolog annotation: Hit_ID=Q1SBZ8; Match level="QueryCoverage=99%, HitCoverage=94%, E-value=0.0, Identity=69%"; Hit description =Protease-associated PA; Peptidase S8A, bacillopeptidase F
  Pfam annotation: Domain name=PA; Domain location=326-425; Score =115.3; E_value=1.8e-31; Accession=PF02225.12; Description=PA domain
  Pfam annotation: Domain name=Peptidase_S8; Domain location=82-566; Score=60.0; E_value=7.8e-15; Accession=PF00082.12; Description =Subtilase family
  Pfam annotation: Domain name=Subtilisin_N; Domain location=1-71; Score=22.5; E_value=0.00086; Accession=PF05922.7; Description =Subtilisin N-terminal Region
  Pfam module annotation: Pfam domain module=PA::Peptidase _S8::Subtilisin_N; Domain location=326-425::82-566::1-71
MAKSKMPASFNHHSVWYKSIMKSISNSTEMLYTYDNTIHGLSTRLTLEEARLLKSQTGILKVLPEKIYKPLTTRTPKFLGLDKIADMFPKSNEASDIVIGLLDTGVWPESKSFEDTGLGPIPSSWKGKCESGDNFTTLNCNKKLIGARFFLKGYEASMGPLNATNQFRSPRDADGHGTHTASTAAGSAVKGASLFGYASGTARGMASRARVAVYKVCWGDTCAVSDILAAMDAAISDNVNVISASLGGGAIDYDEENLAIGAFAAMEKGIVVSCAAGNTGPDSSSLQNIAPWMITVGAGTLDRDFPVNVNLGNGQNYSGVSIYDGKFSRHTLVPLIYAGNASAKIGAELCETDSLDPKKVKGKIVLCDRGNSSRVEKGLVVKSAGGVGMVLANSESDGEELVADAHLLPTTAVGFKAGKLIKLYLQDARKPTSRLMFEGTKVGIEPSPVVAAFSSRGPNPITPEVLKPDFIAPGVNILAAFTKLVGPTNLDQDDRRVDFNIISGTSMACPHASGIAALIKSFHPDWSPAAIRSALMTTAYTTYNNGKKLLDSATNGPSTPFEVGAGHVNPVAALNPGLVYDLAVDDYLNFLCALNYTPDRIEVVARRKFRCNAHKHYSVTDLNYPSFGVVFKPKVGGSGATIVKHKRTLTNVGDAGTYKVSVTVDISSVKIAVEPNVLSFNKNEKKSYTITFTVSGPPPPSNFGFGRLEWSNGKNVVGSPISITWESGRA

SEQ ID NO: 223230 - protein, 334 aa, Glycine max
  Coding DNA Sequence Number=SeqID_106452
MATNCTQWEKMLHLKEEEEGKEEEEEEIEALSLCDLPVNLIGHEDQSKAKPDSQINETQEEDFDFRLWSGPFSTEPEMCAADEVFFQGQILPLHLSLKRCESLDHVSVREFCSNSSSSSIRSQNSSSSSSSTTTTTTPIISETRIQNQNQNHFLTHPSPQRQLKVTVPRQTSFGNHGRKSSAWDFLRLGVVPAPEIALQDLKVRSTNGVNKNHTARSNSMGSNNSNANANGTVKTSYSGKTKNHVFKKIGGFWSGCKYSVETVQQSDMVMIKGGTKSANTTESATHAAKEKVLERKRQKHRQKQGKRTMSRRRTFEWIKELSHVSYPDEEALLS

SEQ ID NO: 223231 - protein, 129 aa, Glycine max
  Coding DNA Sequence Number=SeqID_106453
  Homolog annotation: Hit_ID=Q9C6J5; Match level="QueryCoverage=34%, HitCoverage=4%, E-value=7e-15, Identity=82%"; Hit description=DNA polymerase A family protein, putative
  Pfam annotation: Domain name=ERp29; Domain location=63-122; Score =8.1; E_value=7.6e-05; Accession=PF07749.3; Description=Endoplasmic reticulum protein ERp29, C-te
MCSDIYSNLATFSSRFLDMSKQVHDEVILEGPTESAEVAKSIVIECMSKPFNGKNILKVDLSVDANDEEKKSVFTRMEEEVEKLKGSASRHGKIYLKAAKNYLEKKTNETYAEFLCLLQKFIHNRIYVK

SEQ ID NO: 223232 - protein, 63 aa, Glycine max
  Coding DNA Sequence Number=SeqID_106454
MEWNGSTRRYVPRADSSLSFLYNYNYTPYPVNLLLIRLKKHLTSGMQFSNSYTFVDYFQSPFL

SEQ ID NO: 223233 - protein, 79 aa, Glycine max
  Coding DNA Sequence Number=SeqID_106455
MEEGKRERKQQRKGRTRREKGKAYVSWPPRQPSTGTIFDHRPMNPLSQFCLFHCVPQSPKTDGFFYFFSLSLVVTFAKW

SEQ ID NO: 223234 - protein, 83 aa, Glycine max
  Coding DNA Sequence Number=SeqID_106456
  Gene Ontology: Mol. function=sequence-specific DNA binding; Cellular component=nucleus; Biological process=regulation of transcription, DNA-dependent
  Homolog annotation: Hit_ID=Q1S8N0; Match level="QueryCoverage=98%, HitCoverage=39%, E-value=2e-17, Identity=60%"; Hit description =Leucine zipper, homeobox-associated; Homeodomain-related
MKLKTMLREQASRTQQVSTGYTEISGEETVESTSEALRCSKRGTLHHQQQQNNIGEGNCSFTLEDYNTVPVLPYWPGVPYYHP

SEQ ID NO: 223235 - protein, 59 aa, Glycine max
  Coding DNA Sequence Number=SeqID_106457
MKNDGKPSRNRPRKRLRSITEAPRLGFSSRKQFFSLISREKREVVAAQLAQASWVALIE

SEQ ID NO: 223236 - protein, 416 aa, Glycine max
  Coding DNA Sequence Number=SeqID_106458
  Gene Ontology: Mol. function=protein serine/threonine kinase activity; Cellular component=spindle pole body; Biological process =protein amino acid phosphorylation
  Homolog annotation: Hit_ID=Q6JJ37; Match level="QueryCoverage=92%, HitCoverage=70%, E-value=1e-154, Identity=69%"; Hit description =Putative serine/arginine (SR) protein kinase protein
  Pfam annotation: Domain name=Pkinase; Domain location=44-411; Score =86.3; E_value=9.3e-23; Accession=PF00069.15; Description=Protein kinase domain
  Pfam annotation: Domain name=Pkinase_Tyr; Domain location=44-405; Score=-101.9; E_value=3.2e-06; Accession=PF07714.7; Description =Protein tyrosine kinase
  Pfam module annotation: Pfam domain module=Pkinase::Pkinase_Tyr; Domain location=44-411::44-405
MGDKHQQHQEDSSDFTSEDEGTEDYRRGGYHAVRIGDTFNAGRYVVQSKLGWGHFSTVWLAWDTKHSRYVALKVQKSAQHYTEAAMDEIKILQQIAEGDPDDKKCVVKLLDHFKHSGPNGQHVCMVFEYLGDNLLTLIKYSDYRGLPIAMVKEICFHILVGLDYLHKQLSIIHTDLKPENILLLSTIDPSKDPRKSGAQLILPDSKDKMALESAGVKDMKTLNGDLIKNHKKKIKRKAKQAAHGCVEKEASEGVEGNAETSGAVELSPNASSAREQASSSAGTSRLSDADATKLKEQGNKRGSRSMRQKLLALVDLKCKLVDFGNACWTYKQFTNDIQTRQYRCPEVILGSKYSTSADLWSFACICFELATGDVLFDPHSGENFDRDEEQCGTIQVNERTIYMDFLKFKLMKVFES

SEQ ID NO: 223237 - protein, 474 aa, Glycine max
  Coding DNA Sequence Number=SeqID_106459
  Gene Ontology: Mol. function=ATP-dependent peptidase activity; Cellular component=integral to membrane; Biological process=ATP -dependent proteolysis
  Homolog annotation: Hit_ID=Q75GI8; Match level="QueryCoverage=95%, HitCoverage=96%, E-value=1e-122, Identity=52%"; Hit description =Expressed protein
  Pfam annotation: Domain name=DUF81; Domain location=75-448; Score= -28.6; E_value=0.00041; Accession=PF01925.9; Description=Domain of unknown function DUF81
MNHRPLLLLFFAMPMLSSRGFIAYVLSAFSCAVLSALFITNHIHDDDNKAVTLLASRVSETLKVWPDLEPSWRLLLATVIGFLGSACGTVGGVGGGGIFVPMLNLILGFDTKSAAALSKCMIMGASTSSVWYNVRVPHPTKEVPILDYDLALLFQPMLMLGITVGVALSVVFPYWLITVLIIILFIGTSSRSFFKGIEMWREETIFKREKTMQRATLVDSQVRIDTKYEPLIPKEKKSTMEILCLNLRWKRILVLIVVWVGFLLVQVIKASSLTPFFSLSLTRLFGCDNLPIALLVFGYEAVKLYKEHKRRMNTGNSECICEASIEWTAINLAFCALCGIVGGIVGGLLGSGGGFVLGPLLLEIGVIPQVASATATFVMMFSSSLSVVEFYLLKRFPIPYALYLTSVSVLAGFWGQFFVRRLITCLGRASIIVFILSGVIFASALTMGVVGIENSIQMINNHEFMGFLGFCSSQ

SEQ ID NO: 223238 - protein, 225 aa, Glycine max
  Coding DNA Sequence Number=SeqID_106460
  Homolog annotation: Hit_ID=Q9FLH0; Match level="QueryCoverage=23%, HitCoverage=4%, E-value=2e-13, Identity=71%"; Hit description =Putative nuclear matrix constituent protein 1-like protein
  Subcellular localization annotation: CTP_CleavageSite=99; ConfidenceScore=5.83e-01
MVLQAIFNGTFFSTTTSSSTTLFIGSSASTLVAVDSRHHRFPSLLFSATLASTLIAVNSRHHQFYKFSISMRTTNLGFELGDVSNKCKLIFVLNRFLIEASVTEALPDLFVRERVSQNPRTRCNGQEEILGTEPHALCKLGFRFWKCDLDDAASVGEILIPVKGRKGERDFGEVGIGRVVEESGGEEVASGGDKGWGGAEGGFGGDEFVTEKREKTEREVEGVQS

SEQ ID NO: 223239 - protein, 45 aa, Glycine max
  Coding DNA Sequence Number=SeqID_106461
  Gene Ontology: Cellular component=membrane
  Homolog annotation: Hit_ID=Q9FFN2; Match level="QueryCoverage=96%, HitCoverage=10%, E-value=4e-12, Identity=77%"; Hit description =Similarity to limonene cyclase
MKDHVKHIESLGWRMNLKVSSNLSYSSLHSYMLPWGNTHQNVLQD

SEQ ID NO: 223240 - protein, 436 aa, Glycine max
  Coding DNA Sequence Number=SeqID_106462
  Gene Ontology: Mol. function=mannosyltransferase activity; Cellular component=membrane; Biological process=protein amino acid O-linked glycosylation
  Homolog annotation: Hit_ID=Q39871; Match level="QueryCoverage=78%, HitCoverage=74%, E-value=1e-143, Identity=79%"; Hit description =Maturation polypeptide
  Pfam annotation: Domain name=LEA_4; Domain location=106-157; Score =39.8; E_value=9.4e-09; Accession=PF02987.7; Description=Late embryogenesis abundant protein
  Pfam annotation: Domain name=LEA_4; Domain location=158-201; Score =70.0; E_value=7.8e-18; Accession=PF02987.7; Description=Late embryogenesis abundant protein
  Pfam annotation: Domain name=LEA_4; Domain location=202-245; Score =72.0; E_value=1.9e-18; Accession=PF02987.7; Description=Late embryogenesis abundant protein
  Pfam annotation: Domain name=LEA_4; Domain location=246-289; Score =34.4; E_value=3.9e-07; Accession=PF02987.7; Description=Late embryogenesis abundant protein
  Pfam annotation: Domain name=LEA_4; Domain location=297-340; Score =45.6; E_value=1.7e-10; Accession=PF02987.7; Description=Late embryogenesis abundant protein
  Pfam annotation: Domain name=LEA_4; Domain location=348-391; Score =36.7; E_value=7.9e-08; Accession=PF02987.7; Description=Late embryogenesis abundant protein
  Pfam module annotation: Pfam domain module=LEA_4::LEA_4::LEA_4::LEA _4::LEA_4::LEA_4; Domain location=106-157::158-201::202-245::246 -289::297-340::348-391
MASKKQEERAEAAAKVAAKELEQVNRERRDRDFGVVAEQQQQHHQEDQQKRGVIGSMFKAVQDTYENAKEAVVGKKEATNNAYSNTEVIHDVNIQPDDVSATGEVRDISATKTHDIYDSATDNNNNKTGSKVGEYADYASQKAKETKDATMEKAGEYTDYASQKAKEAKKTTMEKGGEYKDYSAEKAKERKDATVNKMGEYKDYAAEKAKEGKDATVNKMGEYKDYAAEKTKEGKDATVNKMGEYKDYTAEKAKEGKDTTLGKLGELKDTASDAAKRAVGYLSGKKEETKEMASETAEATANKAGEMKEATKKKTAETAEAAKNKAGEIKDRAAETAEAAKNKTAETAEVTKNKALEMKDAAKDRTAETTDAAKQKTAQAKENTKVSTLHLLKDNLFIFPSRLVEITFILFKMVHVSVECSGFRPRLLKGLKSYHF

SEQ ID NO: 223241 - protein, 310 aa, Glycine max
  Coding DNA Sequence Number=SeqID_106463
  Gene Ontology: Mol. function=transferase activity; Cellular component= membrane; Biological process=metabolic process
  Homolog annotation: Hit_ID=Q9FFN2; Match level="QueryCoverage=90%, HitCoverage=68%, E-value=1e-116, Identity=68%"; Hit description =Similarity to limonene cyclase
  Pfam annotation: Domain name=Exostosin; Domain location=92-310; Score= 22.6; E_value=6.6e-11; Accession=PF03016.6; Description=Exostosin family
MKETEVFNVSKPEFNLAPVNKPDESHPRLKQKRKFSFLDRTEVVLAQARAAIREARNRNRTLDSDYVPTGPMYWNAKAFHRSYLEMEKQFKVFVYEEGETPVFHNGPCKSIYSMEGNFIHAIEMNDHFRTKDPKKAHVFFLPFSVVMMVRFVYERDSRDFGPIKKTVIDYVNLIATRYPYWNRSLGADHFMLACHDWGPEASFSLPYLHKNSIRVLCNANTSEGFKPAKDVSFPEINLQTGSINGFVGGPSASKRSILAFFAGGVHGPIRPILLEHWENKDEDIQVHKYLPKGVSYYGMLRKSKFCLCPS

SEQ ID NO: 223242 - protein, 137 aa, Glycine max
  Coding DNA Sequence Number=SeqID_106464
  Gene Ontology: Mol. function=DNA photolyase activity; Biological process=DNA repair
  Homolog annotation: Hit_ID=Q1RUS6; Match level="QueryCoverage=75%, HitCoverage=25%, E-value=7e-22, Identity=49%"; Hit description =Deoxyribodipyrimidine photolyase, class 1
MEACREIEKKVLKTREVVCIHDIGPNCLGKLHQHHLELPDAHNDIGLACLEVTAEVEDGVDEEGNMIGVDLVEAVDGEDNEGFFVGGGEAIVVEETKVVAEPDYCSMAEGNSVGGVAGAVGLEGKKGCGGGWQRRWI

SEQ ID NO: 223243 - protein, 90 aa, Glycine max
  Coding DNA Sequence Number=SeqID_106465
  Gene Ontology: Mol. function=signal transducer activity; Biological process=G-protein coupled receptor protein signaling pathway
  Homolog annotation: Hit_ID=Q9LI02; Match level="QueryCoverage=54%, HitCoverage=5%, E-value=2e-15, Identity=80%"; Hit description =Putative extra-large G-protein
MGDLDAFFPAATWECAPLVEEVWRDLAIQETFKRKDELHFLPDVVEYLSRDLLERNIVAHINHVMWIGVDEYKMDWSSLPNGRCMNKLIK

SEQ ID NO: 223244 - protein, 84 aa, Glycine max
  Coding DNA Sequence Number=SeqID_106466
  Gene Ontology: Mol. function=protein phosphatase type 2C activity
  Homolog annotation: Hit_ID=Q9LHJ9; Match level="QueryCoverage=98%, HitCoverage=22%, E-value=1e-19, Identity=57%"; Hit description =Protein phosphatase 2C
MVMSCWKQIVDGDEGDESGRVDGLLRYKDLGNHLYGEFSMVVVQDNSSLEDRGELESRPLSSNHLGPQGTFIGVYDGHDGSEAS

SEQ ID NO: 223245 - protein, 454 aa, Glycine max
  Coding DNA Sequence Number=SeqID_106467
  Gene Ontology: Mol. function=transferase activity; Cellular component= membrane; Biological process=metabolic process
  Homolog annotation: Hit_ID=Q9FFN2; Match level="QueryCoverage=87%, HitCoverage=97%, E-value=1e-164, Identity=67%"; Hit description =Similarity to limonene cyclase
  Pfam annotation: Domain name=Exostosin; Domain location=127-415; Score=238.5; E_value=1.4e-68; Accession=PF03016.6; Description =Exostosin family
MASMTTMEVEDSGDVIGNTERWKKKHEAATTSYDHENETEVFNVSKPGFNLAPANESDESHPRQKRKRKFSFLDKTEAVLAQARAAIREAENWNQTQDSDYVPVGPMYWNPKEFHRSYLEMEKQFKVFVYEEGELPVFHEGPCASIYSTEGSFIHAIEMNEHFRTRDPKKAHVFFLPFSVVMMVRYVYIRDSHDFGPIKRTVRDYINVIAARYPYWNRSLGADHFMLSCHDWGPEASKFSPYLRKNSIRVLCNANTSEGFDPRKDVSFPEINLQRGPIDGLLGGPSASQRSILAFFAGGIHGPIRPILLEHWEKKDEDIQVHQYLPKGVSYYGMLRKSKFCLCPSGYEVASPRVVEAIYTGCVPVLISDHYVPPFSDVLNWKMFSVEVSMKEIPNLKDILMNISPRKYIRMQKRVRQIRRHFEVHSPPKRYDVFHMILHSVWLRRLNFRVLDDQ

SEQ ID NO: 223246 - protein, 200 aa, Glycine max
  Coding DNA Sequence Number=SeqID_106468
  Gene Ontology: Mol. function=protein serine/threonine kinase activity; Cellular component=integral to membrane; Biological process=protein amino acid phosphorylation
  Homolog annotation: Hit_ID=O64556; Match level="QueryCoverage=93%, HitCoverage=21%, E-value=2e-46, Identity=47%"; Hit description =Putative receptor-like protein kinase
MENGDAIGLGAALCDAQFIGTGTSKSISHKFISDTPQRTFTNVRSFPEGKKNCYTLRHPEGRNTIYLIRASFMYGNYYDLNKLPQFDLYIGVNLWDTVMFDNATHVVIKEILHVPSLDELYVCLLNTDKGTPFISALEVRHFDHSSYRTNSKLLSLYKRFDIGSTTNEIVRYDKDDYDRMWYPYNFLILHHSILPSPSTP

SEQ ID NO: 223247 - protein, 44 aa, Glycine max
  Coding DNA Sequence Number=SeqID_106469
MEEVIVVVVVYYDGDVVSTFKETKCSLTAIRKVIMDAIGGGRNL

SEQ ID NO: 223248 - protein, 385 aa, Glycine max
  Coding DNA Sequence Number=SeqID_106470
  Gene Ontology: Mol. function=transporter activity; Cellular component= outer membrane; Biological process=transport
  Homolog annotation: Hit_ID=Q933S4; Match level="QueryCoverage=99%, HitCoverage=50%, E-value=1e-149, Identity=65%"; Hit description=CjrC
  Pfam annotation: Domain name=TonB_dep_Rec; Domain location=206-375; Score=21.2; E_value=0.0037; Accession=PF00593.14; Description=TonB dependent receptor
MKQHPKSQLFKLDIKPNEFNSIEFSARNYQNRFSRRDIDSHDLYLKYHYAPCSELVDLNLTVSTSKGNQKYDGGSLFTFFNTNAENRSDALDINNTSRFSLLDTDVAFSYGGKLMRNQYRKHVESAIENSQTAQEAIENNTFAPSGEQRIGSLYTGLQLNRDIYQLDLNLNYTSNKLTGYKPECDYRVECFPQGAASINLKEQGFNPSVMLSAQVTPWLQPFVSYSKSMRAPNIQEVFYSNSGGASMNPFLKGERAETWQAGFNANGHDLLVKEDSLRLKVVGYTSKVRNYIFSESYMVCRNGRKCSYRENLENDWADASEDYSDNMYIYVNSLTPVRMHGVEVEANYDAGRAFARVSFSKQHTEQPTSIASTYFGAGDINELPD

SEQ ID NO: 223249 - protein, 62 aa, Glycine max
  Coding DNA Sequence Number=SeqID_106471
  Homolog annotation: Hit_ID=Q67XL6; Match level="QueryCoverage=67%, HitCoverage=6%, E-value=3e-11, Identity=76%"; Hit description=MRNA, complete cds, clone: RAFL25-35-C17
QFSDIYQEEHFINYLTPDIRIVRELPKELQSLDLEAISSVTREKLASRNYYASLEKVFCICG

SEQ ID NO: 223250 - protein, 104 aa, Glycine max
  Coding DNA Sequence Number=SeqID_106472
  Gene Ontology: Mol. function=oxidoreductase activity; Cellular component=membrane; Biological process=electron transport
  Homolog annotation: Hit_ID=Q2MJ03; Match level="QueryCoverage=83%, HitCoverage=16%, E-value=1e-18, Identity=50%"; Hit description =Cytochrome P450 monooxygenase CYP94C9
MEFQPQRWLKDGVFQPMNPFEYPIFQVGLRVCVGKEMDLKEMKSVVVLLLRKFHIELVSSLSCGINPHFSSRLTTTFSSGLHVMVHEREIITTTESQKRSNLIG

SEQ ID NO: 223251 - protein, 77 aa, Glycine max
  Coding DNA Sequence Number=SeqID_106473
MIVTTFTDITVVIVKTTTTIATVMVATTVTVDDGGDNDDEEGHSDRVDGGNNYGGGCGGSHGGDNNNHDSDELIEIF

SEQ ID NO: 223252 - protein, 340 aa, Glycine max
  Coding DNA Sequence Number=SeqID_106474
  Gene Ontology: Mol. function=helicase activity; Biological process =viral genome replication
  Homolog annotation: Hit_ID=Q9LW42; Match level="QueryCoverage=98%, HitCoverage=32%, E-value=7e-47, Identity=44%"; Hit description =Helicase-like protein
MMFAFTSPGAKLDRSISKWCRTTNHMDTRNQKNIDAKIVSKLSAMLDEYNVHGKFFRMAKESLKSEHVHDLKLKLISNRNKDGRIYNIPSVSKVATLIVGDVDTGSKRNIIMEMHSGKLQRIDELHTCYLSFQYPLLFPYDEDGYRHDVLHRSTHTSKKRIQLTIKEWLCFRIQTRANEAQTLLRSRRLFQRFLSKYPTAKDIDRIILAEIPSEQDEPKLYNLVKAHMIHGPCGSSNKSSPCMKGGKCSRYYPKKFQNSTIVDQDGYPIYRRRDNGHTILKNSVIVDNRIVVPYNPMLLLKFQAHINMEWCNQSTSIKYLFKYINKGYDRITAAIVPTEH

SEQ ID NO: 223253 - protein, 334 aa, Glycine max
  Coding DNA Sequence Number=SeqID_106475
  Gene Ontology: Mol. function=DNA binding; Cellular component =chromatin; Biological process=base-excision repair
  Homolog annotation: Hit_ID=UPI0000162E13; Match level="QueryCoverage =86%, HitCoverage=34%, E-value=8e-69, Identity=49%"; Hit description =DNA binding
MVPLATEELGLAFESVKLVYNGLLYAWQFVCSNPFRPLRSLNPMPRIIYSLDWLSNPSCIIMSFEDGTMRTISLVKAANDLPVTGEIYSGKKQPGLHGSAYSSFAIWSVQVSRLTGMVAYCGVDGAVIRFQLTTKSVETDHSRNRSRRFLCGSVTEEDSTLIINTPLSDAPFQWKKPPEKGRCAESFRDLLAKSNPFRSASNQMAETSNPDSQTLAIGAGEDVGLESGSEEALCSVKQPKRPKLNSGRKKKPEGLALVCGDDDAPPITPEADNEKSDFGNIPETFPPKVAALHRVRWNMNKGSERWLCFGGACGLVRCQEIVYSNIDKRWALKK

SEQ ID NO: 223254 - protein, 106 aa, Glycine max
  Coding DNA Sequence Number=SeqID_106476
  Gene Ontology: Mol. function=identical protein binding; Cellular component=cytoplasm; Biological process=negative regulation of enzyme activity
  Homolog annotation: Hit_ID=Q9LZS6; Match level="QueryCoverage=99%, HitCoverage=13%, E-value=1e-27, Identity=60%"; Hit description =Cucumisin-like protein
  Pfam annotation: Domain name=Subtilisin_N; Domain location=1-75; Score=35.0; E_value=2.6e-07; Accession=PF05922.7; Description =Subtilisin N-terminal Region
MGELPVDRAYAPEDHHNNLLATAIGDWQLARESKIHSYGKSFNGFVARLLPYEAEKLLEEDNVLSVFPNTQNKLHTTRSWDFLGLPLKLNRHSNVESDIIVGVLDT

SEQ ID NO: 223255 - protein, 449 aa, Glycine max
  Coding DNA Sequence Number=SeqID_106477
  Gene Ontology: Mol. function=identical protein binding; Cellular component=cytoplasm; Biological process=negative regulation of enzyme activity
  Homolog annotation: Hit_ID=Q9LZS6; Match level="QueryCoverage=99%, HitCoverage=60%, E-value=1e-140, Identity=55%"; Hit description =Cucumisin-like protein
  Pfam annotation: Domain name=PA; Domain location=60-158; Score=30.2; E_value=7.5e-06; Accession=PF02225.12; Description=PA domain
  Pfam annotation: Domain name=Peptidase_S8; Domain location=14-287; Score=-83.6; E_value=0.027; Accession=PF00082.12; Description =Subtilase family
  Pfam module annotation: Pfam domain module=PA::Peptidase_S8; Domain location=60-158::14-287
MKRGILTSCSAGNNGPSTMTVENVAPWILTVAASNTDRQFTTAVHLADGKKARGMSINTFTPEKKMYPLISGALASKVSRDGYGNASACDHGSLSQEKVMGKIVYCLGTGNMDYIIKELKGAGTIVGVSDPNDYSTIPVIPGVYIDANTDGKAIDLYINSTKNAQAVIQKTTSTRGPAPYVASFSSRGPQSITVNILKPDLSAPGVDILAGYSKLATLTGDPADNRRNVFNILSGTSMACPHAASAAAYVKSFHPDWSPAAIKSALMTTAIPMRIKDATAELGSGSGQINPVSALDPGLLYNSSMDSYIAFLCKEGYNSSSIGILIGTKGLNCSTISPPQGTDGINYPSMHTQIIPSNASISAIFYRSVTNVGSGNSTYKAKVRAPKGLSIEVIPDTLNFGGVNQELSFKVVLKGPPMPKETKIFSASLEWNDSKHNVRSPIVVYKPTF

SEQ ID NO: 223256 - protein, 396 aa, Glycine max
  Coding DNA Sequence Number=SeqID_106478
  Gene Ontology: Mol. function=nucleic acid binding
  Homolog annotation: Hit_ID=Q2QXN6; Match level="QueryCoverage=93%, HitCoverage=80%, E-value=1e-118, Identity=56%"; Hit description =Calmodulin-binding family protein, putative, expressed
WQVIDFARLNHSTISFFNLPESAASRWSRVKLNASKVGKGLYLDAKAQKLAFQHWIEAIDPRHRYGHNLHYYYEEWCKTDSGQPFFYWLDLGNGKNIDLEQCPRSKLRKQCIKYLGPQEREHYEFIVCEGKIIHKQSGDLLHTKEDSKDAKWIFVMSTSKKLYAGKKKKGLFHHSSFLAGGATLAAGRLEVEHGVLKSISAYSGHYRPTDDALNSFVSYLKENGVNIDEVEVRNPKDDTDTYEDSKVSEIATAPEDSSNGKISKPVVSEEAENTASSIKEDPQPGSVGSYKRTLSGGLQSPRADVPKKAILQRINSKKATKSYQLGHQLSHRWSTGAGPRIGCVADYPVELRLQALEMLNLSPKVPPSPSSYRFVGGLVSPMANGTRIDSDENSVH

SEQ ID NO: 223257 - protein, 55 aa, Glycine max
  Coding DNA Sequence Number=SeqID_106479
MEKWKNIEMSFGVWLKVSPIKANVVVGVRHEVTCYGLSIFVEGDDSSFGGLLFSV

SEQ ID NO: 223258 - protein, 359 aa, Glycine max
  Coding DNA Sequence Number=SeqID_106480
  Gene Ontology: Mol. function=protein binding; Cellular component =spliceosome; Biological process=dorsal/ventral axis specification
  Homolog annotation: Hit_ID=Q01B93; Match level="QueryCoverage=92%, HitCoverage=59%, E-value=2e-52, Identity=35%"; Hit description =Inframe stop codon
MKFLLSLSLLNLVGICEALLLVCDWELAEARKKDAIDRARVRGEEPPADLLAEERGLHYSVEPDVKNLLQGKTHAELEAYQVHTESEMRTGTAKVVEYWEAVLKHLHIYKAKACLKEIHAKMLCKHLQRPEQPLEDEDELEDAQVRNSEDDTEHYAKDESFSPEPIKGEVQEAKDQAGSFSPELFHGDENEEAIDPEEDRALLEQKRMAVKEEQQRQIQEAMASKPAPSEDNFEMKAMKAMGAMEDGDAVFGSGAEVNLDSEVYWWHDKYRARKPKYFNRVHTGYEWNKYNQTHYDHDNPPPKVVQGYKFNIFYPDLVDKTKAPTYTIEKDGSNGETCIIRFHAGPPYEDIVGISLETG

SEQ ID NO: 223259 - protein, 39 aa, Glycine max
  Coding DNA Sequence Number=SeqID_106481
GLTVKEMEELHDDIKMHLDLDRDTPTHVEYWEVSSLSIV

SEQ ID NO: 223260 - protein, 152 aa, Glycine max
  Coding DNA Sequence Number=SeqID_106482
  Gene Ontology: Mol. function=peptidyl-prolyl cis-trans isomerase activity; Cellular component=chloroplast; Biological process=protein folding
  Homolog annotation: Hit_ID=Q00T94; Match level="QueryCoverage=70%, HitCoverage=47%, E-value=4e-19, Identity=46%"; Hit description=[O] KOG0552 FKBP-type peptidyl-prolyl cis-trans isomerase
  Pfam annotation: Domain name=FKBP_C; Domain location=42-137; Score =103.5; E_value=6e-28; Accession=PF00254.18; Description=FKBP-type peptidyl-prolyl cis-trans i
MVHIGGYHATAHILPQLRGAKIPESDYTTLPNGLKYYDLKVGNGAEAKMGSRVAIHYVAKWKGITFMTSRQGMGVGGGTPYGFDVGQSERGTVLKGLDLGVQGMRVGGQRLLIVPPELAYGSKGVQEIPPNSTIEVNYSDLFVKICSSLEFN

SEQ ID NO: 223261 - protein, 309 aa, Glycine max
  Coding DNA Sequence Number=SeqID_106483
  Homolog annotation: Hit_ID=Q8WUQ7; Match level="QueryCoverage=17%, HitCoverage=7%, E-value=1e-09, Identity=50%"; Hit description =Uncharacterized protein C19orf29
  Pfam annotation: Domain name=DUF1777; Domain location=26-180; Score= -92.5; E_value=0.058; Accession=PF08648.2; Description=Protein of unknown function (DUF1777)
  Subcellular localization annotation: CTP_CleavageSite=21; ConfidenceScore=5.02e-01
MSCFQSPDVDWHRRLHFAAIFCATGSKSRKERRRRRSGDSSRSDDDAESRDLSSQERRRRDGHLGHRRLWRGRSRQDSDSSSDESSDRGGKRKRSSRHVTEEEIAQYLAKKAQRKALKDAKKLKTRTVSGYSNDSNPFGDSNLNEKFVWRKKIELDVVQGVPIDAFSVKAEKKRQKERMAEIEKVKKRREERALEKARHEEEMENFMLPLNTHVSGWCLFVVANWLYVNMTCPISPIPALLARERARAEFHDWQKREEEFHFDQSKVRSEIRLREGRARPIDILTKHLNGSDDLDIEINEPYMVFKVNI

SEQ ID NO: 223262 - protein, 64 aa, Glycine max
  Coding DNA Sequence Number=SeqID_106484
RVHRHAVSADANGSDAPELHESREEVVFLDVWVEVSDREGKKKKGKRVRVTECEDLACTQTKVD

SEQ ID NO: 223263 - protein, 136 aa, Glycine max
  Coding DNA Sequence Number=SeqID_106485
  Homolog annotation: Hit_ID=Q1S9Z0; Match level="QueryCoverage=22%, HitCoverage=13%, E-value=2e-08, Identity=90%"; Hit description=RNA -binding region RNP-1
  Subcellular localization annotation: CTP_CleavageSite=57; ConfidenceScore=5.81e-01
MASVHSSFLLPYNLLSLTTPSSSSTQILFTARPSATHLRPLLLTTRRRSGRRPFAAVAEQAATATEAAARRLYVGNIPRTVTNDELAKIVQEHGAVEKAEEWGVLLRDLDKAYRIFQNCYYCLEFEDMMCFTKGFA

SEQ ID NO: 223264 - protein, 101 aa, Glycine max
  Coding DNA Sequence Number=SeqID_106486
MNPDFNQPRGGCSREVSIHPAQQHCYMFALGKRCSPTETLLRLLLPLNDKVQWTSHNVAGSEPAHVAAIRTLHRTIQSVGATGGVYKGQGRSQRELMTRAY

SEQ ID NO: 223265 - protein, 137 aa, Glycine max
  Coding DNA Sequence Number=SeqID_106487
  Homolog annotation: Hit_ID=UPI000044A741; Match level="QueryCoverage =71%, HitCoverage=28%, E-value=4e-12, Identity=54%"; Hit description =PREDICTED: similar to Ac1147, partial
MGGGAWPFLVGGAICLVNSVNERDLSLLNSYVEVCDALRCSGPHARYTDVFNESIALADRIIAIVGLQRGIPSKRESSARVDYVPALCTHRPSLLPIEWSGEVFGLRRRERVRCPRRCEKSTEPYHLEEGEVVTRFP

SEQ ID NO: 223266 - protein, 58 aa, Glycine max
  Coding DNA Sequence Number=SeqID_106488
  Gene Ontology: Mol. function=prenyltransferase activity; Cellular component=integral to membrane
  Homolog annotation: Hit_ID=Q647J9; Match level="QueryCoverage=98%, HitCoverage=14%, E-value=1e-12, Identity=62%"; Hit description =Homogentisate phytylprenyltransferase
MVGRTLSTISACLIAVEKSSDISPLFFIGLLQALVPYTFLDVYINGVNQLSDLEIDKI

SEQ ID NO: 223267 - protein, 384 aa, Glycine max
  Coding DNA Sequence Number=SeqID_106489
  Gene Ontology: Mol. function=nucleotidyltransferase activity
  Homolog annotation: Hit_ID=Q10Q39; Match level="QueryCoverage=56%, HitCoverage=16%, E-value=4e-20, Identity=35%"; Hit description =Nucleotidyltransferase domain containing protein, expressed
MAHLIGTITMLVYGVQNPYHLFQKLLSLIDPNLLVAETPECDQGEFLLQKEFLRKYRNMCTFPSRASETMTHEFPVKFMNILDPLRNDNNLGRSVNIANLHRVRFALSYGARRLKQILTLPGENLGAALEKFFFSTLDRNGKGERADVVVPISPFYRSYFHLIFPKAKNYNSYWDMHTKPSRPRRFASSKYNALPKSPSKKQQAEEVHSLTDINANSDSRLFEFSSEDSPLLLCNCKVILPTQAQESTPLAKFHSETDMDVTSQLLEFSNEDFPLLPKVYYETHMEGNSRSFELSKKDFPLLQSTDKTALSESAAKLTKQAKSFPSSKESKLKNIEFGTFKKSQSLIEPSLSTKGEREDSGVPLSQETVLVVPKVAAERKDESP

SEQ ID NO: 223268 - protein, 119 aa, Glycine max
  Coding DNA Sequence Number=SeqID_106490
  Subcellular localization annotation: CTP_CleavageSite=66; ConfidenceScore=5.72e-01
MKFKSSGTPSKAQALLDLRGHFSTPTLSPTTLKLSCTSSATPPTPSSSPLSKGGIWDFGTLTEVVRLMGERMKGKGGSSSSSSSSPMMVKCKCEVPVIMFMSRSVNHPRRRFWRCPHWN

SEQ ID NO: 223269 - protein, 99 aa, Glycine max
  Coding DNA Sequence Number=SeqID_106491
ESSSCIFFQWVNDIEARNNFYVEGSELIQYVHKNEELKLKLASLMEEAKANAKEIVELREKIVAHEEKYRTSSAKVVHLKSKIGRKKKNVVVERNRVKL

SEQ ID NO: 223270 - protein, 67 aa, Glycine max
  Coding DNA Sequence Number=SeqID_106492
MENWRTALRDNFAGFQTRRSRTHEQRLPINSWGSEKSGEWRIGEQRYAITSRGSRLEDGEHMNSARQ

SEQ ID NO: 223271 - protein, 280 aa, Glycine max
  Coding DNA Sequence Number=SeqID_106493
  Gene Ontology: Mol. function=binding; Cellular component=periplasmic space; Biological process=cytochrome complex assembly
  Homolog annotation: Hit_ID=UPI00005F76D4; Match level="QueryCoverage =98%, HitCoverage=68%, E-value=1e-104, Identity=69%"; Hit description= COG4235: Cytochrome c biogenesis factor
  Pfam annotation: Domain name=TPR_2; Domain location=110-143; Score =24.5; E_value=0.00037; Accession=PF07719.7; Description =Tetratricopeptide repeat
  Pfam annotation: Domain name=TPR_2; Domain location=39-72; Score =10.9; E_value=1.8; Accession=PF07719.7; Description=Tetratricopeptide repeat
  Pfam module annotation: Pfam domain module=TPR_2::TPR_2; Domain location=110-143::39-72
MPELRERVANERAKPLSMEEIARLGLGLRTALQQDDRNINDWMMLGRVGMALNNATTATQAFAHAYQLDPNSLEVRLGYAEVLTRSNDPEDNKQATQLLRRMIAENHGDPRVLSLLAFNAFEQGDFKQAIGAWQVMLQLLPANDPRAEVIKRSIAQAKAQAGGENVKLNVTVSLSPQAAKALPAQGTLVISVTDGVSPVPVAVKQLPLSRFPLSFSLDDGNAMMPERLLSAQHQVQVRVRLSQDGLATPQPGDWFGESSLQTFSGKEQVSVQINKQVTEK

SEQ ID NO: 223272 - protein, 171 aa, Glycine max
  Coding DNA Sequence Number=SeqID_106494
  Gene Ontology: Mol. function=nucleoside-triphosphatase activity; Cellular component=chloroplast
  Homolog annotation: Hit_ID=Q2PMM5; Match level="QueryCoverage=99%, HitCoverage=9%, E-value=1e-82, Identity=80%"; Hit description =Protein ycf2
MSHTNGFGSTTMGSNVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRSDIASSVRTKESLKYDSKWILFYR

SEQ ID NO: 223273 - protein, 104 aa, Glycine max
  Coding DNA Sequence Number=SeqID_106495
MEPKKRARIEDMPSSSTPAPPSVTIGQDVQSSLTLVPMLQSLFRGQFIIMHNLQELAHNRPILSMEHFLEQVAWPKAQLPLLRPNEAALPESTPVQVNPEPANP

SEQ ID NO: 223274 - protein, 154 aa, Glycine max
  Coding DNA Sequence Number=SeqID_106496
MARQLARCITLLQCWIYEHFPSVGCVVAADDYDERKPRAYRWKSRKALLVSMYHKRLARLTSDVTYQMGSIYCHTSAKEGCMIVWVCADHSSAPAAPSLSIEDIDDRWIQFSEYIAPVGQICVAPGQCSPDYIDWFYLIFHPFMSSAQPVDPLR

SEQ ID NO: 223275 - protein, 58 aa, Glycine max
  Coding DNA Sequence Number=SeqID_106497
VAALEAATSTGGVIAELDIQTLTENLMRTLIALDEIYGEGELKLQRRKQVREEAVGFA

SEQ ID NO: 223276 - protein, 93 aa, Glycine max
  Coding DNA Sequence Number=SeqID_106498
MKAQVEKDEGPETYQGNPCGVYLDLSSFTGSGVYPDLSSFTGSGVYPDLSSFTGSGVIQKLYSLYQAIRPVRFTSKGLNRKLNSRHRSRSSPD

SEQ ID NO: 223277 - protein, 415 aa, Glycine max
  Coding DNA Sequence Number=SeqID_106499
  Gene Ontology: Mol. function=nucleoside-triphosphatase activity; Cellular component=excinuclease ABC complex; Biological process =nucleotide-excision repair
  Homolog annotation: Hit_ID=Q7WG87; Match level="QueryCoverage=99%, HitCoverage=99%, E-value=0.0, Identity=59%"; Hit description =Putative excinuclease ABC subunit
MLGVVREQARIGLGEAGAARGAGALDREVLLLQFAVQRLVQLVHRPHHRHHALAVFQRALDRGAQVGLVGRVDHHVGHGQFDGVFLVAVQARPRRHRDEFAVDPQVRVALGASPLGQVGVVALARGDQRRQQADVLALALAQQARHDLVGVLRFDRDVAVRAVLRAQFHVQQPQEVVDLGHRGHGRLASAAAGALFDGHGRRDAEDGVHVGLAGRLHDGAGVGVERFEIAALAFVEEDVEGQGRLARAGHAGDHRELVARDLDADVLQVVLARIADLDRHVVLAALAHDGLQRRAFAGAVGGIRFGDAGRQAGLFDFLRVDVAGHDHVGRQDADLVVAQRRAGVRGGGGHQVLRRADADHQAAGVAAFRPQVDQPVGRADDVQVVLDDQQRVARGQQLAEGAHQARHIVEVQAGG

SEQ ID NO: 223278 - protein, 269 aa, Glycine max
  Coding DNA Sequence Number=SeqID_106500
  Homolog annotation: Hit_ID=Q47522; Match level="QueryCoverage=23%, HitCoverage=83%, E-value=8e-21, Identity=73%"; Hit description=LacZ protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNASVFPVTTLNSIDHDRGGENGGDGRGHAELPDGAIGNIGINNKAKIPVDRRQAGNGNETIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 223279 - protein, 207 aa, Glycine max
  Coding DNA Sequence Number=SeqID_106501
MTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPGPRRTRTRASASASEAPLPTQSPSQPSQRPRHPPASTSASMDMHGQMLRWIPRSPLQRPIVSESPGQETSPPLTGGKSLLEPLRILQSMRTSLLT

SEQ ID NO: 223280 - protein, 134 aa, Glycine max
  Coding DNA Sequence Number=SeqID_106502
  Gene Ontology: Mol. function=ATP binding; Biological process=defense response
MEGNLKLSKLDGGNKEDHTSFEIVVGNLRNVNKQVIVTLSTCEVEYVVATSCICLRRLKEFNMDQEKSIKIHIDNKSAQVLAKNMMFYEQSKHIGTIYHFIRECVARKEVELVHVRTQDQVADISRNSSNLKIL

SEQ ID NO: 223281 - protein, 153 aa, Glycine max
  Coding DNA Sequence Number=SeqID_106503
MPISPADVSVGLCRHDIGKDRAHKMPSGPEEVQQDLGVSSSGYGPLSVLQGARSPSEESHPQRHPVDPEKSNRALGFPALVTGLCSPTGCPFPPARSRHHSSTEYLSPPARASGPLLIELSSRSTTLPGRRKAKHHNSLGMVGSGQQTHCHHL

SEQ ID NO: 223282 - protein, 127 aa, Glycine max
  Coding DNA Sequence Number=SeqID_106504
MMNGLATTDILMWIVWSYLSMPFYSGGMINDKDGSQSQSSQSNVDCYCLTVGTVDEIIIDAPWSCDSCPNCTTTFDPSKGGSACRSCHTSVVDTVPRLAMIIFCTDYLFTRFAVLANFPEISMDVKV

SEQ ID NO: 223283 - protein, 145 aa, Glycine max
  Coding DNA Sequence Number=SeqID_106505
MVHVDPTTSKADGPQKKKLQTYLGIVAHDKVEFEIPETSDNRTKKKVLQTMGDKDGVDNTVYEKYSISKEKWAQFCQTHRDPSWEDVRKKVQAIQKQNTAPHVLCRGGYDYLEQKLMAEKTKKKLEEAAQSGSTEGVINPPSPIR

SEQ ID NO: 223284 - protein, 93 aa, Glycine max
  Coding DNA Sequence Number=SeqID_106506
LGRIDGDPVLRETRIWATWEYVSSVGGGQQGMSGTWRYVAGVRRPWGRQASSWQSTDKRKTRPQSKEACGSWPAGAKMVSGNRLPGDVIDYQA

SEQ ID NO: 223285 - protein, 96 aa, Glycine max
  Coding DNA Sequence Number=SeqID_106507
MRVEDFVLYQILKVGFKDSTPIKVFLSMRWSRGKQWRLVPITGGRGWWRRRVRDLVVLGRERERKTCFLSLMNVFIIYISLSEIQLLLLSVKFHTK

SEQ ID NO: 223286 - protein, 109 aa, Glycine max
  Coding DNA Sequence Number=SeqID_106508
  Gene Ontology: Mol. function=RNA-directed DNA polymerase activity; Biological process=RNA-dependent DNA replication
MADSLNETTKRVIKNGSNGKKIEAIIAAVNKIEMTTVTENEEGMATKEFKDCFGWDYGGMLGLNKDFMEHRLPIQEERKHVKQEPRRFSPNVMEAIKEEIERLLNAKFI

SEQ ID NO: 223287 - protein, 142 aa, Glycine max
  Coding DNA Sequence Number=SeqID_106509
MNNINISNNDRDTSGGHGGNGNSGDGSGGRGDIGGGSDVDGGGSDDVVVVAVMDMVLILVVATTIMVMVVGGNDVVVGNKWWQCGGVCDNVGGGCGGSDNDKGGIIGSSGDNNGVNGIDGGGGSDSNGGNDGCNTHEYRLSK

SEQ ID NO: 223288 - protein, 133 aa, Glycine max
  Coding DNA Sequence Number=SeqID_106510
MGVDLGNFESKTEFLAFGNIEKHIWIFEVESFMRINMYFEEGTNEQDSEIVSNSSSEHVEVISPALMSPRLVFPKSQAPPGLDLVDLVSEDEGEELEENTSFEKDPSMDEEVPTIEPELMEQDSSQDSFEEPY

SEQ ID NO: 223289 - protein, 167 aa, Glycine max
  Coding DNA Sequence Number=SeqID_106511
MEDRQIELEALEKAIQEGLGLLIIIRRKKKCRNLPKIYAHALLLSSNTEAYDKMQGELVKARASLTKILTSKDAKVTVLLEFKEYATEVVHTSEWVGLWDCKDGLNFLKNEYATIVQLFNCSIVRSFRLTRMMTFMKHPLYYRLCDGRTREVRPKISCSSKVDVMSS

SEQ ID NO: 223290 - protein, 154 aa, Glycine max
  Coding DNA Sequence Number=SeqID_106512
  Gene Ontology: Mol. function=hydrolase activity, hydrolyzing O -glycosyl compounds; Cellular component=cell wall; Biological process= carbohydrate metabolic process
  Homolog annotation: Hit_ID=Q8GTJ0; Match level="QueryCoverage=96%, HitCoverage=51%, E-value=5e-52, Identity=65%"; Hit description =Xyloglucan endotransglycosylase
  Pfam annotation: Domain name=Glyco_hydro_16; Domain location=26-154; Score=142.2; E_value=1.4e-39; Accession=PF00722.11; Description =Glycosyl hydrolases family 16
MASSYVLFMLSLSCLASTTIALGGNFNTDFNILFGDSRANIQDGGSSMSLAMDKSSGSGIATKNEYLFGRFDMQIKLIPGNSAGTVTTFYLSSQGPNHDEIDLEFLGNLSGDPYILSTNYYANGTGGREMQFYLWFDPTQDFHTYSIDWNTQRI

SEQ ID NO: 223291 - protein, 50 aa, Glycine max
  Coding DNA Sequence Number=SeqID_106513
MVSKNDRSQGITPNSSPHKKITQKHSPKFRIIWGIDLSGSMSTLLQPKKG

SEQ ID NO: 223292 - protein, 214 aa, Glycine max
  Coding DNA Sequence Number=SeqID_106514
  Gene Ontology: Mol. function=binding
  Homolog annotation: Hit_ID=Q1SBZ0; Match level="QueryCoverage=80%, HitCoverage=17%, E-value=3e-37, Identity=49%"; Hit description =Tetratricopeptide-like helical
MRVLAVLSRFIKANKAQECLNQMLQIDGSSSGMLILFKHHRTLDIAKTVIKEKSYVYSKTDQIICLFKDGKLEEVVIHANSVSDLYNVVGEDFWSSTWCNSTAFEGKQLEGTRITLVKMGSLVLTLQLEHLVHLLDGRIMMQKCQWHGKLSAMLTVVKIMGLLILTCLKMYNFMLLSRGSAVVGFVVMLGLLLAANMEFTGSIPQGFQVDGNPF

SEQ ID NO: 223293 - protein, 377 aa, Glycine max
  Coding DNA Sequence Number=SeqID_106515
  Gene Ontology: Mol. function=binding
  Homolog annotation: Hit_ID=Q1SBZ0; Match level="QueryCoverage=98%, HitCoverage=40%, E-value=1e-99, Identity=52%"; Hit description =Tetratricopeptide-like helical
  Pfam annotation: Domain name=TPR_1; Domain location=25-58; Score =25.2; E_value=0.00024; Accession=PF00515.18; Description =Tetratricopeptide repeat
  Pfam annotation: Domain name=TPR_1; Domain location=286-319; Score =29.8; E_value=9.6e-06; Accession=PF00515.18; Description =Tetratricopeptide repeat
  Pfam annotation: Domain name=TPR_1; Domain location=59-92; Score=9.8; E_value=0.37; Accession=PF00515.18; Description=Tetratricopeptide repeat
  Pfam annotation: Domain name=TPR_2; Domain location=25-58; Score =12.0; E_value=1.3; Accession=PF07719.7; Description=Tetratricopeptide repeat
  Pfam annotation: Domain name=TPR_2; Domain location=286-319; Score =24.5; E_value=0.00037; Accession=PF07719.7; Description =Tetratricopeptide repeat
  Pfam annotation: Domain name=TPR_2; Domain location=59-92; Score =16.0; E_value=0.14; Accession=PF07719.7; Description=Tetratricopeptid e repeat
  Pfam module annotation: Pfam domain module=TPR_1::TPR_1::TPR_1::TPR _2::TPR_2::TPR_2; Domain location=25-58::286-319::59-92::25-58::286 -319::59-92
MAPATSQRAELARVFDSFVSQSGAIKDICNRAFCYSQLELHKHVIKDCDKALQLDPSRLQAYILKGHALSALGRKIDALSVWEQARRAFDNNKTTPNNAFYETNGSPVPQSESDSMSNGNLTEICKNQDSLSPQDELCDNTSDKSLILLKSADNFDLRNELNSEDRESNKSDGQVNGSTDVIDKLSYNSESCNNLSDTSESRDKDKVVASLVVTHLMLLKFLESQVTKSVSVDFQLSQGIAEGNMLTPYPFLISCNGLLPSDIWGVSFYLLVSDTCDILKEDPAYPEALIGRGTAYAFKRELDAAMADFSKAIEFNPSAGEAWKRRGQARAALGGVCGGIANFKFKEFDAAVEDLSACVQLGRDNESAYTCLVGPES

SEQ ID NO: 223294 - protein, 606 aa, Glycine max
  Coding DNA Sequence Number=SeqID_106516
  Gene Ontology: Mol. function=binding
  Homolog annotation: Hit_ID=Q6L4Y6; Match level="QueryCoverage=89%, HitCoverage=89%, E-value=1e-143, Identity=49%"; Hit description =Putative tetratricopeptide repeat (TPR)-containing protein
  Pfam annotation: Domain name=TPR_2; Domain location=429-462; Score =12.6; E_value=1.1; Accession=PF07719.7; Description=Tetratricopeptide repeat
  Pfam annotation: Domain name=TPR_2; Domain location=468-501; Score =3.8; E_value=12; Accession=PF07719.7; Description=Tetratricopeptide repeat
  Pfam module annotation: Pfam domain module=TPR_2::TPR_2; Domain location=429-462::468-501
  Subcellular localization annotation: CTP_CleavageSite=38; ConfidenceScore=5.14e-01
MEYQLPQNPPTNTKTHKSTPPIPTYTNNYCSCFFCIIMSETVPPLRRAKIARYFKQMPLTDDQEHILALSGLWKIAITNPNDPEFPSLGIFRCMAKLIQKGVNHKDWLLRGQNMYIPYYAAHIIGSYTMNKAKFADKAVKFNVVPPLMELLRGKISWVEQRVALRALGHLASHEATFEAVSEHEAEVVEAAIKIASTCLKEVFEKFVVLKESERLEYHRNLLTRGHADLELENRKAEEWASQLQCWSLYLLDCFACRERSMGLICKKKFLKDLCGMWGGLANPTSPSGIGLLSTLCGTQIGRESVADLEEVVVNLCNVSRSSDDRQHMAIDSLLQLLRDPVTRYKVIDTTVPVLADLVELRSLGGKPNVGQEIMQTLLQDYHKVKFGELKLKSEKTKRALEELWDLKVERVKKQSLMSEQEIREKEVLAGILKQEGNREFGSREIEKAVVKYTEALDLCPLKSKKERIVLHSNRAQCHLLLRDPEAALSDTTRALCLSSVARTACLHSKSLWRRSQAYDMKGLAKESLMDCLMFISNRFGSSTQRKGFKIPHYAARMVNKQMNATWLFASAKSSWKKVAREEVKEFMVQNKIDSLRLRKKTRRRTS

SEQ ID NO: 223295 - protein, 299 aa, Glycine max
  Coding DNA Sequence Number=SeqID_106517
  Gene Ontology: Mol. function=hydrolase activity; Biological process =aromatic compound metabolic process
  Homolog annotation: Hit_ID=Q1SBZ4; Match level="QueryCoverage=91%, HitCoverage=89%, E-value=1e-137, Identity=86%"; Hit description =Alpha/beta hydrolase fold
  Pfam annotation: Domain name=Abhydrolase_1; Domain location=44-262; Score=43.2; E_value=8.7e-10; Accession=PF00561.10; Description =alphabeta hydrolase fold
MGIAAEAHNVKILGSGTEYIVLAHGFGTDQSVWKHFVPYLVDNFRVILYDNMGAGTTNPDYFDFERHSILEGYASDLLAILEELQVESCIFVGHSVSAMIGAIASISRPDLFTKLIMVGASPRYLNDVEYYGGFEQEDLDQLFDAMAANYKAWCYGFAPLAVGGDMESVAVQEFSRTLFNMRPDIALIVSRTIFQSDMRQILSLVSVPCHIIQAEKDMAVPMMISEYLHQHIGAESIVEVMATDGHLPQLSSPDTVIPVLLKHIQLDIEARSCDNQAKEALRIDLGLCHLSFLMDFDNR

SEQ ID NO: 223296 - protein, 691 aa, Glycine max
  Coding DNA Sequence Number=SeqID_106518
  Gene Ontology: Mol. function=pepsin A activity; Cellular component =cellulose and pectin-containing cell wall; Biological process =proteolysis
  Homolog annotation: Hit_ID=Q1SED9; Match level="QueryCoverage=99%, HitCoverage=100%, E-value=0.0, Identity=66%"; Hit description =Peptidase aspartic, active site
  Pfam annotation: Domain name=Asp; Domain location=92-479; Score= -31.6; E_value=9.5e-12; Accession=PF00026.14; Description=Eukaryotic aspartyl protease
MASLWTQLISTVSLILSLARWVAVSGDSGNVLLFPSRHHEGSRPAMILPLHHSVPESSLSHFNPRRHLQGSQSEHHPNARMRLFDDLLRNGYYTTRLWIGTPPQRFALIVDTGSTVTYVPCSTCKHCGSHQFLLARGDQTLNLSPLSFFLNHPTNLISPVIGSLIYLNSRCLLLGMKDPKFRPEASETYQPVKCTWQCNCDDDRKQCTYERRYAEMSTSSGVLGEDVVSFGNQSELSPQRAIFGCENDETGDIYNQRADGIMGLGRGDLSIMDQLVEKKVISDAFSLCYGGMGVGGGAMVLGGISPPADMVFTHSDPVRSPYYNIDLKEIHVAGKRLHLNPKVFDGKHGTVLDSGTTYAYLPESAFLAFKHAIMKETHSLKRISGPDPHYNDICFSGAEINVSQLSKSFPVVEMVFGNGHKLSLSPENYLFRHSKVRGAYCLGVFSNGNDPTTLLGGIVVRNTLVMYDREHSKIGFWKTNCSELWERLHVSNAPPPLMPPKSEGTNLTKAFKPSVAPSPSQYNLQLGELQIAQLIVVISFNISYMDIKPYITELTGLIAHELDVNTSQVHLMNFSSLGNGSLSRWVITPRPYADFFSNATAMSMIARLSEHRMQLPNSFGSYKLLEWNAEPPLKRTWWQQYYLVVALAVSLTLVLGISALGIFLIWKKRQQAEHSYKPVDVAVQEQELQPL

SEQ ID NO: 223297 - protein, 512 aa, Glycine max
  Coding DNA Sequence Number=SeqID_106519
  Gene Ontology: Mol. function=transporter activity; Cellular component= membrane; Biological process=transport
  Homolog annotation: Hit_ID=Q7X9B8; Match level="QueryCoverage=96%, HitCoverage=96%, E-value=0.0, Identity=80%"; Hit description=Ferrous ion membrane transport protein DMT1
  Pfam annotation: Domain name=Nramp; Domain location=68-431; Score =751.8; E_value=4.3e-223; Accession=PF01566.9; Description=Natural resistance-associated macrophage protein
  Pfam annotation: Domain name=YibE_F; Domain location=122-315; Score= -152.1; E_value=0.098; Accession=PF07907.2; Description=YibEF-like protein
  Pfam module annotation: Pfam domain module=Nramp::YibE_F; Domain location=68-431::122-315
MPPEQTQQPLLSEEQEETAYDSSEKVVVVGIDDHDGDVEAPPFSWRKLWLFTGPGFLMSIAFLDPGNLEGDLQSGAIAGYSLLWLLMWATAMGLIIQLLSARLGVATGRHLAELCREEYPTWARIVLWLMTEIALIGADIQEVIGSAIAIRILSNGVVPLWAGVVITAFDCFIFLFLENYGVRKLEAFFAVLIGVMALSFAWMFGEAKPNGVDVLVGILVPKLSSRTIQQAVGVVGCIIMPHNVYLHSALVQSRQVDPSKKGRVQEALNYYSIESTIALIVSFVINIFVTTVFAKGFYGTEIANSIGLVNAGQYLQEKYGGGLFPILYIWGIGLLAAGQSSTITGTYAGQFIMGGFLNLRLKKWIRALITRSFAIIPTIIVALIFDTSEESLDVLNEWLNVLQSVQIPFALIPLLCLVSKEQIMGSFRIGPVLKIISWLVAALVIVINGYLLLEFFSSEVNGAVFATVVRNYAEGSGTLLVVILQQNKSIMYLYFCQNSMHNAAVSMPWILR

SEQ ID NO: 223298 - protein, 376 aa, Glycine max
  Coding DNA Sequence Number=SeqID_106520
  Homolog annotation: Hit_ID=Q019U2; Match level="QueryCoverage=69%, HitCoverage=78%, E-value=1e-20, Identity=26%"; Hit description =Homology to unknown gene
  Subcellular localization annotation: CTP_CleavageSite=65; ConfidenceScore=5.33e-01
MGCPFASRDSTQHFRGSAHFGDSTPMLKRGYKPKPWSGAQNCRVSVFLMFFTLVLMLVVFLLVFRYDSDGANPILAYELPKQKWNSFDSLVHLHPTKEFRNETDLIWQVPESPKGVLFLAHGCNGRAINFWDKSPKCPDCIGLPEERLLVLHGLAQGFAVITISSAQRCWTFGKEVLVVKDIIEWWIGRKKLEKLPLVALGASSGGYFVSVLATAMKFSSTVLMIAEGMFEQIDVKGDYPPTLFVHMPKDLYRQQKIDEYVEVLKDKGIDVGVVECLEFPLSPSTLADRIPGLDQALSRNLFEFFQEKGFIDKNGYMRKDGRQIKWKKAFEEKKALLLDKNLVPHIQEELNLAFAYHEMTSVHSDQIFKWLETHMS

SEQ ID NO: 223299 - protein, 84 aa, Glycine max
  Coding DNA Sequence Number=SeqID_106521
  Subcellular localization annotation: CTP_CleavageSite=68; ConfidenceScore=5.61e-01
MKFYVSAKGIKRVVAGKGSAKTTAPAYTVAARRISNRMVVVLGIVLLLSFVRVAVLVLESSAVCSTFVASSVRKTVECGTSTYE

SEQ ID NO: 223300 - protein, 439 aa, Glycine max
  Coding DNA Sequence Number=SeqID_106522
  Homolog annotation: Hit_ID=Q9SJG4; Match level="QueryCoverage=46%, HitCoverage=79%, E-value=6e-58, Identity=55%"; Hit description =Putative DNA binding protein
  Pfam annotation: Domain name=DUF296; Domain location=261-378; Score =183.5; E_value=5.3e-52; Accession=PF03479.5; Description=Domain of unknown function (DUF296)
MGTAYEHFGMSSVAGKQLTNNNMVRLWNTRPDLDHVKIPKARESSTVMHNKKSRRDCETKAPSHVGNANKAGSLHDSPPLHLPPFSQPVLQCIIRQSSLNLRTRQTQNKTSSSKENFKICHLTEASQNLIALEGILLGHASSLSPHELKSTNNPKFPSGRMVQCKNLSIKTERFALCYCTFSSKCLMFGEMDRKQEQDKGNSNMSGIDVALISPKVPKAVSPVSSAAAEGDTLRRPRGRPAGSKNKPKPPIIVTRDSANALKAHAMEVSSGCDVNESLLNFARRKQRGLYILNGTGCVTNVTLRQPGSAGAIVTLHGRFEILSLLGSILPPPAPPGITGLTIYLAGAQGQVVGGAVVGALIASGPLVIMAASFMHATFDRLPLEDDELAAAMQNQHYQNGRTHHLDISDLYAIPQNLLMNGTMPPEIYSWAPGRNFSKT

SEQ ID NO: 223301 - protein, 145 aa, Glycine max
  Coding DNA Sequence Number=SeqID_106523
  Homolog annotation: Hit_ID=Q1SW35; Match level="QueryCoverage=71%, HitCoverage=19%, E-value=2e-37, Identity=75%"; Hit description=IMP dehydrogenase/GMP reductase
MVCSLDSAFYQVNGFSILFMEVKIMNTYEVELMFMNRRNHEDLHLFTIILNQEIRRLSTQVIRVKWSLHAREEIVFELLQQLRGNAAIVLLEGVMKSTRQMIEEQEAVRGRLFITQNVMQSSVWAWLQESLLSSCSRKEADSPNR

SEQ ID NO: 223302 - protein, 214 aa, Glycine max
  Coding DNA Sequence Number=SeqID_106524
  Gene Ontology: Mol. function=structural constituent of ribosome; Cellular component=intracellular; Biological process=translation
  Homolog annotation: Hit_ID=Q9FN19; Match level="QueryCoverage=79%, HitCoverage=26%, E-value=1e-49, Identity=62%"; Hit description =Arabidopsis thaliana genomic DNA, chromosome 5, TAC clone:K8K14
  Pfam annotation: Domain name=WD40; Domain location=104-142; Score =50.0; E_value=8.1e-12; Accession=PF00400.22; Description=WD domain, G-beta repeat
  Pfam annotation: Domain name=WD40; Domain location=163-201; Score =26.8; E_value=7.5e-05; Accession=PF00400.22; Description=WD domain, G-beta repeat
  Pfam module annotation: Pfam domain module=WD40::WD40; Domain location=104-142::163-201
MVNERRKILQKNRNKESEKENEGGRGWLKEKGRHEREKECERDGEKAENLKELEQQHYNQSCREMVIDQEDLVTVKHAENKAFGGTEPMDVSTTSTLQPCQIPRSDVIVLEGHTSEVCACAWSPTGSLLASGSGDSTARIWTIAEGRCKSALLNGPPNVLVLKHVRGKTNEKSNDVTTLDWNGEGTLLATGSYDGQARIWTTNGRSFLISPTLQ

SEQ ID NO: 223303 - protein, 89 aa, Glycine max
  Coding DNA Sequence Number=SeqID_106525
MKEKGRYDELERKKGKMVVLWVNHATKSIYSGSGRLCEVVRDKGEGLRKQKWGVVRESVGGCKQEKEQKGGEKVTKKVENEVKEELFGI

SEQ ID NO: 223304 - protein, 540 aa, Glycine max
  Coding DNA Sequence Number=SeqID_106526
  Gene Ontology: Mol. function=1-acylglycerol-3-phosphate O -acyltransferase activity; Cellular component=integral to membrane; Biological process=phospholipid biosynthetic process
  Homolog annotation: Hit_ID=Q9SHJ5; Match level="QueryCoverage=98%, HitCoverage=99%, E-value=1e-174, Identity=56%"; Hit description =Glycerol-3-phosphate acyltransferase 1
  Pfam annotation: Domain name=Acyltransferase; Domain location=324 -443; Score=37.8; E_value=3.6e-08; Accession=PF01553.11; Description =Acyltransferase
MVFPMVLLRLADWVLYQLLANSCYRAARKMKSYGFHLGYLSSKPPLQPSSFPSVTKCDLEGRGSQTLVACDIHRVLLRSHSFFPYFMLVAFEGGSILRALLLLLSCPVLWILDHELSLRVMTFITFCGLRTSAMENMSRAVLPKFYLENLNLHAYEVLASAGSKVVFTSVPRVMVEGFLREYLSVGAVVGTELHSVGCYFSGLVSGSGLLVKHRALKDYFGDRKPDIGVGSSSVHDHLFLSLCKEAYVVNNEEGKGNPSSVLPRDKYPKPLIFHDGRLAFLPTPSATLYMFMWFPLGILLAIYRILLGILLPYGWAMALGVWSGINLQVKGNVLEEKSEQNKGVLFVCSHRTLLDPVFLSTCLAKPLTAVTYSLSKVSELIAPIRTVRLTRDRRKDGETMQRLLKEGDLVVCPEGTTCREPYLLRFSSLFAELADEIVPVAVNSHVSMFYGTTASGLKCLDPIFFLMNPRPSYYIEVLGKVPKELTCAGGRSSCEVANYIQQKLACALGFECTTLTRRDKYMMLAGNEGIVHEDKWRKCY

SEQ ID NO: 223305 - protein, 255 aa, Glycine max
  Coding DNA Sequence Number=SeqID_106527
  Gene Ontology: Mol. function=catalytic activity; Cellular component =membrane; Biological process=carbohydrate metabolic process
  Homolog annotation: Hit_ID=Q8RZK0; Match level="QueryCoverage=53%, HitCoverage=48%, E-value=2e-36, Identity=54%"; Hit description=Beta 1,3-glucanase-like
  Pfam annotation: Domain name=X8; Domain location=109-193; Score =166.3; E_value=7.7e-47; Accession=PF07983.3; Description=X8 domain
MLWTYSTEQSNSVVISNTGSSRTQKEVPGHVNVLGHDQGKQEFTASISTVQRDITTPITTIPNLVPTTPTISTSPFLNPNSNPDTVSPASTIPFTTPTTVNSPISSGASWCIASPTASQTTLQIALDYACGYDGADCSAIQPGGSCYNPNSIRDHASYAFNKYYQKNPVPNSCNFGGTAVIISTNPSTGACEYPSTSTSTSVLNTTNSSGANVFGSVPVPTEPSPSAAAAPDTLNGFADICIVLWIISTLQRNYL

SEQ ID NO: 223306 - protein, 537 aa, Glycine max
  Coding DNA Sequence Number=SeqID_106528
  Gene Ontology: Mol. function=DNA primase activity; Cellular component= alpha DNA polymerase:primase complex; Biological process=DNA replication, synthesis of RNA primer
  Homolog annotation: Hit_ID=Q9FJ26; Match level="QueryCoverage=76%, HitCoverage=90%, E-value=1e-117, Identity=54%"; Hit description=DNA polymerase alpha subunit IV (Primase)-like protein
  Pfam annotation: Domain name=DNA_primase_S; Domain location=206-455; Score=136.7; E_value=6.5e-38; Accession=PF01896.9; Description=DNA primase small subunit
MSSNNPIGIACIIFQAIGMNTIGTKYVTFLIKQQRLRPISVSVPATFILIFPPSRSHTNHFALDFSVSHLANTILRLIQFIISVAKQMIPHQEPDFNLNHLKLYYGKLFPFVDLVRWVSYGNDGKHPGCDQSYIGRREFSFTLENDIYLRFQSFHNAHELENSIKEKCPVKIDIGPVYTVDPAKRNAYAQSGDNNVFAPVERELIFDIILLFGCADVCLVCWPLMTTAIKVIDTALRDSSTSHITYKDHGVDMTLVSNTFSGYIVGAEVFIVGSVMERQEGCLHLYRLTNEQRGAIADYFRVYKGNENSHKKVSLMGAALHPFLATSYTNVLKDYFEKNLLTGQNLLATEERYEKILGMIPDESIASELRGRWQDSRRSSSAKEDINVVRWEQCKQLLQSGKHKAQGLRRCIEEIVFCFTYPRLDMEVSKHMNHLLKAPFCVHPKTGRVCVPIDPKRCEEFDPTTVPTLSQGEKNFPKRCLVQWLIEELNYEGSRADVDGGGDRKFLLLKIAAVKEFPCLVVPPILDLSNRAVLGSH

SEQ ID NO: 223307 - protein, 265 aa, Glycine max
  Coding DNA Sequence Number=SeqID_106529
  Gene Ontology: Mol. function=unspecific monooxygenase activity; Cellular component=integral to membrane; Biological process=electron transport
  Homolog annotation: Hit_ID=Q9XFX1; Match level="QueryCoverage=99%, HitCoverage=69%, E-value=2e-45, Identity=60%"; Hit description =Cytochrome P450
  Pfam annotation: Domain name=p450; Domain location=1-265; Score= -177.0; E_value=0.0065; Accession=PF00067.12; Description=Cytochrome P450
MLLAASYGDHWRNLRLEILSTHRLNFFLEIRNDETLKLLRNLAMASNNKKDLTKVEFRSMLEDLTFNIIMRMVCVKRYYGEENEGTIAEEANKFRDIMNEMAQFGLGSNLGDFVPVFEMVRFGWWPQEATKNWGEEDALFQGLINEHRNKNENSNTTMYLQNLISETLRLHPPAPLLQPHFSSEDCTVRGFGVARNTILFVNAWTIHGDPELRTDPKCFKPERFENGPIDTHKLMPFGLGRRACPGGGMAPRTLGLTLVSLIQCF

SEQ ID NO: 223308 - protein, 273 aa, Glycine max
  Coding DNA Sequence Number=SeqID_106530
  Gene Ontology: Mol. function=RNA-directed DNA polymerase activity; Cellular component=nucleus; Biological process=RNA-dependent DNA replication
MLGGPFKEEEIRAAVWSCGSEKSPGPDGLNFKFIKQFLEVLNPDISRFLDEFHANGIFPRGSNKSFVALIPKVKDPQNLNEYRPISLIGCIYKIVAKLLANRLKLVMPDIIDERQSTFISGRHLLHNVLIVNEVVEEAKRHQKPCLVFKVDYERAYDSVSWAFLSDMMKRLGFCNKWICWIEGCLKSASISVLVNGSPTNEFLPQRGLREGDPLAPLLFNIVAEGLTGLMREALDKGIYSSFLVGKNNTPANILQYADDTIFWGSYNAKCQDN

SEQ ID NO: 223309 - protein, 628 aa, Glycine max
  Coding DNA Sequence Number=SeqID_106531
  Gene Ontology: Mol. function=protein serine/threonine kinase activity; Cellular component=nucleus; Biological process=protein amino acid phosphorylation
  Homolog annotation: Hit_ID=Q9SJG9; Match level="QueryCoverage=99%, HitCoverage=98%, E-value=0.0, Identity=64%"; Hit description=Mitogen- activated protein kinase 20
  Pfam annotation: Domain name=Pkinase; Domain location=15-306; Score =296.1; E_value=6.4e-86; Accession=PF00069.15; Description=Protein kinase domain
  Pfam annotation: Domain name=Pkinase_Tyr; Domain location=15-304; Score=31.8; E_value=2e-14; Accession=PF07714.7; Description=Protein tyrosine kinase
  Pfam module annotation: Pfam domain module=Pkinase::Pkinase_Tyr; Domain location=15-306::15-304
MEMEFFSDYGDVSRYKIQEVIGKGSYGVVCSAIDTHTGEKVAIKKIHDIFEHVSDAARILREIKLLRLLRHPDIVEIKHVMLPPSRRDFKDIYVVFELMESDLHQVIKANDDLTKEHYQFFLYQLLRALKYIHTANVYHRDLKPKNILANANCKLKICDFGLARVAFNDTPTTVFWTDYVATRWYRAPELCGSFYSRYTPAIDIWSIGCIFAEVLIGKPLFPGKNVVHQLDLMTDLLGTPSLDTISKVRNDKARRYLTSMRKKQPIPFAQKFPNADPLALRLLERLLAFDPKDRPTAEEALADPYFKGLSKIEREPSCQPITKMEFEFERRRVTKEEIGELIFREILEYHPQLLKDYINGTERTNFLYPSAVDQFKQQFSHLEENGGKSYPIMPLERKHASLPSSYGYGYLNNQIMNSVRHNSIPQNSLVRSTMVHSNMVPSKEQSNIASCINRQTTGEFNNNSRDTESPAPRSIPGLQKFSQAKPGKVVGPVIPYEYASVVKGTYDPRTFMRGSVLPSQPILPTNHYQRSTSGKQERSATEADKGVSLQSKLAQQCGVNAKIAPDTAINIDTNPFFMTRAGVNKIEQDDRIAIETKLLQSKAHQYGGISTTAHRKVGPVQYGMTRLF

SEQ ID NO: 223310 - protein, 233 aa, Glycine max
  Coding DNA Sequence Number=SeqID_106532
  Gene Ontology: Mol. function=nucleic acid binding; Cellular component= intracellular; Biological process=regulation of transcription
  Homolog annotation: Hit_ID=Q9M202; Match level="QueryCoverage=94%, HitCoverage=66%, E-value=1e-34, Identity=40%"; Hit description=Zinc finger protein-like
  Pfam annotation: Domain name=zf-C2H2; Domain location=110-132; Score =21.4; E_value=0.0033; Accession=PF00096.16; Description=Zinc finger, C2H2 type
  Pfam annotation: Domain name=zf-C2H2; Domain location=164-186; Score =19.6; E_value=0.011; Accession=PF00096.16; Description=Zinc finger, C2H2 type
  Pfam module annotation: Pfam domain module=zf-C2H2::zf-C2H2; Domain location=110-132::164-186
GLGFEHESTKKCKTESWVDHDPASSVSDATTEEDVAFCLMMLSRDKWKRQRDQDQPCRFAERENQYEVEDQEEEDDEEDEEDEDDEEAFEESEESQETSKQCKNRVRGRYKCDTCNKVFRSYQALGGHRASHKKIKVNGGGREQELEHNKKKSGTCVVVEKKTHECPVCFRVFASGQALGGHKRTHVTGSAATAAAIATTLPSSSAKFGNSFIDLNLPAPIDEDDASQIENSA

SEQ ID NO: 223311 - protein, 379 aa, Glycine max
  Coding DNA Sequence Number=SeqID_106533
  Gene Ontology: Mol. function=protein dimerization activity; Biological process=DNA integration
  Homolog annotation: Hit_ID=Q2R1C3; Match level="QueryCoverage=98%, HitCoverage=61%, E-value=7e-62, Identity=34%"; Hit description=HAT family dimerisation domain containing protein
  Pfam annotation: Domain name=DUF659; Domain location=49-164; Score= -69.3; E_value=0.092; Accession=PF04937.6; Description=Protein of unknown function (DUF 659)
MDKQAALKIERMFYSSGLPFHLARNPHYRKVFSFAANKNCLSGYQPLGYNNLKRTLLANEKRHVENLLQPIKNIWKEKGVSIALDCSDEVKDMDFKDEQMMDVIMEVGHSNIVQIVTDNAHKFYHGHYMRLSMFNSFNTLKLLALVPTRFASPILMLKRFKNLKKGLQEMVISEQWSSYKAYDINKAKFVKETLFDDIWWNKVDYILSFTTLIYDVLRKTNMDATSHHLVYEMWDSMIENVKKVIYRHERKGEGEESIFYKVVHEILIDCWTKSSSPLHCLAHSLNPRISPHQDGELTRERLKCFKRYFDDDNERRQVNAEFANFFGEREGFDDIDSLRDKGIMETKSWWLVHGAYALTLQKISLKLLRQPCSSWYFFR

SEQ ID NO: 223312 - protein, 111 aa, Glycine max
  Coding DNA Sequence Number=SeqID_106534
  Gene Ontology: Mol. function=nucleic acid binding; Cellular component= intracellular; Biological process=chromatin modification
  Homolog annotation: Hit_ID=Q4U315; Match level="QueryCoverage=99%, HitCoverage=31%, E-value=3e-15, Identity=40%"; Hit description =Cys2/His2 zinc-finger transcription factor
  Pfam annotation: Domain name=zf-C2H2; Domain location=4-26; Score =19.5; E_value=0.012; Accession=PF00096.16; Description=Zinc finger, C2H2 type
MDRHKCKLCFRSFANGRALGGHMRSHMMNLPISKPEELASSRTIQLSFEAESASSSSSSSSDEEDEDDEKTLCYDLRENPKLSIHLVDPEFSFATAADTGSVILHDRESES

SEQ ID NO: 223313 - protein, 228 aa, Glycine max
  Coding DNA Sequence Number=SeqID_106535
MGDAVAMMDIPSGGNRMGKYLYFGACHSVWNSLMTQADHQGGELSVLDRDLLVSKPSSTHYTEVVEVALETSFQGLEIANATYVKKRKIIPKFQPSRASMMVAKVMLENGYHYGGGLGRNAQGSIVVVEQDTFEDEQVNLVHACPSNFECLNNHADEKIEDGLGPSLELLRLVDQEAKEISPHEEFIEVINLGNEEGRKEIKIGTLMKESESHQLIKLLCDYNDVFAW

SEQ ID NO: 223314 - protein, 147 aa, Glycine max
  Coding DNA Sequence Number=SeqID_106536
MAGRNDHGWIASNETIHLLSMEDTTLMKKKLSIDGKTLANAWRLKGNMIVAEYAVMFEELVRYFPHYQRRDGEIGGLVGACVLSAILARLARISEFRLSAHLFAYRMDSSGALSGISPRSANMHNSSFFQILPRAQPQEWCAQRMAR

SEQ ID NO: 223315 - protein, 87 aa, Glycine max
  Coding DNA Sequence Number=SeqID_106537
MGMGMTMMGTTVVATLTRGDDNDTKKGTKVPGFDAGAGCWACFELLMQLPVRYMGLDVAVGVVFKLGCRCWCCFQAKMLGVDAGFRL

SEQ ID NO: 223316 - protein, 170 aa, Glycine max
  Coding DNA Sequence Number=SeqID_106538
  Gene Ontology: Mol. function=ribonuclease H activity; Cellular component=mitochondrion; Biological process=DNA integration
MVVTYKDWHEMLPFSLHGYHTSICTSTGATPFSLVCGMEAVLPVEVKIPSLRVLMETELEEAEWIQTRVEKLNLIEEKRLNAICHVQLYQKRLKKAFEKKVYPRQYQERDLVLKKILLNKKDRISKWTPYYKGPYVVKKAFSGGALILTNMDGKDLSYLVNSDPVKKYYA

SEQ ID NO: 223317 - protein, 272 aa, Glycine max
  Coding DNA Sequence Number=SeqID_106539
  Homolog annotation: Hit_ID=Q9LEH5; Match level="QueryCoverage=24%, HitCoverage=42%, E-value=4e-22, Identity=82%"; Hit description=SnRK1- interacting protein 1
MQGDHQYSLSQQVLNFENTLNQYRTMMDASALNQFLASSIAVVVTGSNDYINNYLLPGLYGSSYNYTAQQFGNLLVNKFWIKEVLPSRNWATGLHPQQNLQQNPKTYPFSIKIKIHSLFFPYITYPFLTFSFTAPEWSGEVRNISYSPDSKSVSVVYRVTLYGTDAEMTQVMEILYRRQKQLLFVELVHALGWASTFIIKKMHHKIKHCFNVFMMPIVSFFHIICDHIATLEGIYFVVTWRRPSKLLRFAICFISSYLICHAIGRIDVLLHT

SEQ ID NO: 223318 - protein, 40 aa, Glycine max
  Coding DNA Sequence Number=SeqID_106540
MRKEVLFSLESVNGTWEKFISASNSFSTAKSMCHFQLLLY

SEQ ID NO: 223319 - protein, 78 aa, Glycine max
  Coding DNA Sequence Number=SeqID_106541
MVMAGDEHTHMVTATVVIVVTTMMTKVMDNGGGVNGDAVVVLEVVTIDDNDAAITTLKNIIAVTMVMIITVIVATMMN

SEQ ID NO: 223320 - protein, 101 aa, Glycine max
  Coding DNA Sequence Number=SeqID_106542
MGWSKVVRQPSKVRETEGADSGAQCQAKNPHNRENSGSECNAPQDPYQIICNSGSQYDNGCRTEEANSNLTLETIAITLDDSTRSTMGGEEVAYRSMGRML

SEQ ID NO: 223321 - protein, 227 aa, Glycine max
  Coding DNA Sequence Number=SeqID_106543
MSLTCISLLLFHIYFLAHFTITFFVQNIFLLGLLKDSTALLLLLLFHFEILVADVSRWSQACHVVNTFRGADNPMDNSSLLAPSVLAMCVVDYGLESAVLRIIGHCRLSPSSGDLTDEAASGVPKQLSSESISSDDQISLLRRQVQLSVPRWISSTTCTLYSTPPPPMFTYTVCCMAGLHGVRMSTLVLSTLRDSSTSSSTSATSPIAATICWIYFFSDAISGTPQH

SEQ ID NO: 223322 - protein, 324 aa, Glycine max
  Coding DNA Sequence Number=SeqID_106544
MGENTTYLKVRHRTRKWLLETSTPVAMRKKQPGGITIVLHHDHRRLKNLVWFDKLEEDPLWDFGADITLKYLGDDMVLLLGLSNDRAEQMNQEAMEGEESMFYSMEKWSPKLRAGQRLTWVQCWGVPLIASEKKYIQQIVAAMGDVADVDDDVEESRRVDRTRYKVHVVEEIHRGTESCTCRRRRDIWSSEEIDSDDSCFGTPLAASSVKSPDDGDNRQCPMIRNTADSTDNSVYAAMQQNEYLHPERAVESLSNPRRKMFCTKKWTGPFYSDEDMTKSKGKDPLEGLGGPMTRARARKAKEALQQVLSILFEYKPKFQGEKSK

SEQ ID NO: 223323 - protein, 124 aa, Glycine max
  Coding DNA Sequence Number=SeqID_106545
MDDTSWEDWDQLRADYHLEDKVFPQAIGNGSNPGVQPESKAIICVHDNNMCQIANLFRERHKDEFPFNKLRAEKRKPYSLSRRKVESKRPKISEAKEDSRYQDYIQGVTRAKRCRMRAQRALLR

SEQ ID NO: 223324 - protein, 82 aa, Glycine max
  Coding DNA Sequence Number=SeqID_106546
ENDQVAPTIIEKSLDFEPTLDEIEEPSGGQEESSYESAKQSFQPSPSVPDAESTENPNIVPVAQRENTSWKSCCGLFEIMRG

SEQ ID NO: 223325 - protein, 224 aa, Glycine max
  Coding DNA Sequence Number=SeqID_106547
  Gene Ontology: Mol. function=phosphoric monoester hydrolase activity; Biological process=dephosphorylation
  Homolog annotation: Hit_ID=Q2QT46; Match level="QueryCoverage=67%, HitCoverage=23%, E-value=7e-45, Identity=60%"; Hit description=PTEN, putative, expressed
  Subcellular localization annotation: CTP_CleavageSite=15; ConfidenceScore=5.38e-01
MEPASADSSSQPTPPASNTEDRHSTKASGQTGNAHDSQLSSPTSGISSWARNLKFPQALGLGGAQQNSQAQNAGMSAFARLTGGLGLQTLSNETAPVKSGTEQSNLLESVTKGLVDSSKSAVKAVQVKARHIVSQNKRRYQEDGFDLDMTYITENIIAMGFPGGDFSSGIFGYIEGFYRNHMDEVIKFFETHHKISQGSYQKDGQRNLEQNQRVLYLLVNSSGI

SEQ ID NO: 223326 - protein, 128 aa, Glycine max
  Coding DNA Sequence Number=SeqID_106548
  Gene Ontology: Mol. function=nucleotide binding; Cellular component =intracellular; Biological process=small GTPase mediated signal transduction
  Homolog annotation: Hit_ID=Q9LYJ3; Match level="QueryCoverage=99%, HitCoverage=90%, E-value=1e-43, Identity=62%"; Hit description=ADP -ribosylation factor-like protein
  Pfam annotation: Domain name=Arf; Domain location=4-117; Score=84.2; E_value=4e-22; Accession=PF00025.11; Description=ADP-ribosylation factor family
MGLTVSRLLRLFYARKEMRILMVGLDAAGKTTILYKLKLGEINTQGLIFVVDSNDRERILEARDELHRMLREDELRDATLLVLANKQDLPNALVLQKLLINLVYIHFACVSGTYSQLVPHPAKDSMKG

SEQ ID NO: 223327 - protein, 479 aa, Glycine max
  Coding DNA Sequence Number=SeqID_106549
  Gene Ontology: Mol. function=phosphoric monoester hydrolase activity; Cellular component=integral to membrane; Biological process =dephosphorylation
  Homolog annotation: Hit_ID=Q8GZT8; Match level="QueryCoverage=83%, HitCoverage=62%, E-value=1e-122, Identity=54%"; Hit description=PTEN- like protein
MIRKKKQNHEPMMVATFPFSDHNCPPIQLIASFCQSAYSWLKEDIQNVVVVHCKAGMGRTGLMICSLLLFLKASHDNQLQRLWNFFPTAEEAIDYFNHKRCVDGKALILPSQIRYVKYFERTLTHFNGEVQPGRRCMLRGFRLHECPYWVRPSITISDHKGILFTTRKHPKTKDLMPEDFWISAPKKGIVVFALPGEPGLTELVGDFKIQFQDRQGDFYCWMNTTLTENRKILDGSDFDGFDKRKIPAPGFKVEIVMIGYNAILPANTKSNPASKGSDGNTSNALPGLKHTTSNSSESEVPRNGDDDVFSDSDEEETRDTQSTKAATEYKFMAPHQVSETTTDHVGMLTHKTDQLSLQQEERKQNVASEESDTDKLHKNHTGNNSINMGSVGASDIKAIAADASVFSFGDEDFERLHVYMILSSILRDMLHCPQWPMENSKIIASRSQKVAMQRGDGWGGDGAVARVVVKGKRIGEREK

SEQ ID NO: 223328 - protein, 158 aa, Glycine max
  Coding DNA Sequence Number=SeqID_106550
MPPASRRKAKQAKKYKTVTILNHHSSHSDQLQGTAVSPNHIKKMEGSLNGALQDSHKVETQILREDKEVVVEVDDSQNGDIAITDEEAPPNEENKELVDSGKVEVTQDVSESVCETFEPDAMKDGQVENTMESDVVELELKEEEGKDFLSDLAVVNDE

SEQ ID NO: 223329 - protein, 105 aa, Glycine max
  Coding DNA Sequence Number=SeqID_106551
  Gene Ontology: Mol. function=molecular_function; Cellular component =integral to membrane; Biological process=retrograde vesicle-mediated transport, Golgi to ER
  Homolog annotation: Hit_ID=O48670; Match level="QueryCoverage=63%, HitCoverage=34%, E-value=9e-28, Identity=83%"; Hit description =Protein RER1A
  Pfam annotation: Domain name=Rer1; Domain location=1-82; Score=13.6; E_value=1.7e-14; Accession=PF03248.4; Description=Rer1 family
MLLFCFGIWFYCFKLWKYSITKAFCIAFVMTFFSAFDVPVFWPILLFYWVVLFTLTMRRQISHMIKYKYVPFSFGKQDYIHVANTLRRKESSRRHKPDLGLKFSA

SEQ ID NO: 223330 - protein, 101 aa, Glycine max
  Coding DNA Sequence Number=SeqID_106552
MEAMKEQMATMMEAMKSTEGQAVGGIPFENTLEGPQFRPQPQPLHFAVGRAPPAMAEKGKADHLKERLRAIEGGEDYAFANLEKLFLIPKHGHSQVQGAGL

SEQ ID NO: 223331 - protein, 60 aa, Glycine max
  Coding DNA Sequence Number=SeqID_106553
MYIYRIIKFRCLLTGSHGGEASGSDGVAGDSNRGGYCGGGVVDSDCGVGGHGNEVVRNNG

SEQ ID NO: 223332 - protein, 568 aa, Glycine max
  Coding DNA Sequence Number=SeqID_106554
  Gene Ontology: Mol. function=galactosylgalactosylxylosylprotein 3 -beta-glucuronosyltransferase activity; Cellular component=membrane
  Homolog annotation: Hit_ID=Q4VZ79; Match level="QueryCoverage=99%, HitCoverage=100%, E-value=0.0, Identity=88%"; Hit description =Glycosyltransferase
  Pfam annotation: Domain name=Glyco_transf_43; Domain location=169 -422; Score=220.5; E_value=3.8e-63; Accession=PF03360.6; Description =Glycosyltransferase family 43
MKLSALQQSYLTRRANSFRGSAQLDSSADGAVKSPAAIFWLVIHGVCCLISLVLGFRFSRLVFFFLFSTSLYTAPFRSGSEIAAPHDVPPAANRTAMLSTASRVVVGRHGIRIRPWPHPDPVEVMKAHRIIERVQREQRALFGVKNPRTVIAVTPTHVRTFQTLHLTGVMHALMLVPYDLVWIVVEAGGVTNETASIIAKSGLRTIHVGFSQRMPNSWEARHKLESRMRLHALRIVRKEKLDGVVVFADDSNMHSMELFDEAQNVNWIGAVSVGILLHSDESSYMVQSEEEGASMPVQGPACNATDKLVGWHTFNSLQYTGRSAVYIDDRAPVLPRKLEWSGFVLNSRLVWKDVDGKPEWVKDLDKFDGVDEEIETPLSLLKSTSVVEPLGNCGRQVLLWWLRVEARTDSKFPSRATESPTKIIQEYSHPGLKKFSLGMDFQKGETEILDVIGHKKFPKVKFKSWKKRDIGTLLSTLAQSHNISGHHSQAIRWIIDPPLDITIPSKRSPWPDAPPELPSNEKVLTNTQEQTNKPSTRTKSPRSRRSRSKKKHDTKVIGVQVSTYSEQN

SEQ ID NO: 223333 - protein, 135 aa, Glycine max
  Coding DNA Sequence Number=SeqID_106555
  Gene Ontology: Mol. function=nucleic acid binding
  Homolog annotation: Hit_ID=Q0WQM7; Match level="QueryCoverage=72%, HitCoverage=33%, E-value=2e-24, Identity=59%"; Hit description =Putative RNA-binding protein
  Pfam annotation: Domain name=RRM_1; Domain location=31-98; Score =33.4; E_value=7.9e-07; Accession=PF00076.12; Description=RNA recognition motif. (a.k.a. RRM, R
  Subcellular localization annotation: CTP_CleavageSite=33; ConfidenceScore=5.23e-01
MKGGLQTGGGRKMKKSSTPYIPQNSTPCATLFVANLGPSCNEQELIQVFSRYPGFLKLKMQSTYGAPVAFVDFQDVGSSTDALNSLQGTILHSSQSGEGMRLDGRITLLISVWFLLNKNLRYAKSRMGMRRKPNR

SEQ ID NO: 223334 - protein, 321 aa, Glycine max
  Coding DNA Sequence Number=SeqID_106556
  Gene Ontology: Mol. function=sequence-specific DNA binding; Cellular component=nucleus; Biological process=regulation of transcription
  Homolog annotation: Hit_ID=Q9FXS1; Match level="QueryCoverage=99%, HitCoverage=100%, E-value=1e-62, Identity=46%"; Hit description=WRKY transcription factor NtEIG-D48
  Pfam annotation: Domain name=WRKY; Domain location=248-308; Score =143.4; E_value=6.2e-40; Accession=PF03106.6; Description=WRKY DNA -binding domain
MAVDLMMGYRNHNFAQENAVREAASGLESVEKLIKLLSQTQQQFQTTSNSTSNSKSSMANIDTDYRAVADVAVSKFKKVISLLGSSRTGHARFRRAPVAPPPPPAEPRVYRATPVQQIPPPTLHTHAVVTDHSLVPKIERKDSSKTINFSYSNSFVSSLTAGDTDTKQPCSSSPSTAFQITNLSQVSSGGKPPLSSSSLKRKCSSENLGSAKCGSSSSRCHCSKKSRKMRQKRVVRVPAISLKMADIPPDDYSWRKYGQKPIKGSPHPRGYYKCSSVRGCPARKHVERALDDPSMLVVTYEGEHNHTLSAAEATNLILESS

SEQ ID NO: 223335 - protein, 181 aa, Glycine max
  Coding DNA Sequence Number=SeqID_106557
  Homolog annotation: Hit_ID=UPI000065D3EF; Match level="QueryCoverage =33%, HitCoverage=23%, E-value=1e-07, Identity=47%"; Hit description =Homolog of Homo sapiens "Ataxin 7-like 3
  Pfam annotation: Domain name=Sgf11; Domain location=6-117; Score= -29.9; E_value=0.0016; Accession=PF08209.2; Description=Sgf11 (transcriptional regulation prote
MAICFHWGVLQLSYFFLDLLDSIIVDVASECHRVARLGLDSNLEEEDEELKLSAQARVRVADPSNSNEANGKYVVDIFGQTHPPVANEIFDCLNCGRSIMAGRFAPHLEKCMGKGRKARLKVTRSSTATQNRYSRGGPSPGSTHSPYSNYSTNSMNRLAYGTSTFAGSVSHLELVSSQGDG

SEQ ID NO: 223336 - protein, 252 aa, Glycine max
  Coding DNA Sequence Number=SeqID_106558
  Homolog annotation: Hit_ID=Q1SBV5; Match level="QueryCoverage=32%, HitCoverage=12%, E-value=2e-14, Identity=45%"; Hit description=RNA -directed DNA polymerase homolog F21E10.5-Arabidopsis thaliana
MRIRSRIFFFFFLSLEKKKLNEDDDEKGLQKKQTTFSWNWVGPTFPLKEEKVGPRLSTHGHIVNANSISVHPRVCRGGQHNACKERPQQDRWYTCCGGYNHEPKGTSHYIFSHSHSVVGPNPIYVHVYTFPLVQGSTYWCHVSFPLVMGDLMISEEKEDIFKWRGTPGHASNGAIFQGHMSVSLGCFSTYIGVQSLIYAELFPVILAMESSLERNWRKVWFECDSILVMEAFKNPSLVPWRLRRHWKNCLFL

SEQ ID NO: 223337 - protein, 907 aa, Glycine max
  Coding DNA Sequence Number=SeqID_106559
  Gene Ontology: Mol. function=RNA-directed DNA polymerase activity; Cellular component=chromatin; Biological process=chromatin assembly or disassembly
  Pfam annotation: Domain name=Chromo; Domain location=827-881; Score =19.0; E_value=0.0057; Accession=PF00385.14; Description='chromo' (CHRromatin Organisation MOdifier
  Pfam annotation: Domain name=zf-H2C2; Domain location=655-696; Score =18.9; E_value=0.0011; Accession=PF09337.1; Description=His(2)-Cys(2) zinc finger
  Pfam module annotation: Pfam domain module=Chromo::zf-H2C2; Domain location=827-881::655-696
MAKHNDRTRSQHLQSQVSVIQTWMEDQRTRDKKLQDRFDELQASNQARMDLMQRSIDLLIQSQSHTIGGSNSNRGTPVLEWIFKAEKFFNHHNTPYLDRVDITSIHFEKDVIPWFQMLQWMQVVSTWAELTRFMALANRSEGLTPEALRNCFISGLNKDIRRDVVAQAPNDLLRAISLAKLYEENDDVELEGHDSKDIIDNVDGNAEVILEEHHLSLNALKGGRGVGTISPQATCGTNTFFKVMVGNGNYMVAEGVVNKLTIKAQNATFQLLVFLLPILGANLILGSSWLKTIGPHIADYDKLQLKFMYDGKFTTLQGETYMITAQAQLHHIRRMLNTDVIAEIFTMQLIKPNSVQFPLVELPNDIEPELALLLHSYSVVFGTPTSLPLQGIMIIIFHWLKALNLLSKSPFSSPIILVKKKDGSWRVCTDYRALNAITIKDTFPIPTVDELIDELYGAVVLNTLKQHQLFARFSKCAFGVREIDYLSHTLSGVGVAIKTMKLQVVLNWPLPISLKQLIGFLGLIGYYRRFVKGYATITTPLTDLLKKDSFKWSTSTTNAVNQLKEAMTSATFLAILNFKEPFVLDIDASGTGIGAYKSGKENIPVDALSTILLMAWSEAVGGTEYIVKDELLFWKGRMMIPENQALKQQIMKEFHASKIGGHEGVTKSVSRICKQFHWPKMQQDIRDFVRECTICQRAKVEQALLSDGQTEVLNKTLEMYSRCFVFDYPKAWFDMLPWAQFWYNTSFHHSIGMPSFKDLKLNLLRAQNYMKHNVNKKRRDLAYKLKLPETARIHLVFHISVLKKFVGSSKQPYLSLPLTMSANGPIVQPITVLDSRVILRGSAQVKQVLIQWELASLEEATWEDVTWVGTTYHQFNLEDKVVLKGKGRQSTRIKRPNVLYKEFVTKK

SEQ ID NO: 223338 - protein, 61 aa, Glycine max
  Coding DNA Sequence Number=SeqID_106560
  Subcellular localization annotation: CTP_CleavageSite=30; ConfidenceScore=5.11e-01
MELPSCGKLNPLLDLPSHPSSKFFLALSCKSGALSRKSGALSGCLAKAADWLSEKLEISTS

SEQ ID NO: 223339 - protein, 776 aa, Glycine max
  Coding DNA Sequence Number=SeqID_106561
  Gene Ontology: Mol. function=transmembrane receptor activity; Cellular component=integral to membrane; Biological process=defense response to bacterium
  Homolog annotation: Hit_ID=Q9XGQ5; Match level="QueryCoverage=79%, HitCoverage=93%, E-value=0.0, Identity=80%"; Hit description =Putative transmembrane 9 superfamily protein member 2
  Pfam annotation: Domain name=EMP70; Domain location=16-575; Score =843.9; E_value=8.2e-251; Accession=PF02990.7; Description =Endomembrane protein 70
  Pfam annotation: Domain name=MFS_1; Domain location=254-612; Score= -50.6; E_value=0.065; Accession=PF07690.6; Description=Major Facilitator Superfamily
  Pfam module annotation: Pfam domain module=EMP70::MFS_1; Domain location=16-575::254-612
LIYAKVNSLTSIETELPYNYYSLPYCQPDGGIKKSAENLGELLMGDQIDNSPYRFQMNVNETLYLCTTPLLNEHEVKLLKQRARDLYQVNMILDNLPVMRFTNQNGVTIQWTGFPVGYTPSDGSEDYIINHLKFTVLVHEYEGSGVEIVGTGEEGLGVISESDNKKASGYEIVGFQVVPCSIKYDLEVMTKHKRYDTLSPISCPAELDEYQVIREKERISFTYEVEFVKSDIRWPSRWDAYLKMEGSRVHWFSILNSLMVISFLAGIVFVIFLRTVRRDLTRYEELDKETQAQMNEELSGWKLVVGDVFREPDCSKLLCVMVGDGIQILGMAGVTIVFAALGFMSPASRGMLLTGMIVLYLILGIAAGYVSVRVWRTIKGTTEGWRSISWLAACFYPGIAFIILTVLNFILWSSNSTGAIPISLYFELFFLWFCISVPLTLIGGFMGTKAQPIEYPVRTNQIPREIPARKYPSWLLVLGAGTLPFGTLFIELFFILSSIWLGRFYYVFGFLLVVLLLLIVVCAEVSVVLTYMHLCVEDWRWWWKAFFASGSVALYVFLYSINYLVFDLRSLSGPVSATLYLGYSLLMAIAIMLSTGTIGFLMSFYFVHYLFSSVDLIKQNLARIEYEGGNLLKPMVHIEDSVLDGLCPLAECSDLKLLGKSNGFQMVKDRLMRLWNLKVGFDILDTGTFHVQTWSPDFISLAAKTALKIMSGGEGVRDVELKLFMKVVQEQFTTLNAGLDDLQFTSRSKIPLRKNHDDEEEEYSNGRHNERRRGEP

SEQ ID NO: 223340 - protein, 841 aa, Glycine max
  Coding DNA Sequence Number=SeqID_106562
  Gene Ontology: Mol. function=protein serine/threonine kinase activity; Cellular component=cytoplasm; Biological process=protein amino acid phosphorylation
  Homolog annotation: Hit_ID=Q9LFA2; Match level="QueryCoverage=93%, HitCoverage=96%, E-value=1e-166, Identity=42%"; Hit description =Protein kinase-like
  Pfam annotation: Domain name=Pkinase; Domain location=437-769; Score =240.3; E_value=4.2e-69; Accession=PF00069.15; Description=Protein kinase domain
  Pfam annotation: Domain name=Pkinase_Tyr; Domain location=437-763; Score=-23.4; E_value=4.9e-11; Accession=PF07714.7; Description =Protein tyrosine kinase
  Pfam module annotation: Pfam domain module=Pkinase::Pkinase_Tyr; Domain location=437-769::437-763
MDIDYSFNANTCEIVEAREEIICKFKIDEKPESSCAHKSGKKYSIEDDINRLLQAIDIENSARALNTPDSQKSALKKPIKITSSQTSGIGLSEPVSLKQAFRGLCISHASKMAALKRLSKPSTSSRVSKVGISRPSNELGCNDNNEISNSSAHHSPSFVNATNPKPMSTRSSYQNQIGPLASEVQGEKLVTRLEQHVLANSTSVVAYSSNEVLELDIRLKTFCDSSRKDSLGSSMPNKGMEANLNSPPSSGTGNGVEKPTSSITSFAKPIFRDKNFHKNKVKQDLCSSSSCSNLCTRNIGNDLAFCTSNLNKVTDNSDSKNEMKEKRKLSFKHSNHSIEVYSVNASMDSSKHGFCLTDKKRTRFLVTKFDEKSRSKEKGELSQSPKSSTSDYRSISKEKNLSGSSYNGHRPHMSKHARWEAVHVIEQQHGHLSWRNFKVLKRLGRGDIGIVYLAQLIGTSSLFAVKVMENDILVNQKKTSRAQIEREILQMLDHPFLPTLYAHFTTDKLSCLVMEYCPGGDLHVLRQRQPSKSFSEHATRFYVAEVLLALEYLHMLGVVYRDLKPENIMVREDGHIMLTDFDLSLRCWVNPVLVKSPSPSVDPTKMSSSCLKAICMHPFCLQPNWHVSCTPILLSGGAKPQKTKAEISGQVGPLPQLIVEPINARSNSFVGTYEYLAPEIIKGEGHGSAVDWWTFGILLFELIYGITPFKGPSYEDTLANVVSQSLKFPDTPIVSFRARDLIKRLLIKDPKSRLGFVKGATEIRQHSFFEGLNWALIRCAPPPKLLKFCDFGTSLQSMKNAIDSQDCEEFDITMVRAKVDEWKRDFKEQEQLGSFDIASLR

SEQ ID NO: 223341 - protein, 223 aa, Glycine max
  Coding DNA Sequence Number=SeqID_106563
MRSAGANTPTQKEPYIRTRENPYFDGLLRSDGQIPLKSQLEFTYIGETRPKNFVSDISEEVMELSPENSAVSGLNSKSSEHSSSEKWLKTSKIAPFIQLDILSELIEPDNPKHHHLGYGQSPRTPEQSPAIHNTEKTYTVIRRKEKLSSILLPLSAASYYIGVSPEMEIVESCESIDKLNAFLKARKDDVNAGVPGKFLHAVMGSDGAGNFFFLASVVSNSKS

SEQ ID NO: 223342 - protein, 852 aa, Glycine max
  Coding DNA Sequence Number=SeqID_106564
  Gene Ontology: Mol. function=protein serine/threonine kinase activity; Cellular component=integral to membrane; Biological process=protein amino acid phosphorylation
  Homolog annotation: Hit_ID=Q53MD2; Match level="QueryCoverage=96%, HitCoverage=97%, E-value=1e-169, Identity=38%"; Hit description =Leucine Rich Repeat, putative
  Pfam annotation: Domain name=LRRNT_2; Domain location=31-70; Score =56.0; E_value=1.2e-13; Accession=PF08263.3; Description=Leucine rich repeat N-terminal domain
  Pfam annotation: Domain name=LRR_1; Domain location=123-144; Score =17.5; E_value=0.048; Accession=PF00560.23; Description=Leucine Rich Repeat
  Pfam annotation: Domain name=LRR_1; Domain location=146-168; Score =17.6; E_value=0.045; Accession=PF00560.23; Description=Leucine Rich Repeat
  Pfam annotation: Domain name=LRR_1; Domain location=170-193; Score =2.0; E_value=1.2e+02; Accession=PF00560.23; Description=Leucine Rich Repeat
  Pfam annotation: Domain name=LRR_1; Domain location=195-217; Score =11.2; E_value=2.3; Accession=PF00560.23; Description=Leucine Rich Repeat
  Pfam annotation: Domain name=LRR_1; Domain location=219-241; Score =13.9; E_value=0.6; Accession=PF00560.23; Description=Leucine Rich Repeat
  Pfam annotation: Domain name=LRR_1; Domain location=243-265; Score =13.9; E_value=0.6; Accession=PF00560.23; Description=Leucine Rich Repeat
  Pfam annotation: Domain name=LRR_1; Domain location=267-289; Score =11.2; E_value=2.3; Accession=PF00560.23; Description=Leucine Rich Repeat
  Pfam annotation: Domain name=LRR_1; Domain location=291-313; Score =11.2; E_value=2.3; Accession=PF00560.23; Description=Leucine Rich Repeat
  Pfam annotation: Domain name=LRR_1; Domain location=315-337; Score =6.6; E_value=17; Accession=PF00560.23; Description=Leucine Rich Repeat
  Pfam annotation: Domain name=LRR_1; Domain location=339-358; Score =8.6; E_value=7.1; Accession=PF00560.23; Description=Leucine Rich Repeat
  Pfam annotation: Domain name=LRR_1; Domain location=363-385; Score =1.2; E_value=1.7e+02; Accession=PF00560.23; Description=Leucine Rich Repeat
  Pfam annotation: Domain name=LRR_1; Domain location=387-409; Score =4.0; E_value=52; Accession=PF00560.23; Description=Leucine Rich Repeat
  Pfam annotation: Domain name=LRR_1; Domain location=411-433; Score =7.1; E_value=13; Accession=PF00560.23; Description=Leucine Rich Repeat
  Pfam annotation: Domain name=LRR_1; Domain location=435-457; Score =11.4; E_value=2.1; Accession=PF00560.23; Description=Leucine Rich Repeat
  Pfam annotation: Domain name=LRR_1; Domain location=459-481; Score =21.3; E_value=0.0035; Accession=PF00560.23; Description=Leucine Rich Repeat
  Pfam annotation: Domain name=LRR_1; Domain location=483-505; Score =14.9; E_value=0.29; Accession=PF00560.23; Description=Leucine Rich Repeat
  Pfam annotation: Domain name=LRR_1; Domain location=507-526; Score =7.0; E_value=14; Accession=PF00560.23; Description=Leucine Rich Repeat
  Pfam annotation: Domain name=LRR_1; Domain location=75-97; Score=1.5; E_value=1.5e+02; Accession=PF00560.23; Description=Leucine Rich Repeat
  Pfam annotation: Domain name=LRR_1; Domain location=99-121; Score =11.5; E_value=2; Accession=PF00560.23; Description=Leucine Rich Repeat
  Pfam annotation: Domain name=Pkinase; Domain location=562-833; Score =183.9; E_value=3.9e-52; Accession=PF00069.15; Description=Protein kinase domain
  Pfam annotation: Domain name=Pkinase_Tyr; Domain location=562-833; Score=107.5; E_value=3.9e-29; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=31-70::123 -144::146-168::170-193::195-217::219-241::243-265::267-289::291 -313::315-337::339-358::363-385::387-409::411-433::435-457::459 -481::483-505::507-526::75-97::...
  Pfam module annotation: =99-121::562-833::562-833
MAKSPRLFHFFQFLAMLLLTSYSIFPPCVSLTLETQALLQFKNHLKDSSNSLASWNESDSPCKFYGITCDPVSGRVTEISLDNKSLSGDIFPSLSILQSLQVLSLPSNLISGKLPSEISRCTSLRVLNLTGNQLVGAIPDLSGLRSLQVLDLSANYFSGSIPSSVGNLTGLVSLGLGENEYNEGEIPGTLGNLKNLAWLYLGGSHLIGDIPESLYEMKALETLDISRNKISGRLSRSISKLENLYKIELFSNNLTGEIPAELANLTNLQEIDLSANNMYGRLPEEIGNMKNLVVFQLYENNFSGELPAGFADMRHLIGFSIYRNSFTGTIPGNFGRFSPLESIDISENQFSGDFPKFLCENRKLRFLLALQNNFSGTFPESYVTCKSLKRFRISMNRLSGKIPDEVWAIPYVEIIDLAYNDFTGEVPSEIGLSTSLSHIVLTKNRFSGKLPSELGKLVNLEKLYLSNNNFSGEIPPEIGSLKQLSSLHLEENSLTGSIPAELGHCAMLVDLNLAWNSLSGNIPQSLKHDAEKNLQGQKEVRRKWKLASFHQVDIDADEICKLDEDNLIGSGGTGKVYRVELRKNGAMVAVKQLGKVDGVKILAAEMEILGKIRHRNILKLYASLLKGGSNLLVFEYMPNGNLFQALHRQIKDGKPNLDWNQRYKIALGAGKGIAYLHHDCNPPVIHRDIKSSNILLDEDYESKIADFGIARFAEKSDKQLGYSCLAGTLGYIAPELAYATDITEKSDVYSFGVVLLELVSGREPIEEEYGEAKDIVYWVLSNLNDRESILNILDERVTSESVEDMIKVLKIAIKCTTKLPSLRPTMREVVKMLIDAEPCAFKSPNKDTKALL

SEQ ID NO: 223343 - protein, 162 aa, Glycine max
  Coding DNA Sequence Number=SeqID_106565
MERLAGILLDTANLRDPRCSSKDKYMASLLINGAGRYGCNGLYQLLRYKMHDLSSLQVADILRKDFKKWTGQVSEKLRALIVVSGYYNDEKNFKREVLISTESAKLLESLLFFFDFNASRLPLKSLHFPGLKNGMKAYEIDKITSRKIVEHLIEEFVGIPKA

SEQ ID NO: 223344 - protein, 482 aa, Glycine max
  Coding DNA Sequence Number=SeqID_106566
  Gene Ontology: Mol. function=nucleic acid binding; Cellular component= nucleus; Biological process=negative regulation of transcription
  Homolog annotation: Hit_ID=Q9M378; Match level="QueryCoverage=96%, HitCoverage=22%, E-value=1e-129, Identity=54%"; Hit description=TATA box binding protein (TBP) associated factor (TAF)-like protein
MNKVLEFGALLASGGQEYDIGNDNIKNPKERLVRQKQNLRRRLGLDVCEQFMDISDVIRDEDLMASKSDSHLNGIDRRLFTSCSSHNIQKMVSNMVPSVKSKWPSARELNLLKRKAKINSKDQTKSWCEDGSTEVSGGQNLTSKGTCPDSVNYSKAFMSVNHDEDGIEHDGDGQWPFHTFVEQLIIDMFDPVWEVRHGSVMALREILAHQGASAGVFKPDSSMGGTLFIELEDKSIPNILKREREIDLNMQVSADEFVSNLKRPKLEDVSSSTSMDSVMTCNNEGDIEISISSETHGFNLTLDYGNGQFNGNSVDMDYSDGLRDACKEPANIEEQKGYSDDNKIPSGNISVLRNLPQNCELMNSVKVARGSWLRNCEFLQDCVIRFLCVLSLDRFGDYVSDQVVAPVRETCAQALGAAFKYMHPALVNETLNILLKMQCRPEWEIRHGSLLGIKYLVAVRQEVVQGHPGSSCSLLPLFCSHL

SEQ ID NO: 223345 - protein, 913 aa, Glycine max
  Coding DNA Sequence Number=SeqID_106567
  Gene Ontology: Mol. function=nucleic acid binding; Cellular component= nucleus; Biological process=regulation of transcription, DNA-dependent
  Homolog annotation: Hit_ID=Q9M378; Match level="QueryCoverage=99%, HitCoverage=45%, E-value=0.0, Identity=58%"; Hit description=TATA box binding protein (TBP) associated factor (TAF)-like protein
  Pfam annotation: Domain name=HEAT; Domain location=115-151; Score =18.1; E_value=0.032; Accession=PF02985.12; Description=HEAT repeat
  Pfam annotation: Domain name=HEAT; Domain location=3-39; Score=22.3; E_value=0.0018; Accession=PF02985.12; Description=HEAT repeat
  Pfam annotation: Domain name=HEAT; Domain location=512-548; Score =2.1; E_value=24; Accession=PF02985.12; Description=HEAT repeat
  Pfam annotation: Domain name=HEAT; Domain location=679-710; Score =11.9; E_value=1.5; Accession=PF02985.12; Description=HEAT repeat
  Pfam annotation: Domain name=HEAT; Domain location=754-790; Score =19.3; E_value=0.014; Accession=PF02985.12; Description=HEAT repeat
  Pfam module annotation: Pfam domain module=HEAT::HEAT::HEAT::HEAT::HEA T; Domain location=115-151::3-39::512-548::679-710::754-790
MLSDLLGRVLPACKSGLEDPDDDVRAVAADALIPAASAIVSLQGQTLHSIVMLLWDILLDLDDLSPSTSSVMNLLAEIYSQEDMAPKMYTVFKLADNQMENGVDGCYDVDGEENPYVLSTLAPRLWPFMRHTITSVRYSAIRTLERLLEAGYKRSMSELSSASFWPSFIFGDTLRIVFQNLLLETNEDILQCSERVWSLLVQCSVEDLEIAARSYVASWIELASTPFGSALDASKMYWPVAFPRKSQIRAAAKMRAAKIENECGVDFSLDSIKGTIPPDRNGDVSMNSVKIVVGAEVDTSVTHTRVVTSTTLGIFASKLPEGSLKYVIDPLWSSLTSLSGVQRQVASMVLVSWFKEIKNRNSSKNLDGIPGALKDWLLDLLACSDPAFPTKDSILPYAELSRTYGKMRNEAGQLLNVVKSSGMFNELLTATQIELDRLSVDDAIGFASKIPALCNDSSANESLGKNITDDIESSKQRLLTTSGYLKCVQSNLHVTVTSAVAAAVVWMSEFPTRLTPIILPLMASIKREQEEILQMKSAEALAELMYHCVARRPCPNDKLIKNICSLTCMDPSETPQAKSLCTMESIDDQGLLSFRTPVSKQKSKVHVLAGEDRSKVEGFLSRRGSELALRLLCEKFGASLFDKLPKLWDCLTEVLKPSSSESLLVTNEKPVTMSIESVNDPQTLINNIQHSHVAVRLAASRCITSMAQSMTVKVMGAVVENAIPMLEDASSVYARQGAGMLISFLVQGLGVELVPYAPLLVVPLLRCMSDCDQSVRQSVTHSFAALVPLLPLARGLPQPIGLGEGVSRNAEDLQFLEQLLDNSHIEDYKLCTELKVTLRRYQQEGINWLAFLKRFKLHGILCDDMGLGKTLQASAIVASDIAEHRTSIGNEDLLPSLIICPSTLVGHWGLEIE

SEQ ID NO: 223346 - protein, 52 aa, Glycine max
  Coding DNA Sequence Number=SeqID_106568
MKDETNRNIKPKEWIIIMITYKIGPTVVVVKYDCMKDKTFEHPYLQASGGHM

SEQ ID NO: 223347 - protein, 259 aa, Glycine max
  Coding DNA Sequence Number=SeqID_106569
  Gene Ontology: Mol. function=oxidoreductase activity; Cellular component=chloroplast thylakoid membrane; Biological process =metabolic process
  Homolog annotation: Hit_ID=Q38M75; Match level="QueryCoverage=89%, HitCoverage=70%, E-value=3e-87, Identity=69%"; Hit description =Ripening regulated protein-like
  Pfam annotation: Domain name=ADH_zinc_N; Domain location=85-223; Score=31.7; E_value=2.7e-06; Accession=PF00107.16; Description=Zinc -binding dehydrogenase
MAVLEPRRGIPSVSRLKEGNWLRIMNSSSQYGGGFAEFAVASESLTAARPSEVSAAEAAALPIAGLTARDALTQIAGVKLDGTGQLKNILVTAASGGVGHYAVQLAKLGNTHVTATCGARNIDFVKGLGADEVLDYRTPEGAALKSPSGRKYDAVINCTTGISWSTFDPNLTEKAVVVDLTPNASSLWTAAMKKITFSKKQLVPFFVNVQREGLEYLLQLVKDGKLKSVIDSKFPLSKAEDAWAKSIDGHATGKIIVEP

SEQ ID NO: 223348 - protein, 89 aa, Glycine max
  Coding DNA Sequence Number=SeqID_106570
IPDDSNWSVGSTEDNSEYESTSVGWYEQKDTVEEEDLTLTFSDKVMVRSFSSKAKKVLQKHTASNFHAFGVAVIASTRCNQEIVQFTEE

SEQ ID NO: 223349 - protein, 271 aa, Glycine max
  Coding DNA Sequence Number=SeqID_106571
  Gene Ontology: Mol. function=N-acetyltransferase activity; Biological process=metabolic process
  Homolog annotation: Hit_ID=Q4C5G2; Match level="QueryCoverage=64%, HitCoverage=77%, E-value=2e-15, Identity=31%"; Hit description=GCN5 -related N-acetyltransferase
  Pfam annotation: Domain name=Acetyltransf_1; Domain location=151-242; Score=44.6; E_value=3.3e-10; Accession=PF00583.14; Description =Acetyltransferase (GNAT) family
  Subcellular localization annotation: CTP_CleavageSite=51; ConfidenceScore=5.47e-01
MAHLLASNPNASQKLTFSNLGYYGVRRGSRTKGSCYRVGRKRRGGLVLQCSSTTDQDVRLQIESGSIGKLKQHFEYLVCEYGWRVRRLFENADEIKKASHVQAEAFHVPVSLFNELFFQFFQAEVLSGLLYKLKNSPPNRYACLVAEPAINDPDSPKQLVGVIDVTVLRDQNVLQHLPPEAEEYLYISGIAVSKTFRRKKIATALLKACEMLSILWGFEFLALRAYEEDLGARKLYANAGYQVVSRDPPWTSNWIGRKCRVLMIKRTSLPK

SEQ ID NO: 223350 - protein, 65 aa, Glycine max
  Coding DNA Sequence Number=SeqID_106572
MEEGYSTNEPPLFKGIKYDYWKEHATKDKGEEVRGGAIHKGISHGRRSFTTKRVPWIKSLERKLQ

SEQ ID NO: 223351 - protein, 232 aa, Glycine max
  Coding DNA Sequence Number=SeqID_106573
  Gene Ontology: Mol. function=transcription factor activity; Cellular component=nucleus; Biological process=regulation of transcription, DNA-dependent
  Homolog annotation: Hit_ID=O22174; Match level="QueryCoverage=61%, HitCoverage=81%, E-value=2e-40, Identity=64%"; Hit description =Putative AP2 domain transcription factor
  Pfam annotation: Domain name=AP2; Domain location=30-94; Score=134.4; E_value=3e-37; Accession=PF00847.10; Description=AP2 domain
MEGEGRRREGGERETATAAATRKVVEGADQRRYKGIRMRKWGKWVAEIREPNKRSRIWLGSYSTPVAAARAYDTAVFYLRGPSARLNFPELLIGEGAAALTGGCDMSAASIRKKASEVGARVDALQATLHHHHHHVVPPRQLLSASCGGGSGDFAVRVVDLNKMPEPESSDCEWNVMVVVNVRRLRQNDVVDEACGGGGGGAEYCTGKWNGPLPRENVVATAVLTTMDDGVG

SEQ ID NO: 223352 - protein, 78 aa, Glycine max
  Coding DNA Sequence Number=SeqID_106574
MNLLPSVVRLSSTLNSYPEPHKLLVIHASSTIEFGTPRIDFLALFVYPPPSNLIRSPMNCLSFIHPPPSSLEPHELIA

SEQ ID NO: 223353 - protein, 100 aa, Glycine max
  Coding DNA Sequence Number=SeqID_106575
MCLPGKESLLMKSPITINEILDVSISFLNDHLEETLGSTKIEEIHSKCINLAQGKVYGESGFWLKACRMARHDTCQGLVWFKDKRDAPHYFHDTNAKMMI

SEQ ID NO: 223354 - protein, 631 aa, Glycine max
  Coding DNA Sequence Number=SeqID_106576
  Gene Ontology: Mol. function=transporter activity; Cellular component= integral to membrane; Biological process=transport
  Homolog annotation: Hit_ID=Q2PF01; Match level="QueryCoverage=93%, HitCoverage=88%, E-value=1e-154, Identity=74%"; Hit description =Putative cytosolic factor
  Pfam annotation: Domain name=CRAL_TRIO; Domain location=327-535; Score=29.3; E_value=4.2e-08; Accession=PF00650.10; Description =CRALTRIO domain
  Pfam annotation: Domain name=CRAL_TRIO_N; Domain location=223-317; Score=42.6; E_value=1.3e-09; Accession=PF03765.5; Description =CRALTRIO, N-terminus
  Pfam annotation: Domain name=EMP24_GP25L; Domain location=545-626; Score=56.8; E_value=7.1e-14; Accession=PF01105.14; Description =emp24gp25Lp24 family
  Pfam module annotation: Pfam domain module=CRAL_TRIO::CRAL_TRIO _N::EMP24_GP25L; Domain location=327-535::223-317::545-626
MAEEPQKPASAEEVVAVPAENPPSEAEAENIEAEKAQSGVEDKISQSVSFKEETNVVGDLPEAQKKALDELKKLVQEALNNHELTAPKPEPEKKKPAAEKKEEVEVTEGKKEAEVIEEKKEVEVTEEKKEIEVTEEKKEAEVIEEKKEVEVTEEKKEIEVTEEKKEAEVKEEKKEGEVTEEKKEVEVTEEKKEAEVIVEEKKEVEVTEEKKEVEVTEGKKEVEVIEEKKETEVTEEKKEVEVEVREEKKESEVKEEEKGREVVPEEVEIWGIPLLGDERSDVILLKFLRARDFKVKEALNMIRNTVRWRKEFGIEGLVEEDLGSDWEKVVFKDGYDKEGHPVYYNVFGEFEDKELYSKTFLDEEKRNKFIRWRIQSLEKSVRSLDFSPNGISTIVQVNDLKNSPGLGKRELRQATNQALQLLQDNYPEFVAKQIFINVPWWYLAFSRMISPFFTQRTKSKFVFAGPSKSADTLFRSSLSLSLSLSHLYPFSTNILIPPYRYIAPELVPVQYGGLSREAEQEFTSAYPVTEFTIKPATKHSVEFPVSEKSHLVWEIRVVGWDVSYGAEFVPSAEDGYTVIVHKSRKIAPADETVLTNGFKIGEPGKIVLTIDNQTSKKKKLLYRSKTKPIAE

SEQ ID NO: 223355 - protein, 83 aa, Glycine max
  Coding DNA Sequence Number=SeqID_106577
MGKESSKDTVPVTQWLNRMVSEPYYLFHFLTFFSYFVVRSSATQILAPHLTHHLLRREIQTLLVFAILAFIKVCADGIGSRLW

SEQ ID NO: 223356 - protein, 813 aa, Glycine max
  Coding DNA Sequence Number=SeqID_106578
  Gene Ontology: Mol. function=transporter activity; Cellular component= integral to membrane; Biological process=transport
  Homolog annotation: Hit_ID=Q6ZC71; Match level="QueryCoverage=46%, HitCoverage=99%, E-value=1e-134, Identity=61%"; Hit description=Sac domain-containing inositol phosphatase 3-like
  Pfam annotation: Domain name=Syja_N; Domain location=104-330; Score =217.8; E_value=2.4e-62; Accession=PF02383.9; Description=SacI homology domain
MVKSGNRNMESTAKVHPSNDPELDPDSYALEKFRLYETRARFYLIGSDRNKRFFRVLKIDRSEASDLNISQDPVLYSPQEIKSLLQRIAEGNRATGGLTFVAKVFGIAGCIKFLESYYLILVTKRRQIGSICGHAIYSIKESQLIAIPHVSIQSDLAHSKTELREGLKEEEQQTRYLKRGVNDRGRVANDVETEQIVLDEESGSCKGKMSSVVQMRGSIPLFWSQEASRFSPKPDIICMRVVEINIYPRYDPTYQATKLHFEDLAKRYGNPIIVLNLIKTVEKRPREMMLRREFANAVGYLNQILPVENHLRFIHWDFHKFAKSKSANVLAVLGAVASEALDLTGFYYSGKPSIIKRANKSNQTSTGRDTSLRDLRASSVDLVRIGNSNEMLNSVVNQDKETDMNHKNKKDNFGSDAPHFQSGVLRTNCIDCLDRTNVAQYAYGLQALGRQLHAMGLTDVPKVDPDSSIAAALMDMYQSMGDALAQQYGGSAAHNTVFPERQGKWKATTQSREFLKSIKRYYSNAYTDGYFQPQEGKPALWELDSDYYLHVSGIGDDLIPEKCSEPNLSSSGRGGMIFTPIPACREDFSRIKLTSFDKLIEKTCSTIKNVRLCREPDQRPGGVSGNSGVAPDAAEIQLKSPNWLFGQRKYEEGSSAAKVASCESDVEGSHANGFCDLNWLSSGNAMNEEDVFQRYLTMTSANEANGWYGGSLLGDQDENSEIYEHYAELCQGPALELFQNDPDREQHYADALSTSSYEIVNDAAVAAEMEATLKEYDQVGADLGIIPKSCKFFADDPSWLTRWLTGDEKVPRI

SEQ ID NO: 223357 - protein, 152 aa, Glycine max
  Coding DNA Sequence Number=SeqID_106579
  Gene Ontology: Mol. function=binding; Cellular component =intracellular; Biological process=metabolic process
  Homolog annotation: Hit_ID=Q9LTV8; Match level="QueryCoverage=90%, HitCoverage=48%, E-value=2e-23, Identity=35%"; Hit description =Selenium-binding protein-like
  Pfam annotation: Domain name=PPR; Domain location=116-149; Score =36.0; E_value=1.3e-07; Accession=PF01535.11; Description=PPR repeat
MRVAAGVKCLLRVRQWNWRVQGTKHYSSERVLQFYASFMNSGHSPDQFTFAVTLSACAKLQNLHLGRAVHSCVIKSGLESTSFCQGALIHLYAKCNSLTCARTIFASAPFPHLHTVSWTALISGYVQAGLPHEALHIFDKMRNSAVPDQVAL

SEQ ID NO: 223358 - protein, 650 aa, Glycine max
  Coding DNA Sequence Number=SeqID_106580
  Gene Ontology: Mol. function=binding; Cellular component =intracellular; Biological process=metabolic process
  Homolog annotation: Hit_ID=Q6Z0F9; Match level="QueryCoverage=97%, HitCoverage=95%, E-value=1e-121, Identity=30%"; Hit description=PPR -repeat protein-like
  Pfam annotation: Domain name=PPR; Domain location=119-153; Score =33.2; E_value=9.4e-07; Accession=PF01535.11; Description=PPR repeat
  Pfam annotation: Domain name=PPR; Domain location=18-52; Score=41.1; E_value=3.8e-09; Accession=PF01535.11; Description=PPR repeat
  Pfam annotation: Domain name=PPR; Domain location=220-253; Score =16.5; E_value=0.083; Accession=PF01535.11; Description=PPR repeat
  Pfam annotation: Domain name=PPR; Domain location=322-356; Score =38.4; E_value=2.5e-08; Accession=PF01535.11; Description=PPR repeat
  Pfam annotation: Domain name=PPR; Domain location=357-391; Score=1.3; E_value=5.2; Accession=PF01535.11; Description=PPR repeat
  Pfam annotation: Domain name=PPR; Domain location=424-458; Score =43.2; E_value=8.9e-10; Accession=PF01535.11; Description=PPR repeat
  Pfam annotation: Domain name=PPR; Domain location=459-493; Score=3.1; E_value=3.2; Accession=PF01535.11; Description=PPR repeat
  Pfam annotation: Domain name=PPR; Domain location=495-529; Score=8.5; E_value=0.74; Accession=PF01535.11; Description=PPR repeat
  Pfam annotation: Domain name=PPR; Domain location=53-87; Score=7.0; E_ value=1.1; Accession=PF01535.11; Description=PPR repeat
  Pfam annotation: Domain name=PPR; Domain location=561-595; Score =10.8; E_value=0.39; Accession=PF01535.11; Description=PPR repeat
  Pfam module annotation: Pfam domain module=PPR::PPR::PPR::PPR::PPR::PP R::PPR::PPR::PPR::PPR; Domain location=119-153::18-52::220-253::322 -356::357-391::424-458::459-493::495-529::53-87::561-595
MPDDARQVFDAISQKNMIVWNAMLGVYSQNGFLSNVMELFLDMISCGIHPDEFTYTSILSTCACFEYLEVGRQLHSAIIKKRFTSNLFVNNALIDMYAKAGALKEAGKHFEHMTYRDHISWNAIIVGYVQEEVEAGAFSLFRRMILDGIVPDEVSLASILSACGNIKVLEAGQQFHCLSVKLGLETNLFAGSSLIDMYSKCGDIKDAHKTYSSMPERSVVSVNALIAGYALKNTKESINLLHEMQILGLKPSEITFASLIDVCKGSAKVILGLQIHCAIVKRGLLCGSEFLGTSLLGMYMDSQRLADANILFSEFSSLKSIVMWTALISGHIQNECSDVALNLYREMRDNNISPDQATFVTVLQACALLSSLHDGREIHSLIFHTGFDLDELTSSALVDMYAKCGDVKSSVQVFEELATKKDVISWNSMIVGFAKNGYAKCALKVFDEMTQSCITPDDVTFLGVLTACSHAGWVYEGRQIFDVMVNYYGIEPRVDHYACMVDLLGRWGFLKEAEEFIDKLEVEPNAMIWANLLGACRIHGDEKRGQRAAKKLIELEPQSSSPYVLLSNMYAASGNWDEARSLRRTMIKKDIQKIPGCSWIVVGQETNLFVAGDISHSSYDEISKALKHLTALIKDNNRFQDIVISWVGQI

SEQ ID NO: 223359 - protein, 174 aa, Glycine max
  Coding DNA Sequence Number=SeqID_106581
  Gene Ontology: Mol. function=heat shock protein binding; Cellular component=integral to membrane; Biological process=protein folding
  Homolog annotation: Hit_ID=Q2R8U4; Match level="QueryCoverage=75%, HitCoverage=52%, E-value=2e-48, Identity=67%"; Hit description=DNAJ heat shock N-terminal domain-containing protein, putative, expressed
  Pfam annotation: Domain name=DnaJ; Domain location=2-65; Score=89.9; E_value=8e-24; Accession=PF00226.21; Description=DnaJ domain
MDTTRFLGVSPDADLEEIKVAYRKLSKEYHPDTTSLPLKTASEKFMKLREVYNVLSNEESRKFYDWTLAQEVASRHAEKMKMKLEDPREQQLKNWEPVPDMVDRLGGRNMKLSDQAVSAITIDLFIIVFAICCIIYMMPHSLECLPPVAAQGGFMANYYMALSPKHIVIVRNIL

SEQ ID NO: 223360 - protein, 238 aa, Glycine max
  Coding DNA Sequence Number=SeqID_106582
  Homolog annotation: Hit_ID=Q6ZI83; Match level="QueryCoverage=92%, HitCoverage=46%, E-value=3e-63, Identity=55%"; Hit description =RanBPM-like
MLHTAAFHGLGRLQLICLTYRIVRSYLLHYGYEDTLNSFDVASKSTVPPIYIAQESGIDEQEITYALNHRKTLRQLIRNGDIDVAFGKLREWYPQIVEDNTSATCFLLHCQKFIELVRVGALEEAVKYGRMELSSFYDLPVFKDLVQDCVALLAYERPLESSVGYLLKDSQREVVADTVNAMILSTNLNMKDSKHCLHSYLERLLRQLTACCLVRRSLNGEQGEAFQLQRVLSSSRRG

SEQ ID NO: 223361 - protein, 318 aa, Glycine max
  Coding DNA Sequence Number=SeqID_106583
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q9ZRD1; Match level="QueryCoverage=99%, HitCoverage=98%, E-value=1e-104, Identity=59%"; Hit description=NTGP4
  Pfam annotation: Domain name=AIG1; Domain location=20-217; Score =345.8; E_value=7.2e-101; Accession=PF04548.7; Description=AIG1 family
  Pfam annotation: Domain name=MMR_HSR1; Domain location=20-138; Score =15.5; E_value=3.8e-05; Accession=PF01926.13; Description=GTPase of unknown function
  Pfam module annotation: Pfam domain module=AIG1::MMR_HSR1; Domain location=20-217::20-138
  Subcellular localization annotation: CTP_CleavageSite=50; ConfidenceScore=5.35e-01
MGGSSIGDDWELTSSSNEGRTVVLVGRTGNGKSATGNTILGRKVFKSRASSSAVSTSCELQTTELNDGQIVNVIDTPGLFDLSVGSEFVGKEIVKCIDLAKDGIHAVIVVFSVRTRFTEEEETALRSLQTLFGSKIVDYMIVVFTGGDELEENAETLEDYLGRECPEPLKDEGKRFGQVQQLLSFVNTVLSRNGGRPYTDELFTQLKKGAMELHNQQREVDSLKGYSKGEILKFKKQMQQTYDDQLKRITEMVESKLREATMRLEQQLAEEQAARLKAEENAMLAQMRSDDEIRKLREHLEKAHEELRKRGEGRCAIL

SEQ ID NO: 223362 - protein, 172 aa, Glycine max
  Coding DNA Sequence Number=SeqID_106584
  Gene Ontology: Mol. function=nucleic acid binding; Cellular component= mitochondrion; Biological process=DNA integration
MVGGCKLTKTGSEDVSDPTLYGSVVGALQYVTITRPKICFSVNKVDPFMSKPSEQHWSAVKRILRYLKAIFLGPNLISWWSKMQTVVARSSTEAEYRSMTLVAVEVTWILSLLSELKDSHASPVILCDTMCRHPHKSSHLPPFLPTETSSECLKSFQPTPHELAGGIRVYLL

SEQ ID NO: 223363 - protein, 69 aa, Glycine max
  Coding DNA Sequence Number=SeqID_106585
  Gene Ontology: Cellular component=mitochondrion
  Homolog annotation: Hit_ID=Q1S326; Match level="QueryCoverage=85%, HitCoverage=16%, E-value=1e-15, Identity=65%"; Hit description =Putative receptor kinase-related
MASVGFLMSMAAMQQWPLYQLDIKNAILHSVLAEEVYMEQPPGFVAQGLSSVCKVREEVYMEQPQDTVS

SEQ ID NO: 223364 - protein, 49 aa, Glycine max
  Coding DNA Sequence Number=SeqID_106586
MNLGICLSRIYLELSHWWGMLPGTWAYVSAGAFGRAIIGYEMMKEMDDA

SEQ ID NO: 223365 - protein, 694 aa, Glycine max
  Coding DNA Sequence Number=SeqID_106587
  Gene Ontology: Mol. function=sequence-specific DNA binding; Cellular component=nucleus; Biological process=regulation of transcription, DNA-dependent
  Homolog annotation: Hit_ID=Q1T199; Match level="QueryCoverage=45%, HitCoverage=26%, E-value=1e-44, Identity=62%"; Hit description =Homeobox
  Pfam annotation: Domain name=PPR; Domain location=214-248; Score =20.8; E_value=0.005; Accession=PF01535.11; Description=PPR repeat
MKRAMDKEDEDANNDRGSAELLGEEVERKNGQDLEGAADTNSDHNESSQEVKQRWTQRGSTRAASEDAESRNGVFEPDEVTMGIAVLLYKRPASFEKLFLEFFRRWIRGAPFRLGVDDKDDQTRQGLEYSCTQYLNIPQMIHLYGKLWTFTTSFAKFGQLEMGEELYREMLGYAPDVIIYGVFINAFADAGSYLKEAQETYKLLQLSDEVLSLFSFNCMIDLYTERLMVEQAKEIFESLMKNEVVLLVSDIKKDLGYCGSRPKQRAWRQISQRLKAHGIVEQFDAKVNGKIEACLRLLDPITTESGNEDKKLNSGKICQVIDQLVELPMEHQIYDIIDAAGSCGITLKEEEQCLKSKANRVWISKNFNPEPEVGLICKLDENKTLNNVPDSSKILSEFETSTTSGKLDDPAKLEDRGVGAELSCVSPRNTESNFVGTSADLQDLVLDRRSTVSHCKSVSSSVEADNAPSGAFPSDMLKPFSTGPNQRYASLSLSVDNTRRANRILERLKDERFILKSEINRCLICFEKDKSTKVDRKTIDRILTKLQEQEKGIQKNQSVIVPDGQASKAEAMRANGFVLAKMICAKLLHSFIWDCLHRSTSHIDVLSSKKCAFEGTDTPHSSSKLFFLEATIKEMPVELFLKVVGSTKNYEEMIGKCKMDLHLSDLPPEEYKFLMDAQATGRLSLVIDILRRLK

SEQ ID NO: 223366 - protein, 147 aa, Glycine max
  Coding DNA Sequence Number=SeqID_106588
  Homolog annotation: Hit_ID=Q1T4S3; Match level="QueryCoverage=44%, HitCoverage=4%, E-value=3e-16, Identity=66%"; Hit description=Zinc finger, CCHC-type
MESRMVRTTELVLELCVQVKDHCRLLTRLVQSGNIVIPWKKITGALFIRDIRTKNAVISHLLEYIDYPDQIESFNILHSFFDDVEVYMNCHKFDNQREGLSVVKAGLLVKSLCFQSSLVFVGAAIWVFLESKDSFASYCLSMGLKRN

SEQ ID NO: 223367 - protein, 159 aa, Glycine max
  Coding DNA Sequence Number=SeqID_106589
  Homolog annotation: Hit_ID=Q1T251; Match level="QueryCoverage=77%, HitCoverage=43%, E-value=3e-10, Identity=34%"; Hit description =Multicopper oxidase, copper-binding site
MDVHHTPGNSKTGGDDRVDSWIWEADPMGSYKVNSAYAAITDAREGGFSEELFCKISKLGVPPKVQCLMRRIFHHSFLPLKSNLTKRRIIIDHMLCPFCHSQEKSQQHLLFTCPASSQVWNTYYSWLNELTVLPSATAHFWQNMGCASSNREKKVMTFM

SEQ ID NO: 223368 - protein, 117 aa, Glycine max
  Coding DNA Sequence Number=SeqID_106590
  Gene Ontology: Mol. function=pyridoxal phosphate binding; Biological process=biosynthetic process
  Homolog annotation: Hit_ID=Q1SKS5; Match level="QueryCoverage=98%, HitCoverage=10%, E-value=4e-51, Identity=81%"; Hit description=SAM (And some other nucleotide) binding motif
  Pfam annotation: Domain name=MTS; Domain location=2-115; Score=-93.7; E_value=0.093; Accession=PF05175.4; Description=Methyltransferase small domain
FDEGINRHPDSIFKERTVAELGCGNGWISIAIAEKWLPYKVYGLDINPRAVKVSWINLYLNALDENGHLIYDVENKTLLDRVEFHESDLLSYCREKDIQLERIVGCLPQKIKVKGDI

SEQ ID NO: 223369 - protein, 487 aa, Glycine max
  Coding DNA Sequence Number=SeqID_106591
MAELSQIQLGLNWAKPEPSAKRQNGSLSERVEKPNVSRYYLAVVLAKRVGRKIDKWHQGKGRALLLGHRLSMIPGDSNPRKPGTDIQITFWTGGSIRKGISEHQSPKQVRVRGHLIRIDADSLSSFLETPIVLEEGETQPTYSRFSRMRIDPQEFTARLCIPGRGFVLNAEGHPWKLLRKDLTTLAQTWSVLSYSNLTPTSHTSDLNMDRARLVYGLVTSMYMNIGAIISGQISTIAQSNSSRLEFLALITALCRARGVTSNSLTYESLSPAINLAYIKKNCSNVDDLTINFRGARKVRAQLADVPSSSALSAPPILPCLHQLPMTLSALKPCFIVSWPGTIPSVVREGEGPSAQLPQQATIPGAPDFSDAGVEMRPDEAIFPEPIVPVIHEIIEAGESQLRQEATTPERTPQTPEDPLSPGMELSFAQLVADPPTPDPTTPVLTLNTTLLATPELQFSDEEGGRITTPPGTPDGSLLVGLLWRLDL

SEQ ID NO: 223370 - protein, 139 aa, Glycine max
  Coding DNA Sequence Number=SeqID_106592
MVEREKFNHIEERLRAIEGGRDYAFADMAKLCLVPNMVIPPKFKVPNFDKYKGTTCPKNQLKMYYRKMGACNMCKRDNESFKEYAQRWRNLAAQVAPPMMEREMITMIVDTLSVFYYEKMVGYMPSSFANLEFAGERIE

SEQ ID NO: 223371 - protein, 364 aa, Glycine max
  Coding DNA Sequence Number=SeqID_106593
  Gene Ontology: Mol. function=transferase activity, transferring phosphorus-containing groups; Cellular component=membrane; Biological process=two-component signal transduction system (phosphorelay)
  Homolog annotation: Hit_ID=Q12HT1; Match level="QueryCoverage=96%, HitCoverage=37%, E-value=5e-71, Identity=38%"; Hit description=ATP -binding region, ATPase-like protein
  Pfam annotation: Domain name=MHYT; Domain location=100-166; Score =19.4; E_value=0.003; Accession=PF03707.7; Description=Bacterial signalling protein N terminal repeat
  Pfam annotation: Domain name=MHYT; Domain location=32-99; Score=51.8; E_value=2.2e-12; Accession=PF03707.7; Description=Bacterial signalling protein N terminal repeat
  Pfam annotation: Domain name=PAS; Domain location=170-283; Score =58.3; E_value=2.6e-14; Accession=PF00989.14; Description=PAS domain
  Pfam annotation: Domain name=PAS_3; Domain location=192-286; Score =14.6; E_value=0.0038; Accession=PF08447.1; Description=PAS fold
  Pfam annotation: Domain name=PAS_4; Domain location=176-288; Score =6.0; E_value=0.052; Accession=PF08448.1; Description=PAS fold
  Pfam module annotation: Pfam domain module=MHYT::MHYT::PAS::PAS _3::PAS_4; Domain location=100-166::32-99::170-283::192-286::176-288
MPGTLASYYALRLVSENQLDYQKLIKGGFSVGAGIGAMHYTGMLAMQMEPVLKFDLTWVLISVVVAVGLSFLSLWTGVYLNQKGKIPNQVSIILGGLLMGCAITAMHYTGMASARFVGKAQPGFNPVDNQSASLALGITLVTILVGCIAAAINALIRYRQMLATIQASETRLATILNTAVDGIVTINTTGQIISCNDAVQTLFGWEKSEMTGQNISMLMPEPDRSNHLYYLKNYQAGGQAQIIGEGRDLNAMKKDGTIFPIRLAIGEVKLTNETLFVGFITDLSQRQAIEKAIREKDQQIRSMMNNIPDWSMRLISNAVVSMTGWQAEDFLHGTVHFAQLIHPDDAQRIQPIVEAAIASRTNYH

SEQ ID NO: 223372 - protein, 57 aa, Glycine max
  Coding DNA Sequence Number=SeqID_106594
MLPELNLRDQYCSRKPFLLAFKLNQTKSDRVRPLVVEAEKLIDVGHKGKWLRERREV

SEQ ID NO: 223373 - protein, 107 aa, Glycine max
  Coding DNA Sequence Number=SeqID_106595
  Gene Ontology: Mol. function=cysteine-type peptidase activity; Biological process=proteolysis
MVHLIFHMIREIKCCGPIYLRWMHPVERYMKILKGYTKNLHYPEASIMERYIAEAAIEFCSEYTEKEKPVELPESQHDERVRGLVKESNPKMLKNKVLKEHNKTFLN

SEQ ID NO: 223374 - protein, 211 aa, Glycine max
  Coding DNA Sequence Number=SeqID_106596
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=UPI000034F3B5; Match level="QueryCoverage =78%, HitCoverage=23%, E-value=2e-31, Identity=36%"; Hit description =ATP binding / ATP-dependent DNA helicase/ ATP-dependent helicase/ DNA binding / ...
  Homolog annotation: Hit description=hydrolase, acting on acid anhydrides, in phosphorus-containing anhydrides / nucleic acid binding
  Pfam annotation: Domain name=DEAD_2; Domain location=138-211; Score= -41.2; E_value=0.0022; Accession=PF06733.6; Description=DEAD_2
MFYKPVTWVPDRIGKPDFPAQFIQHTSRERHITFGIVESEVKGKEKKIFASNPNPKNVYLVGGLQVEFPYQPYGSQFAFMARVISTLNLVQKEGHCHALLKSPSGTAIVLLVVSEIPDHTQIEINKKQKKKEAPTIYYASRTHSQISQVVRELRKTAYRVPMAVLVAVRARSMSNDAQLVFCPYNYINNPVIWAPMEVDIKVGIVIFDEAQ

SEQ ID NO: 223375 - protein, 200 aa, Glycine max
  Coding DNA Sequence Number=SeqID_106597
  Homolog annotation: Hit_ID=Q1T013; Match level="QueryCoverage=42%, HitCoverage=20%, E-value=1e-10, Identity=62%"; Hit description =Ionotropic glutamate receptor; Extracellular ligand-binding receptor
MIEAESPSFYLVAMRSKALNLVHVLDSAAAATTTAPVVVSPMRLWIHVLHEIQQKSLMDGFSQITGVQYKFILFGDGDKNPSYCDLVNMITSDVFDAAVVVWILEHRTNDEFRGSLREHIVTVLWFSLSTMFFAHKKTHLVHLVELCPSMSCIYILTSLTCISPPKVTDMLNWATFVVDPPLRRSTDTTLTLDVFSMQFP

SEQ ID NO: 223376 - protein, 62 aa, Glycine max
  Coding DNA Sequence Number=SeqID_106598
MDKDDILWADLEVGDDNNEGEKEETNIETKSNYFRCSSFRIDVIDQNELVTTMMEYPQSEEA

SEQ ID NO: 223377 - protein, 820 aa, Glycine max
  Coding DNA Sequence Number=SeqID_106599
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=90%, HitCoverage=36%, E-value=0.0, Identity=53%"; Hit description=CCHC -type integrase
  Pfam annotation: Domain name=B_lectin; Domain location=77-183; Score =55.0; E_value=2.5e-13; Accession=PF01453.15; Description=D-mannose binding lectin
  Pfam annotation: Domain name=Pkinase; Domain location=516-787; Score =126.0; E_value=1.1e-34; Accession=PF00069.15; Description=Protein kinase domain
  Pfam annotation: Domain name=Pkinase_Tyr; Domain location=516-784; Score=106.3; E_value=9.3e-29; Accession=PF07714.7; Description =Protein tyrosine kinase
  Pfam annotation: Domain name=S_locus_glycop; Domain location=201-328; Score=-41.7; E_value=0.042; Accession=PF00954.11; Description=S-locus glycoprotein family
  Pfam module annotation: Pfam domain module=B_lectin::Pkinase::Pkinase_ Tyr::S_locus_glycop; Domain location=77-183::516-787::516-784::201-328
MASSLLLFFLFCSVILLPFVVAQTKTNIAIGDSHTAGKSTTPWLVSSPSGDFAFGFLPLEATPDHFILCIWYANIQDRTIVWFANRDNKPAPKGSKVELSADDGLVLTAPNGDKLWNTGGFTARVSSGVFNDTGNLVLLDGASSSTWESFDDYRDTLLPSQTMERGQKLSSKLRRNDFNIGRFELFFQNDGNLVMHSINLPSEYVNANYYASGTIESNTSSAGTQLVFDRSGDVYILRDNKEKYNLSDGGSISTTQFYLRATLDFDGVFTLYQHPKGSSGSVGWTPVWSHPDNICKDYLSATSSGVCGYNSICSLGDYKRPICKCPKWYSLVDPNDPNGSCKPDFVQSCSEDELSQREDLYDFEVLIDTDWPLSDYVLQKPFTEEQCRQSCMEDCLCSVAIFRLGDSCWKKKLPLSNGRVDATLNGAKAFMKVRKDNSSLVVPPIIVKKNSRNTLIVLLSGSACLNLILVGAICLSSFYVFWCKKKLRRVGKSGTNVETNLRCFTYEELEEATNGFEKVLGKGAFGIVYEGVINMGSLTLVAVKRLNTFLLEEVQKEFKNELNVIGLTHHKNLVRLLGFCETQDERLLVYEYMSNGTLASLVFNVEKPSWKLRLQIATGVARGLLYLHEECSTQIIHCDIKPQNILLDDYYNARISDFGLAKILNMNQSRTNTAIRGTKGYVALEWFKNMPITAKVDVYSYGVLLLEIVSCRKSVEFEADEEKAILTEWAFDCYTEGVLHDLVENDKEALDDMKTLEKLVMIALWCVQEDPGLRPTMRNVTQMLEDIGLCSTSDMQNSLATGLVQAYKGRPKLKTPSLKL

SEQ ID NO: 223378 - protein, 155 aa, Glycine max
  Coding DNA Sequence Number=SeqID_106600
  Gene Ontology: Mol. function=protein serine/threonine kinase activity; Cellular component=membrane; Biological process=protein amino acid phosphorylation
  Homolog annotation: Hit_ID=Q0ZCC5; Match level="QueryCoverage=78%, HitCoverage=5%, E-value=9e-28, Identity=52%"; Hit description=CCHC -type integrase
MNRWMTMKNLMLEDTGTQRSDRMVSQSVVAWVAFGSSTFLNVILIGALCRIFFFIFQYKKKHRGISKSEKALETNLHCFSYKELQRATNGFQKELGRGSFGVVYERVINIGSAIPIAVKKLNNLLFQQVEKEFKNELHVIGLTHHKNLVRLIGYL

SEQ ID NO: 223379 - protein, 79 aa, Glycine max
  Coding DNA Sequence Number=SeqID_106601
EECGRSQIGADVGKRVQFSCAGIGALFISSQKWKIKARGKFTKLGVSPLKMATSLVPLVLLARQSGTASAAGETAAYVE

SEQ ID NO: 223380 - protein, 786 aa, Glycine max
  Coding DNA Sequence Number=SeqID_106602
  Gene Ontology: Mol. function=binding; Cellular component=thylakoid; Biological process=photosynthesis
  Homolog annotation: Hit_ID=Q7EY18; Match level="QueryCoverage=100%, HitCoverage=45%, E-value=0.0, Identity=50%"; Hit description =Putative tetratricopeptide repeat(TPR)-containing protein
MAPRNSRGKAKGEKKKKEEKVLPVVIDITVKLLDETHVLKDTVDVSALKPCILDLVEEDYDEDRAVAHVRRLLDIVACTTSFGPPSPKNDSGTVQKSGKSEAPPSKQSAKDAAAADLDGEISHSCPKLENFYDVNDGVCESMHADVKRGSRRHVEEISEEDYLFSLDVKVCNGKVVHVEACRKGFYSVGKQRILCHNLVDLLRQLSRAFDNAFDDLLKAFSERNKFGNLPYGFRANTWLVPPVAAQSPSSFPPLPVEDETWGGNGGGLGRDGKYDLVPWANEFSFIASMPCNTAEERQVRDRKAFLLHSLFVDVAIFRAIKAIKYVMEEPKFSCSIVENNIIYTERVGDLNINVLKDVSVASYKIDTKIDRVEATGVNQKDLLERNILKGITADENTAAHDITTLGVINVRYCGYVVTVKVERGVNENVDSPSQQNIELFDQPEGGANALNINSLRLLLHNTTPPENNKPMSQIQTFESEEFGASHAFLEKLIKESLAKLEEEEPGIDYFVRWELGACWIQHLQDQNNTEKDKKLSLEKAKNEMKVEGLGKPLKALKNYKKKSDSSNTNSATEYSKFNREAESPPFPSIESQLETTEAENELVLKRILSEEAFTRLKESGTGLHCKSMHDLINLSRKYYTDVALPKLVADFGSLELSPVDGRTLTDFMHTRGLRMRSLGHVVKLSEKLSHVQSLCIHEMIVRAFKHILRAVISAVDKEKMASSIAGALNLLLGVPENRELDKSREVHPLVWKWLELFLKKRFDWDPNKLNYKDVRKFAILRGLCHK

SEQ ID NO: 223381 - protein, 67 aa, Glycine max
  Coding DNA Sequence Number=SeqID_106603
MAYRHQSDPALSWSMSVKKKMKLAEAKRNSHTAHCSSVCVKEKREGGVDGGSVNMKENRIKKAKEIF

SEQ ID NO: 223382 - protein, 119 aa, Glycine max
  Coding DNA Sequence Number=SeqID_106604
MGLNQAHAFKERFIKSRHCSLHSFLEIRIVIIVIKRKERTLRCPYQTRVRSRVMSEIEEVQEQMKANMEAMKEQMATMMEAMMSLRRTMEVNAATVVAASTAIEVREAKSWELWRTPFC

SEQ ID NO: 223383 - protein, 121 aa, Glycine max
  Coding DNA Sequence Number=SeqID_106605
MAEVDEVQERMKADMEAMKEQMTTMMEAMMSMKKIMENKHVFPPYGLPPNYTPPNENVNNSTPILIESQQPQTDHAHVSQPMGETHEISHHNLVDFEPRLGYATEGQAVSDIPLQNTLESP

SEQ ID NO: 223384 - protein, 73 aa, Glycine max
  Coding DNA Sequence Number=SeqID_106606
MLKTVIIIGSFLCHDSDSTGTALHWAVRFGRNLYFILGRREYQCKEREQEGQIKPPIPTQLVKHYKLLAAFKE

SEQ ID NO: 223385 - protein, 69 aa, Glycine max
  Coding DNA Sequence Number=SeqID_106607
  Homolog annotation: Hit_ID=Q75LE1; Match level="QueryCoverage=72%, HitCoverage=14%, E-value=2e-07, Identity=58%"; Hit description =Expressed protein
MNCIHVRLVTLKGFNERTKVAALKEDGCPKVWVVTSDQCHQQAAHGVFYTATDFQGAFIWSCKALVTEI

SEQ ID NO: 223386 - protein, 123 aa, Glycine max
  Coding DNA Sequence Number=SeqID_106608
  Gene Ontology: Mol. function=hydrolase activity
  Homolog annotation: Hit_ID=Q69QI6; Match level="QueryCoverage=75%, HitCoverage=17%, E-value=4e-35, Identity=70%"; Hit description =Nucleotidase-like protein
MDLGHVRGQACLLVDIVQYFVDAKLEFDASYIYEDVIRAIDHVHRSGLVHRGILSDPHRYLVKNGKILRYLNMLREQGKKLFLLTNSPYYFVDGGMCFMLEPGAIILQRVPKEYRWKNEFSQL

SEQ ID NO: 223387 - protein, 65 aa, Glycine max
  Coding DNA Sequence Number=SeqID_106609
MEEVTVDSRASKVVVKGKATDPMKVQEKKEEEITIARGEKGGGYLTFNIGTYVTTDVKTHKLFNI

SEQ ID NO: 223388 - protein, 70 aa, Glycine max
  Coding DNA Sequence Number=SeqID_106610
MKGIVGTYPMVGLKCSPGKLHASVKVDLQAYTFFMLKHVFPVTISLMSYIYMRVLHGSLQTHQGTKCYHK

SEQ ID NO: 223389 - protein, 48 aa, Glycine max
  Coding DNA Sequence Number=SeqID_106611
MIVGDILIIENLGKAGIRPPQIFGSLANISSGAIPSINERKAIDLGHN

SEQ ID NO: 223390 - protein, 69 aa, Glycine max
  Coding DNA Sequence Number=SeqID_106612
MNEKNRFGKNGFRIILTKENVSQLPMTTPIPLLFCWNHEDHIDNSKGVRDTPNDSERARGRVTGGEQEL

SEQ ID NO: 223391 - protein, 57 aa, Glycine max
  Coding DNA Sequence Number=SeqID_106613
MGILTVAAQITQQYLLERGINVEKKMDPTVKKLSQHAGPTELRFLEGVFKHTSKHLG

SEQ ID NO: 223392 - protein, 492 aa, Glycine max
  Coding DNA Sequence Number=SeqID_106614
  Gene Ontology: Mol. function=GTPase activity; Cellular component =microtubule; Biological process=cell division
  Homolog annotation: Hit_ID=Q9SMB6; Match level="QueryCoverage=99%, HitCoverage=77%, E-value=0.0, Identity=75%"; Hit description =Phragmoplastin
  Pfam annotation: Domain name=Dynamin_M; Domain location=121-390; Score=291.5; E_value=1.6e-84; Accession=PF01031.10; Description =Dynamin central region
  Pfam annotation: Domain name=Dynamin_N; Domain location=1-112; Score=- 39.6; E_value=0.027; Accession=PF00350.13; Description=Dynamin family
  Pfam annotation: Domain name=GED; Domain location=395-488; Score =126.8; E_value=5.9e-35; Accession=PF02212.8; Description=Dynamin GTPase effector domain
  Pfam module annotation: Pfam domain module=Dynamin_M::Dynamin_N::GED; Domain location=121-390::1-112::395-488
VNLTLVDLPGLTKVAVDGQPDSIVQDIENMVRAFIEKMYELQWWKLNFLSMSLNPNCIILAISPANQDLATSDAIKISREVDPKGKVKLKVRKMLKIQNLEGERTFGVLTKIDLMDKGTDAAEILEGKSYKLNFPWIGVVNRSQADINKQVDMIAARKREMEYFANTPEYRHLASRMGSVHLGKVLSKHLESVIKSRIPGLQSLINKTIIELETELNRIGKPIAADTGGKLYMIMEICRTFDQIFKDHLDGIRPGGEKIYQVFDNQFPASIKRLQFDKHLSIDKVRKLITEADGYQPHLIAPEQGYRRLIESCLVSIRGPAEAAVDAELKQYPTLRVELGSAAVDSLERMREESKKSTLLLVDMEYGYLTVDFFRKLPQDAEKGGNPTHSLFDRYNDSYLRRIATTVLSYVNMVCGTLRHTIPKSVVYCQVREAKRSLLDHFFTELGKKEGKQLASLLNEDPAIMQRRTSLAKRLELYRNAQSEIEAVAWER

SEQ ID NO: 223393 - protein, 238 aa, Glycine max
  Coding DNA Sequence Number=SeqID_106615
  Pfam annotation: Domain name=DUF1442; Domain location=1-232; Score =37.4; E_value=3.2e-10; Accession=PF07279.2; Description=Protein of unknown function (DUF1442)
MEWSSKSATKAYFDTLQLCNNHKRQYGTWRVQNPGSNEFVSALAAGMKAKLIVEVTSHVSLTTLALAAAARQNGVRMVCILPESILNDSQEVINNSGLKDQVEFRTEDPSKLLPFYENIDFFLVDCNKDENYAKLLNLVDVNLTRSIVVAKNMVGDGDKKGIRWCLRGKDEKLEVRSLKHPLGNGMKVTRISKSDDTNMRFEVKGDYSKKRRKSSWIAKFDEESGEEHIYRVPQVDWF

SEQ ID NO: 223394 - protein, 414 aa, Glycine max
  Coding DNA Sequence Number=SeqID_106616
  Gene Ontology: Mol. function=dopamine beta-monooxygenase activity; Cellular component=integral to membrane; Biological process =histidine catabolic process
  Homolog annotation: Hit_ID=Q8LHG0; Match level="QueryCoverage=82%, HitCoverage=93%, E-value=6e-92, Identity=49%"; Hit description =Membrane protein-like
  Pfam annotation: Domain name=COPI_assoc; Domain location=257-396; Score=-56.5; E_value=0.069; Accession=PF08507.1; Description=COPI associated protein
  Pfam annotation: Domain name=Cytochrom_B561; Domain location=201-383; Score=-64.1; E_value=0.0058; Accession=PF03188.6; Description =Cytochrome b561
  Pfam annotation: Domain name=DOMON; Domain location=73-186; Score =6.6; E_value=0.013; Accession=PF03351.8; Description=DOMON domain
  Pfam module annotation: Pfam domain module=COPI_assoc::Cytochrom _B561::DOMON; Domain location=257-396::201-383::73-186
MANSRSWTQIWPCFVKLCVLNFVLVFKITALGDGSGSGPTVTAENTCKNTNYQSFLPPPYQNISQMICTPVWHTYELRYFQNGDTTTIILSAPYTIGWVGIGFSRDGMMVGSSAMVGWISKHGHAKIKQFYLRGRKQSEVIIDKGELLLNNIPAAVATNGAEIHIAFQLQMTTPFQKQPILLAFGSKYPQNHHLSKHEDKTAIVFDFSAGSTGPVSSELIQMRTNHGILAIIGWGLILPVGAIIARYFRHKDPLWFYLHAIIQFVGFTFGLGTVVLGLQLYSKMHVHIPAHRGIGIFALVLSILQVLALFLRPNKDSKIRKIWNWYHSWFGRMALIFAAINIVLGMQAAGAGSDWKIGYGFVFGIMVVVAIVLEVLAYLKKSEMRSLPPNFQLDPVGGATFPSNQALYFLFFIP

SEQ ID NO: 223395 - protein, 983 aa, Glycine max
  Coding DNA Sequence Number=SeqID_106617
  Gene Ontology: Mol. function=binding
  Homolog annotation: Hit_ID=Q7EY18; Match level="QueryCoverage=97%, HitCoverage=51%, E-value=0.0, Identity=45%"; Hit description =Putative tetratricopeptide repeat(TPR)-containing protein
  Pfam annotation: Domain name=TPR_1; Domain location=135-168; Score =8.4; E_value=0.53; Accession=PF00515.18; Description=Tetratricopeptid e repeat
  Pfam annotation: Domain name=TPR_1; Domain location=51-84; Score =17.6; E_value=0.043; Accession=PF00515.18; Description =Tetratricopeptide repeat
  Pfam annotation: Domain name=TPR_1; Domain location=93-126; Score =3.1; E_value=2.3; Accession=PF00515.18; Description=Tetratricopeptide repeat
  Pfam annotation: Domain name=TPR_2; Domain location=135-168; Score =15.5; E_value=0.2; Accession=PF07719.7; Description=Tetratricopeptide repeat
  Pfam annotation: Domain name=TPR_2; Domain location=51-84; Score =23.8; E_value=0.00062; Accession=PF07719.7; Description =Tetratricopeptide repeat
  Pfam annotation: Domain name=TPR_2; Domain location=93-126; Score =8.4; E_value=3.4; Accession=PF07719.7; Description=Tetratricopeptide repeat
  Pfam module annotation: Pfam domain module=TPR_1::TPR_1::TPR_1::TPR _2::TPR_2::TPR_2; Domain location=135-168::51-84::93-126::135-168::51- 84::93-126
QAACSSADGRQLLESSKTALDKGKLEDAVTYGTKALAKLVAVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHVALRYLHKALKCNQRLLGADHIQTAASYHAIAIALSLMEAYPLSVQHEQTTLQILRAKLGPDDLRTQDAAAWLEYFESKAFEQQEAARNGTRKPDASIASKGHLSVSDLLDYINPNTKGRDAAAKRRSQITKVRATSYPNVGMSSSDESSKEIPKEASDEEVQIPILVGSADSEQENNSGPDLEQAILKQISDEKPQIYDEILSEAHAEGEDGWQPVQRPRSAGSYGRRLKQRRATLGKVYSYQKNVEVGSESPFVRSPNPSSRYYFLKKRTISHGSYTDDHTVNITQGTKFGRKVVKAVTYRVKSVPSTSKPCVNEKLENGDKLLSSLPEPDPTDANPVKKSIVSLGKSPSYKEVALAPPGTISKFQVYNPQSVISVSSEHDGGKHEEEDIEADRNVNVDPTPTEVNDMVKEKNDDSLSDSVDDSQDDTGVAIEGKEETQLIVAVQDNCMSAEGQSGDVEAQGAVDNSILIHAVDDHVDSSKQELDASNSSASLEPSDNTNPTSQGGEDLKVNVSPSSQSHTGGIPYKKLSASAAPFNPSPAIARAAPIAMNMTLPSGPSAVPAIGPWPVNMNVHPGPTTVLPTVAPMCSSPHHAYPSPPATPNMMQPLPFVYPPFTQPQSVAPSNYPVTSSAFHANHFTYLNPTISKFGPSAVWPGCHPVEFPLPVPIVEPIRDPISESQVLCHGSESPSSASVLPEDIDSIGDSNQGVKTLSSEISEDEAVRAGSENIKENGNMNFHGSENAGNKQNQNFGSNGSSSSSETNMDGEKTFSILIRGRRNRKQTLRMPISLLTRPNGSQSFKVIYNRVVRGSHATKSMNLSSSKDCTATA

SEQ ID NO: 223396 - protein, 123 aa, Glycine max
  Coding DNA Sequence Number=SeqID_106618
  Gene Ontology: Mol. function=GTPase activity; Cellular component =microtubule; Biological process=cell division
  Homolog annotation: Hit_ID=Q39821; Match level="QueryCoverage=79%, HitCoverage=16%, E-value=2e-37, Identity=78%"; Hit description=SDL12A
  Pfam annotation: Domain name=Dynamin_N; Domain location=37-122; Score= -6.9; E_value=5.7e-05; Accession=PF00350.13; Description=Dynamin family
MENLIQLVNKIQQACTALGDHGEEGAMPTLWDALPSIAVVGGQSSGKSSVLESVVGKDFLPRGSGIVTRRPLVLQLHKIDEGREYAEFMHLPRKKFTDFGILLHKTFSQTYGLMYIALNISVW

SEQ ID NO: 223397 - protein, 594 aa, Glycine max
  Coding DNA Sequence Number=SeqID_106619
  Gene Ontology: Mol. function=phosphotransferase activity, alcohol group as acceptor; Biological process=protein modification process
  Homolog annotation: Hit_ID=Q9ZPY9; Match level="QueryCoverage=98%, HitCoverage=99%, E-value=0.0, Identity=58%"; Hit description =Expressed protein
  Pfam annotation: Domain name=PI3_PI4_kinase; Domain location=289-546; Score=290.8; E_value=2.5e-84; Accession=PF00454.17; Description =Phosphatidylinositol 3- and 4-kinase
  Pfam annotation: Domain name=ubiquitin; Domain location=119-190; Score=25.7; E_value=0.00017; Accession=PF00240.13; Description =Ubiquitin family
  Pfam annotation: Domain name=ubiquitin; Domain location=40-111; Score= 51.8; E_value=2.3e-12; Accession=PF00240.13; Description=Ubiquitin family
  Pfam module annotation: Pfam domain module=PI3_PI4_kinase::ubiquitin:: ubiquitin; Domain location=289-546::119-190::40-111
MSSAGVTTLSPVPRELLLSPDGYYTPLHLSLDREFIFIYLSYFGSLTPMRVLPCDTIESVKLKIQKSEGLPSLTNKQKLVCDGRELARSNSLLKEYGVTEGNVLHLVIRLSDLQTISVRTSSGKDFTFQVERCRDVGYIKQQIGKKEKCFADPEQQEVMCNGKLLEDQMLIDDICSKYNDAVIHLFVRVKYAEVRTGQDELSVVAKELNDTKDYETNCRRKYDISKEDTRREYGVVEPIMPRKALDRDLLLEPVIVNKKIELASEIWNMINSTYEGLDIGNYPIRSAEGTGGAYFMLDSTGQKYISVFKPIDEEPMAVNNPRGLPFSEDGEGLKKGTTVGQGAFREVAAYILDHPMSGRRSLFGDEKGFAGVPPTVMVKCLHKGFNHPGELTTKIGSLQMFIENNGSCEDMGPGAFPVKEVHKISVVDMRLANADRHAGNILIGKVEENGQAVLIPIDHGYCLPKSFEDCTFEWLYWPQARQPYSPEIIDYIKSLDADEDIALLKFHGWNLPVECARTLQISTMLLKKGVKRGMTPFAIGSLMCRESLNKESVIEGIVKAALDSVLPCTSEATFLDTVSEIMDQHLDEITGSIS

SEQ ID NO: 223398 - protein, 521 aa, Glycine max
  Coding DNA Sequence Number=SeqID_106620
MTNENSVKKKPRIIQSVKEARDYLSKKHDKQDPGTSTKSKIELVKENIADLKSSKFEKNTIVSKSGTLNRITDSKPLINSSDDSDRKDKDVSPRKNEYIKDSGIEPGLEELQKDETTLDHEVRGISTETRLPVKPENWPDKNLIEVEHSKSDALNGLSDSKPATNPSEDSDQKNKEFGTTKDDYLKPGIRNHQKSGTTLDSEVNGISTETRASGKTENWLEKNFHEVEPIDDHLRDIVFRVRENELSGRDPFYLMNDEDKDTFFSGLEKKVEKENKKLSDIHEWLHSNIENLDYGADGISIYDPPEKIIPRWKGPPVEKIPEFLNEFLDERMTSSTGNMNPVKKDESGFAITSAESSLQEKVDGPTVPIKKLKNPKTIIEGSDGSVKVGKKSGKEYWQHTKKWSQGFLDCYNDETDPEVKSIMKDMAKGLDRWITEKEIEEAAELMEKLPDRNRSFMEKKLNKIKREMELFGPQAVVSKYREYAVDEEEDYLWWLDLSHILVKEEVEETQKGMMVFKLSTK

SEQ ID NO: 223399 - protein, 173 aa, Glycine max
  Coding DNA Sequence Number=SeqID_106621
  Gene Ontology: Mol. function=transcription regulator activity; Cellular component=nucleus; Biological process=regulation of transcription
  Homolog annotation: Hit_ID=Q5DM34; Match level="QueryCoverage=78%, HitCoverage=48%, E-value=6e-23, Identity=55%"; Hit description=BHLH transcription factor
MTGRRGYGGGSRLMEGRNPQSCGGREAKAGEAEPAMDKASLLGDAIAYINELQAKLKTIESERERFGSTSMDGPELEANARVENHHNGTPDVDVQVAQDGVIVKVSCPIDVHPVSKVIQTFKDAEIGVVESKVTATNVSVFHTFVVKSQGPDQLTKDKLIALFSKESSTIKTL

SEQ ID NO: 223400 - protein, 435 aa, Glycine max
  Coding DNA Sequence Number=SeqID_106622
  Gene Ontology: Mol. function=transcription regulator activity; Cellular component=nucleus; Biological process=regulation of transcription
  Homolog annotation: Hit_ID=Q5N8F6; Match level="QueryCoverage=53%, HitCoverage=50%, E-value=3e-29, Identity=37%"; Hit description=BHLH protein-like
MKIEVGLGGVWDEEEKATVMEVLGRGAFDYLVANSVSNENLLMAFGCGENMQNKLSDLVERPNSSNFSWNYAIFWQISQSKYGDWVLGWGDGCCREPREGEEGGGEVRRVRVVFDDDDEKVQRMRKGVLQKLHMTFGGSDEDNYAFGLDRVTDTEMFFLASMYFSFPRGLGGPGKCFASGKHLWVSDVLKSSFDYCVRSFLAKSAGIQTVVLVPTDFGVVEMGSVRMVGESFELLQAVKSVFSAQASSLLVPHMVKPIAPLDLVREKRDGSESANALLSGLAIGDKNKNINNNSRVEGIGVPKIFGQDLNCVTQFREKLAVRKMEERPRPWGGHPPNVNSIGFPNGVQGSSWGAGQVVRHLGPPEMLAPRLASSGTLPKLANGARHDFVHNNFEQQRPVQMQIDFSGATSRAASGRSIIAESEISDVEATCKEER

SEQ ID NO: 223401 - protein, 72 aa, Glycine max
  Coding DNA Sequence Number=SeqID_106623
MEGITEGVNNIMNPLFQDVGFDLCFLKHEFPLPRLFPTLLHPYSCCSVGVIDRGAIGEAVKFDNTNCYCPRA

SEQ ID NO: 223402 - protein, 151 aa, Glycine max
  Coding DNA Sequence Number=SeqID_106624
MVISKPIATIAQAPEVAESTLVTGLEKQIDKVDEALTEPTSNEATSKDTTIVTIYTTNCTTNSGPTPINFAPPEIVTKSSDASVMLLMPQYCFHPSNLNHQPWIFFINGVLCFLKINGSEMEKKKDDWRRHFKEKMSQEQAHHHRKPWIRA

SEQ ID NO: 223403 - protein, 79 aa, Glycine max
  Coding DNA Sequence Number=SeqID_106625
MSAEPQTPVVNPPPSSELDVVPPSPPLVVISNASSDEAAGPPDSPAGETTDPPASLVGGIVDLSYLSSGEVVALSDSPV

SEQ ID NO: 223404 - protein, 75 aa, Glycine max
  Coding DNA Sequence Number=SeqID_106626
MYHLEDKVMFLGVGDDSKSLVPANHEGRPKRSATGPTHLKDYAVEAMPSKVILMMPKNQESNKFQESRSRFKNQE

SEQ ID NO: 223405 - protein, 336 aa, Glycine max
  Coding DNA Sequence Number=SeqID_106627
  Pfam annotation: Domain name=Transposase_23; Domain location=43-113; Score=-6.8; E_value=0.0063; Accession=PF03017.5; Description =TNP1ENSPM transposase
MLSLSHMQSQGLALPPEPGVGPSTARVSTKESCADPSGNDPDTGDSYKCGLYIEEYPPRLVALGRVYEGSTSIHNIPLLHDQVKVGVEEIRDANAPIPVPTKEVKVMGQALNTFLAWPTHLVKRLSEQGVVGPAKPVDRPDDEVDDPLYLMTLTIPQLFLKPLQVMWDATLFGLFYENFPLYIKHEDLSEIAHGGQCLSISVIQLWILHMTETSMRAGNIDVYGFLEPQSIQRSGQSQFESENYIKNWMQNSKRDVYLGAYLNGAHWQMVVILPKENVVIWFCSLHNKPDNYLKGIINRSVLFFNIFALALVSALKGLDDTQQSKSKTPARWIVVK

SEQ ID NO: 223406 - protein, 50 aa, Glycine max
  Coding DNA Sequence Number=SeqID_106628
GQNRLRPRLEVETKLTVETNQEDRVTTDRSSSLPGAGQAKNVAAGQPNIL

SEQ ID NO: 223407 - protein, 119 aa, Glycine max
  Coding DNA Sequence Number=SeqID_106629
  Gene Ontology: Cellular component=nucleus; Biological process =regulation of transcription, DNA-dependent
  Homolog annotation: Hit_ID=Q1EPA1; Match level="QueryCoverage=90%, HitCoverage=10%, E-value=1e-20, Identity=40%"; Hit description =Paired amphipathic helix repeat-containing protein / transcription regulator-related
  Pfam annotation: Domain name=PAH; Domain location=18-64; Score=53.7; E_value=6e-13; Accession=PF02671.11; Description=Paired amphipathic helix repeat
MDALQYIKEVQCAFHDSGEKFDKFMDVMKDYKFHRIDVGIVVEKMEEILKDHGDLILGFNKFLPKGYEILLLDEGEDGFGNASKYLKKIQAATLFEGHRDLLRDFTKFLPSVHLRGKST

SEQ ID NO: 223408 - protein, 66 aa, Glycine max
  Coding DNA Sequence Number=SeqID_106630
MPTSEANKESLRLFMEMYAAISIKIKDLDPVVMLHSIVMALKLGSFADNLCKKQPEDLDKLKARAT

SEQ ID NO: 223409 - protein, 140 aa, Glycine max
  Coding DNA Sequence Number=SeqID_106631
MAPHCTKAFNAKILYLPPPARSFNLADRSKQSRYHQNFGRTTEEYVVVKERIEELIQEGALTKYIYSPNNNRDRDRGWGEVEAAIIVLKVKKYVDDKQEQIKAKSDPANNLSTGESGLHVVINTIIGGFEIQLITLEGIE

SEQ ID NO: 223410 - protein, 962 aa, Glycine max
  Coding DNA Sequence Number=SeqID_106632
  Gene Ontology: Mol. function=importin-alpha export receptor activity; Cellular component=nuclear pore; Biological process=protein import into nucleus, docking
  Homolog annotation: Hit_ID=Q9ZPY7; Match level="QueryCoverage=99%, HitCoverage=99%, E-value=0.0, Identity=69%"; Hit description =Importin-alpha re-exporter
  Pfam annotation: Domain name=CAS_CSE1; Domain location=522-953; Score= 343.4; E_value=3.8e-100; Accession=PF03378.6; Description=CASCSE protein, C-terminus
  Pfam annotation: Domain name=Cse1; Domain location=158-521; Score =689.4; E_value=2.6e-204; Accession=PF08506.1; Description=Cse1
  Pfam annotation: Domain name=IBN_N; Domain location=29-100; Score =59.2; E_value=1.4e-14; Accession=PF03810.9; Description=Importin -beta N-terminal domain
  Pfam module annotation: Pfam domain module=CAS_CSE1::Cse1::IBN_N; Domain location=522-953::158-521::29-100
MEWNPQTLQFLSECFLHTLSPSPEPRRRAESSLAEAADRPNYALAVLRLVAEPSIDDQIRQAAAVNFKNHLRLRWASDDSPVPDPEKDQIKTLIVPLMLSATPKIQSQLSEALALIGHHDFPKSWPSLLPELIANLQKASQSSDYASINGILGTANSIFKKFRFQYKTNDLLLDLKYCLDNFASPLLEIFLKTASLIDAGAMNLRPLFESQRLCCRIFYSLNFQELPEFFEDHMKEWMGEFRKYLTTSYPALESSGADGVALVDELRAAVCENINLYMEKNEEEFQGFLNDFALAVWTLLGNVSQSSSRDRLAITAIKFLTTVSTSVHHTLFASDGVIPQICQCIVIPNVSLREDDEELFEMNYIEFIRRDMEGSDLDTRRRIACELLKGIAMYYGDAVKSIVSAQIQNLLSSYAANPGTNWKDKDCAIYLVVSLATKKAGASVVSTELVDVQSFFESVIVPELQSADVNGYPMLKAGALKFFTMFRTQISKPVALKFFPDLVRFLTAESNVVHSYSASCIEKLLLVKDEGGGARYTSADINPIFPVLMNNLFGAFKLPESEENQYVMKCIMRVLAVADISIDVARVCVEGLGSLLAEVCRNPKNPTFNHYLFESVAILVRRACEGDSTLVSVFEASLFPRLEVILTNDVTEFLPYTFQLLAQLVELNRPPIPPIYMQIFELLLSPETWKRASNVPALVRLLQAFLQKAPNEITQGDRLTKVLGIFDTLIQASSTSEQGFYVLNTVIESLEYNAIKPYISHIWAALFRELQKRRTVKLIKSLLIFMSLFLIKHGAANVVDTMNSVQPDIFVVILNQFWIPNLKLITGAIELKLTAVASTRLICESPVLLDPAASVSWGKMVDSIVTLLSRPEEDRVQEEPDMPDITENAGYSTTFVLLYNAGKKEEDPLKDIRDPKEFFVASLSRLSALSPGRYPKVISENVDPANQAALLQLCNTYNLSIV

SEQ ID NO: 223411 - protein, 164 aa, Glycine max
  Coding DNA Sequence Number=SeqID_106633
MDSRITKVEEDVTIIRDCLDLPPQPSDCHHQKGGDYGSNVFQGYFDDAKESRVKQNPKIQESSIKFQDSRLNIQDSRIKTKESRFKNNQDQDSRLKIQESREDSIKISTKKKFFKTLSSTRSFHKIITKEFYSLVIDYQKVVIDMNPHVLISNRLPVASIIFKN

SEQ ID NO: 223412 - protein, 133 aa, Glycine max
  Coding DNA Sequence Number=SeqID_106634
MSRKDSYIYKILKEIRKGTKITSNPLEKLADHCVENTVNKRNDEGCDPRSQLCNARAPLCISSSFCILPLVSPSFCICLSLICMTFYRKKSQEVWTNSPRRVELAQSSFLLSAKDTHSLRQAVASLGELIAYA

SEQ ID NO: 223413 - protein, 148 aa, Glycine max
  Coding DNA Sequence Number=SeqID_106635
DPLEEQASQGSFVAYGPGVMVKQYFGPAPRTSHTSSSMAPEDQEQLMQKIRDQLEEDSHYRLSPRLVLQLLMSTQRRVVLIPQGMTKTRGSTTIHNIPLCHDQIKVGVEEVRDVDAPIPIPTEEVQLVGQTLNTFVAWPTHLVKRLSE

SEQ ID NO: 223414 - protein, 154 aa, Glycine max
  Coding DNA Sequence Number=SeqID_106636
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=2e-19, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=71; ConfidenceScore=5.39e-01
ARACSPLKARTYSPLKARTCSPLKVACSPLKVRACCPLKVSACSLLKAWACSPLKARTCSPLMVRACRPLKARACSPLKARACSPLKARTCSPLKARTCSPLKVTACSLLKARTCSTLRSRTCSHLKGRARSLLKARTCSPLKARTCSPHMVRA

SEQ ID NO: 223415 - protein, 51 aa, Glycine max
  Coding DNA Sequence Number=SeqID_106637
  Subcellular localization annotation: CTP_CleavageSite=39; ConfidenceScore=5.49e-01
MATPPASPPPPVVASVFMSTQKRTRKATRLRSLATRPPRAKRPVVNVEDIQ

SEQ ID NO: 223416 - protein, 98 aa, Glycine max
  Coding DNA Sequence Number=SeqID_106638
  Homolog annotation: Hit_ID=Q6CQF2; Match level="QueryCoverage=34%, HitCoverage=41%, E-value=1e-07, Identity=76%"; Hit description =Kluyveromyces lactis strain NRRL Y-1140 chromosome D of strain NRRL Y- 1140 of Kluyveromyces lactis
MVAQARAVDMLVETSSSRLWMAARALGVPRHLRAPGVGLWAPHSARLETRTKESDMCASQRASKPHTCRDPKDGELCLSGAKPEETLVEARSDTDVQI

SEQ ID NO: 223417 - protein, 158 aa, Glycine max
  Coding DNA Sequence Number=SeqID_106639
MHARARVMGEIDEVQEQMKVDMEALKEKMATMMEAMMSMKKILEANAAVAAATSTVAEVYPTPPSSPKQINHPTSDMIGQGGKELGSTGGPHFVQVQNKHAFPPYGLPPNYTPPNVAHTSDENVDNSTPILIESQQTQFDHAHVFQPMGETHEIPTTT

SEQ ID NO: 223418 - protein, 353 aa, Glycine max
  Coding DNA Sequence Number=SeqID_106640
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=6e-55, Identity=31%"; Hit description= UPI00006A17C9 related cluster
RLHVLSFRGLNILTFRGLHVLTFKGLHVLAFRGLHVLAFKGLHVLTFKGLHVLTFKGLHALTFSRLHVLPYRGLHVLTFKGLHALAFIGVNALTFRGLHVLAFRGLHAFTFRGLHVLTFKGLHVLAFRGLHVLTFKGLHVLTFKGLHALTFSGLHVLAFRGLHVLTFKGLHALAFIGLNALTFGGLHVLSFRGLHTLTFRGLQDYTSSPNKGLRALAFKGLQILAFKGLHALAFKGLDALAFKGLHALAFKGLHALTFRGLHVLSFRGLHVLTFRGPQALTFRGLHVPVVLTFRGLHALTFRGLHVLAFRGLHVLTFRGLHALAFVGLHAFTFRGLHVLAFRGLHALSFRGLH

SEQ ID NO: 223419 - protein, 255 aa, Glycine max
  Coding DNA Sequence Number=SeqID_106641
  Gene Ontology: Mol. function=transferase activity; Biological process= UDP-N-acetylgalactosamine biosynthetic process
  Homolog annotation: Hit_ID=Q2NWI9; Match level="QueryCoverage=82%, HitCoverage=50%, E-value=8e-95, Identity=85%"; Hit description=UDP-N- acetylglucosamine 1-carboxyvinyltransferase
  Pfam annotation: Domain name=BolA; Domain location=1-40; Score=10.7; E_value=0.00023; Accession=PF01722.8; Description=BolA-like protein
  Pfam annotation: Domain name=EPSP_synthase; Domain location=46-255; Score=3.6; E_value=9.7e-12; Accession=PF00275.10; Description=EPSP synthase (3-phosphoshikimate 1-carboxyvinyltransferase)
  Pfam module annotation: Pfam domain module=BolA::EPSP_synthase; Domain location=1-40::46-255
MFGELSRVKKQQAVYAPLMEYIADNRIHAVSIKTYTPAEWARDRKLNGPTRLSGEVTISGAKNAALPILFAALLAEEPVEIQNVPKLRDIDTTMKLLSLLGARVERNGSVHVDAREVNVFSAPYDLVKTMRASIWALGPLVARFGQGQVSLPGGCAIGARPVDLHITGLEQLGAEIKLEEGYVKVSVDGRLKGAHIVMDKVSVGATVTIMSATTLATGTTIIENAAREPEIVDTANFLNTLGAKISGAGTDKITI

SEQ ID NO: 223420 - protein, 411 aa, Glycine max
  Coding DNA Sequence Number=SeqID_106642
  Gene Ontology: Mol. function=ATPase activity, coupled to transmembrane movement of substances; Cellular component=integral to membrane; Biological process=transport
  Homolog annotation: Hit_ID=Q0KEH8; Match level="QueryCoverage=98%, HitCoverage=67%, E-value=1e-106, Identity=48%"; Hit description=ABC -type transporter, ATPase and permease components
  Pfam annotation: Domain name=ABC_membrane_2; Domain location=1-242; Score=120.3; E_value=5.5e-33; Accession=PF06472.5; Description=ABC transporter transmembrane region
  Pfam annotation: Domain name=SbmA_BacA; Domain location=2-293; Score=- 9.8; E_value=9.7e-10; Accession=PF05992.3; Description=SbmABacA-like family
  Pfam module annotation: Pfam domain module=ABC_membrane_2::SbmA_BacA; Domain location=1-242::2-293
VFYDALQNKNYPVFKAQLWRFTYLALIFIVLAVYKIYLTQGLQMRWRRWMTEKFMEKWLAHQAYYHAEQQQIVDNPDQRIAEDLNVLTQYTLSLSLGLLSSLVTLFSFIDILWHVSGPMTFALGQHAITLPGYMVWFALLYAVLGSLLIWWVGKPLVILGFNQERYEANFRFGLIRIRENNDAIALYHGEPREAQQLGDRFDTIRSNWWAIMRITRRLNIATNFYGQFAIVFPLLVAAPRYFSGAIQMGGLMQIASAFGQVQGALSWFIDAFNDLATWKACVNRLAGFNAAVDQVHHQPRGIQLREETAHPLTLDNLSLNLPDGQPLLAGAEMTLQRGDRLLIVGPSGCGKSTLLRAIAGIWPYGAGAIGVAANANTLFLPQRSYIPIGTLREALSYPSLASEYSDPQLMR

SEQ ID NO: 223421 - protein, 192 aa, Glycine max
  Coding DNA Sequence Number=SeqID_106643
  Homolog annotation: Hit_ID=Q015F1; Match level="QueryCoverage=89%, HitCoverage=9%, E-value=2e-10, Identity=29%"; Hit description=[R] KOG1064 RAVE
  Pfam annotation: Domain name=WD40; Domain location=144-180; Score =2.7; E_value=18; Accession=PF00400.22; Description=WD domain, G-beta repeat
  Pfam annotation: Domain name=WD40; Domain location=8-48; Score=4.7; E_ value=10; Accession=PF00400.22; Description=WD domain, G-beta repeat
  Pfam annotation: Domain name=WD40; Domain location=84-122; Score =32.5; E_value=1.5e-06; Accession=PF00400.22; Description=WD domain, G-beta repeat
  Pfam module annotation: Pfam domain module=WD40::WD40::WD40; Domain location=144-180::8-48::84-122
MSCHITNLACLFEGGAHTVSVFDNHVGGGSVSPLIVTGGKGGDVGLHDFRYIATGKAKRHKRADNIGQSSVSSLTRDKDQNVDGMLWYIPKAHSGSVTKVVTIPNTSLFLTGSTDGDVKLWDAQSTKLIHHWSKIHEKHTFLQPSSRGFGGVVRAAVTDIQVVPHGFLSCGGDGIVKLVRLDNHLRAHGIEL

SEQ ID NO: 223422 - protein, 444 aa, Glycine max
  Coding DNA Sequence Number=SeqID_106644
  Homolog annotation: Hit_ID=Q9ZPY4; Match level="QueryCoverage=98%, HitCoverage=98%, E-value=2e-38, Identity=29%"; Hit description =Expressed protein
MATAEVRASWQRAVNRCFVPEDAKRAPKLACCQSSCATSKLFDAGAASASDEFDHAAVDVTHFNQNSSFSNVIPDSRWWLLQLQPNYEVQKGLTYEQLNALEDEVENLNASNENKTCKGDADHFGDENHEYISSMEGMQEANSKKSQGCPQLMDMIAKHEKVETDSVGCTMSKQTNDFSFDSDYSWIGVEKAQPWWRTTDRDELACFVSRKSLNHIENCDLPPPQKYLRVQPSADISNVKIKTSSFDREAKSSAFSNFNVQAKRSLESELMHRKLVPSTNKGHLNFDCDKYSSYPTIHGGVTEQVFEGNPSKAQLMEALCHFQTRARKAEEAAKQACAEKENTIALFFIQASQLFAYKQWFQLLQLEALNSQVKNKDQSISTLFPWIGTEPGERMLKFGNAKQKMLGKPESGIATYAVALALGLSLVGAGLLLGWTVGCMLPRL

SEQ ID NO: 223423 - protein, 241 aa, Glycine max
  Coding DNA Sequence Number=SeqID_106645
  Gene Ontology: Biological process=regulation of transcription
  Homolog annotation: Hit_ID=Q9LVU9; Match level="QueryCoverage=89%, HitCoverage=88%, E-value=3e-13, Identity=32%"; Hit description =Genomic DNA, chromosome 5, P1 clone:MNB8
MGGCEVEFEADQCKIPKLPLLNPPTMHSPERSGMKTPPLFTSASVPFGWEEEPGKPRPCTDIVSFSNPTPKCLELPPRLLLDSQSNNNKSMKLSSPTTVLEGPYPYVATTNNTCNSPSFRMSEDLYGSFGSERGQLGTMVLNQSVGIKEKEQEKEKGWFGSWREKTLKREASGGGSHVFPSSVDYVGTHKKVRSMRKRNRPGSFTNPFHAKSSSVWTRMCEGLKQVVPWRGKKLKKYGCWP

SEQ ID NO: 223424 - protein, 1179 aa, Glycine max
  Coding DNA Sequence Number=SeqID_106646
  Pfam annotation: Domain name=WD40; Domain location=222-273; Score =21.5; E_value=0.0031; Accession=PF00400.22; Description=WD domain, G- beta repeat
  Pfam annotation: Domain name=WD40; Domain location=471-512; Score =6.1; E_value=7.2; Accession=PF00400.22; Description=WD domain, G -beta repeat
  Pfam annotation: Domain name=WD40; Domain location=685-744; Score =17.3; E_value=0.054; Accession=PF00400.22; Description=WD domain, G -beta repeat
  Pfam annotation: Domain name=WD40; Domain location=74-113; Score=3.2; E_value=16; Accession=PF00400.22; Description=WD domain, G-beta repeat
  Pfam annotation: Domain name=WD40; Domain location=757-795; Score =7.6; E_value=4.8; Accession=PF00400.22; Description=WD domain, G -beta repeat
  Pfam module annotation: Pfam domain module=WD40::WD40::WD40::WD40::WD4 0; Domain location=222-273::471-512::685-744::74-113::757-795
MTESEKMNPIDHLPLRLLRSDTVPPAPTFSESTVDFLPHFSGYSWIAYAASSLLTISHFPSPLSPHQTRIGPFFRQSFQLSAHPVAAVAWSPSSPSSGDLAAAADDCIWLFRHDSAAGKGSFCWSQNAVLVQHMKVANIKWTGSGDGIISVGMEVVFWKKSNTCWEVAWKFKADQPQTLVCATWSIEGPSATAAHPSREHIEGTLTNEESKCVLVCQSNGLSEYSKVKLHHPLPVVMIQWRPSRGKLSNRYGKCSVRHVLLTCSLDGTARLWSEIDNAKARRTAKDINDQKNAGCSFCVVAVIEINQSLNATLSSDIFVRWGTEFEGLFQTDKEAKQVFSKEGFEHDVRNCDWLVGFGPGMLLSFWAVHCLDDVSPLRFPRVTLWKKHELQNHDIANVYKFNSSDFKNALFLHKVIILRSCLFGPPTICSSLQLLPCNSLVWSNFRIQTIHNAVEDSNDNVNTDNISSHLTGGVLNLDGHSGKILKVSLHPCTCKVQFAASLDSNGLLLFWSLSNISNCILGCPTLVPTMELCGKLATQDSCSLYTSLKWAPSILGDKLVFFMGHTRGIDCFIVNICQSEEENIECHYLCTIPFSGHGPYEDGPFDIFTIPLNSTCDKTFRNNKLMLLAIWMGRFQALSWEVNLHSFDMSTNCCECNFDVKSIDNCSVRAFESTFANKKYCITVNPCSCEFPSSKDLVTSFAVADSGTLSHRQQEFSLANDLCSSYPAYIMATGSSDGILKLWKSKPGNSLTQHLPWELVGSFVAHDGPIKDICLANCGEKIATFCYESNSNAINTIHIWDAVPLISAGTFILEDKIKTESDVIALKWLTLGTGELLLGVCLQNELHVYAPKRCVGTTLSDSVNFPKMNIWVCIAYAHTSIPIYDFLWGPRAAAVVIHGNYFSIFSHWLFHEDKKQGSKFRPCDSKPNTYNCKDEIYEDILSSVFTEYDIGAYREQSLGDSHADFDSVQSIKINMKDNSSSLFLAKEQLKSELLTKVGLWSILEVAEIISGSLPTYHPDVLLTNISSGNWKRAYVAVRHLVECLTNYDPKKRHISKRIGLPNVLLSYYLEGCIPKGSQPKGFQWGGDAALITSISQAQSSLFRFPYHSDSSVENESISSSTKSELNDFIESLEKFPDLPFLVDIEKTQILAIIDLLSEVSSAHSSSAYQSLDEPGRRYS

SEQ ID NO: 223425 - protein, 1108 aa, Glycine max
  Coding DNA Sequence Number=SeqID_106647
  Homolog annotation: Hit_ID=Q4WS81; Match level="QueryCoverage=13%, HitCoverage=11%, E-value=1e-24, Identity=40%"; Hit description=WD repeat protein
  Pfam annotation: Domain name=WD40; Domain location=1015-1052; Score =10.9; E_value=2; Accession=PF00400.22; Description=WD domain, G-beta repeat
  Pfam annotation: Domain name=WD40; Domain location=964-1000; Score =6.2; E_value=7; Accession=PF00400.22; Description=WD domain, G-beta repeat
  Pfam module annotation: Pfam domain module=WD40::WD40; Domain location=1015-1052::964-1000
MEKLARAQYLKNKNPKDCALLYIALNRVQVLAGLFKISKDEKDKPLVGFLSRNFQDEKNKAAALKNAYVLLGKHQLELAIAFFLLGGDHSSAINICAKNLGDEQLALVICRLVEGHGGPLEHHLITKYILPFAIDKGDYWLASLLEWEMGNYYQSFYRMLEFSVNPVPRESTVMSNCGPFLDPTVGFYCQMLATKNSMRNAVGEQNSAILLRWATLMTVAALKRCGNPLEALEYFSSSLSMPGTADQESELGDSHDVLSSTLKPLPRKCSNWLSANMSVHLEFHIKLNLALCYLSKLIKEHPSWLDTFAEYNGEASDSDEYMMQYEKSVESFKQKLYTGLALFERRFLLAPRCLISMILLLLCHHGSLYIGYDMTDGYTQAELSQKKSNIFDDFNLYYSRIKPLFKTAEEVSFFYSRFFCACSMENSQQNSSIDSKPKFLDAFQCCFEGVLISLWFLRANFRIQLSSICKDLVKTHLDILDLYEYYLHFSLAWLQKNSEALLYMLEPFLVAQSNDRNPYNIDIVNLKKLIPKIGQLLAQTSFMSNIQNLQLSERAEDKLVADIKHSIPDDERWKIIGTCLWQHMSRFMIFNLNLVLAKLEDGKLSGPFHRKYTYGESYLINMDSESISLPEKIRLVLFSLCDLLMTTVTHISSYHVKQQAEFLWQKVGNDLNVMTLQWLKQKSEFSQNQNLDILELGNMKDNYSVNQLLWDRCADPKLISDCFAQEKLNWPNDLDQMNTKGWNDLSIIMTGLHKTDDTCGDGCKLSTRSSNHEVGTPVKGTSLSGNASARSNQKDITYTNFAVFQSPREMYKRNGELLEALCINSTNQREAAVAGNRKGSVLSFLLWVGIECGAKKGIMFFHWEDEIPFSGKSDDLLWATADWPQNGWAGSESTPAPTCVSPGVGLGSKKGAHLGLGGATIGVDSSAWPSNDLTGGGVLGMLGYTGIGASGLGWEIQQDFEDFVDPLATLENISTRALSSHPMRPFFLVGSSNTHIYLWEFNKDKATATYGVLPAANVPPPYALASISALQFDHFGHRFASAALDGTVCTWQLEVGGRSNVRPTESSLCFNGHASYVLSLSQLLVAIVEILALQQILFRFYCIPLILS

SEQ ID NO: 223426 - protein, 49 aa, Glycine max
  Coding DNA Sequence Number=SeqID_106648
MNIIKINIEGSLWHNFVQCILEELTDKGSRKVHHEDQHTRIEYLICKML

SEQ ID NO: 223427 - protein, 132 aa, Glycine max
  Coding DNA Sequence Number=SeqID_106649
  Homolog annotation: Hit_ID=Q00M75; Match level="QueryCoverage=20%, HitCoverage=4%, E-value=1e-07, Identity=100%"; Hit description=PPR -repeat containing protein
MTKLRPSPNNIVTPPSSCHTKGIKESRLEQLDEIQVKAINASNGENLPKCPTLIFEFTLVAFGKIHWVALLLLRTPLPGGSSLCEGMGEGCCTQPYPCICKEAVSGFEPMTNKSPRHNFTAAPRHNFELGSL

SEQ ID NO: 223428 - protein, 81 aa, Glycine max
  Coding DNA Sequence Number=SeqID_106650
MGWLTFKLSRTRKLQVSKGKAWKGKCKHVFTHFREFLKKLDVNECQETFTSEPGLTDVANLKADSVGLPLSRSETRSLFQS

SEQ ID NO: 223429 - protein, 567 aa, Glycine max
  Coding DNA Sequence Number=SeqID_106651
  Gene Ontology: Mol. function=oxidoreductase activity; Cellular component=intracellular; Biological process=lignin catabolic process
  Homolog annotation: Hit_ID=Q9ZPY2; Match level="QueryCoverage=94%, HitCoverage=95%, E-value=0.0, Identity=62%"; Hit description =Putative laccase
  Pfam annotation: Domain name=Cu-oxidase; Domain location=162-313; Score=189.9; E_value=6.3e-54; Accession=PF00394.12; Description =Multicopper oxidase
  Pfam annotation: Domain name=Cu-oxidase_2; Domain location=415-551; Score=185.8; E_value=1.1e-52; Accession=PF07731.4; Description =Multicopper oxidase
  Pfam annotation: Domain name=Cu-oxidase_3; Domain location=40-151; Score=166.2; E_value=8.1e-47; Accession=PF07732.5; Description =Multicopper oxidase
  Pfam module annotation: Pfam domain module=Cu-oxidase::Cu-oxidase _2::Cu-oxidase_3; Domain location=162-313::415-551::40-151
MANLITLFSLWLSMMSTIYSVKLIANGSTKGESTRFYDFKCSPMPLSPFVDALNGYCTGPVVYAQEDDRIIVKVTNMTPFNVTIHWHGVRQRLSCWYDGASLITQCPIQSGQSFTYNFTVVQQKGTFFWHAHISWLRGTVYGAMIVYPKTGVPYPFNFPYQEHIIILGEYWLQDLQQIENATIASGGPPPIADAYTINGHPGPNYNCSTNDVYQINVIPGKIYLLRLINAGLNTENFFSIAYHNLTIVEADAEYTKPFTTDTVMIGPGQTLNVLLSADQPIGKYSMAITPYKSGRFVKYQNISAIAYFNYIGTSSDSLPLPAKLPKLDDKLAVKTVMDGLRSLNQVNVFKEIDKNLFVTIGLNVQKCHSKKPKQNCQFMHNGVLAASMNNVSFVNPNISILGAYYKKIKGSYTEDFPDTPPKFYDFVNGAPNNISYDTQSLNGTRTKVLKYGSRVQLIMQDTGIVNTENHPMHFHGYSFYVVGYGTGNYNPRTAKFNLVDPPYMNTIGVPAGGWAAIRFVADNPGVWYMHCHIDIHMQWGLGMVFIVNNGKGELESLPHPPPDLPQC

SEQ ID NO: 223430 - protein, 570 aa, Glycine max
  Coding DNA Sequence Number=SeqID_106652
  Gene Ontology: Mol. function=oxidoreductase activity; Cellular component=intracellular; Biological process=lignin catabolic process
  Homolog annotation: Hit_ID=Q9ZPY2; Match level="QueryCoverage=94%, HitCoverage=94%, E-value=0.0, Identity=63%"; Hit description =Putative laccase
  Pfam annotation: Domain name=Cu-oxidase; Domain location=165-316; Score=194.6; E_value=2.3e-55; Accession=PF00394.12; Description =Multicopper oxidase
  Pfam annotation: Domain name=Cu-oxidase_2; Domain location=418-554; Score=179.1; E_value=1.1e-50; Accession=PF07731.4; Description =Multicopper oxidase
  Pfam annotation: Domain name=Cu-oxidase_3; Domain location=38-154; Score=179.0; E_value=1.1e-50; Accession=PF07732.5; Description =Multicopper oxidase
  Pfam module annotation: Pfam domain module=Cu-oxidase::Cu-oxidase _2::Cu-oxidase_3; Domain location=165-316::418-554::38-154
MANLISLFLLSLSMISLIYNVNLLAHGSTKVESTKFYDFKWNEVSPMPFSLFIYALNGYFIGPVVYAQEDDRIIVKVTNMTPFNVTIHWHGVRQRLSCWYDGPSLITQCPIQAGQSFTYNFTVVQQKGTFFWHAHVSWLRGTVYGAMIVYPKTGVPYPFKFPFQEHIIILGEYWLQDLQQLENATIASGGPPPITDAYTINGHPGPNYNCSTNDVYQIDVIPGKTYLLRLINAGLNTENFFAIANHNLTIVEADAEYTKPFTTNTVMIGPGQTLNVLVSANQPVGKYSMGVAPYESGRMIIYQNVSAIAYFNYIGTPADSLSLPAKLPKLDDELAVKTVMDGLRSLNRVNVFKEIDKNLFVTIGLNVQKCHSKKPKQNCQFMHNGVMAASMNNISFVDPNISILEAYYKKIKEIYTEDFPDTPPKFYDFVNGAPNNIPYDTQSLNGTRTKVLKYGSRVQVILQDTRIVTTENHPMHFHGYSFYVVGYGTGNYNPLAAQFNLVDPPYMNTIGVPSGGWAAIRFVADNPGVWYMHCHLDIHKSWGLGMVFIVNNGKGELESLPHPPPDLPQC

SEQ ID NO: 223431 - protein, 84 aa, Glycine max
  Coding DNA Sequence Number=SeqID_106653
MGWNYSNSRMARFVVSKSDGKQWEGSLLSLKRLAKILLKHKHLDNEGKLELLHMMSNDPRCRIQCPDILLENTGSAVQCKIKVK

SEQ ID NO: 223432 - protein, 161 aa, Glycine max
  Coding DNA Sequence Number=SeqID_106654
  Gene Ontology: Mol. function=DNA binding; Cellular component=nucleus; Biological process=regulation of transcription
  Homolog annotation: Hit_ID=Q0PJJ9; Match level="QueryCoverage=99%, HitCoverage=55%, E-value=3e-54, Identity=69%"; Hit description=MYB transcription factor MYB92
  Pfam annotation: Domain name=Myb_DNA-binding; Domain location=5-50; Score=53.2; E_value=8.9e-13; Accession=PF00249.21; Description=Myb -like DNA-binding domain
PDIKRGNITPEEDDLIIRMHSLLGNRWSLIAGRLPGRTDNEIKNYWNTHLSKKLKIQGTEDTDTHNMLENPQEEPASDGGNNNKKKKKNGGKKKNKGKDNAEPPKTQVYLPKPIRVKAMYLQRTDSNTFTFDSNSNSASGSTSQEKDESPVTKESNVVSEV

SEQ ID NO: 223433 - protein, 162 aa, Glycine max
  Coding DNA Sequence Number=SeqID_106655
  Gene Ontology: Mol. function=metal ion binding; Cellular component =integral to membrane; Biological process=ubiquitin cycle
  Homolog annotation: Hit_ID=Q655W3; Match level="QueryCoverage=74%, HitCoverage=64%, E-value=1e-27, Identity=48%"; Hit description=RING zinc finger protein-like
  Pfam annotation: Domain name=zf-C3HC4; Domain location=107-148; Score= 30.1; E_value=7.6e-06; Accession=PF00097.15; Description=Zinc finger, C3HC4 type (RING finger)
MAETPSPSLSQSPSPPFGPIISDGQVGGFDWMVLLAAILCAFVCALGLNTMLQCACRVFTEPRQWIASRRLNSGLKRKEMVALPTSTYTTHSSAASSPSSSPNSSTCVICLAEFSDGDPIRFLPKCNHYFHVVCIDKWLLSHSSCPTCRHLLKSNDSLHSLQ

SEQ ID NO: 223434 - protein, 68 aa, Glycine max
  Coding DNA Sequence Number=SeqID_106656
MSRNFTDCLTMGFKFFEAVKQRLHAIKQWSPDEIRAINSWGSGLDGGGCTNSVRQSIRGAPDSMVEAA

SEQ ID NO: 223435 - protein, 101 aa, Glycine max
  Coding DNA Sequence Number=SeqID_106657
  Homolog annotation: Hit_ID=Q1SKD7; Match level="QueryCoverage=95%, HitCoverage=25%, E-value=1e-09, Identity=34%"; Hit description =Ankyrin
MAPKKLSMKRSRKKAAGEGSSTALEFDSHRFRSVEHQQRFEAIKGWSFHRERRVQLREDEYTDFQEEIARRCWTPLVTPMAKFDPEIVLEFYANAWPTEEG

SEQ ID NO: 223436 - protein, 298 aa, Glycine max
  Coding DNA Sequence Number=SeqID_106658
  Gene Ontology: Mol. function=protein binding; Cellular component =integral to membrane; Biological process=protein amino acid phosphorylation
  Homolog annotation: Hit_ID=Q949G9; Match level="QueryCoverage=94%, HitCoverage=79%, E-value=5e-37, Identity=36%"; Hit description =HcrVf1 protein
  Pfam annotation: Domain name=LRR_1; Domain location=100-125; Score =6.6; E_value=17; Accession=PF00560.23; Description=Leucine Rich Repeat
  Pfam annotation: Domain name=LRR_1; Domain location=127-150; Score =12.5; E_value=1.3; Accession=PF00560.23; Description=Leucine Rich Repeat
  Pfam annotation: Domain name=LRR_1; Domain location=152-174; Score =13.2; E_value=0.97; Accession=PF00560.23; Description=Leucine Rich Repeat
  Pfam annotation: Domain name=LRR_1; Domain location=176-198; Score =12.3; E_value=1.4; Accession=PF00560.23; Description=Leucine Rich Repeat
  Pfam annotation: Domain name=LRR_1; Domain location=200-222; Score =17.4; E_value=0.05; Accession=PF00560.23; Description=Leucine Rich Repeat
  Pfam annotation: Domain name=LRR_1; Domain location=224-246; Score =17.8; E_value=0.039; Accession=PF00560.23; Description=Leucine Rich Repeat
  Pfam annotation: Domain name=LRR_1; Domain location=248-270; Score =18.0; E_value=0.035; Accession=PF00560.23; Description=Leucine Rich Repeat
  Pfam annotation: Domain name=LRR_1; Domain location=3-25; Score=14.1; E_value=0.52; Accession=PF00560.23; Description=Leucine Rich Repeat
  Pfam annotation: Domain name=LRR_1; Domain location=50-71; Score =11.4; E_value=2.1; Accession=PF00560.23; Description=Leucine Rich Repeat
  Pfam annotation: Domain name=LRR_1; Domain location=76-98; Score=8.5; E_value=7.4; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=100 -125::127-150::152-174::176-198::200-222::224-246::248-270::3-25::50 -71::76-98
MTSLTHLDLSYSRFMGKIPSQIGNLSNLLYLGLGGNYHAENVEWVSSMWKLEYLDLSSANLSKAFHWLHTLQSLPSLTHLYLSGCKLPHYNEPSLLNFSSLQTLDLSDTSYSPAISFVPKWIFKLKKLVSLQLSDNYEIQGPIPCGIRNLTHLQNLDLSFNSFSSSIPNCLYGLHRLKFLNLRYNNLHGTIFDALGNLTSLVELDLSVNQLEGTIPTSFGNLTSLVELDLSLNQLEGTIPISLGNLTSLVELDLSANQLEGNIPTSLGNLCNLRKFLLLVFPMDSQDLQFRVHDFQAI

SEQ ID NO: 223437 - protein, 101 aa, Glycine max
  Coding DNA Sequence Number=SeqID_106659
MDVAIVKEFYANLNDPEDKSPKQVRVRGHLVKFDEDTLNIFLKTPMILEEGEILCTYSKFALLRPGPQELAAKLCIPGRGFELNADGQPLKILRKNMTTLA

SEQ ID NO: 223438 - protein, 119 aa, Glycine max
  Coding DNA Sequence Number=SeqID_106660
  Homolog annotation: Hit_ID=Q1SDS1; Match level="QueryCoverage=65%, HitCoverage=15%, E-value=2e-07, Identity=37%"; Hit description=IMP dehydrogenase/GMP reductase
MGTRGCISYNPVLAIRQLGYPMRGAPLEEELAPVISRGFSETNVETLQKVRKAWEVVQKKDKELRGSNNGPIGGYREWLKAHVQGLDWLSSLRTAKREEVEAPEEDEELQALRAELEQA

SEQ ID NO: 223439 - protein, 174 aa, Glycine max
  Coding DNA Sequence Number=SeqID_106661
  Gene Ontology: Mol. function=transporter activity; Cellular component= membrane; Biological process=transport
  Homolog annotation: Hit_ID=Q71CH5; Match level="QueryCoverage=100%, HitCoverage=26%, E-value=5e-77, Identity=87%"; Hit description =Secondary glycine betaine transporter BetU
LFLHQRHGRLDDLIHKALNQRAFWQIGDIAQPALPGNGVAGGGGGDGGHILAVALGQIATQRLKQAVDGDQQDGRERQCAGDGDGLQRAEPPGDQQGDGDDAHQRRPENALPNRRVAGAARSQRIHDHGAGIGGGDEKDDNHRHGDKRKHAGEREMLQEVKQRQRHVLLYRSGE

SEQ ID NO: 223440 - protein, 59 aa, Glycine max
  Coding DNA Sequence Number=SeqID_106662
MQPCKMESDPTSHHKHSAIFNGDDATRVYQNSDGVKPGVCSNRWGINISWENVPIQKTW

SEQ ID NO: 223441 - protein, 132 aa, Glycine max
  Coding DNA Sequence Number=SeqID_106663
MAFTHDFVGKQPMGQFGLERLPHIHPRPGNRSLFLDAREHENGCILGEATLFGQQSAMGYAIRVSLHLDVQKFCSSWTCRCRIGSKIPLAIYTFGYGSKILGFVYMKWHQGSLPQRDPGKTKRPKDQFYSRI

SEQ ID NO: 223442 - protein, 293 aa, Glycine max
  Coding DNA Sequence Number=SeqID_106664
  Gene Ontology: Mol. function=DNA binding; Cellular component=nucleus; Biological process=regulation of transcription
  Homolog annotation: Hit_ID=Q0PJJ9; Match level="QueryCoverage=99%, HitCoverage=100%, E-value=1e-137, Identity=82%"; Hit description=MYB transcription factor MYB92
  Pfam annotation: Domain name=Myb_DNA-binding; Domain location=14-61; Score=45.0; E_value=2.5e-10; Accession=PF00249.21; Description=Myb -like DNA-binding domain
  Pfam annotation: Domain name=Myb_DNA-binding; Domain location=67-112; Score=46.1; E_value=1.2e-10; Accession=PF00249.21; Description=Myb -like DNA-binding domain
  Pfam module annotation: Pfam domain module=Myb_DNA-binding::Myb_DNA -binding; Domain location=14-61::67-112
MGRAPCCSKVGLHKGPWTPKEDALLTKYIQAHGEGQWKSLPKKAGLLRCGKSCRLRWMNYLRPDIKRGNIAPEEDDLIIRMHSLLGNRWSLIAGRLPGRTDNEIKNYWNTHLSKKLKIQGTEDTDTHKMLENPQEEAASDGGNNNKKKKKKKNGGKKNKQKNKGKENDEPPKTQVYLPKPIRVKAMYLQRTDSNTFTFDSNSASGSTSQEKEESPVTKESNVVSEVGNVGEESDGFGFFSEDHDLVNVSDIECHSYFPTDHGNLQQLYEEYFQLLNMDHGQFELNSFAESLLD

SEQ ID NO: 223443 - protein, 292 aa, Glycine max
  Coding DNA Sequence Number=SeqID_106665
  Gene Ontology: Mol. function=cysteine-tRNA ligase activity; Cellular component=mitochondrion; Biological process=cysteinyl-tRNA aminoacylation
  Homolog annotation: Hit_ID=Q9FMB9; Match level="QueryCoverage=70%, HitCoverage=43%, E-value=7e-55, Identity=57%"; Hit description =Cysteine-tRNA ligase
  Pfam annotation: Domain name=tRNA-synt_1e; Domain location=107-292; Score=10.9; E_value=1.2e-15; Accession=PF01406.10; Description=tRNA synthetases class I (C)
MDSNKKWMETEKHSARVSNGDPNQSKKKAKFRNDKAIIDYEMVAKLKGWDAYLNNPLIVNVLGKQCKGGGHFFPNASEKKKVVVWIQISRLSLELYNGMFQWKQKEIFKTKFDAYDFNHLSHARVAVSFDILLRYLKHLGYEITYVRNFTDVDDKIIKRANETGEDPLLLSNHFCDEYNVDMVDLQCETPSKEPHVSEHLNEIKNMITQIINNGYAYKVNDDVFYIVDKCPNYGMLSRQRLEHNRVVERVVVDSRKRNPTNFALWKVLNQASLVGTTLGILEVLGGTLNAVQ

SEQ ID NO: 223444 - protein, 208 aa, Glycine max
  Coding DNA Sequence Number=SeqID_106666
  Homolog annotation: Hit_ID=Q9FNL3; Match level="QueryCoverage=81%, HitCoverage=93%, E-value=5e-50, Identity=59%"; Hit description =Arabidopsis thaliana genomic DNA, chromosome 5, P1 clone:MCL19
  Pfam annotation: Domain name=DUF679; Domain location=49-207; Score =193.9; E_value=3.8e-55; Accession=PF05078.3; Description=Protein of unknown function (DUF679)
MDVIVQEDHDQYMYNNSKNHDEQKLPLLHIMEVPDDDAQRSLIQRAMSQTFQSTAHLANLLPTGTVLSFQLLSPIVTNQGICDSVCKFMTSTLVALCGVSCFLQCFTDSFRDDKGNVCYGLATFRGMWVIDGSTTIPPELGAKYRLRLIDFLHAVMSILVFAAVALFDQNVHAVCGVSYAEAWNWLPTFNKVKCWVLSVFMYGPFSRV

SEQ ID NO: 223445 - protein, 47 aa, Glycine max
  Coding DNA Sequence Number=SeqID_106667
MATKTEVLVVMVFEVVSSVMGKRLKMAVVRWTCCDFDGNNDPDNCKS

SEQ ID NO: 223446 - protein, 79 aa, Glycine max
  Coding DNA Sequence Number=SeqID_106668
DVDGQWVRKQDLPPPIPDEHTPSPPPQRDASSSLLTEVLTELCNLRAFVGEHFDVMDTRFDGMDTHITRLKDYIELVYG

SEQ ID NO: 223447 - protein, 88 aa, Glycine max
  Coding DNA Sequence Number=SeqID_106669
MVSKVWSFDGGFNGEEEEEKSNVRREHESFKEYAQRWRDLAAQVAPPMVERKMVTMIMDTLLVFYYEKLVGYMPSSFADLVFVGERIE

SEQ ID NO: 223448 - protein, 55 aa, Glycine max
  Coding DNA Sequence Number=SeqID_106670
MEVVLKIAITLRTSRRAHDSLGLKPNTRGEKQHFFGYCHWKFVVPHHNANIVGGG

SEQ ID NO: 223449 - protein, 67 aa, Glycine max
  Coding DNA Sequence Number=SeqID_106671
MKMKVVSSKIEAHNSNDIEILHAHTSIAEHFFLLMTKYPLAEQALHELDPLWPRMRNRSHPLLRWWK

SEQ ID NO: 223450 - protein, 84 aa, Glycine max
  Coding DNA Sequence Number=SeqID_106672
TGGTTRPVKDRSASPAEGTSRPVHTGGGPIDPTQDLPPMDLVKGFRLYSFQLPDSMSPAPSPESNPNSPSPVTTMVGHYPTIES

SEQ ID NO: 223451 - protein, 196 aa, Glycine max
  Coding DNA Sequence Number=SeqID_106673
  Gene Ontology: Mol. function=DNA binding; Biological process =transposition, DNA-mediated
  Homolog annotation: Hit_ID=Q10CY9; Match level="QueryCoverage=72%, HitCoverage=18%, E-value=2e-12, Identity=29%"; Hit description =Expressed protein
MESSNVKNKSGGKRKMSSEDTRSYFAWNLEMERVLADVLRDQRNLGNKGDGNWKAVAYSTAAQILSKRFGVHLMADNVKNRFKLWRTWYGIVSDILSQSGFDWDSTKYMITVENEIAWNEYVKSHEEAKRFRFKVIPNWDDIVDLCAKDRATGLGAENALDADDIMSKETNEEEAIHSVSFDLEGSSSATRKNIRP

SEQ ID NO: 223452 - protein, 238 aa, Glycine max
  Coding DNA Sequence Number=SeqID_106674
PNDMRRYLMVIRTFCQLEASEPVDTQRLTSSSAPLSSRDSKSDDMRRYLMVIRTFCQLEASEILMHIHTFCQLEASEPVDTQRLTSSSAPFKRCQHLPTETAKKSRLLSVRLKDGKSDDMRRYPMVIHTFCQLEARDPVDTQRLTSSSAPSSSRDGKSDDMRRYLMVIRTFCQLEASEPIDTQRLTPPSAPLSSRGEKSNDMWRYLMVICTFCQLEASEPIDTQRLTSSSAPLSSTDD

SEQ ID NO: 223453 - protein, 471 aa, Glycine max
  Coding DNA Sequence Number=SeqID_106675
  Gene Ontology: Mol. function=Type I site-specific deoxyribonuclease activity; Biological process=DNA modification
  Homolog annotation: Hit_ID=Q160U5; Match level="QueryCoverage=49%, HitCoverage=55%, E-value=4e-66, Identity=58%"; Hit description=Type I restriction-mod
  Pfam annotation: Domain name=Methylase_S; Domain location=121-284; Score=77.1; E_value=5.4e-20; Accession=PF01420.9; Description=Type I restriction modification DNA specificity domain
TLITALINAFGHKDPKAEPVTDSNGKLVPDTDLTDYENVPYLEDIDDYFAREVLPHVPDAWLDESFTDARDGQLGRVGYEINFNRFFYQYQPPRKLQDIDENLKQVEAEIAALLAEVPEEWLNRKVFHAFQAIGSGTTPPAKEHEWYQGGTIPWITTSELRENTVVKTKKCVTSDAMQKFSALKIFPAGSLAIAMYGATIGRLGFLGIPATTNQACCVLSGERDLNIQFLYYWLMAFRADIVAFFSEGGGQPNINQEVIASLRVPSPAPDEQATIVATLDRETARIDALIEKKTRFIELLKEKRQALITHAVTKGLDPNVKMKDSGVEWIGPVPEHWDVVPSTWLFVESKERAHEDDQHLSATQKYGVISLAEYERLEGRQVTHAVKNLEQRKHVKLDDFVISMRSFQGGIERVKALGCVRSSYVVIQAGDGADKNYFAYLFKSGSYIQGLQATSSFIRDGQDLNYGNFRQ

SEQ ID NO: 223454 - protein, 47 aa, Glycine max
  Coding DNA Sequence Number=SeqID_106676
MAFCCIKNWFRKIEAVGFALEKEGTSWFGIGRKKAMGAQWSLYILQE

SEQ ID NO: 223455 - protein, 128 aa, Glycine max
  Coding DNA Sequence Number=SeqID_106677
MAFLGLVGLSSIGKSTHNGVDYTSDLLGRFLFLWRLSLTLLLLVVRPARQCMWEILKSFAVLIMHQGCHSPWVRSGNLSQLLLVGSLHLCNAVLELLKSICVRHSYRMRMGVFERSLAYEARLSTNHA

SEQ ID NO: 223456 - protein, 65 aa, Glycine max
  Coding DNA Sequence Number=SeqID_106678
MEVKDLVRLVRAESKRRERKGWLCCVRRWEVRQRLRTPTHSLSSFASPQETPNPPPSYVAPTPVR

SEQ ID NO: 223457 - protein, 74 aa, Glycine max
  Coding DNA Sequence Number=SeqID_106679
MHMRIKRSFKVVMGSRTRLMWLEAYKNKMPKSSPNMHVNKEVSTRVKPRLLCKQSMGQNTPNKTDDDGSNSHQG

SEQ ID NO: 223458 - protein, 298 aa, Glycine max
  Coding DNA Sequence Number=SeqID_106680
  Gene Ontology: Mol. function=protein disulfide oxidoreductase activity; Biological process=cell redox homeostasis
  Homolog annotation: Hit_ID=P0AC59; Match level="QueryCoverage=71%, HitCoverage=99%, E-value=2e-85, Identity=72%"; Hit description =Glutaredoxin-2
  Pfam annotation: Domain name=GST_N; Domain location=84-154; Score =12.0; E_value=0.061; Accession=PF02798.10; Description=Glutathione S- transferase, N-terminal domain
  Pfam annotation: Domain name=Glutaredoxin2_C; Domain location=167 -298; Score=252.3; E_value=9.7e-73; Accession=PF04399.3; Description =Glutaredoxin 2, C terminal domain
  Pfam module annotation: Pfam domain module=GST_N::Glutaredoxin2_C; Domain location=84-154::167-298
MGFSRLGLAIGGLIAGPAGAAVDAAQHRRHDHATGAVVAVPAAPGGTGDLQQLVCRFRRSLPYFPHVRKKGDLRHPENHRRNGMKLYIYDHCPFCVKARMIFGLKNLPVELIVMLNDDEATPKKLIGQKMAPILQKADGSAMPESMDIVRFVDNQDRQPLLTGKQNPAIADWLRRVNGYINKLLLPRIAEAAFAEFATPEARDYFREKKQASLGDFAELRKHAPGFIKNISDDLRQLDKLIVKPNAVNGELSEDDIHLFPLLRSLTLVSGIEWPSRVADYRDNMAKQTQVNLLSSIAA

SEQ ID NO: 223459 - protein, 140 aa, Glycine max
  Coding DNA Sequence Number=SeqID_106681
  Gene Ontology: Mol. function=protein binding; Biological process =apoptosis
  Homolog annotation: Hit_ID=Q1S0J6; Match level="QueryCoverage=84%, HitCoverage=38%, E-value=6e-13, Identity=37%"; Hit description =Ubiquitin; Apoptosis regulator Bcl-2 protein, BAG
MTLEELRAKTSSTTPNETLILKVKIIQKYVETLDVLKVKNSMPSSNGDHATVQLQQKHSNGQQQKYLNGHHRSALAPIQEQQQEQEQPSRNSTSGVVVTTNWELFDSVPPLIPVPSTSPSPHPSETNKSGPPKFNWEFFN

SEQ ID NO: 223460 - protein, 111 aa, Glycine max
  Coding DNA Sequence Number=SeqID_106682
MPEHSTRQTSLERLEEAVHKLTQHQATLAQNNQTLTQANADLTLKLDSVLDRLAALTTTPSSPQPPPSSPPPHIPRPHMKLEVPCFDGQDPLGWIFKIQQFFDYQGVFDAD

SEQ ID NO: 223461 - protein, 61 aa, Glycine max
  Coding DNA Sequence Number=SeqID_106683
  Homolog annotation: Hit_ID=Q6T7D3; Match level="QueryCoverage=82%, HitCoverage=27%, E-value=2e-12, Identity=66%"; Hit description=Fiber protein Fb34
MAGTYSQLVTFIIAASCLLADSVRNAYHTKYHDLMGERAPSCQTLRKGVFGARAAFMFSQA

SEQ ID NO: 223462 - protein, 363 aa, Glycine max
  Coding DNA Sequence Number=SeqID_106684
  Gene Ontology: Mol. function=succinylarginine dihydrolase activity; Biological process=arginine catabolic process to glutamate
  Homolog annotation: Hit_ID=Q66B18; Match level="QueryCoverage=71%, HitCoverage=57%, E-value=2e-95, Identity=68%"; Hit description=N -succinylarginine dihydrolase
  Pfam annotation: Domain name=AstB; Domain location=105-363; Score =367.5; E_value=2.1e-107; Accession=PF04996.3; Description =Succinylarginine dihydrolase
AIVTPGIIDMTGVAGLPDEEVFGPLLQVIRYDHYAQAIRLANDTRYGLSCGLVSPQRDQFDQLLLEARAGIVNWNKPLTGAASSAPFGGVGASGNHRASAWSDIMKAFEANFDGLVGLTHHYAGLSFGNEASTRNQLQPSNPRLAAKQGLLKMKALADMGYVQGVIPPHERPNLPLLRQLGFSGSDAQVLAKAARQAPQLLSAASSASAMWVANAATVSPSADSADGKVHFTVANLNNKFHRAIEAPETADLLRAIFRDGRHFSVHDALPQVALFGDEGAANHNRFGADYGAPGVQLFVYGRDGQQQGSAPARYPARQTREASAAVARLHQLDDARTLFAQQNPAVIDQGVFHNDVIAVSNQQ

SEQ ID NO: 223463 - protein, 169 aa, Glycine max
  Coding DNA Sequence Number=SeqID_106685
  Subcellular localization annotation: CTP_CleavageSite=41; ConfidenceScore=5.49e-01
MAEPSKKRKGSSSTAAAAGHRHHGPSGAPTAPIHPSLSSPRSSTLFSSNDQRLRYLSQFSYRIILDPKYLDVEFFNDETFDCYQVFQNSGLVDFMSLKLPHYPELVKVFYCNLKIQDGIITSEVHGIPMVIDQSLFFSLTHLPNQGAPFEGTIVDDWKFDYSSHDARRM

SEQ ID NO: 223464 - protein, 71 aa, Glycine max
  Coding DNA Sequence Number=SeqID_106686
  Subcellular localization annotation: CTP_CleavageSite=35; ConfidenceScore=5.02e-01
MPISPCGSISWSVSFRRGRDSTTAWGWPATGNKCTAATSRASQLIHRKVPDRQVIKRPAQDIKEALLGGNL

SEQ ID NO: 223465 - protein, 170 aa, Glycine max
  Coding DNA Sequence Number=SeqID_106687
  Gene Ontology: Mol. function=oxidoreductase activity; Cellular component=cytoplasm; Biological process=cell redox homeostasis
  Homolog annotation: Hit_ID=Q1RFN6; Match level="QueryCoverage=99%, HitCoverage=37%, E-value=8e-43, Identity=51%"; Hit description =Probable pyridine nucleotide-disulfide oxidoreductase ykgC
  Pfam annotation: Domain name=Pyr_redox_2; Domain location=9-170; Score=34.4; E_value=3.9e-07; Accession=PF07992.4; Description =Pyridine nucleotide-disulphide oxidor
MENIMNHYQAAIIGFGKAGKTLAAALGRAGWRVAIIEKSRAMYGGTCINVGCIPTKALVHDVQHHASFSDAMQRKAAVVELLREKNYLNLAAIAQVDIIDGEAEFVDAHTLKITSSQQVSQIHAERIFINSGAEAVFPVLEGLVPGPRVVDSSGILKLTQLPQRLGILGG

SEQ ID NO: 223466 - protein, 721 aa, Glycine max
  Coding DNA Sequence Number=SeqID_106688
  Gene Ontology: Mol. function=ATPase activity, coupled to transmembrane movement of substances; Cellular component=integral to membrane; Biological process=anthocyanin accumulation in tissues in response to UV light
  Homolog annotation: Hit_ID=Q9LJX0; Match level="QueryCoverage=97%, HitCoverage=98%, E-value=0.0, Identity=59%"; Hit description =Multidrug resistance protein 11
  Pfam annotation: Domain name=ABC_membrane; Domain location=535-718; Score=-40.3; E_value=0.057; Accession=PF00664.13; Description=ABC transporter transmembrane region
  Pfam annotation: Domain name=ABC_tran; Domain location=241-425; Score= 225.6; E_value=1.1e-64; Accession=PF00005.17; Description=ABC transporter
  Pfam annotation: Domain name=SMC_N; Domain location=229-429; Score= -134.5; E_value=0.093; Accession=PF02463.9; Description=RecFRecNSMC N terminal domain
  Pfam module annotation: Pfam domain module=ABC_membrane::ABC _tran::SMC_N; Domain location=535-718::241-425::229-429
MAHVSKARFNVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIINQKPTIVEDPSEGKCLAEVNGNIEFKDVTFSYPSRPDMFIFRNFSIFFPAGKTVAVVGGSGSGKSTVVSLIERFYDPNEGQVLLDNVDIKTLQLKWLRDQIGLVNQEPALFATTILENILYGKPDATMAEVEAATSAANAHSFITLLPNGYNTQVGERGVQLSGGQKQRIAIARAMLKNPKILLLDEATSALDAGSESIVQEALDRLMVGRTTVVVAHRLSTIRNVDTIAVIQQGQVVETGTHEELIAKAGTYASLIRFQEMVGNRDFSNPSTRRTRSSRLSHSLSTKSLSLRSGSLRNLSYQYSTGADGRIEMISNAETDKKNPAPDGYFFRLLKMNAPEWPYSIMGAVGSVLSGFIGPTFAIVMSNMIEVFYFRNYASMERKTKEYVFIYIGAGLYAVGAYLIQHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQILTLLSHLPFYTGENLASHTSWH

SEQ ID NO: 223467 - protein, 161 aa, Glycine max
  Coding DNA Sequence Number=SeqID_106689
  Gene Ontology: Mol. function=ATPase activity, coupled to transmembrane movement of substances; Cellular component=integral to membrane; Biological process=anthocyanin accumulation in tissues in response to UV light
  Homolog annotation: Hit_ID=Q9LJX0; Match level="QueryCoverage=87%, HitCoverage=62%, E-value=3e-66, Identity=56%"; Hit description =Multidrug resistance protein 11
MAEASEPKALPEAEKKKEQTLPFYKLFSFADKCDWMLMISGSIGAIVHGSSMPVFFLLFGEMVNGFGKNQMDLKKMTEEVSKYALYFVYLGLVVCISSYAEIACWMYTGERQVSTLRKKYLEAVLKQDVGFFDTDARTGDIVFSVSTDTLLVQDAISEKVL

SEQ ID NO: 223468 - protein, 253 aa, Glycine max
  Coding DNA Sequence Number=SeqID_106690
  Homolog annotation: Hit_ID=Q7WBK9; Match level="QueryCoverage=47%, HitCoverage=24%, E-value=7e-21, Identity=49%"; Hit description =Methyl-accepting chemotaxis protein
PGAERGGGGGARRRERARVRGGGHRSPGAGAAQRQRGARHSHADRRFPAQDQRGFPPGRSRGRGDSRGGVQHRPGGTHRRPDRRGGANPERGYRRGKPGGVQHGRTGPRDRVRGGPGGSRLGRAAIAGGGLAAGGGSVPPASRPSGRCRGRAGRAAAICRVEVGGRVTRYLEMARAMAPLALPALSVFAVFGVFAELVASVLAMTGGRVGQALLRDQRSSDSTVCGTWLACARTDVPACCRIWALDMFDTSVA

SEQ ID NO: 223469 - protein, 162 aa, Glycine max
  Coding DNA Sequence Number=SeqID_106691
  Homolog annotation: Hit_ID=Q852F8; Match level="QueryCoverage=73%, HitCoverage=70%, E-value=3e-28, Identity=51%"; Hit description =Expressed protein
  Pfam annotation: Domain name=DUF1195; Domain location=1-150; Score =255.9; E_value=8.6e-74; Accession=PF06708.2; Description=Protein of unknown function (DUF1195)
MKDEDGLQMMTTTAATKKESMDSSLFGKGRYKFWVLAAMLLQVFWSMYNGTVSLHWFGTLNSLSSDINTPIHDDLDVLEMEEREKVVRNMWDVCTNNHRVRLPRFWQEVFKAAYKDLMSDAAEVRDAAVTEIAKMFVRSIHFDPPPLQSMVFLNFFFNLPRI

SEQ ID NO: 223470 - protein, 155 aa, Glycine max
  Coding DNA Sequence Number=SeqID_106692
  Gene Ontology: Mol. function=nucleic acid binding; Cellular component= mitochondrion; Biological process=DNA integration
  Homolog annotation: Hit_ID=Q2HSG0; Match level="QueryCoverage=99%, HitCoverage=30%, E-value=2e-61, Identity=72%"; Hit description=IMP dehydrogenase/GMP reductase
MASLRKRFGETINKLVSCANMMNSDFSLLDQVSNKVNVNGDMLHTTVIYWITISGSQVITKKICNSSIFSLRSEFGYSSLFRGFPRYQVGAIVYKMCRGRGEIIFVSSPISITLCNEGRGPWFLKQQPMKNVGRCVNWASLFTEKAMSGRVMDKY

SEQ ID NO: 223471 - protein, 271 aa, Glycine max
  Coding DNA Sequence Number=SeqID_106693
  Homolog annotation: Hit_ID=UPI00006A2901; Match level="QueryCoverage =52%, HitCoverage=83%, E-value=3e-47, Identity=73%"; Hit description =UPI00006A2901 related cluster
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGINDEAFGYLKRVIVTPAVTRACSELTVRRPGKRPRRARSQSVPRPARDDPLSPRKQLEQSTDSRRVRDWDPRAQPSEPILFPRGCSPWRPDAVMSTTGRGRHSVLRIFKGRRGRTGHHATCGALPAAGPYLRLSRFQGGQAVKQKR

SEQ ID NO: 223472 - protein, 152 aa, Glycine max
  Coding DNA Sequence Number=SeqID_106694
  Gene Ontology: Mol. function=unspecific monooxygenase activity
  Homolog annotation: Hit_ID=O04892; Match level="QueryCoverage=67%, HitCoverage=24%, E-value=9e-25, Identity=51%"; Hit description =Cytochrome P450 like_TBP
TGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKSPSAGNGGSNYDSLKVAKCLVI

SEQ ID NO: 223473 - protein, 37 aa, Glycine max
  Coding DNA Sequence Number=SeqID_106695
MAFNIANPWFRSMEHGCMPLLLSGVKQWKHGSSSSKI

SEQ ID NO: 223474 - protein, 97 aa, Glycine max
  Coding DNA Sequence Number=SeqID_106696
  Subcellular localization annotation: CTP_CleavageSite=36; ConfidenceScore=5.53e-01
MRVHCNQASRRPSMITDSPPLLMFPRTRSPVESPTVATYPSAGGRRVTRGMRVPRKEYARSRHQRLFEENVGKTGKDAIYELLSERFRSCIYVRGRY

SEQ ID NO: 223475 - protein, 258 aa, Glycine max
  Coding DNA Sequence Number=SeqID_106697
  Pfam annotation: Domain name=zf-CCHC; Domain location=1-13; Score =6.9; E_value=0.072; Accession=PF00098.13; Description=Zinc knuckle
CKKPGHFKSKCPDLEKPKDKKKKFFKSKKKSPMSSWEDLDHSSSDEHSEEEANLQGTTGQKRYPVDAKLFLRIFKTLKKGHNFHWVEEEVVACSSSIHKDDKVTSSFAELDPPTWIKVLPPPTWKRLHPKVSKPSSPAALRKSVYKIPLGACRKVHIQLFTPMSKFSPLFNGHQVIPLTKEDIFNVGMIMMQCGLTDQWPSYPPEIHIKPTTTIKFMSDRASPRWPPLDLRKKKHKVPPCLTSTSEYDKEGISNYMCM

SEQ ID NO: 223476 - protein, 96 aa, Glycine max
  Coding DNA Sequence Number=SeqID_106698
MYPRKPQMSAVAATKSQISEKLKPEVDLVTEEAMKLPGRETQNSRVCCKVVTTERLITRFISRVLLGAPSSIAGAPSIFVFFQFCHFIRLSHTNVV

SEQ ID NO: 223477 - protein, 314 aa, Glycine max
  Coding DNA Sequence Number=SeqID_106699
  Gene Ontology: Mol. function=protein binding; Cellular component =anchored to membrane; Biological process=protein amino acid phosphorylation
  Homolog annotation: Hit_ID=Q657S8; Match level="QueryCoverage=70%, HitCoverage=46%, E-value=4e-16, Identity=31%"; Hit description =Putative disease resistance protein
  Pfam annotation: Domain name=LRR_1; Domain location=113-136; Score =9.5; E_value=4.7; Accession=PF00560.23; Description=Leucine Rich Repeat
  Pfam annotation: Domain name=LRR_1; Domain location=165-187; Score =14.0; E_value=0.55; Accession=PF00560.23; Description=Leucine Rich Repeat
  Pfam annotation: Domain name=LRR_1; Domain location=200-221; Score =3.9; E_value=53; Accession=PF00560.23; Description=Leucine Rich Repeat
  Pfam module annotation: Pfam domain module=LRR_1::LRR_1::LRR_1; Domain location=113-136::165-187::200-221
AHDNGRGGMLGLFEVMGALLEDPYRAQTHPQPCTDTPWPGVECELSNSNQPIFHVTKIHIGADIVFPFQPCKPSAYLSQSLMKLKYIKTLSIFDCFGASPVILPKTLFGPFTSLEHLALENNPSLCGDIPTSLGEQLDLSYNNLSGQIPMEIGGVLLYSLEQLQLLQKLDLHSNMLSGNIPPDIGKLKGGIPQFIGKLRKLKSLSLSGGQVPPNLGSLPSLDQQNISHNKLSGVLELPGDFIQKLGKMLDLRGNSELCISDQSKKKNLSSYLEIPSCLNTRQRNDNNYFAGTVATQVHVHHGQKIYMSSYLPWF

SEQ ID NO: 223478 - protein, 431 aa, Glycine max
  Coding DNA Sequence Number=SeqID_106700
  Gene Ontology: Mol. function=oxidoreductase activity; Cellular component=peroxisome; Biological process=electron transport
  Homolog annotation: Hit_ID=Q19U05; Match level="QueryCoverage=40%, HitCoverage=93%, E-value=2e-72, Identity=78%"; Hit description =Glycolate oxidase
  Pfam annotation: Domain name=FMN_dh; Domain location=14-422; Score =548.6; E_value=6.5e-162; Accession=PF01070.8; Description=FMN -dependent dehydrogenase
  Pfam annotation: Domain name=Glu_synthase; Domain location=117-410; Score=-219.2; E_value=0.016; Accession=PF01645.7; Description =Conserved region in glutamate synthase
  Pfam annotation: Domain name=IMPDH; Domain location=45-427; Score= -241.7; E_value=0.065; Accession=PF00478.15; Description=IMP dehydrogenase  GMP reductase domain
  Pfam module annotation: Pfam domain module=FMN_dh::Glu_synthase::IMPDH ; Domain location=14-422::117-410::45-427
MEMITNVTEYEAIAKEKLPKMVYDYYASGAEDQWTLNENRNAFSRILFRPRILVDVSKIDLTTTVLGFKISMPIMIAPTAMQKLAHPEGELATARAASAAGTIMVLKDRNVVAQLVRRAERAGFKAIALTVDTPILGHREADIKNRIGSWKAGQGFREASVVCEDINVRRDDFSTVIVNDIHGEIKVGEEGVKGGIAVAASNPVGELLDDGDLPVNVIKGGGGRAGNERVVFAMDFLLVVLLSGGGEFEGGAKVVSDLKTSDSGLASYVAGQIDPSLNWKDIKWLQSITSLPILVKGVLTVEDTRIAIQAGAAGIIVSNHGARQLDYVPATIMALEEVVKAAQGKIPVFLDSGIRRGTDVFKALALGAAGVFIGRPVVFSLAADGEAGVRKVLQMLRDELELTMALSGCRSLKEITRDHVVTEWDRPKFSP

SEQ ID NO: 223479 - protein, 73 aa, Glycine max
  Coding DNA Sequence Number=SeqID_106701
  Homolog annotation: Hit_ID=Q8S7U9; Match level="QueryCoverage=66%, HitCoverage=8%, E-value=2e-07, Identity=53%"; Hit description =Putative pentatricopeptide repeat containing protein
  Pfam annotation: Domain name=PPR; Domain location=7-41; Score=29.1; E_ value=1.6e-05; Accession=PF01535.11; Description=PPR repeat
MTDRDVVSWSSMIAAYVACNSPLDAFHMFREMGMENEEPNSVTLVSLLSACTKMLNLSAVGEPNSVSLGHVGK

SEQ ID NO: 223480 - protein, 131 aa, Glycine max
  Coding DNA Sequence Number=SeqID_106702
MGTCTDKDSVDDTVCKKCAKEGTGHPETKHCPLCVVSWGYEFLENKLMEEKKKKQLEEVAKSGSTDIVIDLLSPIKRHMKWKMAHTKKIEQITSEAAKEIADKIARFLGGAGLTGFLCFPWTSGYTVYCHW

SEQ ID NO: 223481 - protein, 83 aa, Glycine max
  Coding DNA Sequence Number=SeqID_106703
MEGFTDGDRGIASVGLEGKRVGEVVGVKGRGLEEAEESEGVVRRWGGGEGSDEGVPGEEGGGSGRMRRRKGGRWWRLVRGTGR

SEQ ID NO: 223482 - protein, 265 aa, Glycine max
  Coding DNA Sequence Number=SeqID_106704
  Gene Ontology: Mol. function=oxidoreductase activity; Cellular component=peroxisome; Biological process=electron transport
  Homolog annotation: Hit_ID=Q39640; Match level="QueryCoverage=91%, HitCoverage=65%, E-value=8e-98, Identity=74%"; Hit description =Glycolate oxidase
  Pfam annotation: Domain name=DeoC; Domain location=12-212; Score= -74.2; E_value=0.099; Accession=PF01791.10; Description=Deoxyribose -phosphate aldolase
  Pfam annotation: Domain name=FMN_dh; Domain location=1-254; Score =315.4; E_value=9.9e-92; Accession=PF01070.8; Description=FMN -dependent dehydrogenase
  Pfam annotation: Domain name=IMPDH; Domain location=63-259; Score= -244.6; E_value=0.096; Accession=PF00478.15; Description=IMP dehydrogenase  GMP reductase domain
  Pfam module annotation: Pfam domain module=DeoC::FMN_dh::IMPDH; Domain location=12-212::1-254::63-259
MKGGFKRGELATARAASAAGTIMVLKDRNVVAQVVRRAEKAGFKAITLTVDSPILGRREADIKNRFTLPPNLVLKNFEGLDLGKLNKITFQTSDSFAASYAAELYDRSLNWKDIKWIQTITSLPILLKGVLTPEDTMIAIQAGAAGIIVSNHGARQLDYVPATIMALEEVVKATQGRIPVFLDGGIRRGTDVFKALALGAAGVFIGRPVVFSLAADGEAGVRKVLQMLRDEFELTMALSGCRSLKEITRDHVLTEWDRPRFSPKL

SEQ ID NO: 223483 - protein, 93 aa, Glycine max
  Coding DNA Sequence Number=SeqID_106705
  Gene Ontology: Mol. function=RNA-directed DNA polymerase activity; Biological process=DNA integration
  Homolog annotation: Hit_ID=Q1RVB5; Match level="QueryCoverage=97%, HitCoverage=8%, E-value=4e-29, Identity=60%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MVGSLVYAMICIRSDIVQAVGVVNGFMAGPSKEHWSVMKRVLRYIKGTSNVALCFGGPDFVVGDYVDSDYAGGAMSWLSKLQTVVALFTTKVE

SEQ ID NO: 223484 - protein, 226 aa, Glycine max
  Coding DNA Sequence Number=SeqID_106706
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q1EP29; Match level="QueryCoverage=98%, HitCoverage=54%, E-value=5e-75, Identity=60%"; Hit description =Glycosyl transferase family 14 protein
  Pfam annotation: Domain name=Branch; Domain location=50-226; Score =221.3; E_value=2.1e-63; Accession=PF02485.11; Description=Core-2I -Branching enzyme
  Subcellular localization annotation: CTP_CleavageSite=36; ConfidenceScore=5.04e-01
MGLVSTIHSFNSILFFLPSRLAVNQSAPIFVETKISATAPAPAAPAIPRFAYLISGSKDDLEKLWRTLLALYHPLNHYLVHLDLESPLEVRLELASRIEKQSVFSEVGNVFMIPKANMVTYRGPTMIAHTLHACAILLKRTKDWDWFINLSASDYPLVTQDDLLDTFSEVDRSLNFIEHTSRLGWKLEKRAMPLIIDPGLYRTNKSDVFWVGPKRTLPTAFKLFTG

SEQ ID NO: 223485 - protein, 76 aa, Glycine max
  Coding DNA Sequence Number=SeqID_106707
  Homolog annotation: Hit_ID=Q6AVV2; Match level="QueryCoverage=68%, HitCoverage=3%, E-value=5e-10, Identity=54%"; Hit description=Myosin heavy chain class XI E3 protein, putative
  Pfam annotation: Domain name=Myosin_N; Domain location=12-53; Score =19.8; E_value=0.0096; Accession=PF02736.9; Description=Myosin N -terminal SH3-like domain
MIQGIPENIVVGSHVWVGDPELVWIDGQVVNINGQEAEIQTSNENKLVSEPYKGRRGWLKQCKKERKFKAVAPLLY

SEQ ID NO: 223486 - protein, 92 aa, Glycine max
  Coding DNA Sequence Number=SeqID_106708
MGGGNRSGRPTGAIGQAQDSKIHRRLGSGLLKPSLAWPIPIPNCKEWPNVEGSHCCGSLERVKYMNPIKGTLSMTSTFEQQVELQSWRESNA

SEQ ID NO: 223487 - protein, 66 aa, Glycine max
  Coding DNA Sequence Number=SeqID_106709
MRHYSTFIMDPHEFYMKGMRAGACDDKFMAVLNTSDLGNTLRCLELDQGAVFSMGLGGVKEKDVTV

SEQ ID NO: 223488 - protein, 189 aa, Glycine max
  Coding DNA Sequence Number=SeqID_106710
MDKYCLVSSVLIKLLSLNKCCSGCFCQVVCDGHIFGVPDKACAAHMQYSCMWQGLWGSIEEPIIDRKVILIGSSLFEDTRRGSSDTEFSSSERVSASFLAPTEWHDFLLLSGSQSRSLLSQHALLRACEERLTGALSKGGKMRGVATNEGISTSHVDKSGALAPTYPPSKRKSDLRSSFLRVNQAILFT

SEQ ID NO: 223489 - protein, 96 aa, Glycine max
  Coding DNA Sequence Number=SeqID_106711
  Gene Ontology: Mol. function=aminocarboxymuconate-semialdehyde decarboxylase activity; Biological process=metabolic process
  Homolog annotation: Hit_ID=Q9STA5; Match level="QueryCoverage=84%, HitCoverage=17%, E-value=9e-20, Identity=60%"; Hit description =Nodulin 6
MENLKKLNLVGNTITVSGDIFGLKSIPTYCSGLEINTNVTKKDVEEGLRQDILTHHSILSVGKPVRIANKNLIDYIFLQSLEVAQSYDLPMQIHTG

SEQ ID NO: 223490 - protein, 340 aa, Glycine max
  Coding DNA Sequence Number=SeqID_106712
LTYRATKGAKYFEAANQRLHIINQSVGSPSSTPVVVGYESVRDDILKYMSCLTSTASVTVLQRQVKLENPKNSCKLVVQACKSGPGSHSTLNRFSVCSVRALECGPFSTPPKQLDNVFLFFFQMKLSGKIGWVSLNSVSKKLFEFDSNIFCRFKDYFFKVLATCIVTDGSTDPCGEGRQSNLEQLPASLDMRAILSLPSMSDPLISLDGKVPNLALVRPIGGIVLSSATALDAGEGGQPAGEVGSIAVVTRHGNGAGRGGARMGMPPDSPTLIPQHIPIFVPDTRRVKICYPIPVPIGIDVRCDHPSIAQDVPQAPPAIKVLVVAATHAPPPLPVKRRMT

SEQ ID NO: 223491 - protein, 315 aa, Glycine max
  Coding DNA Sequence Number=SeqID_106713
  Pfam annotation: Domain name=Transposase_23; Domain location=150-220; Score=-5.4; E_value=0.0044; Accession=PF03017.5; Description =TNP1ENSPM transposase
MDEKRKGKLEEAAQSESTDTMIDPLSPIRRHVKWKMARMKKTDQITSKAAKEITEKIDVLTAAIGRPEHPGRVCATGAGVTIKQYFGPTPRTSRTSSSVTPKDLQMQSQFQLQMQSQGLVLSLELEVDPSAARVSTNESCVDPLGNNPDTGDSDKCGLYIEKNPHRLVALGRLYEGSTTVHNIPLLHDQVKVGVEEVRDANAPIPVPTEEVKLVGQTLNTFLAWATHLVNRLSEQGVVGPVKPADRLDHDVDDPIYLMTLTIPQFFLKLLQVMWDVVVFRVYNDNFPLYIKHEDLSEIAHGGQCLSIYVIQLWIL

SEQ ID NO: 223492 - protein, 140 aa, Glycine max
  Coding DNA Sequence Number=SeqID_106714
MGVVPHKDHKIKSYRVISNDTYCNGTNCKDRMAAIHLDATGTELIMRLRTTGTPLSSVEPKDVCSQCGRRQRVFKSKTIRKQAVTYLNRGSDEPQLVCGSCTLSDTCSFSSAVCGSDRVRSKEKGQRGFERAGEKNEFGF

SEQ ID NO: 223493 - protein, 111 aa, Glycine max
  Coding DNA Sequence Number=SeqID_106715
MARMKKIGQMTFEAAKETVDKIASFRGSHTSSSMATEDLKQLTQKIRDQLEESITQKSDSTINDVLHPDAAEVGPSAARVSIKESGVNPSGLVPKMGDLYKCGLYVDDSPP

SEQ ID NO: 223494 - protein, 117 aa, Glycine max
  Coding DNA Sequence Number=SeqID_106716
MTVDNKYFMLQDEDSRAPGSRVAASPGAKSLSESSDGVVGVAGRKSRLYSQLQWRQGFLEQAKQRNQGGRENLASAQNCRPDPATAATLNRPASPTFVAVGCRVAPRRRDSGCDDRY

SEQ ID NO: 223495 - protein, 191 aa, Glycine max
  Coding DNA Sequence Number=SeqID_106717
  Subcellular localization annotation: CTP_CleavageSite=45; ConfidenceScore=5.10e-01
MVFSRFSQGYNSSNGFLDQGTSFVVQVEGTSTWVVVTENKREYISCGSVQVEGTSTWLFKENKGGKSLIKSSNIKKDRSNNQVRDRRVALSSRKGAEAIWSCSEQPMPSTAASHVSHPLCHSARRGRDTTSSCMFIAHPSTATTCATTTRVCTMTKLLLPGGLQAGCSLERQGKKDAKDGGKGDKKDDRGR

SEQ ID NO: 223496 - protein, 335 aa, Glycine max
  Coding DNA Sequence Number=SeqID_106718
MDEISILRGGNSFIISTIAISIKDMASSRINECIGLNPCKIRVKQVEFQLTNKQSFLSQRQLDNLSSQPEPNPKKEDVIVVMTRNKRIQDNSEEKEGFFLKATDGVLIEKDQAPKKVEVLTDGNPVLKKKVNEKKEILTFPKKLDITNLETTNINLHLARSVVYPRGVIEDVLVKVRLGRLTLTLGDEIVCGDSLMKSYPARALDRRLKVDWTRDAREGPRVLMSLRAYKLQWSYIILDPLERVLTNEDLDWELNPEPSIKEPPSNFKYVFINPPSSLPVMIAASLHEIEEKKLLRFCKDKRETFGWNIQDMKVVKGEDAKPTVKMKAYHKAFQQ

SEQ ID NO: 223497 - protein, 47 aa, Glycine max
  Coding DNA Sequence Number=SeqID_106719
MPRPDKPNWPTMHSRSAPHLALSAFRSCAERAMHAGPVLLLDRALGA

SEQ ID NO: 223498 - protein, 550 aa, Glycine max
  Coding DNA Sequence Number=SeqID_106720
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q3KRR4; Match level="QueryCoverage=94%, HitCoverage=95%, E-value=0.0, Identity=74%"; Hit description=9-cis -epoxycarotenoid dioxygenase 2
  Pfam annotation: Domain name=RPE65; Domain location=61-545; Score =801.0; E_value=6.6e-238; Accession=PF03055.6; Description=Retinal pigment epithelial membrane protein
  Subcellular localization annotation: CTP_CleavageSite=47; ConfidenceScore=5.43e-01
MAALNSSTWAKPQFHHPLSSSSSLLTDMGFPTRFPKKPIGEWNPFQKAAAKALDMFESALLSRELSQPLPKTTDPRVQIAGNFAPVPEHPVQHSLPVIGTIPDAVNGVYLRNGANPLFHPKAGHHLFDGDGMVHAVKINHGTASYACRFTETQRLMQEHALGKPVFPKAIGELHGHSGIARLMLFYARGLCGIVDHRSGAGSANAGLVFFNGKLLAMSEDDLPYELRITASGDLETIGRYSFHDQLNSSMIAHPKVDPISGELFTLSYDVTSKYLKYFRFSPEEEKKSPDVEIPLGAATMTHDFAITENFVVIPDQKVVFKLGEMIKGGSPVIYDDEKKSRFGILPKYASDASSIVWVESPDTFFFHFWNAWEERETDEVVVIGSCMTPPDSIFKDTEESLKSVLTEIRLNIRSGKSTRRVVVEEMNLEAGMVNRNRLGRKTRFAYLCIAEPWPKVSGFAKVDLESGEVKRHEYGERRFGGEPFFLPTRGENGNEDEGYVMAFVHDEVTWQSELQILNALDLKLEATIMLPSRVPYGFHGTFVEAMDLPQ

SEQ ID NO: 223499 - protein, 182 aa, Glycine max
  Coding DNA Sequence Number=SeqID_106721
MASRKRHAVPSPGEAANWDTSRFTSEIAWHRYQDNIQLRNILPERNVELGPRMFDEFLQELRRRRWDQVLTHLPEKRIDVALVKEFYSNLYDPEDHSPRFCRVRGQVVRFDADTINDFLDTPVILEDGEEYPAYTRYLSTHPDPDTIAATLCTPGGRFVLNADGLPWKLLRKDMMTLAQTWS

SEQ ID NO: 223500 - protein, 352 aa, Glycine max
  Coding DNA Sequence Number=SeqID_106722
  Gene Ontology: Mol. function=protein binding; Cellular component =ubiquitin ligase complex; Biological process=cell cycle
  Homolog annotation: Hit_ID=Q10CD7; Match level="QueryCoverage=99%, HitCoverage=37%, E-value=1e-136, Identity=71%"; Hit description =Cullin-4B, putative, expressed
  Pfam annotation: Domain name=Cullin; Domain location=1-254; Score =177.1; E_value=4.3e-50; Accession=PF00888.12; Description=Cullin family
GKDVFEAFYKKDLAKRLLLGKSASIDAEKSMISKLKTECGSQFTNKLEGMFKNMFPSSNVQQDHGGIFVCLVDMEHWPTYPPMDVRLPHELNVYQVLHVLVTDFSFNCGLGILSDSLDMDIFKEFYLSKYSGRRLMWQNSLGHCVLKAEFPKGRKELAVSLFQFILASFIAQISIFFYINSARLAVLQTVVLMLFNDAEKLSLQDIKDATGIEDKELRRTLQSLACGKVRVLQKMPKGRDVEDDDLFVFNDGFTAPLYRIKVNAIQLKETVEENTSTTERVFHDRQYQIDAAIVRIMKTRKVLSHTLLITELFQQLKFPIKPADLKKRIESLIDREYLERDKSNPQIYNYLA

SEQ ID NO: 223501 - protein, 439 aa, Glycine max
  Coding DNA Sequence Number=SeqID_106723
  Gene Ontology: Mol. function=protein binding; Cellular component =ubiquitin ligase complex; Biological process=cell cycle
  Homolog annotation: Hit_ID=Q93YY3; Match level="QueryCoverage=90%, HitCoverage=46%, E-value=1e-163, Identity=74%"; Hit description =Putative cullin protein
  Pfam annotation: Domain name=Cullin; Domain location=79-439; Score =194.5; E_value=2.5e-55; Accession=PF00888.12; Description=Cullin family
MSNTKLSPPMKKAKSIDSKNDDAVLKSPAAASDDPNAPALVAANLSRKKATPPHPPKKLLIKFHKGIPTLPPNFEEDTWAKLKSAIGAIFLKQPVSCDLENLYQAVNDLCLYKMGGNLYQRIEKECEAHISAALQSLVGQSPDLIVFLSLVERCWQDLCDQMLMIRGIALFLDRTYVKQTTNVQSLWDMGLQLFCKYLSLSPEVEHKTVTGLLRMIGSERNHHSDMRELELRFLNGFGMEFLSGESVDRTLLNHLLKMFTALGIYAETFEKPFLECTSEFYAAEGMKYMQQSDAPDYLKHVETRLQEEHERCLLYLDASTRKPLIATAEKQLLERHIPAILDKGFTVLMDGNRIEDLQRMHSLFSRVNALESLKQALSSYIRRTGQGIVMDEEKDKDMVSSLLEFKASLDTIWEESFFKNEAFSNSIKDAFEYLINLRQ

SEQ ID NO: 223502 - protein, 214 aa, Glycine max
  Coding DNA Sequence Number=SeqID_106724
  Gene Ontology: Mol. function=6-phosphofructokinase activity; Cellular component=6-phosphofructokinase complex; Biological process=glycolysis
  Homolog annotation: Hit_ID=Q9FIK0; Match level="QueryCoverage=37%, HitCoverage=18%, E-value=4e-23, Identity=61%"; Hit description =Pyrophosphate-fructose-6-phosphate 1-phosphotransferase-like protein
MKVKTARGCLKEDATDVVPMVNEFGMGGEWISGVKPLVASGDVKNTTDAIELPQAHHKLSHDGVKVGAETLAGDNGNTNTRKGGGRRSKEREKNFRFGRDWVSDGGKVVFVVGEANGGFGREICATPFASSSSSSSQTHRRTSPPGYHLLQTSRPNAHRISTSTLSSPSSPTPTTSFSLWKPEVLSPSILDCPVPFVGWFRSSGHGRTEPDLGL

SEQ ID NO: 223503 - protein, 113 aa, Glycine max
  Coding DNA Sequence Number=SeqID_106725
  Homolog annotation: Hit_ID=Q9FQZ5; Match level="QueryCoverage=99%, HitCoverage=87%, E-value=3e-09, Identity=35%"; Hit description =Avr9/Cf-9 rapidly elicited protein 169
  Pfam annotation: Domain name=VQ; Domain location=8-38; Score=37.1; E _value=6.2e-08; Accession=PF05678.4; Description=VQ motif
MTSGPKIVHIETRYVETDAIHFRDVVQHLTGKNSSTTNWVGNGASFSSVACSSDYNKRGIANGGVMSAKPHEDSTTDDKKNSVASSMLLMNVSFKDFEGLLSDMPPMEELLML

SEQ ID NO: 223504 - protein, 75 aa, Glycine max
  Coding DNA Sequence Number=SeqID_106726
  Homolog annotation: Hit_ID=Q9AVI1; Match level="QueryCoverage=77%, HitCoverage=28%, E-value=5e-10, Identity=56%"; Hit description =Putative senescence-associated protein
MCLRHELEFSVNLYGVALSPWERIGSHGVRNFVLFKKPEGVADVDGSTALSRSSRGSGSWKAWFNKSLNLKISTH

SEQ ID NO: 223505 - protein, 350 aa, Glycine max
  Coding DNA Sequence Number=SeqID_106727
  Gene Ontology: Mol. function=DNA binding; Cellular component =mitochondrion; Biological process=DNA integration
  Homolog annotation: Hit_ID=Q1SAI8; Match level="QueryCoverage=98%, HitCoverage=68%, E-value=1e-100, Identity=63%"; Hit description =Integrase, catalytic region
MATTTPPTLTDIKATMHTIGLNPSDVNWYMDTSATSHMTSEQGIRLMRRKNWGDLYPIITNQATSPSTFFALAPSLWHARLAISKARPIHQLDVKNVFLHGELKETLYMHQPMGFRDSNHPNHVCLLKKSLYGLKEAPQAWYQRLTDYVSTLGFFRSTSDHSFFIYRQGTILAYILLYVDDIILIASSDVIRKSIISLLSSKFAMKDLGKYATKIIERANMPSCKLSPIPVDTKPKLSGNSSTPYVDSSHYRSLVNDLQYITFTRPNIAYVVQHVCLFMHDSREEYMHTLKCIVCYIQVGCPDTRRSTSGYCVFLGDNLISWSVKRQATLSRSSAEAEYRGDTNVVSESC

SEQ ID NO: 223506 - protein, 159 aa, Glycine max
  Coding DNA Sequence Number=SeqID_106728
MGGGERRKGTEKEGNFSCNLALSATSALSEYSGDYMLNAEFALSTPSSLFVGFLRAKLWLAADRGVELNLSYALSKMLFNFNFFFKTLLQACRMVIPFRIFIAPDGTIGVFELDAHVSEWYPWRVLRLCDRGFWISNLRFGDDGLEEEDARVLGCEEEP

SEQ ID NO: 223507 - protein, 46 aa, Glycine max
  Coding DNA Sequence Number=SeqID_106729
MAVRKGLYGMVCDKWFFFWTKITSKFSSAPNDALIVMGCSILNNPN

SEQ ID NO: 223508 - protein, 148 aa, Glycine max
  Coding DNA Sequence Number=SeqID_106730
MAAAAPTEVGIDQHDLRHAVDDFAAIDDRLDRLMNLRILTEGTEAYTIVEECVGIARRYTGQPTVAHRSRRRRDQGVPMNPKRMKVILEWPTPPTPLIELVRNHVPSWEDAQEMGVEGRSPEYEEPRDLRSNPFQGGGNDAILSRKGI

SEQ ID NO: 223509 - protein, 87 aa, Glycine max
  Coding DNA Sequence Number=SeqID_106731
MTKLGLCLSSGPPPLDDKRVRITIRMTKLGLCLSSGPPPLDDKRVRITIRMTKLGLCLSSGPPPLDDKKGANNRKVSPRIIGPAASG

SEQ ID NO: 223510 - protein, 131 aa, Glycine max
  Coding DNA Sequence Number=SeqID_106732
  Homolog annotation: Hit_ID=Q1T344; Match level="QueryCoverage=47%, HitCoverage=22%, E-value=6e-08, Identity=39%"; Hit description=RNA polymerase, RBP11-like
MDEDQWMYDSIMSEEVNMDYQNEEEYGVNEPHVDCSNVFNTSQVIMCLTAEMMYCGGLDPLLMKTDLWRSDEYRCRKKEFVRRDTGTRKCGCPFKLRGKLVDGGQGWMMKLMYGIHNHELVKSLVGHPYVG

SEQ ID NO: 223511 - protein, 64 aa, Glycine max
  Coding DNA Sequence Number=SeqID_106733
MGSKIYPKVHENPRAFFSSSSPSLLESSIQYPWGVGLHQVYFIGKKVFKMNGSNASYVMSERYR

SEQ ID NO: 223512 - protein, 61 aa, Glycine max
  Coding DNA Sequence Number=SeqID_106734
MDFMVTTKEPEFLRDVDGTGHSSNSAEQIFHILGQSETTSKQDGVSASNSKNFNSVATELI

SEQ ID NO: 223513 - protein, 160 aa, Glycine max
  Coding DNA Sequence Number=SeqID_106735
MYQSCLNQSQASKHSNTESRCPIPLNSMGFLGLRSEMEDEHSPNFLISPKWHFKLGLTHFNLYLPQNPDLTFQLSKPHSFSTHNTTFSLSSPRNLARLPIISPKTPYPRKSKEKEVHPNLKFRSPTRRDALHDSENALLSRFGAEMMAKGWSFVWSFNGE

SEQ ID NO: 223514 - protein, 186 aa, Glycine max
  Coding DNA Sequence Number=SeqID_106736
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=4e-21, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MQALALTGLHVLIFRGLHNLAFRGLDALAIRGVHILPLRGLHALAFVGLDTLTFKGVHVLNIRGLYIVAIRGLHVLAFRGLHVLHFRGLHAHTFKGYLHRTTRPWHRKASLPHLQRTTHARLQRTTSLCLRRATRPHLQRTTHPRFLSDTRPRLQRTTRLTFQGAARPCLQGATRPCLQRTTRPSL

SEQ ID NO: 223515 - protein, 170 aa, Glycine max
  Coding DNA Sequence Number=SeqID_106737
  Gene Ontology: Mol. function=transition metal ion binding; Cellular component=chromatin; Biological process=cytoskeleton organization and biogenesis
  Pfam annotation: Domain name=Transposase_21; Domain location=1-142; Score=37.5; E_value=8.3e-18; Accession=PF02992.5; Description =Transposase family tnp2
MLCMIIAGPRQPWNDIDVYLSPLTKNLRKLWEDGVDVWDGNLHKTFRLHAMVFCTINDFLAYENLSGYSIKGYHACPIYEKNTSFIQLKHGKKTIYTRHQRFLKHYNPYRRLKRAFDGSQENESAPSPLAGKEVYDQKNVCDSLIGTLLNIKGKTKDGLKCHQDLVDMGI

SEQ ID NO: 223516 - protein, 225 aa, Glycine max
  Coding DNA Sequence Number=SeqID_106738
  Gene Ontology: Mol. function=nickel ion binding; Cellular component =cytosol; Biological process=nitrogen compound metabolic process
  Homolog annotation: Hit_ID=Q8H1P5; Match level="QueryCoverage=65%, HitCoverage=59%, E-value=3e-77, Identity=85%"; Hit description =Urease accessory protein UreD
  Pfam annotation: Domain name=UreD; Domain location=87-222; Score= -46.0; E_value=0.0017; Accession=PF01774.8; Description=UreD urease accessory protein
  Subcellular localization annotation: CTP_CleavageSite=51; ConfidenceScore=5.37e-01
MSYGAVVTHQSGSCTSLIQSNQRVALPSVDGRGRIMRSGEAVREMEMGSVVVEKVGGRSSVTSCFSRYPLKFIIPKKVGSSKTDAVWVYALNYGGGIVSVYKSVGSKCSQQILEARVGSNALLAIIPDPVTCFSTARYCQKQVFCVLPDSNLVMVDWITSGRHESGEKWDFDLYRSTNNIFLEDGQPLFLDTAAGSTNYLYYCLGMCDLKKERFIPYTRFVLVVL

SEQ ID NO: 223517 - protein, 47 aa, Glycine max
  Coding DNA Sequence Number=SeqID_106739
VHCEGCQGMAQDLGAIAEDLEWVINLRMVTEGTDLHDIMTHSLSKES

SEQ ID NO: 223518 - protein, 264 aa, Glycine max
  Coding DNA Sequence Number=SeqID_106740
  Subcellular localization annotation: CTP_CleavageSite=42; ConfidenceScore=5.02e-01
NANEDMKLKLSFGSKSEKLVIPPTSIKGQQQQQPQNGWSTARSTTTFTDHGTVLVRLLLQDLCSWLFFSALFDWWVGVQDKCNHNCGCGDGENLDVVAKIAVVDCSKEEAFFDSKAWLDSDCEDDFYSVNGDFTPSRGTTPVHHTFGTPSRNRIHGSMAETSPEKKKKLLELFRESVKDDQGDVHGHKEVKPTIQDVIMPKSAHCTPYLSEANSACSSERTMSMSEDRSSIREKSVKSLQWCIPSLSSCRSFRERRPKTSPAVE

SEQ ID NO: 223519 - protein, 207 aa, Glycine max
  Coding DNA Sequence Number=SeqID_106741
  Gene Ontology: Mol. function=nucleic acid binding; Biological process= DNA integration
MPMKKLLFLELSGVGKQKDLNELNELHNHQKEERYDLWRECAQAHKDYEDLKMSKHNLWVEYEEHKKSMSFLNNKLLKNQEFKGSGCSRHMTGEKSMFQCLTFYHGGTITFEGNQRGRITSVGLKHNQQSISQLCDNGYGVSFNKDECVILYDDGSLLFSAKRKGNLYKIRLDNVAPCRACKPLIFFINGVICFLKINGSRMEKEER

SEQ ID NO: 223520 - protein, 202 aa, Glycine max
  Coding DNA Sequence Number=SeqID_106742
MDKSLKVGEDEWREGERGEQNFKREKRQNELWFIPLIQDQIQDSPLSVLRCHEASHGPKIYPKAHENPRAFSCISGTIFLESSIQCPWGDRIASLGEISNQKVSCLLSIKEIIGYGIKILAMQVGGQSPNCKKTTFLLVEFLWKMDLGASMRSFNGDFSSWRCSGRQRRRGEGRHHPLGNKPRKKELHHQELPWIRSLKRML

SEQ ID NO: 223521 - protein, 101 aa, Glycine max
  Coding DNA Sequence Number=SeqID_106743
MWDTLAITYKDTSQQDEGLKREKSLAIRSQKNKKASSSRDQVLRSSSKALKVNDSSNDESGEDSDEDELAFISRIISQYIEKQRWVQVEKLLKKNALRQEE

SEQ ID NO: 223522 - protein, 133 aa, Glycine max
  Coding DNA Sequence Number=SeqID_106744
MKVTLEQSLKEAPQADLNAIHKRKQKRLAKAIADEDQDAPTPKREKEVQPVSELQAPVILSAISRCIKTRETKANLEIGDKEWAVSFTRNKEDLTSQSSDSESADDTFIFTLCKHPLSTQLCPPQSPLHLDRY

SEQ ID NO: 223523 - protein, 68 aa, Glycine max
  Coding DNA Sequence Number=SeqID_106745
MSLEKLVGILMKGNSLALSIQKTKKGPESKDSSSNPSSKALSADSSSDGDFKGEFEEDDKLSFISRKI

SEQ ID NO: 223524 - protein, 126 aa, Glycine max
  Coding DNA Sequence Number=SeqID_106746
  Gene Ontology: Mol. function=RNA-directed DNA polymerase activity; Biological process=RNA-dependent DNA replication
MLSPAKPNSSSLDSPLSPKTRLWRFTDSKAYSIKSGYSQVIKKMIVEIKFIPKCVHFVWKVCKDILLVRQNLSRKGMDVDPICPRCGQAEEDIVNAFLLCDEVRRIWFASTWEEESKLVKDLPLRA

SEQ ID NO: 223525 - protein, 124 aa, Glycine max
  Coding DNA Sequence Number=SeqID_106747
NWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGVRVSKVNSLWVDGTM

SEQ ID NO: 223526 - protein, 446 aa, Glycine max
  Coding DNA Sequence Number=SeqID_106748
  Gene Ontology: Mol. function=DNA-3-methyladenine glycosylase I activity; Cellular component=cytoplasm; Biological process=base -excision repair
  Homolog annotation: Hit_ID=Q1SSR7; Match level="QueryCoverage=99%, HitCoverage=99%, E-value=1e-154, Identity=67%"; Hit description =Protein prenyltransferase, alpha subunit
  Pfam annotation: Domain name=Adenine_glyco; Domain location=160-403; Score=251.3; E_value=2e-72; Accession=PF03352.4; Description =Methyladenine glycosylase
MSGAPRLRSMNVADSEARPVLGPAGNKTGSLSSRKTASKPLRKKVDKLLDEIASVKEKKPHQVLLSSVATSSPQSHSASVSLLLPRHEQLLHSNLSLNASCSSDASTDSFHSRASTGRLTRSYSLGSRRKPYVSKPRSVASDGVLESPTDGSQSNKRCAWVTPNTEPCYATFHDEEWGVPVHDDKKLFELLVLSSVLAEHTWPAILSKRHIFSFKSLLSVCLKTLSSSVAYFLDYVYIIFVNKALYREVFVDFEPVAVSKLNEKKIMTPGTIASSLLSEVKLRAIIENARQISKVDWSFFYNIFEKIVSFSAFIFGEITKNRKVIDEFGSFDKYIWSFVNHKPIVSRFRYPRQVPVKTPKADVISKDLVRRGFRGVGPTVVYSFMQVAGLTIDHLISCFRFEECIAAAEGKEENGIMDNHADQKESENIMESDLSIAMEDLSFASE

SEQ ID NO: 223527 - protein, 96 aa, Glycine max
  Coding DNA Sequence Number=SeqID_106749
MTPTHDALLYYNGRWNMPRQNNFVGYAFTGKNPKKFDIPLVCTIDELKDLIKQVAPQGIPPHGHLEYSDKVIKFEIIELKTNDDVMKVLVQSNYWK

SEQ ID NO: 223528 - protein, 294 aa, Glycine max
  Coding DNA Sequence Number=SeqID_106750
  Gene Ontology: Mol. function=GPI anchor binding; Cellular component =membrane; Biological process=cell adhesion
  Homolog annotation: Hit_ID=Q1RVI7; Match level="QueryCoverage=73%, HitCoverage=75%, E-value=6e-59, Identity=55%"; Hit description =Fasciclin domain, putative
  Pfam annotation: Domain name=Fasciclin; Domain location=64-198; Score= 95.0; E_value=2.3e-25; Accession=PF02469.12; Description=Fasciclin domain
  Subcellular localization annotation: CTP_CleavageSite=60; ConfidenceScore=5.02e-01
MKDVLFSLLLFMSFCSVYLTTTLAQAPDTAPSKPIVQTLPQSPSSDTSDSSPDDIIRILRKAKSFNVLIRLLKTTQLINQINAQLITIRSGGLTIFAPDDGSFSQLKAGFLNSLADNQKIELLQFHVLPTYVSSSNFDSLSNPVRTLAGDNPGRLQLNVTAYGNNVNISTGVVNATVTGVVYSDKVLAIYHVDKVLLPLDFFKPKPPAPAPSPAMAPKADNDNSSADARLGTSKDSAGACSLQNQFHKLLLGLELTVFPFLAELIQPIGFGFYWVEGALWEDSKRMSKNEEYDS

SEQ ID NO: 223529 - protein, 111 aa, Glycine max
  Coding DNA Sequence Number=SeqID_106751
MDQEIEETLIQIQSTTVQINSCNSAILVVKTSIIGLELHQLEFCSSSSNGISWKKVDFSFYHISAASLCICKGKAAYNIPPPYLRIAKSLWAMGYEEEKKKKKSSPSIPLG

SEQ ID NO: 223530 - protein, 104 aa, Glycine max
  Coding DNA Sequence Number=SeqID_106752
  Gene Ontology: Mol. function=sequence-specific DNA binding; Cellular component=intracellular
  Homolog annotation: Hit_ID=Q1SN76; Match level="QueryCoverage=99%, HitCoverage=53%, E-value=6e-16, Identity=43%"; Hit description =Transcription factor CBF/NF-Y/archaeal histone
MSHIRTIIKLEDPDLRVSKDALMAVNTAAVGFYSFSSFSMSLSFVASLLISLQETFVEQFVQEAYTCCAEDRKKCLSYDHLDFVPERVKAEDALRERSAAGKGG

SEQ ID NO: 223531 - protein, 59 aa, Glycine max
  Coding DNA Sequence Number=SeqID_106753
MIVKKRLSHEVLKVIVELSSSIGLSAHPPLSAVSACLAQQKNLAKHQYQGRTLSARSVR

SEQ ID NO: 223532 - protein, 32 aa, Glycine max
  Coding DNA Sequence Number=SeqID_106754
MDRKMQGSCISEHDMRTMEMEYMQLVEQKHAK

SEQ ID NO: 223533 - protein, 65 aa, Glycine max
  Coding DNA Sequence Number=SeqID_106755
MDSKIKVVHYALCITLKFLDSSRGLSRKVKDKGLEEELRKKIMQGMLMLSKDQGEPKGVNWCNDS

SEQ ID NO: 223534 - protein, 135 aa, Glycine max
  Coding DNA Sequence Number=SeqID_106756
  Gene Ontology: Mol. function=DNA binding; Biological process=DNA integration
  Homolog annotation: Hit_ID=Q19PK5; Match level="QueryCoverage=44%, HitCoverage=4%, E-value=8e-19, Identity=73%"; Hit description=TIR -NBS type disease resistance protein
MSRNLTDYAIIPSLAFGMVRNFTDCALTRPFNSRHVAELHGLPNDGCQVPQSGEARVTPQQTDNPQTKLGLTCILNSNYKARLVAKGYIQKEGVDYNEIFSPVVRHTSIQILLALMAILDMEVEQLDVKTTFLHG

SEQ ID NO: 223535 - protein, 296 aa, Glycine max
  Coding DNA Sequence Number=SeqID_106757
SKQRKQVTSDLPSLDDEVQITVRKGADDHIGLCMSSNLGSLNDEMRITIRKGANDHIGLCVLSNLGSPNDETLRSPTKGADDHLGLCVSSDLPYLDDEDDHIGLCMSSDLPSSDDKDDHIGLCVSSDLPSPDDEGAENRLRQRAQMTILVSARHQTCHLWMTRVRIIVRCLRVSSDLPSPDDEGADNREASSRVIGLAISDDEVADNREVSPRVIGLAISGIMRLRIIVRFLRVSSDLPSLDDEDLPSPMTRVRITVRCLHVSSDLPSLDDEDDHIFLCVSLDLPSPDDEGADNRE

SEQ ID NO: 223536 - protein, 120 aa, Glycine max
  Coding DNA Sequence Number=SeqID_106758
  Subcellular localization annotation: CTP_CleavageSite=28; ConfidenceScore=5.59e-01
MMIHTLILMPMATPPGSPPPPPPLPAVVSQSLSTLKRTRKATRLRSLATRPLGADRSVVHIDPATGKDDDPHKKKLRIYLGIVAHDKPTRTVWMTLFVKNTTLARRNRPSFVRPAETPRG

SEQ ID NO: 223537 - protein, 381 aa, Glycine max
  Coding DNA Sequence Number=SeqID_106759
  Gene Ontology: Mol. function=nucleic acid binding; Cellular component= chromatin; Biological process=DNA integration
MELKHIGETNKELSEPDDFFVELRLEEGISDKASINTNTKVATSSQYMDDPQEEIMFKQGHHSDHRVKAMQDENWVKAMQEELDQFQKNDIWKLVELPKDKKAIGATWVFCNKLDENEEVYVEQPLGYESDTLPHHVFKLNQTLYGLKQAPRAWYENLSSFLLENGFKQGKVDTTSFHKNYDFQFILVQVYVDDIIFGASNEMLREEFSKLMQTKFEMSMVGKLMFFLELQIKKTSNGIYIHQTKYVKELIEKFNMDDANEMKIPMHPTLYLRLDEESIKLDENQYRAMIGSLLQLTTPTPNIMFSVCLCARFQKEPREVHLSVVKHIFRYLIRTFNLGLWFKRREDFKLTSYCDANYAGDKLERKSTSGSCHSIGGNLLT

SEQ ID NO: 223538 - protein, 138 aa, Glycine max
  Coding DNA Sequence Number=SeqID_106760
  Gene Ontology: Mol. function=DNA binding; Biological process=DNA integration
  Homolog annotation: Hit_ID=Q1RZ71; Match level="QueryCoverage=98%, HitCoverage=32%, E-value=7e-14, Identity=46%"; Hit description =Peptidase aspartic, catalytic; Polynucleotidyl transferase, Ribonuclease H fold
MTRERCMFQFLNPYHGGTVTFRRNKKEQIIGVGLKKNLLSISQLCDSGYDVYFNKDKCIIQNKDGSLLFSAKRKSNLYKIKLGELSNQKSDDGTFLGYSETSKAYIVYNSKTLVVEEAIHVKLNDTEPQRQSINQHQH

SEQ ID NO: 223539 - protein, 259 aa, Glycine max
  Coding DNA Sequence Number=SeqID_106761
MDPSQEVEPPKAIAYPPNLYISKATEIKIIADKFCCHLPIWNATKKKGFKLYHYAKMPNSKIKVEVIVRNYTLKASSFDYDGSDNADHHNFVQLPRPVKTYHFDYAYVCFTKDTDSYAFITRLKNLPIIFNETTYDLTKMDERDFKDHVIQLHDAQKVRREKFEEELAGRTNAEKLQVEAIAKVVDNNIINEKEPVSKQLETLHEATSRKKDVPDAVIVYSTSSCLPPITYAPSNTMTRDQVHDWSSSTFVERHKQENE

SEQ ID NO: 223540 - protein, 77 aa, Glycine max
  Coding DNA Sequence Number=SeqID_106762
MHFTRGGCFGNGENGDGGVASVGANGTLVVGGSSIAGGCWIDEGEGSNYDAIASATTGGATQLQIETFGLVVYFVAR

SEQ ID NO: 223541 - protein, 142 aa, Glycine max
  Coding DNA Sequence Number=SeqID_106763
  Subcellular localization annotation: CTP_CleavageSite=52; ConfidenceScore=5.16e-01
MYACVSHVSSGKAAQSIYSSLVDPHSLHGDSTAHSHTSVSPNRSMSEGESAVQMLEAGSGVTVHVDLDERVGEYVVKIKRSINSTAENEHKLEETKQLAESAGMLLVQAEVLRHMGEQLLVKYRESVQRVIRKPALRIDFSP

SEQ ID NO: 223542 - protein, 135 aa, Glycine max
  Coding DNA Sequence Number=SeqID_106764
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=99%, HitCoverage=5%, E-value=2e-45, Identity=59%"; Hit description=RNase H, putative
MKPHKEETEIVNLGVDEEKKEVKFHIGMTTPIRDELVALLRDYHDIFAWSYQDMPGLSPNIVQHRLPLNPGYTLVKQKLRRMKPEMSLKIKDEVKKQFDTGFLVVVRYPEWVANIVPVPKKDGKVRICMGYPNLN

SEQ ID NO: 223543 - protein, 46 aa, Glycine max
  Coding DNA Sequence Number=SeqID_106765
MLPRKSPEAFSLSWDNEASFEVLIFTLSLSQSAGLVSHLLSATILG

SEQ ID NO: 223544 - protein, 285 aa, Glycine max
  Coding DNA Sequence Number=SeqID_106766
MAPKKLIAKRSRKDATGEGSSAAPQRRVQLRNEEYAEFQEEIARRQWTQLVSPMAKYDPEIVMEFYANTWPTEEGVKDKCSWVRMPLTSFWGIHWFGKKASAVRFPGGGIMHTSMTTVTQIWMTLLLSNILPSDHNSDLPLSKCQLVYVAQLISDANYQFAGITPLRHPVDPEKSNKALGFLALITGLCQFYGVPAGIELSIATARGGPTAANCGCTTIASTGDTIPGVHLQSPEEIRALDAQATVAWPGDEVDFETRSGPMGAPRDDGGAQEDDNMVDVLDFFT

SEQ ID NO: 223545 - protein, 152 aa, Glycine max
  Coding DNA Sequence Number=SeqID_106767
MEESSGFPVLFGGENSNPPDDGGKDKILGLQLSARLQNNGLKDKIFLGLELIARLQHRTRGLRHLTRIHGVDLTNETQDTCPKRSIKKEIYEDVLGISYSTVSQSEKVVAHDLKEPHSGAIKTMSASRKLNTGEKTVLSWMIETGTILQHEK

SEQ ID NO: 223546 - protein, 51 aa, Glycine max
  Coding DNA Sequence Number=SeqID_106768
MGMTRVRRPKLLMLRQPLRKVLIETSQDRLGIEQSSAFRLSRARLRTTTYW

SEQ ID NO: 223547 - protein, 242 aa, Glycine max
  Coding DNA Sequence Number=SeqID_106769
  Gene Ontology: Mol. function=signal transducer activity; Cellular component=membrane; Biological process=signal transduction
  Homolog annotation: Hit_ID=Q1MBR2; Match level="QueryCoverage=100%, HitCoverage=43%, E-value=7e-49, Identity=45%"; Hit description =Putative two-component sensor histidine kinase transcriptional regulatory protein
MATVITLPLILFVGYLMLRLEAEKRDDLQRETIEDVRVVSRNIDRRLQEIATSLNLLSQFPELESGNLAAFQGRVADSLKREGLYAILATKDGQQHLNTRVPFGKPLGKVPAEADLAKAIESRRITVSNIFFGSTSKEWVFNVTMPLDPELGSAGDALILTQNASDLSRLISTENLPRNWAVAIIDGTNRVVVSTAPDEAAIGNPFVTPAILSEMQAFSGNFFDGKGNLYAYAQLPGWQWKT

SEQ ID NO: 223548 - protein, 84 aa, Glycine max
  Coding DNA Sequence Number=SeqID_106770
MSYRMSRHHASEHADYMCPYEQIKQGTIKVAHKTLKSQNSQNNSSIPDLVQNSCSLHDYIAVYDSGLQLLDAGGDLSSSEKSAV

SEQ ID NO: 223549 - protein, 108 aa, Glycine max
  Coding DNA Sequence Number=SeqID_106771
  Subcellular localization annotation: CTP_CleavageSite=75; ConfidenceScore=5.16e-01
MTYQGNPCGVYPDLSSFTGSGVYPDLSSFTGSGIYPDLSSFTGSGVYPDLSSFTRSGVIQKKTLQPVSNDPLLLRIASLSGQTSANIFFDQYRGIMIFVPRLVIVWHA

SEQ ID NO: 223550 - protein, 79 aa, Glycine max
  Coding DNA Sequence Number=SeqID_106772
MGKKKLELGIDNQKISFELFDEEKHLSDQNVCLQVKEFDEKKKNLQKISGVHSLSATLALSTKSSCAKRAIAHAKHLDP

SEQ ID NO: 223551 - protein, 77 aa, Glycine max
  Coding DNA Sequence Number=SeqID_106773
  Homolog annotation: Hit_ID=Q8S5H5; Match level="QueryCoverage=96%, HitCoverage=6%, E-value=5e-10, Identity=41%"; Hit description =Putative tnp2 transposase
MMEENTSPIDKGQWQPHSPNHLIFEDIDTNFSSLLLTLCGMLGANTFIDLVILDATALVFPCQPGLDDISNHPLSFL

SEQ ID NO: 223552 - protein, 92 aa, Glycine max
  Coding DNA Sequence Number=SeqID_106774
MLSRIQFRTLSPLGFTIKYSWRENKESHEDSKNGGFNPFSVSMTFRNSIGTVGGKARGINRDAIIAVRRHVIPLRGVGPESRGKGLDGLFRV

SEQ ID NO: 223553 - protein, 204 aa, Glycine max
  Coding DNA Sequence Number=SeqID_106775
  Gene Ontology: Mol. function=DNA binding; Cellular component=nucleus
  Homolog annotation: Hit_ID=O75376-2; Match level="QueryCoverage=81%, HitCoverage=7%, E-value=6e-07, Identity=24%"; Hit description =Isoform 2 of O75376
  Pfam annotation: Domain name=Myb_DNA-binding; Domain location=23-68; Score=40.8; E_value=4.5e-09; Accession=PF00249.21; Description=Myb -like DNA-binding domain
MVCGAAVNQRTRSGRLHLRRKSDEKWTNEEKAAFLQAVSSFGNDFTMIAQHIGTKSKDQCKKFFIKGHKSHRLDLIHHRLENIGSLLNEVNLSSSTNTNYAHVWEADSVIDNDESGTKTNDDQPSSVVNSSRDKSKPMEAMNLSAYFKESVIGNDKSGTKTNDEQPSSTMNSSHDKSKPVEARNRSPDLNESNEINREFDHHRT

SEQ ID NO: 223554 - protein, 242 aa, Glycine max
  Coding DNA Sequence Number=SeqID_106776
  Homolog annotation: Hit_ID=Q93YA9; Match level="QueryCoverage=38%, HitCoverage=10%, E-value=5e-27, Identity=66%"; Hit description =Lipoxygenase
  Pfam annotation: Domain name=Myb_DNA-binding; Domain location=115 -161; Score=13.8; E_value=0.21; Accession=PF00249.21; Description=Myb- like DNA-binding domain
  Pfam annotation: Domain name=Myb_DNA-binding; Domain location=25-71; Score=24.4; E_value=0.00039; Accession=PF00249.21; Description=Myb -like DNA-binding domain
  Pfam module annotation: Pfam domain module=Myb_DNA-binding::Myb_DNA -binding; Domain location=115-161::25-71
MFSMFNSSNELVEDPLAVEREGAMINRWTLEERNIFSEKLAAFEKDFKKIASFLDHKTTADCVELYYKDHKTNCLEKDKKKKKKKMGCKSQKSKTSTTTLTKERVQEDSTFGGNPMKWTDEEKAAFLQAVSSFGKDFRMILRHAGLLGSISVLISSSTMFLVPILSLMASKCFKIVSLKSYLILFLTITTALTLNCTGFSACTVSVVFIKSSLIAAIGNFAPFLNLTTLVFSVGNGLEKIQK

SEQ ID NO: 223555 - protein, 158 aa, Glycine max
  Coding DNA Sequence Number=SeqID_106777
MIAQHIGTKSKDQCKKFFIKGHKSHRLDLIHHRLENIGSLLNEVNLSSSTNTNYAHVWEADSVIDNDESGTETNDDQPSSVVNSSCDKSKPMEAMNLSAYFKESVIGNDKSGTKTNDEQPSSTMNSSHDKSKPVEARNRSPDLNESNEINRKFDHHRT

SEQ ID NO: 223556 - protein, 147 aa, Glycine max
  Coding DNA Sequence Number=SeqID_106778
  Gene Ontology: Mol. function=nucleic acid binding; Biological process= DNA integration
MKALLGSQDAWEVVEKGYTQHGNEDSLPQNEKETLLKMKKKDQQTFIYQGLDEGMFEMVTNASTSKEAWEILRTSLEGVDKVKKMHLQTLHGEFESLHMMSESILDFVNKVCKSNVEEKVNFVDEKEDEEPTLLLAHNSEENDDKCL

SEQ ID NO: 223557 - protein, 329 aa, Glycine max
  Coding DNA Sequence Number=SeqID_106779
  Homolog annotation: Hit_ID=Q2HTS2; Match level="QueryCoverage=40%, HitCoverage=19%, E-value=2e-32, Identity=52%"; Hit description =Lissencephaly type-1-like homology motif; WD40-like
  Pfam annotation: Domain name=WD40; Domain location=204-247; Score =24.2; E_value=0.00048; Accession=PF00400.22; Description=WD domain, G-beta repeat
  Pfam annotation: Domain name=WD40; Domain location=252-291; Score =1.7; E_value=23; Accession=PF00400.22; Description=WD domain, G-beta repeat
  Pfam module annotation: Pfam domain module=WD40::WD40; Domain location=204-247::252-291
MVQADGFKYYDLDEAKGLVAEKGTSVQEHNINFFCLQISSTSTSAPLSRPSLGGSRIWRLLIMKNAMRLHASYVKEKRGFGESCFVRNDGVAATSNNFGFRTMLLDSMPHVLRRRVGLARVVLSSDVVGQGGGGGRGDELAPHSALSFSLGYLGLSNLLVVERKKKDNGIHKTWRKCSGFSFNEVGCLHSRKSKVLSSHFSSDGKVLVSAGHEKKVIRCNKFSNSSFVYPFRIIATSSFDRSVRLWDAARPTSSLLKLTGQANQVMSLDFHPRKVDLLCSCDNNDTLTVKTPSQLSCLDMIMMNFREVVNRSACSSPSLEFFSWLPGFV

SEQ ID NO: 223558 - protein, 166 aa, Glycine max
  Coding DNA Sequence Number=SeqID_106780
MRLHTWKVARQTLVTNVMRHARGLVENDMCPNGHGAFESSIHVFRDCTLPRKGSHLDHGLIAWEPPLQGELWAIAKGVEIAWSRGFTNHTVESDSKFAISMLDGGCEEANFSKWVTFRNIFPKWVTAGTSLASDVSAFRQQRPFLRVQSEQRVEGAGSRQAQWRVG

SEQ ID NO: 223559 - protein, 291 aa, Glycine max
  Coding DNA Sequence Number=SeqID_106781
  Gene Ontology: Mol. function=nucleic acid binding; Biological process= DNA integration
  Homolog annotation: Hit_ID=Q1S9K1; Match level="QueryCoverage=93%, HitCoverage=66%, E-value=6e-30, Identity=63%"; Hit description =Integrase, catalytic region; Zinc finger, CCHC-type; Peptidase aspartic, catalytic
MASSSNVSTTISSIYNNVQVPLFEGENYDFWAIKMETLFISLDVLELVKEGYEELVATTKATATQREELKKKKITDARVLGMIQRGVSIAIFPRIMRAKTTKQAREILQQEFKGDSKEIKDLSTMSIQGLMGSLRSYEQRLLRCIEKSIESAEEEVETPVEEEEAPMEDEEVVEDQINGVEFAKTTFMKRKIVGTKASHNVTITKSTNHMMGDKDAFIDMNSSFCLKVKLGNGEYVEVEGKGSIGVATKMYAWKTPLPTISKGRSKKNQRSVGIGAHKRIWSHEYLVSCSK

SEQ ID NO: 223560 - protein, 347 aa, Glycine max
  Coding DNA Sequence Number=SeqID_106782
  Gene Ontology: Mol. function=DNA binding; Cellular component=beta -galactosidase complex; Biological process=DNA integration
MEWKKAFSEPPKIFWVCFYAQVPKENRTKLEEANVKSTLLKEEVYVEQPQGFEIEGQEEKVYRLKKTLYGIKQAPRAWDNNIDNYFMEKGFEKSKNEPTLYVKRQANRYTIGCEWKVEERRWWRKVDASNYRSLIGNLFYLTSTSPDIMFATSLLSRFMNSPSHIHLGAAKRVLRYIQDTLNHGIKYDKEVETNVIDFCDSDWVGYMDEMKSTSEYVFSQGSGAFSWCSKKQQTVVKSSAKAEYISAGLATQQAIWLKRIVEDFGEKQGAITIHCDSKSAIAMAKNPIFHGKTKHITIKHHFIREAIEEEKVQLMFCKSNDQVADIFTKALPREKFQKLREALGVQE

SEQ ID NO: 223561 - protein, 174 aa, Glycine max
  Coding DNA Sequence Number=SeqID_106783
  Homolog annotation: Hit_ID=Q1S4N5; Match level="QueryCoverage=41%, HitCoverage=14%, E-value=3e-18, Identity=61%"; Hit description =Peptidase M, neutral zinc metallopeptidases, zinc-binding site
MLDKSELTNENPMKNSQRDPPTLKDGNPQVEIHLDAHHLNLKILVLGKQHNHDKRITAFQNNTNHLTTMEYWFKARASLDLDHRLLIDFKNWIDLPLCELIFYALNPYKASGLDGFQPIFYRSYCNIVGDEVWQLVAKAFAIEDLPPKLVETLIVPIPKIDNPTSLKEFRPISL

SEQ ID NO: 223562 - protein, 179 aa, Glycine max
  Coding DNA Sequence Number=SeqID_106784
  Gene Ontology: Mol. function=receptor activity; Cellular component =integral to membrane
  Homolog annotation: Hit_ID=Q651J5; Match level="QueryCoverage=98%, HitCoverage=24%, E-value=6e-32, Identity=40%"; Hit description =Putative xenotropic and polytropic murine retrovirus receptor
  Pfam annotation: Domain name=SPX; Domain location=2-172; Score=6.3; E_ value=1.3e-06; Accession=PF03105.10; Description=SPX domain
MVKFSKQFEGQLIPEWKEAFVDYWQLKKNLKKVQLLNNANNTQNKHQASTSLPKYIFSSIRNYSLFGHQHREHGPIQVHRKLASSSFNGDMYETELLEQFSDTDATKEFFACLDQQLNKVNKFYRTKEKEFMDRGDSLKKQMEILHMLKTTFKELQSKAGSSHGSKDDQSISCTFSNGT

SEQ ID NO: 223563 - protein, 73 aa, Glycine max
  Coding DNA Sequence Number=SeqID_106785
MRGRLENGKSDWYTGRREMGARVGKEEFGHKGCARALKAFPLEPTKSTIFYVHVDGLLKLVPYPLDMENMGGI

SEQ ID NO: 223564 - protein, 580 aa, Glycine max
  Coding DNA Sequence Number=SeqID_106786
  Gene Ontology: Mol. function=receptor activity; Cellular component =integral to membrane; Biological process=red or far red light signaling pathway
  Homolog annotation: Hit_ID=Q657S5; Match level="QueryCoverage=98%, HitCoverage=75%, E-value=0.0, Identity=59%"; Hit description =Putative PHO1-like protein
  Pfam annotation: Domain name=EXS; Domain location=389-557; Score =282.5; E_value=8.3e-82; Accession=PF03124.5; Description=EXS family
  Pfam annotation: Domain name=SPX; Domain location=23-156; Score= -52.3; E_value=0.022; Accession=PF03105.10; Description=SPX domain
  Pfam module annotation: Pfam domain module=EXS::SPX; Domain location =389-557::23-156
MMDTTSTDDLEKNEAPFSDSPRAEELAKSMQIKRENGKLKTLSGRVINCQGKNLRINIPLTTPSRTFSAISYLLREDLLNQSSRQCGPEGVNNIHLNKTNLHHAEKMIKGGFIELYKGLGYLKVYWNLNMLAFIKILKKFDKASELRASKLMLKIVTEKQILPIYIKVVESSYFNSSDKVMKLADEVEELFIKNFAEENRRKAMKYLRPSQRKESHAVTFFIGLFTGTFLALLAGYAIMAHVTGLYRPHQNSVYMETVYPVLSMFSLVFLHFFLYGCNTLAWKRTRINYSFIFEQAPTKELKYIDIFLICTMAMSAVVGVMFLHLTLLTKGYYYAKVQDIPWLLLLVVMLDFFMADQLCSQVPMLRNLEYVACYYITGSYKTQDYGYCMRTKHYRDLAYAVSFLPYYWRAMQCARRWFDEGQTSHLVNLGKYVSAMLAAGAKVAYEKDGSVGWLCVLVIMSSAATMYQLYWDFVKDWGLLQMNSKNPWLRNELMLQRKAIYYLSMGLNLILRLAWLQTVLHSSFENVDYRVTSLFLASLEVIRRGLWNFFRLENEHLNNAGKFRAVKIVPLPFHEMDEED

SEQ ID NO: 223565 - protein, 101 aa, Glycine max
  Coding DNA Sequence Number=SeqID_106787
  Subcellular localization annotation: CTP_CleavageSite=70; ConfidenceScore=5.19e-01
MAKTKGKKMKSIRHRPTTLKTISQKENEPTKGHSSNKGKRTTWSPSPPPSPKVTSWFSKEHYEVSYVTLRVSWVEEACGDEGHIYPELILYGTLGAFHVSK

SEQ ID NO: 223566 - protein, 55 aa, Glycine max
  Coding DNA Sequence Number=SeqID_106788
MASMWVVHESSMPWCLDVRTMGPKRFSDEGNTYIMEHGDSVRFNTKPVASNNTFG

SEQ ID NO: 223567 - protein, 279 aa, Glycine max
  Coding DNA Sequence Number=SeqID_106789
  Gene Ontology: Mol. function=nucleic acid binding; Cellular component= oxygen evolving complex; Biological process=DNA integration
  Homolog annotation: Hit_ID=Q1SPP8; Match level="QueryCoverage=89%, HitCoverage=15%, E-value=5e-74, Identity=53%"; Hit description =Integrase, catalytic region; Zinc finger, CCHC-type; Peptidase aspartic, catalytic
MEKNHLASLMQNSMKGVQGKLLHGVKRWNKARLVVKGYNQQEDIDFGETYAPVTRFKILYQMDVKNVLLNGYIEEEVYASQPSFFEDHKNPNHVYNLKKALYGLKQVPKQWYERLNNFFLEQKFERVIVNKTLFIKNFSHNILLVQVYVDDIIVGSTYKSLNEDFVHKMQGEFKKSMMGELNYFLGLQVKQLDHGTFIHQTKYYKDLKKFEMDKNKETTTLMATNCYLSTDDKGKSINKTKYQGIISSLFYLTVSRPDIIFSVCICACYQPNPNEYSLL

SEQ ID NO: 223568 - protein, 66 aa, Glycine max
  Coding DNA Sequence Number=SeqID_106790
MKHGYRYEHWTPMDMYTHRERKNQRNKWKVRNILESNETYSTKSHRECEIEIEQVIGKQWKSRTRN

SEQ ID NO: 223569 - protein, 1754 aa, Glycine max
  Coding DNA Sequence Number=SeqID_106791
  Gene Ontology: Mol. function=4 iron, 4 sulfur cluster binding; Cellular component=nucleus; Biological process=regulation of transcription, DNA-dependent
  Homolog annotation: Hit_ID=Q8LK56; Match level="QueryCoverage=82%, HitCoverage=84%, E-value=0.0, Identity=41%"; Hit description =Transcriptional activator DEMETER
  Pfam annotation: Domain name=HhH-GPD; Domain location=1329-1466; Score=50.8; E_value=4.6e-12; Accession=PF00730.15; Description=HhH -GPD superfamily base excision DNA repair protein
MNFGKQLLGQDDRQFEMNNTWVPIPPEKLIQLTSNTPSDWPVNQMSGPNYQEISVPGSDYMKEKLMHYPGPHQNLPLMGQIGHQTRENKMFDGKLMHRNSVLDYIPGSYTQPWHYESNGSNSNTSEQLLKKDITNIDSANRNLDVNNNMAARNPLLSMFYPQASSDMSDPYAGVQRCNIHSALDILFREANSLLFPNRNSEFGGSSSNSLLNNDIHCSVPNQLEGFFSEIPYGDPYHNYNLNYVPIAEAGTTASFTNSLQSVPAEAGATASFTNSLQSVPAEADATASFTNSLQSVPKLMDQLKFVDNQFFTIPDYIIAESTSQEKDKQKDLVSSTQNEVREHCDGLLQENVDSSSAAISTTYGDQKGSDNIRGKGSDLGFDLNKTPEQKATQRRKHRPKVIKEAKPKRTPKPATQKTQVKENLHKKRKYVRKTAATPQTDVIEESVDSIVATKKSCRRALNFDLEHNKYASQSTIGCQQEINHRNEKAFNTTSDHKATEMLDGATMTYGKNSALLISSWDELTVENQQPRNTEDNTLLLHEKQANNILSERKSITALSATTQEPQIAKFLVAEEGPAQEDSDLCQEGNNGCMHQYIHTKQIANRYQSEACFENSQKTREPICQNTLQLVPNILSNSIEAAKGSKRKYRKRTQKQHDSATNSCDTSLCQETLQAHGNFRGATPAKDVIKKQKIKKTQNRHNAKISGRSSSQIMSKEKIGFHTQSNEEIPYICIESNRFVEQQNNGTLTGECFAISEEHSNLIDEIICRPNDLKLRESNMSEMEGLKALVPYNGDRSVVPYQEFELLKKHKPRPKVDLDAETERTWKLLMGKVGSEGLEETDKEKEKWWDKERNVFHGRVDSFIARMHLIQGDRRFSKWKGSVVDSVIGVFLTQNVSDHLSSSAFMSLASRFPLQSKSSKKTYDVDTNTLFKEAGLNILNPADTITSYGYGTLNQPTYHLGFETPHHAKELWRDCETSRTKGSLIKLNNQSSVEEFLSPQDSLDSSITQDARNRYSSGSNSESEGLDCRCEHRKTQFLTSTNSLQVGKTTMFQEFYNSVNGVSLFEERNKDGQLHPAEQVKQNCSIGRNSSPNVCSAFSHPSNFAYPPKQLPVVPSTDYGLYYSDTQGLKTIQMNGEKFSWTETVSVHSEFQDNNSGNRKEGDSADKPTEIQYTNGTLGSPEIPTIDPYEPLSKYLVLPQDTSQFGSHTNYSQPSLNHHIVGQKSLESESREFTNSLNASRILGRYQDGVVNDSYNIPKDAEGLDSKKISAANSQGCSENSRAESNPQKQVYYPNPINKKSQIKVSKARKEKPETEKKLASDWDKLRKEVQVNGTEKERSMDTMDSLDYEAVRCASVKEISKTIKERGMNNLLAERIKEFLDRLVTEHGSIDLEWLRHVPQDKAKDFLLSFRGLGLKSVECVRLLTLQNIAFPVDTNVGRIAVRLGWVPLQPLPEALQLHLLELYELHYQMITFGKVFCTKKKPKCNACPMRAECRHFASAFASARLALPGPEEKHIVSMHVPIAAERNYFVNENPMVLPLLENNLSRQVSPQSWQCEPIIEEPATPEREWTEAEESDMEDFFKEDSDEILSIDLNAKKSTVNVQNYLQEYNEHNEGCMSKALVALNPRSASIPTPKLKNVSRLRTEHQVYELPDSHPLLEKMDKREPDDPSPYLLAIWTPGETPNSVEPPERRCGSQDSALCNDNTCFSCNSIREANSQTVRGTLLIPCRTATRGSFPLNGTYFQVNEVCVIKA

SEQ ID NO: 223570 - protein, 138 aa, Glycine max
  Coding DNA Sequence Number=SeqID_106792
ISAYHGCRMTKLGLCVPSDTTVSEWQRGADNHKGANNHKVSPRIMGISAYHGCRMTKLGLYVPSDTTVSEWQRGADNHKVSPRIMGISAYHGCRMTKLGLCVPSDTTVSEWQRGADNHKNDQTWSLRAIGHDCVRMAK

SEQ ID NO: 223571 - protein, 312 aa, Glycine max
  Coding DNA Sequence Number=SeqID_106793
  Homolog annotation: Hit_ID=Q6R5A9; Match level="QueryCoverage=33%, HitCoverage=3%, E-value=7e-09, Identity=30%"; Hit description =Tenebrin
  Subcellular localization annotation: CTP_CleavageSite=29; ConfidenceScore=5.31e-01
MARGTQPMIRCGANGNSAGRAVGNWPKRRAAWRQCLRVGACCWRRSRRARWMICRRSVRHRWRKGCCMRWWCWPIMPGRWWNRMRAHHCCRTAPMLGCAEVMASVGFVPTKVGTYQSNVVVSVGFVPTKVGTYQSNIVVSVGFVPTKVGTYQSNIVVSVGFAPTKVGTYQSNVMASVGFVPTKVGTYQSNVMASAGFVPTKVGTYQSRSWRRKAPCRPRSTPTRAVRAQADVAFDDAALLVAVAAQLACVVGHGIRADRAVEAPDHTHTGFQCTQTLQIDDHVIVEADAILAGTAMPLIELEIRLPAVVGQL

SEQ ID NO: 223572 - protein, 184 aa, Glycine max
  Coding DNA Sequence Number=SeqID_106794
  Gene Ontology: Mol. function=electron carrier activity; Cellular component=anchored to membrane; Biological process=electron transport
  Homolog annotation: Hit_ID=Q5Z4F3; Match level="QueryCoverage=63%, HitCoverage=72%, E-value=1e-26, Identity=48%"; Hit description=Blue copper binding protein-like
  Pfam annotation: Domain name=Cu_bind_like; Domain location=41-123; Score=104.4; E_value=3.4e-28; Accession=PF02298.8; Description =Plastocyanin-like domain
MGETRFLKNCTFLMAILTLLSSFLLNHVMASVYTVGDQEEWSSQTNYASWAERYNFSQGDVLVFKYVKGQHNVYEVTEDTFRSCDASSGVLAKYESGEDQVALSEVKRHWFICNIAGHCLGGMRFGIEVKDGNSVTNSTDVAFNPPIEPTPSHNSCTCYYVSERWRVIENFIPLGLLLLLNYYF

SEQ ID NO: 223573 - protein, 212 aa, Glycine max
  Coding DNA Sequence Number=SeqID_106795
  Gene Ontology: Mol. function=transcription regulator activity; Cellular component=nucleus; Biological process=regulation of transcription
  Homolog annotation: Hit_ID=Q9ZVX2; Match level="QueryCoverage=98%, HitCoverage=47%, E-value=9e-47, Identity=48%"; Hit description=BHLH transcription factor
ISKLDRASILGDAIEYVKDLQKQVKELQDELEENADTESNCMNIGVGAELGPNAEHDKAQTGLHVGTSGNGYVSKQKQEGATVIDKQTQQMEPQVEVALIDENEYFVKVFCEHRPGGFVKLMEALNTIGMDVVHATVTSHTGLVSNVFKVEKKDNETVEAEDVRDSLLELTRNRYRGWTHEMTATPENGVGRDQHQLHNHQQIGAYPHQFHS

SEQ ID NO: 223574 - protein, 321 aa, Glycine max
  Coding DNA Sequence Number=SeqID_106796
  Gene Ontology: Mol. function=transcription regulator activity; Cellular component=nucleus; Biological process=regulation of transcription
  Homolog annotation: Hit_ID=Q84WX1; Match level="QueryCoverage=97%, HitCoverage=52%, E-value=1e-51, Identity=37%"; Hit description=BHLH transcription factor
MNISMQHLVERLRPLVGLNGWDYCIYWKLSEDQRFLEWLGCCCAGTESNQNAGEEHLFPVSSVASCRDITYPHPRTKPCDLLSQLSTCIPIDNSGIHAQTLLTNQPNWVNYSNGMDPNILEETIGTQVLISVPGGLVELFVTKQVSEDHQLIDFVTNQCIEAVNHSMSFNIDVSNMQSNPLIQDENEGNNNRNNNHLFHPSEHVITDMDHRNIGLCNSQLNFMQQFNYNQHNRMKSDAAFSEEYQAGNSFLHDEQTNPEDDQEPGHEHDTYQKSLMTTDSQYVEAKDQKQEEDKDLMKNVVGRSDSMSDCSDQNEEEELDG

SEQ ID NO: 223575 - protein, 82 aa, Glycine max
  Coding DNA Sequence Number=SeqID_106797
MKHGHAAEVLCPASEAHRTCKRVRLRCDAVCVASVVTGHGWTQEALIIEHAPPPIRTHRIQNRGLRISKEEKVGKKKDRRIG

SEQ ID NO: 223576 - protein, 55 aa, Glycine max
  Coding DNA Sequence Number=SeqID_106798
MYHGHPWTGHVPSVDGDSDAFSTFLVRKRHLQKQGLGGASGARMNDETSNKLNLD

SEQ ID NO: 223577 - protein, 89 aa, Glycine max
  Coding DNA Sequence Number=SeqID_106799
  Gene Ontology: Mol. function=nucleic acid binding
  Homolog annotation: Hit_ID=Q1SLA4; Match level="QueryCoverage=73%, HitCoverage=12%, E-value=5e-12, Identity=46%"; Hit description=Zinc finger, CCHC-type; Lipocalin
MKNWIYVQWITITKKTDRINLVIRVDSDTLDVRQGKFARVCVQIDLDKDVVGKVWLKDFWYKVEYEGLPAFVHRAGRGTMGTWPEIVLR

SEQ ID NO: 223578 - protein, 139 aa, Glycine max
  Coding DNA Sequence Number=SeqID_106800
  Gene Ontology: Mol. function=nucleic acid binding
  Homolog annotation: Hit_ID=Q1T6D0; Match level="QueryCoverage=85%, HitCoverage=25%, E-value=3e-28, Identity=47%"; Hit description=Zinc finger, CCHC-type; Lipocalin
MGNGGSSKEPPNSGGGGKRRVSFKDLMIGNKAPVALRQKIVFEDNNPLKTMVHILDSVFEGLCVAWQDALMVVKILGKNFGFNVMKDKLSRIWKLVAGFDMLDIGNNFYMVKFDTEADKVKVMTEDPWMIFDHYVTVQT

SEQ ID NO: 223579 - protein, 46 aa, Glycine max
  Coding DNA Sequence Number=SeqID_106801
MGIKSTVPMKAISLINWLFFVMTKNANVNLWRWQRIMISFALYFIL

SEQ ID NO: 223580 - protein, 191 aa, Glycine max
  Coding DNA Sequence Number=SeqID_106802
MTLLAAIASDSYQNSYSKLGDGAGVVSDSAVESGAGAGTSITGAGAGAGTSITGAGAGVGVGGGGTGDGVGAGFVGAGAGVAFAGAGAGGVLAGVGAIFGGGNGGGEATGGGGGDVGGETGEGFGCCGGGAFGLETGGCDVIGVLVAGGDSATVGGCVTAGGVPEDNGDVAVGVVGGKVVGGNFTGMVAGA

SEQ ID NO: 223581 - protein, 383 aa, Glycine max
  Coding DNA Sequence Number=SeqID_106803
  Homolog annotation: Hit_ID=Q2HRX8; Match level="QueryCoverage=83%, HitCoverage=57%, E-value=4e-15, Identity=34%"; Hit description=IMP dehydrogenase/GMP reductase
  Pfam annotation: Domain name=DUF1723; Domain location=113-162; Score =53.2; E_value=8.7e-13; Accession=PF08330.1; Description=Protein of unknown function (DUF1723)
MVRTRGLGRTLGRSIEKVLGWRDESDDDAPSKVPVEEGVADVEGFPSGPYDTSVLSDFENHIALRVWNGEERPELKLSSHGRKMAKFRRLALEIEGLVVASGLSPLIACFLDTGDRGLMSAFVERWHKETSSFHLPVGEVTITLDEVESLLHLPVVEAFHILSNFMSTTLSRCWWSYSRSALQRQEQRPFSVMGLMCDYRGCATQCELRLGCCCTCAHHFPLVASVVIAEDYDERRPRACHWTSDKALPVSMYWRRLDRLTLYAVCWILYSDHRSFREFEVISLFFVHLRWGPLMVIHQPERVVRQFGYIQTIPPHPFVSSLFAVEIDDRWMQFGDYIAPDDFAEIVDRLDRLLNLRILTKGIEAYTVVEECVGIARHYIGQG

SEQ ID NO: 223582 - protein, 184 aa, Glycine max
  Coding DNA Sequence Number=SeqID_106804
  Homolog annotation: Hit_ID=Q9S7X9; Match level="QueryCoverage=57%, HitCoverage=61%, E-value=2e-16, Identity=48%"; Hit description =Putative transcription factor; 86360-87167
  Pfam annotation: Domain name=zf-DNL; Domain location=94-133; Score =17.8; E_value=1.6e-05; Accession=PF05180.3; Description=DNL zinc finger
  Subcellular localization annotation: CTP_CleavageSite=48; ConfidenceScore=5.50e-01
MAASALYNAHMFLLPPLSHKTRKPFHSLCFNPPPSISIPRSKFYGATVAATKLPRRIFRGHGLVADDSGIAPEPESPYSEAGAGIDLNLPRRSLLVQFTCNLCGERTKRLVNRLAYERGAVFVQGRRSEGERIACTFEDGGLIVLMVVFGGGFDGGLVGLMVAVIGGGPRVGLVVVVMGLGGGF

SEQ ID NO: 223583 - protein, 165 aa, Glycine max
  Coding DNA Sequence Number=SeqID_106805
MRPIVYINLYKTEKGMLCTMPLRWDSSSGYTGHVITFEVGAVLEDANWQAPVNCFDENDKEKNIPILGSAVRGGSLGSYDVGSATWADLRKAPLQSAMEVTYICVHFVLKELVRKSISETEVSNVSAMSQQCFQKRKSISVHRYLRLNMVDYLLSILKIVTWLIN

SEQ ID NO: 223584 - protein, 121 aa, Glycine max
  Coding DNA Sequence Number=SeqID_106806
MDSTTFLFKHRCNLVPFDVVAFGSNDVVGQPFNGGGCRCNDVVALTHHVGATIPDLKSLPFNVVRRADNVFEGEPATTGLQSSPSQESCASKMVDGDRRRLAGGLRRPLIQSRPCTVVELR

SEQ ID NO: 223585 - protein, 71 aa, Glycine max
  Coding DNA Sequence Number=SeqID_106807
MTIQRSSGRRLIWSMSMDNGIRCMAAPWYRFLMDNNVMAGDEVAFYFRPNQHVWELILRKQLIWEDEGQSH

SEQ ID NO: 223586 - protein, 44 aa, Glycine max
  Coding DNA Sequence Number=SeqID_106808
MMASRKRKATASRPQQPYDTTRFTFEVAWNVTHRTFTPGTSFRR

SEQ ID NO: 223587 - protein, 75 aa, Glycine max
  Coding DNA Sequence Number=SeqID_106809
LIFSSYQQPIVEVPQVAEDDHVDQVVNKEQQVNVENPVEQQVPQQDNEPTLRRPTRVKMSTIPSDYQVYLQRIGL

SEQ ID NO: 223588 - protein, 116 aa, Glycine max
  Coding DNA Sequence Number=SeqID_106810
  Subcellular localization annotation: CTP_CleavageSite=60; ConfidenceScore=5.54e-01
MQDFSIKKGPNFSPLWLSMKSNQRKKKRKGKRKENHFYKKLKSSLSSFRKISEASSLLPRCFFSSSSPPLLPPLKLQIPLPFYPKLQGKAIFGVLEHTSTSWGFKFQKTGRDDGES

SEQ ID NO: 223589 - protein, 155 aa, Glycine max
  Coding DNA Sequence Number=SeqID_106811
MHDMNAFTDTRARKIISSYLRIRGRSTPCVQFVEAKLHGESRLIQRSFDDNKGDDKKLKESKNKFKMFKMFKMFKIESRTLQGSRGNLISRINNQDSRFKHSRLKIQESRKDLIKISMKKFFQKLSSTWIFLKTCLPKSFYSLVINYQIVVIDYQ

SEQ ID NO: 223590 - protein, 160 aa, Glycine max
  Coding DNA Sequence Number=SeqID_106812
  Subcellular localization annotation: CTP_CleavageSite=87; ConfidenceScore=5.44e-01
HRRTSALASVAVTLRVTTTPAALNAPLQGASHSPFRLRNCWEGRSGFPSHDVVKRRPVNCNTTHYRANWSSTAVAAALELVDPPGCRNSMFVTNAIDGEEIDFKSPKADEIDVQRRRLQKNDLDLDGKVQKYYLCTGTPLRKQLMEWLPDKELVFEDFNF

SEQ ID NO: 223591 - protein, 376 aa, Glycine max
  Coding DNA Sequence Number=SeqID_106813
  Gene Ontology: Mol. function=nucleic acid binding; Cellular component= nucleus; Biological process=mRNA processing
  Homolog annotation: Hit_ID=Q9ZVW9; Match level="QueryCoverage=41%, HitCoverage=31%, E-value=2e-63, Identity=71%"; Hit description =Putative splicing factor
  Pfam annotation: Domain name=RRM_1; Domain location=307-376; Score =72.9; E_value=1e-18; Accession=PF00076.12; Description=RNA recognition motif. (a.k.a. RRM, R
MDFDEYEYLENAVENPQAKHRANGGDKSVKSEERGRNGSSKHKGDDDDDVDLHPKHSKPGDDSHDRERLREKRGSSRHGSKSRDGDKDRSSGGIRDRKRDRDRDHENKDRKRDHGDKDVKRDRERDRDHGRDQERDRRDRGSEAERQQRSRSRSDRHRTDLDDKDRETSRDREYRDIERSRDKDYKDRGRVRESRERDRQDRRHKEKKEEATEPEADPERDQRTVFAYQISLKADERDVYEFFSRAGKFYDVMSVPMAIALSGQPLLGQPVMVKPSEAEKNLVQSTTSVANGLTGLIGPYSGGARKLYVGNLHVSITEADIRRVFEAFGQVELVQLPLDESGHCKGFGFVQFARLEDARNAQSLNGQLEIGGRTIK

SEQ ID NO: 223592 - protein, 396 aa, Glycine max
  Coding DNA Sequence Number=SeqID_106814
  Gene Ontology: Mol. function=translation initiation factor activity; Biological process=translational initiation
  Homolog annotation: Hit_ID=Q6YU95; Match level="QueryCoverage=85%, HitCoverage=69%, E-value=2e-23, Identity=30%"; Hit description =Translation initiation factor 3 (IF-3)-like protein
  Pfam annotation: Domain name=IF3_C; Domain location=8-90; Score=4.0; E_value=6.3e-05; Accession=PF00707.12; Description=Translation initiation factor IF-3, C-terminal domain
MQAEMTLRKDVKEVRFSEKTEAKDLKNKADMIKKLMEKGYRVKCKVSGKENQDLTVLFSPILALMEDVCIVESGPHMAKKDAFMIVRHIKYGLSKKGGKKLQNATNVTTQEGDMEISTANSSDSIEYESHAESGFETEEEVLSDGNKLSKSSLSVFSNNVNMTASPNNQTNAAPEASPVSENRYRSQENNVQSNAQVPPAVTENRYKRIEPRGRFQQTSNNTCMNYQGPGARDAFRSPPPNWNRTRQAPVNANLNPRIENNRLAFTPPGPRHSMPSHENICNPPPNAPNTPRPGYGNFSSPSEGIPMHHGVPNTPRSSSYGNFSGPNEGIPRHPGAPITQRSSSYGNFSAPNEGIPRHPSAPNTPRPSSYGNFSTPNGHETQGVKAGMHRNREGNQ

SEQ ID NO: 223593 - protein, 368 aa, Glycine max
  Coding DNA Sequence Number=SeqID_106815
  Gene Ontology: Mol. function=oxidoreductase activity; Biological process=electron transport
  Homolog annotation: Hit_ID=Q45NI5; Match level="QueryCoverage=42%, HitCoverage=95%, E-value=1e-51, Identity=69%"; Hit description =Monooxygenase
  Pfam annotation: Domain name=RRM_1; Domain location=79-155; Score =12.5; E_value=0.0099; Accession=PF00076.12; Description=RNA recognition motif. (a.k.a. RRM, R
  Subcellular localization annotation: CTP_CleavageSite=46; ConfidenceScore=5.15e-01
SLNACSRAILMQKLDRSGTASSMVGSIGNSGVNNTGLNLPATGNILAAAPVGGLAGGGLQIPTATIPSIDPIGVPSECLMLKNMFDPKDETEPDFDLDIKEDVEAECSKFGALKHIYVDKKSAGFVYLRFEDTQSAISAQQALHGRWFAGKMITASFMCLEWRSLTHSNNGNRRDIVIVAAGIAGLTASFGLHRLGIRSLVLESSDTLRIARFALSKWENAWKALDAVGVGHILRQEHAQLMGMHYAATVVTTSLITGQQTSAMRFKESGNQQTDREIRCVKRNLLLEVLANELPSGTIRYLSKVVAIEESGFYKILHLADGTAIKTKGDMQSGAVQSSRTITGLSPASCSSLAKVSELMLFLHTHQQ

SEQ ID NO: 223594 - protein, 233 aa, Glycine max
  Coding DNA Sequence Number=SeqID_106816
  Homolog annotation: Hit_ID=Q47522; Match level="QueryCoverage=26%, HitCoverage=83%, E-value=7e-22, Identity=75%"; Hit description=LacZ protein
VPPVQLLTGWCVTAKAPPDISAGKCSGHAARRVPFAIQAAQLLGRAIGAGLFAITPAGERGMCCKAIKLGNARVFPVTTLNSITGLVRCLVSPATGLVLAITGLVRGLVSRENALIPGAQQKGRQVVRAEGPADTRPRHGLVGAACGSPRDTAALKTGCDAHHTCSIKLIDTVDLEGGPVGKPVVPAALMNRPTRGERRFAYWALAECILAYYVGTDEGVSEVLHVAGEKRLH

SEQ ID NO: 223595 - protein, 188 aa, Glycine max
  Coding DNA Sequence Number=SeqID_106817
  Homolog annotation: Hit_ID=Q47522; Match level="QueryCoverage=27%, HitCoverage=64%, E-value=6e-24, Identity=100%"; Hit description=LacZ protein
  Subcellular localization annotation: CTP_CleavageSite=29; ConfidenceScore=5.17e-01
MKVAPAASLRRPPGGLFLSLTWGSRRQPPLARVWAWCPLALLPSPLASPSVEPLGLVHFPWKRDPSPARPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 223596 - protein, 106 aa, Glycine max
  Coding DNA Sequence Number=SeqID_106818
  Gene Ontology: Mol. function=oxidoreductase activity; Biological process=electron transport
  Homolog annotation: Hit_ID=O81816; Match level="QueryCoverage=95%, HitCoverage=25%, E-value=9e-28, Identity=53%"; Hit description =Monooxygenase
KELEENPAKLKQYVLNKLENMPRDVRYYIEKIELDAFLSSPLRHRHPWELMFGNISKDNVCVGGDAFHPMTGDLGQGGCCAFEDGVVLARCLAEAFSKHIKQKDEE

SEQ ID NO: 223597 - protein, 355 aa, Glycine max
  Coding DNA Sequence Number=SeqID_106819
  Gene Ontology: Mol. function=oxidoreductase activity; Cellular component=chloroplast; Biological process=electron transport
  Homolog annotation: Hit_ID=O81816; Match level="QueryCoverage=88%, HitCoverage=75%, E-value=1e-86, Identity=52%"; Hit description =Monooxygenase
  Pfam annotation: Domain name=FAD_binding_3; Domain location=3-282; Score=-122.6; E_value=0.0011; Accession=PF01494.9; Description=FAD binding domain
MPETKVYRKLECRNVTTSLILGQQTSSLSFEGTGKHGDCEVRCVRRQLMLEAIANELPSGTIRFLSKVVAIEESGFSKIKIVRLDDGTTIKTKVLIGCDGINSVVAKWLGFKEASFTGRYVIRGYKKLMNNHGLEPKFMHYFGKGFRSGVMPCDDNTVYWFLTWTPTSEEKELAKNPSKMKQLVLRKVEKMPSDIKTFIEKTETKDILTSPLKYRHEWELMLGKISKGNVCVVGDAFHPMAPDLGQGGCCALEDGIILARHLAEAFTKKTGKHVAKEMGEEGKSKEQYKKIEASLRKYAKERRWRNIDISVTSYVLGFVLQGDLKLVSHFRDKLFPAFLAELLLKKSDFDCGKLN

SEQ ID NO: 223598 - protein, 247 aa, Glycine max
  Coding DNA Sequence Number=SeqID_106820
FLQVSSFFEDEGESPVESDEIKVQTWSNQHYRNEPVVVVAAPRLQKYSSFHEQSGEPPLLLPIRSLKSRLSEEDIDVQSLNMLMSSKRFSSNSNRNAEVEADVVDTDVQSLNRSTISQGFSRNSNRKAEVIMLSSNTYVIMLSSNAEDSVRKKGFYKSCPPPPPPPPPTMFKKSVFMKPRFDGSSNEAPSFNKELKRSFTSERTTPVGKKSHEENKSKQGTLFRNNKFMGHASVPLVSQPAEKESLL

SEQ ID NO: 223599 - protein, 119 aa, Glycine max
  Coding DNA Sequence Number=SeqID_106821
MAPMRHLVDLEKSNTTLGFPALIIGLCQFYGVPVTPNKGEAPQQPGERLNESFYQYTLRQQGQNSSPYAWPTPEQFEAAVAWPGDWPDFETQAGPAGTSEGGEEAQDDEDMANLIDFLL

SEQ ID NO: 223600 - protein, 106 aa, Glycine max
  Coding DNA Sequence Number=SeqID_106822
MAKFVPEIVMEFYANAWPTEDGVRDMRSWVRGQWIPFDAEALSLFLGHPLILVEGQQCEFSQMRSQISSFDKEAIAQLEMGVDHAHQHDHPYINMDDIATQQQSAQ

SEQ ID NO: 223601 - protein, 127 aa, Glycine max
  Coding DNA Sequence Number=SeqID_106823
  Gene Ontology: Mol. function=serine carboxypeptidase activity; Biological process=proteolysis
  Homolog annotation: Hit_ID=Q1EP77; Match level="QueryCoverage=49%, HitCoverage=13%, E-value=8e-14, Identity=69%"; Hit description =Serine carboxypeptidase (Carboxypeptidase D), putative
MALCSVFLNLHLWLFVCLTIEALGVPKPSVASYLSQELLAEQEVDRVHGLLAQPPVKLNNMLVISLSMKLKEEICSIGFSRPPINRNKNPFSYGSMENHKPEGQEVSAAGVNIDNHMNEGSGWINSA

SEQ ID NO: 223602 - protein, 226 aa, Glycine max
  Coding DNA Sequence Number=SeqID_106824
  Gene Ontology: Mol. function=transferase activity, transferring phosphorus-containing groups; Cellular component=cytoplasm; Biological process=phosphoenolpyruvate-dependent sugar phosphotransferase system
  Homolog annotation: Hit_ID=Q667F7; Match level="QueryCoverage=99%, HitCoverage=30%, E-value=3e-98, Identity=81%"; Hit description =Phosphoenolpyruvate-protein phosphotransferase
ERGSFPVLPRGADHSSAPAAGCAGGAAARAAPVRRKRRVFHGHTGHADGRDPVTVAAQRHFRPVSPNARARAGGLARRGGGGRVAGQQPAFARSGLPRFDAGHRQRARAPDAGAGRGRRGVSPLQQAFCRQLAKRERGDLRSLLSPAKRRPPQARTVRRNRQRFGGGVGGETGDRNLCRAVCQTAGHLHARARQRPARAGPAPAVPPRRHHSGRYPVAGAFCAGGG

SEQ ID NO: 223603 - protein, 256 aa, Glycine max
  Coding DNA Sequence Number=SeqID_106825
  Gene Ontology: Mol. function=protein dimerization activity; Cellular component=cytoplasm; Biological process=proteolysis
  Homolog annotation: Hit_ID=Q7CK62; Match level="QueryCoverage=86%, HitCoverage=45%, E-value=1e-103, Identity=80%"; Hit description =Aminoacyl-histidine dipeptidase
  Pfam annotation: Domain name=Peptidase_M20; Domain location=106-244; Score=-18.9; E_value=0.024; Accession=PF01546.18; Description =Peptidase family M20M25M40
MAHPAGNSDILWPITSDVLTAIFHWKPACERRRVVSELSQLSPQPLWDIFAKICSIPHPSYHEEALAEYVVGWAKEQGFWVERDQVGNILIRKPATAGMENRTPVALQAHLDMVPQKNNDTVHDFTKDPIQPYVDGEWVKARGTTLGADNGIGMASALAALADNSLTHGPLEVLLTMTEESGMDGAFGLQPNWLQADILINTDSEEEGEIYMGCAGGIDFITTLPLSREAVPAGFETLKLTLKGLKGGHSGADIHL

SEQ ID NO: 223604 - protein, 384 aa, Glycine max
  Coding DNA Sequence Number=SeqID_106826
  Homolog annotation: Hit_ID=Q1RFT3; Match level="QueryCoverage=38%, HitCoverage=98%, E-value=2e-73, Identity=87%"; Hit description =Xanthine phosphoribosyltransferase
MQEAGDRTAAADGKGQGFKLAGQALGGFFISAIRQHLRLIRQLIAFNVGIRGQAVETGGMQPLLAGLIVIGVLHRALLPQRRLLRPLIVPVAAAIANYRVQQRFVGVFKFTDGNARQHFADLLRRQAAPRPQQLIQHAIPAALGIAFQGIVHLRRRVVLAMHQRGGFRVFEAGFEQFFAEIFLGHLKLLLRQSHRWLRVYCTRRTGARRRKHNARHNRALFALHQSAFYNRRNVHHAHVPRLLDPGVLRNIDNVVVHQRAASRLGEDGAETRFWIHITNRLRGTAGIHQIVDDHKTFTVAFCALQHFHFTLVIVIVAGDAHGIDVANPQFTRQQRCRNQTTAADRDDAFPLFHRKQALGQFTGMNLQHVPGNDVFFAHKRNPGQ

SEQ ID NO: 223605 - protein, 230 aa, Glycine max
  Coding DNA Sequence Number=SeqID_106827
  Gene Ontology: Mol. function=DNA-directed DNA polymerase activity; Cellular component=intracellular; Biological process=response to DNA damage stimulus
  Homolog annotation: Hit_ID=Q47155; Match level="QueryCoverage=99%, HitCoverage=65%, E-value=2e-82, Identity=66%"; Hit description=DNA polymerase IV
  Pfam annotation: Domain name=IMS; Domain location=1-220; Score=25.5; E_value=5.1e-11; Accession=PF00817.11; Description=impBmucBsamB family
MAQAIRADILRETGLTASAGIAPIKFLAKIASDMNKPDGQYVITPQAMPDFLLTLPLSKIPGVGKVATKKLEEMGLRTCADVQQADLAQLLKRFGKFGRVLWERSNGIDDRDVVVERERKSLGVERTLGEDIHHWEQCLEIIDFLYAELDRRLSAIRPDKQIARQGVKLKFNDFQLTTQEHVWPVLNKDDMIAVARQAWDERRAGRGVRLVGLHVTLVNPQLERQLVLGL

SEQ ID NO: 223606 - protein, 62 aa, Glycine max
  Coding DNA Sequence Number=SeqID_106828
  Subcellular localization annotation: CTP_CleavageSite=30; ConfidenceScore=5.50e-01
MTSSLVKIQGHHQPSHRPPLVLPVVPLLVPAPATTSNFLQLSNLTSLPVSLSHLALKLTCVS

SEQ ID NO: 223607 - protein, 150 aa, Glycine max
  Coding DNA Sequence Number=SeqID_106829
MPLLTSLTSITFEVAPNTSKRRKFMSMMFVIDINRLYFFTNILSGLFFGQRHLGFFGQCDKACYQEQLEALADSLVRFFIIDMQAQMARDQKEILLKVRRILSAVNKFPSHTVDASNPEENAILVWKQQIQVCLCPAILILSLSRCIYVC

SEQ ID NO: 223608 - protein, 101 aa, Glycine max
  Coding DNA Sequence Number=SeqID_106830
  Homolog annotation: Hit_ID=Q1SYE0; Match level="QueryCoverage=95%, HitCoverage=12%, E-value=7e-38, Identity=62%"; Hit description=HASTY
MNKEGYAEPNESDIRNWFKGIRDSGQLVHSTLIPLVKNCPLDMWEIWLEKLLHPFFVHAQQALSCSWSSLLQDGRAKVPDAHGILSGSDLKVEVMEETIPG

SEQ ID NO: 223609 - protein, 195 aa, Glycine max
  Coding DNA Sequence Number=SeqID_106831
MTGPFDGPISCSLIKVDPWVLVPITFRGLYVLACRGLHALAFRGLRVLIFSVLHTHTLEEYKGSRPQDAQWARRSPTGPWGFQLWLWASVVLQGARFTPADGSGSRLQDTQWTRRSPTGSWSCQALITGLCQFYRVPVTSSKGIRPPTNRAFIKKYCVPRQAQGEIPQQPGDGRQRATDAPPSPLEFASAHPQKG

SEQ ID NO: 223610 - protein, 145 aa, Glycine max
  Coding DNA Sequence Number=SeqID_106832
MRTSDEIGRTTTNKTSNTEHLPHGDHQIFKYFSGPPMESNSKKRKESNEGRRRKSSSGNGLHGRAFSSLHCLMDAPAIMLGARSNSLITGAQTKLAQSIYNGALLSPIGLEIQTSKLMLFLLLFHKNQGVPPLHFRKTNSDTHKK

SEQ ID NO: 223611 - protein, 118 aa, Glycine max
  Coding DNA Sequence Number=SeqID_106833
MVLVEGSTSRESVGNGSEVGENVVAPMMYPIAKAGTSIGVAPPPKKRPVLKEKRLPPPIMLPGYIKGDDDAFAFLRPELVTFTISKRSQSSPLQQSLCFSDQSVAPLLLYSLQLSLLL

SEQ ID NO: 223612 - protein, 187 aa, Glycine max
  Coding DNA Sequence Number=SeqID_106834
  Gene Ontology: Mol. function=transcription factor activity; Cellular component=nucleus; Biological process=regulation of transcription, DNA-dependent
  Homolog annotation: Hit_ID=Q8LLR3; Match level="QueryCoverage=92%, HitCoverage=97%, E-value=2e-43, Identity=51%"; Hit description =Ethylene-responsive element binding protein 1
  Pfam annotation: Domain name=AP2; Domain location=61-126; Score =132.3; E_value=1.3e-36; Accession=PF00847.10; Description=AP2 domain
MAATTSCDFSSLEPLQHYLLKHGSKHLVSNGVESINDAKKLSECKRDQPRASPEVHAPPKWKHYRGVRRRPWGKFAAEIRDPNKNSARVWLGTYVTEEEAGLAYDRAAFKIHGSKAKLNFPHLIGSDVSLSEPMRVVATNSHEPCLLPLESQGSKKKKNLVDLLNRLAKNRKRVGFKSSEISAKIYA

SEQ ID NO: 223613 - protein, 96 aa, Glycine max
  Coding DNA Sequence Number=SeqID_106835
MKNYASEAYSSSSNLETPIENVEVDTPSPIVHPIGQKEEQEKRNRNIYNPWDLIGVEEAIREINILNTKLVALTEIELENEYYDILIKDTSTMSET

SEQ ID NO: 223614 - protein, 178 aa, Glycine max
  Coding DNA Sequence Number=SeqID_106836
ALGFDGCLKDTYWEVGYGPSCIVQTTDGLHCQEGIVRQRKGLKRMVPRISLLPMHVRECDTVEWNFTSRGCDVWCGVICHHYFRSEPLSNKMERSFFLQRSAYYAANLPNNGTKWFRKPDRKTYSRGYSLSERLHFFRMQSYPARALDRRLQVDWAKDPREGPRDLMSLRVDFKPMDQ

SEQ ID NO: 223615 - protein, 254 aa, Glycine max
  Coding DNA Sequence Number=SeqID_106837
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=6e-39, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
PIFFRGLHVHAIRGLHALAFRGSHTLAFIGLHALTFRGLHALAFRGLYVLTFRGMHALAFRGLYILAFRGLHILACRGLHVLAFIGLHALTFRGLHVLTFRGLHVLTFRGLHVLAFRGQHVLAFAFVGLHALTFKGLHVLAIRGLHALTFKGLHILQFRGLHVLAFRWLHVLAFRGLHSLAFRGLHVLVFRGLHVLIFRGLHVLIFRGLHVLAFKGLHVPTFRGLHVFAFRGLRALAFSGIHIRTLREFKVLYP

SEQ ID NO: 223616 - protein, 63 aa, Glycine max
  Coding DNA Sequence Number=SeqID_106838
  Homolog annotation: Hit_ID=Q00M75; Match level="QueryCoverage=51%, HitCoverage=5%, E-value=2e-09, Identity=87%"; Hit description=PPR -repeat containing protein
MMRPPTLLCRPASGNKSPFVYILQENKSPFDQRVSPGAAIKLCLGDLLVMGSNPEIASLHMQG

SEQ ID NO: 223617 - protein, 445 aa, Glycine max
  Coding DNA Sequence Number=SeqID_106839
  Gene Ontology: Mol. function=RNA-directed DNA polymerase activity; Cellular component=intracellular; Biological process=RNA-dependent DNA replication
MAPDRDQLRAMTQKEKETFKEYAQRWREVAAQIVPPLEEREMTKIFLKTLSQFYYEKMVASAPTDFTEMVNMGVRLEEGVREGRLTGESAPAASNAKKFGGHFAKKKDQEVGMVAHGKPQQNFTPYRQVANVASTIPNPSYHQQRPQYPPQQYPPHQYPPQQYPPHQYPPQQYPPHQYPPHQYPPHQYSPQQCHPQQYPSQQYHQPQYPQKQQNRPQTLQQPYHSQNRQKTTFDPIPMKYADLLPALLAKNLVQVRTPPRTPDVLPPWFRPDLTCAFHQGAPGHDVENCYVLKNEVQKLVRANLLSFKDQNPNVQANPLPNHGPTVNMIQDCGEEGVILNVQHIRTPLVPIHIKMCEAALFDHDHAACEICPVNVKGCPKVQEDIQGLIDSRELTITRKDREVCVITPEFQRLEISYNSGESTTTPLVISLPGPMPYASLKAVPY

SEQ ID NO: 223618 - protein, 357 aa, Glycine max
  Coding DNA Sequence Number=SeqID_106840
  Gene Ontology: Mol. function=shikimate kinase activity
  Homolog annotation: Hit_ID=Q9FJQ8; Match level="QueryCoverage=53%, HitCoverage=63%, E-value=7e-43, Identity=49%"; Hit description =Similarity to S-ribonuclease binding protein
  Pfam annotation: Domain name=TolA; Domain location=54-356; Score= -152.3; E_value=0.067; Accession=PF06519.2; Description=TolA protein
MAVQAQYPSNVLFLNSRNGQEGHEYSSLQPQPGGVVLLNQPHMLYDNCNNDNGSNNNNNNINSRKRGREDQPGVGNNNNNTITTASNVINQFSLQSQPLQLVHLSQLHNHQQQNNVVSTGLRLSFDDQHFQQQQRLQLHQNQSQQQQQHGSQSSAFLSLLSQGLGSQIKQQRDEIDQLLHAQAEQLRRALAEKRQRHYRALLSTAEEAVARRLREKEAEVEMATRKNAELEARAAKLSVEAQVWQAKARAQEATAASLQAQLQQTIMSHGGEELAAVGVSSAVEGQAEDAESAYIDPERVVVATTARPKCRGCAKRVASVVVLPCRHLCICTECDAHFRACPVCLTLKNSTVEVFLS

SEQ ID NO: 223619 - protein, 70 aa, Glycine max
  Coding DNA Sequence Number=SeqID_106841
MGDSAKVVIKQDMKGRRHKYGFNNNEREKAQKKRVVDDETADKHQLDEHQERLRKKFALEEGRIFAANEQ

SEQ ID NO: 223620 - protein, 130 aa, Glycine max
  Coding DNA Sequence Number=SeqID_106842
MVLLLLGSKHNNSAKPLPERNRVETTSPERNGVTETEDAGVASVQSSNGARVEDDGAPIVRVFAAYRKNSKNLKYSHLPSLSEAARKTAPEPASLRPVPPRHKTAPLQRCPSRMGAATTSIDYIGLWYGY

SEQ ID NO: 223621 - protein, 78 aa, Glycine max
  Coding DNA Sequence Number=SeqID_106843
MVKNRGQPSLNCLRKHLGSVTEAHRLRFSSQKQFFSPKTAEMHSHGIRGGGCHLARPGELGCFHLNQENAQKPLEGPD

SEQ ID NO: 223622 - protein, 254 aa, Glycine max
  Coding DNA Sequence Number=SeqID_106844
  Gene Ontology: Mol. function=transcription factor activity; Cellular component=intracellular; Biological process=regulation of transcription, DNA-dependent
  Homolog annotation: Hit_ID=Q1VRX5; Match level="QueryCoverage=96%, HitCoverage=97%, E-value=8e-63, Identity=51%"; Hit description =Putative aga operon transcriptional repressor
  Pfam annotation: Domain name=DeoR; Domain location=77-233; Score =192.8; E_value=8.1e-55; Accession=PF00455.13; Description=Bacterial regulatory proteins, deoR family
  Pfam annotation: Domain name=GntR; Domain location=7-61; Score=6.4; E_ value=0.015; Accession=PF00392.11; Description=Bacterial regulatory proteins, gntR f
  Pfam annotation: Domain name=HTH_11; Domain location=7-62; Score =24.4; E_value=0.00019; Accession=PF08279.2; Description=HTH domain
  Pfam annotation: Domain name=HTH_DeoR; Domain location=7-63; Score =70.3; E_value=6.2e-18; Accession=PF08220.3; Description=DeoR-like helix-turn-helix domain
  Pfam annotation: Domain name=Put_DNA-bind_N; Domain location=3-42; Score=4.2; E_value=0.01; Accession=PF06971.4; Description=Putative DNA-binding protein N-terminu
  Pfam module annotation: Pfam domain module=DeoR::GntR::HTH_11::HTH _DeoR::Put_DNA-bind_N; Domain location=77-233::7-61::7-62::7-63::3-42
MEKLIPRHTEILQELEKKDYVLVQELCEKYNVSSVTIRKDLNYLESLGLLFRNHGGASKHVRYAYEKNVDEKENINVEAKQNIAKAAVKLIEENDCIILASGTTMHYLARMLVNFGRLTVLTSSLRVALELCNNPNINIIQLGGEVRKSSTSIVGSISETILAQFSCNKLFLGVDGIDMDFGISTSNAAEAHLNQLMIECSDKVMILADSSKLNKKGFGKISSLDKIDYLITDDGILEEDKKRLEEIGLSVITK

SEQ ID NO: 223623 - protein, 70 aa, Glycine max
  Coding DNA Sequence Number=SeqID_106845
MSKACLSIVYEIRQGNPKLTSCGLKAFQDSQFWEEGNDRLKICLDKKNGILSKNHHVVSPREVSCCVACC

SEQ ID NO: 223624 - protein, 119 aa, Glycine max
  Coding DNA Sequence Number=SeqID_106846
  Homolog annotation: Hit_ID=Q1T2K0; Match level="QueryCoverage=41%, HitCoverage=9%, E-value=1e-08, Identity=54%"; Hit description =Helicase, C-terminal; Type III restriction enzyme, res subunit
MILSAVKDEAEKTIEPLEEEKVAVSTTKKRKRKGTSSETVEGFNVFRSSTSVVQSNDEVRVIEESVRDAIFRKQHNIHVCGYNVPSPLQHNIHVCDYNVSSPLQHNIPEKSQGPGNNNS

SEQ ID NO: 223625 - protein, 388 aa, Glycine max
  Coding DNA Sequence Number=SeqID_106847
  Gene Ontology: Mol. function=transferase activity, transferring hexosyl groups; Biological process=metabolic process
  Homolog annotation: Hit_ID=Q8RYR6; Match level="QueryCoverage=76%, HitCoverage=83%, E-value=5e-76, Identity=51%"; Hit description =Fertility restorer-like protein
  Pfam annotation: Domain name=PPR; Domain location=218-252; Score =26.5; E_value=9.7e-05; Accession=PF01535.11; Description=PPR repeat
  Pfam annotation: Domain name=PPR; Domain location=253-287; Score =37.5; E_value=4.5e-08; Accession=PF01535.11; Description=PPR repeat
  Pfam annotation: Domain name=PPR; Domain location=288-322; Score =31.4; E_value=3.1e-06; Accession=PF01535.11; Description=PPR repeat
  Pfam annotation: Domain name=PPR; Domain location=323-357; Score =15.3; E_value=0.12; Accession=PF01535.11; Description=PPR repeat
  Pfam module annotation: Pfam domain module=PPR::PPR::PPR::PPR; Domain location=218-252::253-287::288-322::323-357
MVYMAASRGGVHKLVSFSQIEKLVSFVHCKQYLPPLLETVRHFSFTDDCSGRSKQPVGESDDFFLQQSDSSFKDNGESDQSLSEPIPSRPLRSRKPVNQPPPRFQEYDRGSHSFPPRFYDNHGGPDELDQTNKSSKIDLAFQNTNVAKTNRDAGQSGDSFLNKFKLGFDDKTVNLSEVAASKQSEEAKRSNPNQPAQESMPQDADEIFKKMKETGLIPNAVAMLDGLCKDGLVQEALKLFGLMREKGTIPEIVIYTAVVEGYTKAHKADDAKRIFRKMQSSGVSPNAFSYMVLIQGLYKCSRLHDAFEFCVEMLEAGHSPNVTTFVGLVDGFCNEKGVEEAKSAIKTLTDKGFVVNEKAVRQFLDKKAPFSPSVWEAIFGKKAPQRPF

SEQ ID NO: 223626 - protein, 431 aa, Glycine max
  Coding DNA Sequence Number=SeqID_106848
  Gene Ontology: Mol. function=glutamyl-tRNA reductase activity; Biological process=tetrapyrrole biosynthetic process
  Homolog annotation: Hit_ID=Q9LVD1; Match level="QueryCoverage=70%, HitCoverage=77%, E-value=1e-101, Identity=53%"; Hit description =Arabidopsis thaliana genomic DNA, chromosome 5, P1 clone:MJB24
  Pfam annotation: Domain name=DUF266; Domain location=141-280; Score =218.4; E_value=1.7e-62; Accession=PF03267.4; Description=Arabidopsis protein of unknown function, DUF266
MKTEKVWRLGGMGDMQILPGSRHRPPMKKPKWIIVLVLFVCVFLICAYIYPPQNSSTCYVFSSKGCKGFVDWLPPMPAREYTDEEIASRVVIKDILNSPAVVSKNSKIAFMFLSPGSLPFERLWDKFFQGHEGKFSVYVHASKTKPVHVSRYFVNRDIRSDPVIWGKISMVDAERRLLANALQDTDNQQFVLLSDSCVPLYDFEYIYEYLMYTNISFVDWYDLQYYMCLSGFKDPGPHGNGRYSDHMLPEVEVKDFRKGAQPGLEGKNCIADEHYLPTFFQMVDPGGIANWSLTHVDWSERKWHPKSYRAQDVTYELLKNITGKPLASSSHPSLNLFGYLRIWVKWNGVLATRAFLAIRRNTCNAVVLFSKRAATVSIDVSMHVTSDEKKEVQSWPCLWNGIQKPCYLFARKFTPETLDSLLRLLANYSGP

SEQ ID NO: 223627 - protein, 345 aa, Glycine max
  Coding DNA Sequence Number=SeqID_106849
  Gene Ontology: Mol. function=hydrolase activity; Cellular component =nucleus; Biological process=metabolic process
  Homolog annotation: Hit_ID=Q9FLZ9; Match level="QueryCoverage=95%, HitCoverage=73%, E-value=5e-88, Identity=30%"; Hit description =Selenium-binding protein-like
  Pfam annotation: Domain name=PPR; Domain location=241-275; Score =37.5; E_value=4.7e-08; Accession=PF01535.11; Description=PPR repeat
  Pfam annotation: Domain name=PPR; Domain location=276-310; Score=5.3; E_value=1.7; Accession=PF01535.11; Description=PPR repeat
  Pfam annotation: Domain name=PPR; Domain location=78-112; Score=44.4; E_value=3.9e-10; Accession=PF01535.11; Description=PPR repeat
  Pfam module annotation: Pfam domain module=PPR::PPR::PPR; Domain location=241-275::276-310::78-112
MLGTGRTLPDKFTYPVVIKACGDLSLIDVGVGIHGQTFKFGYDSDTFVQNTLLAMYMNAGEKEAAQLVFDLMLERTVISWNTMINGYFWNNCVEDAVKVYGRMMDVGVEPNCATVVSVLPACGLLKNVELGRDVHALVQEKGFWGDIVVWSALPDISALMLCRMRQCEGVKPNSVSIASLLSACGSLVYLNYGKCLHAWAIRQKLESEVIVETALIDMYAKCNHGNLSYKVFMGTSKKRTAPWNALLSGFIQNKLAREAIELFKQMLVKDVQPDHVSFNSLLPVYSILADLQQAMNIHCYVIRSGFLYRLEVASILVDIYSKGGSLGYAHQIFNIIPLKDKDIII

SEQ ID NO: 223628 - protein, 432 aa, Glycine max
  Coding DNA Sequence Number=SeqID_106850
  Gene Ontology: Mol. function=protein binding; Cellular component =nucleus; Biological process=regulation of transcription
  Homolog annotation: Hit_ID=Q8GX15; Match level="QueryCoverage=99%, HitCoverage=91%, E-value=1e-121, Identity=55%"; Hit description=Ap2 SCARECROW-like protein
  Pfam annotation: Domain name=GRAS; Domain location=49-347; Score =245.1; E_value=1.5e-70; Accession=PF03514.5; Description=GRAS family transcription factor
MKDLGLHDDSATPVLKTFLHPDDDNNNPSCDDFTPFDHALEFTSLSDIYSNQNLAFDFNHLPHDFNHHLNGFDFIEELIRAADCFDTKQLHVAQVILERLNQRLRSPVGKPLQRAAFYFKEALQSLLSGSNRTPRISSLVEIVHSIRTFKAFSGISPIPMFSIFTTNQIVLDHAACSFMHVIDFDIGLGIQYASLMKEIAEKAAESPVLRITAVVPEEYAVESTLVHDNLAQFALELRIRVQVEFVALRTFENLSFKSVKFVDGENTTVLLSPAIFGHLGNAAAFLADVRRISPSMVVFVDGEGWAETATASAASFRRGVVSSLEYYSMMLESLDASTVGGGGEWVRRIEMMQLGPKILAAVESAWRKLPPWREAFYGAGMRPVQLSQFADFQAECLLAKSQIRGFHVARRQNELVLFWHDRAMVATSAWRC

SEQ ID NO: 223629 - protein, 43 aa, Glycine max
  Coding DNA Sequence Number=SeqID_106851
MDQAYTLKMCWDLMRSKRKTRFPVMKPKGLLRAILLYSGIGTG

SEQ ID NO: 223630 - protein, 297 aa, Glycine max
  Coding DNA Sequence Number=SeqID_106852
  Homolog annotation: Hit_ID=Q6NLY8; Match level="QueryCoverage=98%, HitCoverage=94%, E-value=1e-35, Identity=61%"; Hit description=HVA22- like protein k
  Pfam annotation: Domain name=TB2_DP1_HVA22; Domain location=120-220; Score=39.0; E_value=6.7e-09; Accession=PF03134.9; Description=TB2DP1, HVA22 family
MALLGSNITSEVGLRLLLCPLGSNVVIRTACCTVGVALPVYSTFKAIESKDQDAQHKCLLYWAGWLKSSFNIGMEGGCRIIDRIMNCKFKQMKNNIETRAQIHTCIKHYLDKKPNNTARSSNLVTQHTEVTQPKKKKETGAIVCYWNERSTREETEAETVNKEGILRSYGSFSLAEVFTDKLISWCPIYYHLKFAFLVWLQLPSTSGAKQIYANHLRPFLLRHQARVDQVLGFAYCEVIKLVSSYQAEIQFVRSMVVKITGSADQMLRGGAESDRSPQHISAEDPASDAESDQNHNH

SEQ ID NO: 223631 - protein, 67 aa, Glycine max
  Coding DNA Sequence Number=SeqID_106853
MVVQVENGVIVGGLFGARARARAPAQVEDRSGLVAQARGGGGGGGVEVGKGNGTDYVIGGFWVGLWG

SEQ ID NO: 223632 - protein, 46 aa, Glycine max
  Coding DNA Sequence Number=SeqID_106854
MAETGYKFFCNTLLKEYQTLKPQFCLRIREEKLLLVIFLMAYREVK

SEQ ID NO: 223633 - protein, 106 aa, Glycine max
  Coding DNA Sequence Number=SeqID_106855
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q1T1H3; Match level="QueryCoverage=80%, HitCoverage=13%, E-value=9e-28, Identity=73%"; Hit description =Cadmium-transporting ATPase; ATPase, E1-E2 type
  Pfam annotation: Domain name=E1-E2_ATPase; Domain location=12-106; Score=-101.3; E_value=0.0012; Accession=PF00122.10; Description=E1 -E2 ATPase
MARVKGKPQGFSVSILIATAVMSSLMNIAPQKAVIAETGEVVDADEVKINTVLEVKAGEVIPIDGVVIDGICEVDEKKLTGESFPVAKQKDSTVWAGTINLNGKNS

SEQ ID NO: 223634 - protein, 524 aa, Glycine max
  Coding DNA Sequence Number=SeqID_106856
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=O64474; Match level="QueryCoverage=81%, HitCoverage=36%, E-value=1e-165, Identity=67%"; Hit description =Putative cadmium/zinc-transporting ATPase 2
  Pfam annotation: Domain name=E1-E2_ATPase; Domain location=1-98; Score=-66.6; E_value=1.4e-05; Accession=PF00122.10; Description=E1 -E2 ATPase
  Pfam annotation: Domain name=Hydrolase; Domain location=102-329; Score=115.3; E_value=1.8e-31; Accession=PF00702.16; Description =haloacid dehalogenase-like hydrolase
  Pfam module annotation: Pfam domain module=E1-E2_ATPase::Hydrolase; Domain location=1-98::102-329
MAKLVEEAQNSKTNIQRLIDKFAQFYTPGVVIISALVAVIPLALKQHNHKLWLQFSLVVLVSACPCALILSTPVATFCAYTKAATSGLLIKGGDHLETLAKIKVMAFDKTGTITKGEFVVTHFQSLSDDIDFNTLAYWVSSIESKSSHPSAAAIVDYGRSLSVEPEPEKVTEFEIFPGEGICGKIEGRVIYIGNKRIAARAGFETVPILQGEVERGKTTGYIYLGAIPIGFFSLSDACRLRVQEAIGQLKSLGIKTAMLTGDNQSAAMQVQDELGHSLELVHAELLPEDKVKIISEFKKEGPTAMVGDGLNDAPALAAADIGISMGISGSALASETGNIILMSNDIMKIPEAIKLARKASRKVVENIVFSIMTKAAILDLAIGGHPLVWAAVVADVGTCLLVIFNSMLLLRKGHNHGGKCCRSSTKPHNHKNGCGGSHDNSSHHHHHHEHDQHQHEDHSHKRCCSEKTKKLFPPQKCGGAHGSSSHHHHHHRQHQHEYHNHDQHDQHHQKCASQTSFSTCPPCS

SEQ ID NO: 223635 - protein, 54 aa, Glycine max
  Coding DNA Sequence Number=SeqID_106857
MTVRDGTMTETSLIPAEEEKRLRLREKGKTTSSNNRDKEFGGDDADGWKRCKRA

SEQ ID NO: 223636 - protein, 72 aa, Glycine max
  Coding DNA Sequence Number=SeqID_106858
MAPDTVDEFLIHFLAFRTWFIESTLVNELSSVAATTCVGGITNRRMRQLLAREEEEWTDTRENMKMLMGVFT

SEQ ID NO: 223637 - protein, 79 aa, Glycine max
  Coding DNA Sequence Number=SeqID_106859
MKEEHVYKLGVYELKVVIPRGLSIMMAGGVQVQSHDLLCGRRLWHTNCTTHPALKNKIENGCNVYTVINRLLEWIPSSP

SEQ ID NO: 223638 - protein, 162 aa, Glycine max
  Coding DNA Sequence Number=SeqID_106860
  Gene Ontology: Mol. function=transcription factor activity; Cellular component=intracellular; Biological process=regulation of transcription, DNA-dependent
  Homolog annotation: Hit_ID=P0ACL2; Match level="QueryCoverage=100%, HitCoverage=62%, E-value=3e-59, Identity=70%"; Hit description=Exu regulon transcriptional regulator
  Pfam annotation: Domain name=FCD; Domain location=96-162; Score= -20.5; E_value=0.054; Accession=PF07729.2; Description=FCD domain
  Pfam annotation: Domain name=GntR; Domain location=9-72; Score=88.6; E_value=1.9e-23; Accession=PF00392.11; Description=Bacterial regulatory proteins, gntR f
  Pfam module annotation: Pfam domain module=FCD::GntR; Domain location= 96-162::9-72
MDLNESRRLYQQLASELKQRIEAGSYAVGAKLPAERMIAESHQVSRTVVREAIIMLEVEGYVEVRKGSGIHVISDQPQPRDSAADQLEFASYGPFELLQARQLIESNVAEFAATQIRPQDIVALLAIQEKARQEDHARDSTWDMEFHVHIAQATQNSALAAI

SEQ ID NO: 223639 - protein, 101 aa, Glycine max
  Coding DNA Sequence Number=SeqID_106861
  Gene Ontology: Mol. function=tagaturonate reductase activity; Cellular component=cytoplasm; Biological process=metabolic process
  Homolog annotation: Hit_ID=Q6D9G9; Match level="QueryCoverage=79%, HitCoverage=16%, E-value=1e-22, Identity=61%"; Hit description =Altronate oxidoreductase
  Pfam annotation: Domain name=Mannitol_dh; Domain location=20-101; Score=-28.4; E_value=0.027; Accession=PF01232.13; Description =Mannitol dehydrogenase
MSQSAEAVIPSGKLRTCAPAQFGEGNFLRAFIDWQLDWLNEHQGTDAGVVVVRPRNRMQTETLNQQDGLYTTLLRGLNDAGEPLSETRLIRRLNRDIQPYQ

SEQ ID NO: 223640 - protein, 156 aa, Glycine max
  Coding DNA Sequence Number=SeqID_106862
  Gene Ontology: Mol. function=RNA-directed DNA polymerase activity; Biological process=RNA-dependent DNA replication
AYPLVPSRKEKERHLARFLDIFKKLEITLPFGEALQQMPFYAKFLKEMLTKKNRYIHSDRIVVEGNCSAVIQRFLPPKHKDPGVVTIPYSIGEVAVDKALMDLGATDFVVMEIEEDADIPLILGRPFMSTMSCMGPPDQNVCLKVHVMEERRREKK

SEQ ID NO: 223641 - protein, 175 aa, Glycine max
  Coding DNA Sequence Number=SeqID_106863
MGEIEEVQEQMKADMEAMKEQMATMMEAMMSMKKIMEANVVAVAATSAVAKVNPLPPSDLNQMNHPTSNMVGKDLGSTDGPMMCKFKTSTPSRHMACLRTIHHPMWRTLPNEDVNNSTPILIESRQPHHVHVSQPMRETHEIPHHNLADFEPCLGYATEGQSSWWYTPAKPFGRP

SEQ ID NO: 223642 - protein, 198 aa, Glycine max
  Coding DNA Sequence Number=SeqID_106864
  Gene Ontology: Mol. function=helicase activity; Biological process =viral genome replication
  Homolog annotation: Hit_ID=Q9LTU4; Match level="QueryCoverage=99%, HitCoverage=15%, E-value=2e-49, Identity=44%"; Hit description =Helicase-like protein
MREWFSYRLQCISNESITLLNSKRLFQKFVVDGYTMVDKFCSLQHSLDNGSRRGLNKGKRVILPSTFVGSPRYMDQLYFDGMVICSHVGFPNLFITLTCNQNWPEIHRLLSPLNLKAVDRSDIISRVFKLKYEKMLIDLTKNHMLGKVIAYMYTIEFQKRGLPHVHLLLFLHPDNKYPSSAEIDQIISAEIPSQQDDP

SEQ ID NO: 223643 - protein, 93 aa, Glycine max
  Coding DNA Sequence Number=SeqID_106865
MPSGPEEFQQGPGVSSSGCRPLSVLQGARSPSEESLPQRHPVDPEKSNRALGFPALVMGLCSPTGCPFPPASKGIRPPTNRAFIKKYCVPRQA

SEQ ID NO: 223644 - protein, 94 aa, Glycine max
  Coding DNA Sequence Number=SeqID_106866
TSFGYHKDRNGQWLKKDALPPQDERTPSPPPQRDDSALMTEVLSELRGLRTYVGEHFDSLDTRFAGMDIRLTQLEEDVGYIHQSFDLPPPPPPS

SEQ ID NO: 223645 - protein, 317 aa, Glycine max
  Coding DNA Sequence Number=SeqID_106867
  Gene Ontology: Mol. function=chitin binding; Cellular component =extracellular region; Biological process=chitin metabolic process
  Homolog annotation: Hit_ID=UPI000044A8F0; Match level="QueryCoverage =78%, HitCoverage=99%, E-value=2e-42, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLTFRGIHVLAFRGLNILTFRGLHILAFRGLHVLAFIGLHALAVRRLHVLTFKGIHVLAFRGLHVLTFRGLHALAFRELHAFTFRGLHVLAFRGLHVLAFKGLHVLTYRRLHALAFIGLYALAFRGLHVLAFRGLHILAFRWLHALAFIGLHAFAFRKLHALACRGLHVLAFRGLHALAYRGLHILAIRGPHVLAFRGQHALTFRGLHALAFRGLHALSFRGLHVLTFRGPHILAFRGLHVLTFRGLHVLAFKGSASSPTKNYTSSPIEDYMSAPSEHYTPSPIEGCTPSPLEDYTSSPLEDYTSSPSEDYTSSPSE

SEQ ID NO: 223646 - protein, 105 aa, Glycine max
  Coding DNA Sequence Number=SeqID_106868
MCSLDCVVALHRAKDEHNAYGSAHRRPHDQANIIRHPLKHRTRSRSRSKTKSKMHNIEICVVRGWLWWGRVTTWSHESGDVKVCGWWFWVVAGRGVGLVGSMMLM

SEQ ID NO: 223647 - protein, 68 aa, Glycine max
  Coding DNA Sequence Number=SeqID_106869
MSKVQGFKYKELRTQRIVDNQAKIEALGLSKLATIFKDKIQKVKKKDKKKVNDNDEDYVRTTWIKFFK

SEQ ID NO: 223648 - protein, 56 aa, Glycine max
  Coding DNA Sequence Number=SeqID_106870
MAYDSEECLVKLMEWLDGFLSVLLRMKMNLYYHIGLMYSAYMTLHMGSHCWGFHGG

SEQ ID NO: 223649 - protein, 97 aa, Glycine max
  Coding DNA Sequence Number=SeqID_106871
MEGTVIEVEETGKEWQSECWVVRLRDIRMYDRLQDLVFLNHKCEIRLRYLGDNLILISGLDESGVTEKINNEDESFLSVFHNVQRWNPNVRTQNRIV

SEQ ID NO: 223650 - protein, 296 aa, Glycine max
  Coding DNA Sequence Number=SeqID_106872
  Gene Ontology: Mol. function=pyruvate dehydrogenase (acetyl -transferring) activity; Cellular component=mitochondrion; Biological process=glycolysis
  Homolog annotation: Hit_ID=Q9ZQY1; Match level="QueryCoverage=84%, HitCoverage=67%, E-value=1e-125, Identity=89%"; Hit description =Pyruvate dehydrogenase E1 beta subunit isoform 3
  Pfam annotation: Domain name=Transket_pyr; Domain location=1-139; Score=18.4; E_value=7.3e-08; Accession=PF02779.14; Description =Transketolase, pyrimidine binding dom
  Pfam annotation: Domain name=Transketolase_C; Domain location=156 -278; Score=210.1; E_value=5e-60; Accession=PF02780.10; Description =Transketolase, C-terminal domain
  Pfam module annotation: Pfam domain module=Transket_pyr::Transketolase _C; Domain location=1-139::156-278
MACCWVLWTEKNDEAQARGGGMMDMTIRQACRFAGILLLVNSCCFYAQAIDHIINSAAKSNYMSAGQISVPIVFRGPNGAAAGVGAQHSQCYASWYGSCPGLKVLSPYSSEDARGLLKAAIRDPDPVVFLENELLYGESFPVSAEVLDSSFCLPIGKAKIEREGKDVTITAYSKMVGYALKAAETLAKEGISAEVINLRSIRPLDRSTINTSVRKTNRLVTVEEGFPQHGVGAEICTSVIEESFGYLDAPVERIAGADVPMPYAANLERMAVPQVEDIVRAAKRTCYRSVPLAASA

SEQ ID NO: 223651 - protein, 71 aa, Glycine max
  Coding DNA Sequence Number=SeqID_106873
MCVKESEMEEEPIHQLYSKTFLTLMALFNRDMDNHDFHDSLFHGFHIMIYMIMASWSNSGVVARNKDKYET

SEQ ID NO: 223652 - protein, 108 aa, Glycine max
  Coding DNA Sequence Number=SeqID_106874
MLLLLHSKPIPLKIIEATRSNTSFSIQLSFIFKKQRTPLMKKIQGLRAPHGSYIIKVAGPHHTLLRIEPVTRVEALIPDDVILTKSGSLDTGHRVWMMPLREREDKSR

SEQ ID NO: 223653 - protein, 106 aa, Glycine max
  Coding DNA Sequence Number=SeqID_106875
MNSLALCSLCLFLIAQSPWLTNATVFGDGSDLIGQICNENPEKKIECTNILRADPTVLDVPAIANCALYYERTIEDFTNSLNALKRQDPQTANYLADIAGDGPSSC

SEQ ID NO: 223654 - protein, 155 aa, Glycine max
  Coding DNA Sequence Number=SeqID_106876
  Gene Ontology: Mol. function=enzyme inhibitor activity
  Homolog annotation: Hit_ID=Q1RYM1; Match level="QueryCoverage=95%, HitCoverage=86%, E-value=4e-15, Identity=35%"; Hit description =Pectinesterase inhibitor
  Pfam annotation: Domain name=PMEI; Domain location=11-146; Score =32.0; E_value=2.1e-06; Accession=PF04043.6; Description=Plant invertasepectin methylesterase inhibitor
SPWLTNATVFGDGSDLIGQICNENPEKKIECTNILRADPTVLGAKNLLQLSEAILNLAVNKTEKAEDFLKGLANTTDVPAIANCALYYENAVERFMNSLQKLKCQDLKVANYLAAIAGDEPSSCETELSAAHIVNHAISAGNCLSALASSLRESD

SEQ ID NO: 223655 - protein, 328 aa, Glycine max
  Coding DNA Sequence Number=SeqID_106877
  Gene Ontology: Mol. function=pectinesterase activity; Cellular component=cell wall; Biological process=cell wall modification
  Homolog annotation: Hit_ID=Q4PSQ5; Match level="QueryCoverage=94%, HitCoverage=98%, E-value=2e-70, Identity=44%"; Hit description =Pectinesterase family protein
  Pfam annotation: Domain name=Pectinesterase; Domain location=31-316; Score=167.3; E_value=3.9e-47; Accession=PF01095.10; Description =Pectinesterase
MNIYLVLPVSFLGGTILAESGDCGGKDISTTITVGGRQGNFTFGSIQAAINSIKTNNDRWIKIHIEAGLYIGKIYIPQEKPCIILEGEGSRKTIITFWDHIGIDTSATFTSEPPNVVATDIGFMNTYNSINRRIEIKPALAARIYGDKSFFLRCNFISYQDTLFDATGRHYFKNCYIEGEIDFIWGYGQSFYENCSINAVGINSTGPDFVTAQGRESPTDPSGFVFEGGSLVGDGKVNLGRAWRAYSRVIFHGTYLSSVVTPEGWNPWNYTGSESNFTYAEVDCKGPGADTSKRVKWIKTLNQSQLNEFSLTSFINKDGWIDNLPIIF

SEQ ID NO: 223656 - protein, 176 aa, Glycine max
  Coding DNA Sequence Number=SeqID_106878
  Gene Ontology: Mol. function=enzyme inhibitor activity
  Homolog annotation: Hit_ID=Q1RYM1; Match level="QueryCoverage=98%, HitCoverage=100%, E-value=2e-21, Identity=37%"; Hit description =Pectinesterase inhibitor
  Pfam annotation: Domain name=PMEI; Domain location=27-170; Score =28.0; E_value=3.4e-05; Accession=PF04043.6; Description=Plant invertasepectin methylesterase inhibitor
MNSLALCSLCLFLIAQSPWLTNATVFGDGSDLIGQICNENPEKKIECTNILRADPTVLGAKNLLQLSEAILNLAVNKTEKAEDFLKGLANTTDVPAIANCALYYENAVERFMNSLQKLKCQDLKVANYLAAIAGDEPSSCETELSAAHIVNHAISAVNHQTSLLSYIAFVATGKLS

SEQ ID NO: 223657 - protein, 47 aa, Glycine max
  Coding DNA Sequence Number=SeqID_106879
  Homolog annotation: Hit_ID=Q9ZNW0; Match level="QueryCoverage=87%, HitCoverage=9%, E-value=8e-13, Identity=80%"; Hit description =Molybdenum cofactor synthesis protein 3
MMRTSVYMLGVIDHDVVELNNMHRQVIHTEAYVGKPKVKSAAAACGS

SEQ ID NO: 223658 - protein, 888 aa, Glycine max
  Coding DNA Sequence Number=SeqID_106880
  Gene Ontology: Mol. function=RNA binding; Biological process=RNA processing
  Homolog annotation: Hit_ID=Q9FLQ1; Match level="QueryCoverage=56%, HitCoverage=55%, E-value=1e-102, Identity=44%"; Hit description =Arabidopsis thaliana genomic DNA, chromosome 5, P1 clone:MCO15
  Pfam annotation: Domain name=Surp; Domain location=143-187; Score =48.3; E_value=2.5e-11; Accession=PF01805.10; Description=Surp module
  Pfam annotation: Domain name=Surp; Domain location=351-395; Score =47.0; E_value=6.4e-11; Accession=PF01805.10; Description=Surp module
  Pfam module annotation: Pfam domain module=Surp::Surp; Domain location=143-187::351-395
MDLEVAGRHAMLFDDDGMAAFVNSAEALVEWNSLSIDRYDVRHLLSAPLPPRLKRRPPPPEPDLDHQRYLDLPSSSADDEQQDYGSDPVSSTGFHAVAFSYGNSNVSTETKDNDTKSSFDPKFPVPESLLNNLPPNEKVHQIISRTATFVSKHGSQSEIILRVKQGDNPTFGFLMPNHHLHAYFRFLVDHQELLKVDKDDGSSTEDMNRTQGLDQSGGALSLLGSVYGSGEDEDGTTENTCDVEKKECEGAVDAVSNYTSPGIDQAESYSDVAKNDGDISKNPVPSLKEKVPVIKRNHSISTVKTATTARAKGDGLDSVSNAQNKSQTSVTSTAKIELPVVKPPSDLKRAIEKIVEFILKNGKQFEAVLAEQDRPHGRFPFLLPSNRYHTYYLKVLQTAEESKLLGKGHQKHNPAGRTGDNNTAVHEDRDNLSHGSMASDLPYDMDRKEKFQMIIGKSKKDGQDPIPKEQAQNTISMDAAATAAILQAATRGIKNPNLEALTKTSSGSGQGLGSDGGCLSSSGTGSLYSFQPQGFVENQNLNVKAKASASAPFAKAIAEKVAIAAAGEADSSEAHMTKEQKLKAERLKRAKMFSAMLKSGVGASELPRALSVEPPGSGVSGSDAETGNLVGKEREGSSVPFDVDNSDKSQKSEDKLSIDNNSDKSQKSEEKLTDDNERRSKRKYRSRSSRHEEEEEENKDRRDHKRSRKKHHSHRASHHNRDRHKHKRRHSSSKDKYSYRGTKHDSSSDDEHHRSRHHRHKYDSSSSDDEHHSSKQRHRDDNLSDHEHRHSRHSNEDYSSSDDEHRHRSRSRSVRHKSKSHAERETELEDGEIIMKSEKSVVSGEVGRASREASEGLSNARAQSQAPEITDVSYELRAKIRAMLMANL

SEQ ID NO: 223659 - protein, 128 aa, Glycine max
  Coding DNA Sequence Number=SeqID_106881
  Gene Ontology: Mol. function=histone-lysine N-methyltransferase activity; Cellular component=nucleus; Biological process =multicellular organismal development
  Homolog annotation: Hit_ID=P59467; Match level="QueryCoverage=74%, HitCoverage=79%, E-value=4e-26, Identity=57%"; Hit description=LOB domain-containing protein 23
  Pfam annotation: Domain name=DUF260; Domain location=2-89; Score =122.4; E_value=1.3e-33; Accession=PF03195.5; Description=Protein of unknown function DUF260
MSDCIFSPYFPANDPERFARVHRIYGGSNVGKMLQQIPSYLREQAANSLYFEAQCRIQDPVYGCAGIISKLYEQINSTEIALAHVQTQIACQKLQVPQAKAESNFNVFPAQNSSTAEFQWESQVPWFN

SEQ ID NO: 223660 - protein, 81 aa, Glycine max
  Coding DNA Sequence Number=SeqID_106882
MVHGFSRGAIVDEGGREESVEALMTMEDLALPLTTTLEFFRGLLLNFECQHLQKKKKAKGRDYAISHSFHVHAVITYSYLY

SEQ ID NO: 223661 - protein, 500 aa, Glycine max
  Coding DNA Sequence Number=SeqID_106883
  Gene Ontology: Mol. function=carboxyl- and carbamoyltransferase activity; Cellular component=chloroplast; Biological process='de novo' pyrimidine base biosynthetic process
  Homolog annotation: Hit_ID=Q43086; Match level="QueryCoverage=77%, HitCoverage=99%, E-value=1e-169, Identity=80%"; Hit description =Aspartate carbamoyltransferase 1, chloroplast precursor
  Pfam annotation: Domain name=OTCace; Domain location=234-387; Score =187.7; E_value=2.9e-53; Accession=PF00185.14; Description =Aspartateornithine carbamoyltransferase, AspOrn binding domain
  Pfam annotation: Domain name=OTCace_N; Domain location=86-230; Score =162.9; E_value=7.9e-46; Accession=PF02729.11; Description =Aspartateornithine carbamoyltransferase, carbamoyl-P binding domain
  Pfam annotation: Domain name=PMEI; Domain location=364-487; Score= -8.8; E_value=0.078; Accession=PF04043.6; Description=Plant invertasepectin methylesterase inhibitor
  Pfam module annotation: Pfam domain module=OTCace::OTCace_N::PMEI; Domain location=234-387::86-230::364-487
  Subcellular localization annotation: CTP_CleavageSite=9; ConfidenceScore=5.04e-01
MSAASLLFSCSMHVGVSHPKVAAKPSPCCLLNQPWNHLKSKTPFGHSGVFEKSKLSHKGDEILWRAGALQVESAPSFSMGQKFHLHDVIEAQQFDRETLNAIFEVARSMESIESKSSRSQMLKGYLMATLFYEPSTRTRLSFESAMKRLGGDVLTTENAREFSSAAKGETLEDTIRTVEGYTDIIVMRHFESGAAKRAATTASIPVINAGDGPGQHPTQALLDVYTIEREIGKLDGIRVGLVGDLANGRTVRSLAYLLAKYQDVKIYFVSPNVVKMKDDIKDYLTSKGVEWEESADLLEVASKCDVVYQTRIQKERFREKIELYEEARGKYIVNQDVLDAMQKHAVVMHPLPRLDEITVEVDRDPRAAYFRQAKNGLYIRMALLKAILNLAVNKTEKAEDFLKGLANTTDVPAIANCALYYENAVERFMSSLQVLKHQDLEVANYLAAIAGDEPSSCETELSAAHIVNHAISSVNHQTSLLSYIAFVATGKLLTVVAPLI

SEQ ID NO: 223662 - protein, 298 aa, Glycine max
  Coding DNA Sequence Number=SeqID_106884
  Homolog annotation: Hit_ID=UPI0000E8108B; Match level="QueryCoverage =79%, HitCoverage=25%, E-value=3e-21, Identity=28%"; Hit description =PREDICTED: similar to Esophageal cancer associated protein
MKDDDGQVACSIARFVHMVDYGTEMEHHLAFLVDCRGAFGRLNELKETLVHSSNSLAIQALKCAKKHLNFVKSCVTFSEVTIPSISAHRQFDLFLETAEVAFLGGLVSHSDGLIDSAISCLHTLDIIDGFRTPTDVEGLVSSIRKLCGFLIMVPGTLSLPVTYFPNSLFTLISSRSWFEPKMRAQIFSAIILLLTTLSQKRLPYHANSQIPGNDMLYYGDSSYNQELVSLSKLVLENLLSAVQQEPSQAARGIMALEACNCIASSFMAICFFCFTIAALAAHPTNLPHSLTNRHPTNY

SEQ ID NO: 223663 - protein, 94 aa, Glycine max
  Coding DNA Sequence Number=SeqID_106885
MEEYYKEMEMALVRVNIEEEIEDTLAHFLSGLNPYLRDVVELQEYVELDDLLHKVDGKITSESKISEEEVEEELEEEAMQSDMLMVRRLLGSQM

SEQ ID NO: 223664 - protein, 158 aa, Glycine max
  Coding DNA Sequence Number=SeqID_106886
  Homolog annotation: Hit_ID=Q9SJZ7; Match level="QueryCoverage=38%, HitCoverage=22%, E-value=9e-12, Identity=65%"; Hit description =Putative DnaJ protein
MSLPKMLIARYVVKYRRKRVTYSLIAKGHCPYGGNPCHGYRANVNHSRWYGWWVALTNTIWQHRNNLIFQGNQFDSSKVMEEAMAIIVAEVPEVLGMEQMILNMSITVLFSTLKKQSRPGCLINENSISHLPAVNDMFCMQGDWRNLNSLQYMLWGWS

SEQ ID NO: 223665 - protein, 119 aa, Glycine max
  Coding DNA Sequence Number=SeqID_106887
  Subcellular localization annotation: CTP_CleavageSite=41; ConfidenceScore=5.48e-01
IMATDPTSPPQSDGQSEATSKRSRTTTRLRTLTLRTVDQPRPAVYVDPATGRASGPMREKFHSYLGVVAREKVPIIHNNWKDVPETLKDIVWNDILWSKHPLLAVEHVEISLGRKNSTF

SEQ ID NO: 223666 - protein, 154 aa, Glycine max
  Coding DNA Sequence Number=SeqID_106888
MLPREICFDYHEIIKWWGYVRGNINCSKGYAYKKKLSIDNCGGIVIKRSSDFQEITSSSLVEGQWMQQEIREFQRKKKCDATHQEAIRLQFPTKNTLLQKADSTSVKLSYLRRASHRLCYRCRCKSTTTTSVSPTTVFVMSEDDVSAQLTIVVI

SEQ ID NO: 223667 - protein, 157 aa, Glycine max
  Coding DNA Sequence Number=SeqID_106889
  Gene Ontology: Mol. function=zinc ion binding
  Homolog annotation: Hit_ID=Q1RZN6; Match level="QueryCoverage=43%, HitCoverage=22%, E-value=5e-11, Identity=44%"; Hit description=FAR1
MEISDNDANVTTPSKGLNDHVYTLQRWVPKCDQQLKPVVGNVFDTLEEGNNFYTTYALEVGFNICRSIEVKYKDGEIKFKYYVCSRQGFKEENRRTISVMLVDEKRMPKTRRRKETREECNAKIVFKRTTVENIKFFDFMKVDDERLKYVFLGGGSS

SEQ ID NO: 223668 - protein, 59 aa, Glycine max
  Coding DNA Sequence Number=SeqID_106890
MCPPPERVKTKGAQKKSMTKDQQSVIRLTMSMLMHYILCKMVIMDKWMNISNMGYVIAS

SEQ ID NO: 223669 - protein, 64 aa, Glycine max
  Coding DNA Sequence Number=SeqID_106891
  Gene Ontology: Mol. function=strictosidine synthase activity; Biological process=biosynthetic process
  Homolog annotation: Hit_ID=Q1RTN6; Match level="QueryCoverage=72%, HitCoverage=13%, E-value=4e-16, Identity=82%"; Hit description =Quinoprotein amine dehydrogenase, beta chain-like
  Pfam annotation: Domain name=Str_synth; Domain location=4-64; Score =0.6; E_value=0.0012; Accession=PF03088.7; Description=Strictosidine synthase
MKLSFAIAMNFSNAIEPEARSHGQVFKYNPTSNETVIFLDNVAFANGVALSKDEDYLVVCETWK

SEQ ID NO: 223670 - protein, 191 aa, Glycine max
  Coding DNA Sequence Number=SeqID_106892
  Gene Ontology: Cellular component=nucleus; Biological process=defense response
  Homolog annotation: Hit_ID=Q8LGD5; Match level="QueryCoverage=76%, HitCoverage=73%, E-value=3e-10, Identity=31%"; Hit description =Protein MKS1
  Pfam annotation: Domain name=VQ; Domain location=54-84; Score=38.7; E_ value=2.1e-08; Accession=PF05678.4; Description=VQ motif
MKAGAKLYGFHEQQPKKVINGPRPSPLMINKDSHMIRKETKLQRPQRINPIIIYTESPKIIHTKAKDFMALVQRLTGRSSSTNDNLSTASLPQEGSENFGSSLSDGSNYNSNETSSALRRVGENLVESGAIVQHGPSNLDFADMPLFTPNSSDFFCSSGSSVYKYSDSPYGVLGSLISPSGLEFMKELPEY

SEQ ID NO: 223671 - protein, 103 aa, Glycine max
  Coding DNA Sequence Number=SeqID_106893
  Subcellular localization annotation: CTP_CleavageSite=34; ConfidenceScore=5.01e-01
LNVLSEFHPLSEASTRLADRRNLEGNLSCRHALNASSARSASRLSLSKLSASLALSENSLTRAKRDIEKRKGHWEIEKRALNSHKSFKSEIHRGKEQSKEANF

SEQ ID NO: 223672 - protein, 79 aa, Glycine max
  Coding DNA Sequence Number=SeqID_106894
MLPYYFQIPLGVILAILDPVHIVVWKSGPAVIVGKSIVLKPPTQGSNLSTIKNVLTFNRMQPCINPLLNYPVNCISYKL

SEQ ID NO: 223673 - protein, 106 aa, Glycine max
  Coding DNA Sequence Number=SeqID_106895
MGEAHKMPHHNLADFEPCLGYATKGQAVGDIPLQNTLEGPQYHPQPHPSHSTAIKNPHAMAEKGKLDHIEERLKDIEGGEDYAFANLEELLLVPKHGHSQVQGVGH

SEQ ID NO: 223674 - protein, 104 aa, Glycine max
  Coding DNA Sequence Number=SeqID_106896
MESWGFRFEGYKMRCGFISLDQFRFKGRVIEGTQTFDLFLLREVSFVSRVWWGGQGKTDWIERRCLLYSLPLNDEAKSGRRDLNPQPQPWQGYALPLSYFRQQR

SEQ ID NO: 223675 - protein, 326 aa, Glycine max
  Coding DNA Sequence Number=SeqID_106897
  Homolog annotation: Hit_ID=Q1T493; Match level="QueryCoverage=97%, HitCoverage=75%, E-value=6e-17, Identity=22%"; Hit description =Nucleic acid-binding, OB-fold, subgroup
MEHLPFRKFKFVDFSTVIAGHFQTGLLVDVIGVVNEVVFRYVSSKNMRVVFKLKDLSGQVEDERSIINLLTHARIKKGQGSYPLSISNSFKASKLMINKLVLEIQEFRERLLDLWIEVRSVLTPIGQGSSQVSGSSQLSSKDAFLSKAEAKNISQINVISKVMYIVEVMVNHKGEHTKFLLWDHECAELIGQSADEVNRLKIEDGNADLNVSPQALDRLLGCFLAFKVKPCCKIESSILDSTDPIELEYQSAFVITDDNRSMLDSTEPTELESQSVFVTADHDPLLRIPLIPTKCVSSDELDDEPKNFEISHVKVSSNKIAKHCQA

SEQ ID NO: 223676 - protein, 169 aa, Glycine max
  Coding DNA Sequence Number=SeqID_106898
MEPSTKYRKDLKIYESTTINFFACDHHCVFDIHFIPPLERQTCGRQRHSSRKHIWTVRFTQEMLDAPEPLKLPCYTEVPLKACGHHMTVLRRSGPPLQWKVETLNPAIGGKGVVQPWYDFLEEMDFDEGDEISIYYRYYEKIWDIVIRKRRIGTIVTPIKLLFSSNKIY

SEQ ID NO: 223677 - protein, 127 aa, Glycine max
  Coding DNA Sequence Number=SeqID_106899
MATTTSCDFSSLESIQQYLLELKHDIFQHSRVFPTMKYVIPTLSQHYSNPDLNSESVTDTNKCWHAKGNTIRWRMKFTLLRNRGVSDGDKRSKEEWCKGSHAPSKPVKVMMKASNQSLAWKGFDLKF

SEQ ID NO: 223678 - protein, 150 aa, Glycine max
  Coding DNA Sequence Number=SeqID_106900
  Gene Ontology: Mol. function=transcription factor activity; Cellular component=nucleus; Biological process=regulation of transcription, DNA-dependent
  Homolog annotation: Hit_ID=Q8LLR3; Match level="QueryCoverage=94%, HitCoverage=69%, E-value=1e-18, Identity=37%"; Hit description =Ethylene-responsive element binding protein 1
  Pfam annotation: Domain name=AP2; Domain location=78-142; Score =142.8; E_value=9.5e-40; Accession=PF00847.10; Description=AP2 domain
MNNFNTTLESDDFSLLESIQRYLLDDNEDFNALTEVLATPNNVDAVNSPLSLSEHATTTATAARGASVSVARASHARSQNYKGVRRRPWGKFAAEIRDPNKNVRVWLGTYESAEDAALAYDRAAFEMRGSKAKLNFPHLIGCNDAEPSQR

SEQ ID NO: 223679 - protein, 70 aa, Glycine max
  Coding DNA Sequence Number=SeqID_106901
MKKWNTVCDDRGQAWKTTEWPGVHGGHDATMSLERQLARAFCRVGSSHQPLNDGECFYITLGFSRVFMID

SEQ ID NO: 223680 - protein, 216 aa, Glycine max
  Coding DNA Sequence Number=SeqID_106902
  Gene Ontology: Mol. function=D-alanyl-D-alanine endopeptidase activity; Cellular component=integral to membrane; Biological process=cytochrome complex assembly
  Homolog annotation: Hit_ID=Q945B8; Match level="QueryCoverage=66%, HitCoverage=26%, E-value=4e-40, Identity=60%"; Hit description =Growth-on protein GRO10
MMRASELFHFRRHRLGRSALDLGLDTELKPLILSAASEHASDRIVRDMDLQLLQAHVSVQLYSPFRPAVDIAEVFLWMMAVLTILCASYWSARTTREAVIEQDKLLKDALDEIPNTKYASVSGVVNMNVKAAVLFVVFALCFLFMLYKLMSSWFIDVLVVLFCIGGIEDQHALIPCTGENHVIRWFKHAEKSYIKDSHCPFNHNFFFIGCSNRELH

SEQ ID NO: 223681 - protein, 224 aa, Glycine max
  Coding DNA Sequence Number=SeqID_106903
  Homolog annotation: Hit_ID=Q8S3W1; Match level="QueryCoverage=19%, HitCoverage=10%, E-value=4e-13, Identity=81%"; Hit description =Elongation factor 1-gamma
MNPIGKVPVLETPDGPVFESNAIARYVARLKGDNALFSSSAIDNVNYTLPLSFPCIKHTKSHKKLLFYIGSAYTTDVETLPFYIGPPFTTDVENSSSTSVVQPMLKGLGFSTTPTTTTGHKRCRKAFRTNVEGLFSSSGSLLGNTGKAGFSGILCDNLGQWLSSFSELHALFHGLSLTWNSGYKSVECDSDSLLALQLVAKGVTTYHPYASIINRICTFKTKQW

SEQ ID NO: 223682 - protein, 131 aa, Glycine max
  Coding DNA Sequence Number=SeqID_106904
MVEETNKASQWRMPIAVEEKKGTKFEIDKQMKGAEEERKKTKEEDEPFWKEKNESAEEEACWEGDCWVHERRRKARKKKISMATRAKQKQKGYTRRENIPRASANDIGNKETGQETKVGIGSLEDEPFFES

SEQ ID NO: 223683 - protein, 45 aa, Glycine max
  Coding DNA Sequence Number=SeqID_106905
MTPRVEGIQIEVYELQMRKRTHSCESAYLSPSKTAKQAKRCEQNK

SEQ ID NO: 223684 - protein, 79 aa, Glycine max
  Coding DNA Sequence Number=SeqID_106906
MSRNFTDCLTMGVKYLKVVKRGSHHNKQMTRSPQDGEKVCEMTIICLHPPLDSLSLNDKERRMTIICLRAFITRLAVPE

SEQ ID NO: 223685 - protein, 327 aa, Glycine max
  Coding DNA Sequence Number=SeqID_106907
  Gene Ontology: Cellular component=integral to membrane
  Homolog annotation: Hit_ID=Q7VTU7; Match level="QueryCoverage=99%, HitCoverage=97%, E-value=1e-136, Identity=74%"; Hit description =Putative inner membrane protein
MPAQIGREQGIEAAHRRQGRHAHAGATETQPQQADGQHGEQAGGQQRAIEQPGRQEDAERAGNGGLDHHGARDVGQRQAFLALAHPDQRVHDFRQFGGHGRQQQRGHVRRGAHGDAQQFDLVDEHVRGAGNHDQGQQRLGRGPEHRRIVVARAQLERFQVLAIDAVLVVAQFALDVQAVGGQEQDAEPGFPGEGQQAQADLEDEDAHEPGLVAGQPALVRVDTVGLRGLAAARAPQGQADHGIGQRRQHQRAAHGRADADVLLFGRVAEHHGHEGHGAFRQGGAEGGQHRAGRGGAELEAMSDPFNAIDEEFAGEIDHCRGQEKQEQ

SEQ ID NO: 223686 - protein, 68 aa, Glycine max
  Coding DNA Sequence Number=SeqID_106908
  Subcellular localization annotation: CTP_CleavageSite=41; ConfidenceScore=5.18e-01
MGCAGSSQSKPDGEPPLLFNPLKTSSLHSLFVKSLPISSWVAVKIPSFFFLFHGIREQAFFKGERIRK

SEQ ID NO: 223687 - protein, 303 aa, Glycine max
  Coding DNA Sequence Number=SeqID_106909
  Gene Ontology: Mol. function=amidase activity; Biological process =auxin biosynthetic process
  Homolog annotation: Hit_ID=Q2KVD0; Match level="QueryCoverage=97%, HitCoverage=53%, E-value=2e-38, Identity=34%"; Hit description =Putative amidase
  Pfam annotation: Domain name=Amidase; Domain location=1-303; Score =58.1; E_value=4.6e-15; Accession=PF01425.11; Description=Amidase
  Subcellular localization annotation: CTP_CleavageSite=72; ConfidenceScore=5.57e-01
MHELAAGITGASSLSGFTHNAWQHGRSPGGSSSGSAVAVAAGFVPLAIGSDTAGSVRIPAAFNGLFGLRMTRGALSSAGIVPLSPTQDIPGPLVRYAADLRLISEILTGQRFPRPDRPLRIGIWQEGFAAEETEINQAVQNAVAPFQPRMLSWPQLETLAAEANIIAYEFADALAAWLADKPEAPLRTLAAIAASGRYHPQLEATFKIRAQHPGMKSDGYREVQLRQQRLYQQLAQFFQQQQIDLLAYPVVRHPPVKHGELQPGSNALISAVTGAPAISIPVGLSTEGLPIGLELLALRDRED

SEQ ID NO: 223688 - protein, 116 aa, Glycine max
  Coding DNA Sequence Number=SeqID_106910
  Homolog annotation: Hit_ID=Q1S671; Match level="QueryCoverage=60%, HitCoverage=19%, E-value=9e-07, Identity=43%"; Hit description =Cyclin-like F-box; F-box protein interaction domain
MGFTIWGMHAFMRMMYRARYDDDAVLPAWSIDDDDGAGVFPLKQKYHVIGVCKGLVCLIAKTREDSTTFSVRFYNPATRLRSKKSPRIKIGSKNVMGFGYDDSSDTYKVVAIPNLK

SEQ ID NO: 223689 - protein, 187 aa, Glycine max
  Coding DNA Sequence Number=SeqID_106911
  Subcellular localization annotation: CTP_CleavageSite=45; ConfidenceScore=5.12e-01
MDGHIDMALVKEFYSNLWTWTWVSSFHTRSHRWPSPTPPGLARARGSEGPSSTTPPAPIPTTPAPSTSAPPLPHAHSHSPAPSAPSSSFQCRCSESMHDSAQHMSFISMDEFMAQVAWPGVQPSPLGGGEASATQESQPEPEVTREATPEVTQQVSHATSPVVEVSEGEKGTKDTDYAADLQAVQST

SEQ ID NO: 223690 - protein, 216 aa, Glycine max
  Coding DNA Sequence Number=SeqID_106912
MVSPQGRNTCTIDDLVPYVEKLAILSQEQERITEPVAHGPASERRFPPQQFHMIQSSVETRGFDRRREIVQAEDFSQQMEQRGHGMYYMPPTFSQYPSQMYQYPFEGHDTDMSASEYSFGGVAETHPHFSWPTMTPSQQHDALMATPNAPLASQWDVPGAIPDMGDLLGVDLRHEFSTEAEQQGQRQRARRNQDRLARRWDRPCGTSSRHHGHHND

SEQ ID NO: 223691 - protein, 307 aa, Glycine max
  Coding DNA Sequence Number=SeqID_106913
CESSGILPDEPLLPESSRKRFSGSLPEEVFFRKTFGYFRKNTSSGNFPEQVLPELPEEPLTGLPEDAVVSLLRHFFRRPLVFSPLVFYPKVTILRVGREKTNLFAEKKKKTLPWARLAEKKELAEKKEVHEEERRTRFTEEEEKTKLFVRTNSVFRENPVKPKKPCNSVMFVGVARTMMTSIFSGLGWTPCWCLYETKGHHQQFVVTFKVKVFYGHEPEVGVNHENVKGIQKKANGRQRWCHDLPWNKIAEMRHMLGHPAKHTASVHPLSEKSRAKPKFTNVRKAIKKCTKRTSTNKATYLSLKSDF

SEQ ID NO: 223692 - protein, 87 aa, Glycine max
  Coding DNA Sequence Number=SeqID_106914
MVLDGEISIIGRWKRGVGMEIWVSSCGMEMKGWHWCISRSRGWYRHDIMDGDVRRDGPKMIIKGLQDFLEYLRSGRHGSMMKAPMVV

SEQ ID NO: 223693 - protein, 183 aa, Glycine max
  Coding DNA Sequence Number=SeqID_106915
RECQSLPSEAERIEGKFPIKEKERRKISNQRESKKEKKENSPIKEWEKAKRKERKFPIKEWEKVKKEEEEGKKAPDQGSKENRRNVQKGLWTGQYLNNTELSQIWGSLLGDNNCGKKMTAHTAKSISNKVAAGVSLSEAYALSESHVLSEVLSPLSELGEFGGESEKHMRAQLAQRGVGLFMF

SEQ ID NO: 223694 - protein, 469 aa, Glycine max
  Coding DNA Sequence Number=SeqID_106916
  Gene Ontology: Mol. function=transferase activity, transferring glycosyl groups; Cellular component=integral to membrane; Biological process=lignin metabolic process
  Homolog annotation: Hit_ID=Q9LVR1; Match level="QueryCoverage=100%, HitCoverage=97%, E-value=1e-114, Identity=45%"; Hit description=UTP -glucose glucosyltransferase
  Pfam annotation: Domain name=UDPGT; Domain location=7-465; Score= -61.7; E_value=1.6e-07; Accession=PF00201.9; Description=UDP -glucoronosyl and UDP-glucosyl transferase
MVTSKAHAALVASPGMGHLIPMLELGKRLLTHHSFHVTIFIVTTDSATTTSHILQQTSNLNIVLVPPIDVSHKLPPNPPLAARIMLTMIDSIPFLRSSILSTNLPPPSALIVDMFGLAAFPIARDLGMLTYVYFATSAWFSAVSVYVPAMDKKMIERHAEHHEPLVIPGCEAVRFEDTLEPFLSPIGEMYEGYLAAAKEIVTADGILMNTWQDLEPAATKAVREDGILGRFTKGAVYPVGPLVRTVEKKAEDAVLSWMDVQPAETVVYVSFGSGGTMSEVQMREVALGLELSQQRFVWVVRPPCEGDTSGSFFEVSKNGSGDVVLDYLPKGFVKRTEGVGVVVPMWAPQAEILGHPATGCFVTHCGWNSVLESVLNGVPMVAWPLYAEQKMNAFMLSEELGVAVRVAGEGGGGVVGREEIAELVRRVMVDKEGVGMRKKVKELKVSGEKALSKFGSSHHWLCRMNQDCQ

SEQ ID NO: 223695 - protein, 96 aa, Glycine max
  Coding DNA Sequence Number=SeqID_106917
  Gene Ontology: Mol. function=DNA binding; Biological process=DNA integration
  Homolog annotation: Hit_ID=Q1S6J5; Match level="QueryCoverage=53%, HitCoverage=21%, E-value=7e-09, Identity=51%"; Hit description =Integrase core domain, putative
MYPLPLPRQNILEELREVKTSSGKDIVGSLGGWYLATFGESSGLLTYSKSDGSFWQYKAWNRDMLMAECSDMLYQSSTQCRKKNHFDKKSPPKHCK

SEQ ID NO: 223696 - protein, 135 aa, Glycine max
  Coding DNA Sequence Number=SeqID_106918
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q1RXT3; Match level="QueryCoverage=98%, HitCoverage=25%, E-value=3e-35, Identity=57%"; Hit description =Glycoside hydrolase, family 17
ALGGREGVEDDGGGVRGGNEDVVMEIGIDEGGVEGAEGEEEEGGDGGEGGEDLVAEGDGGDAGGGVVGGDVSADPRGGGGVGGGDGEELVVGDADGDVDVGTRQGAEDVGVGVVEADVGDLLVHEEVDQVRHRSH

SEQ ID NO: 223697 - protein, 132 aa, Glycine max
  Coding DNA Sequence Number=SeqID_106919
MDPPRPVTKPPCWRSLGSISGISLPSNPFVLRSILSLSLFLCYQLHILIAWAIAQGSRALKPPMHTYQQGEKGSVCNTVGLWKCNVEESYFEIQNRTGAGMIIRDDQGSFIVARTAWREPCMHVQEGDRCQR

SEQ ID NO: 223698 - protein, 110 aa, Glycine max
  Coding DNA Sequence Number=SeqID_106920
MLSLRRITAFDVIVQDFLSSNFLEDGGFRPRIRASSKGHMFLVYEYLPTLDLSPYGFDFALDLVQVDLELVEEGLLIVEVGGVATSHDRGRVSEEMDVATKAMLKDMKGC

SEQ ID NO: 223699 - protein, 94 aa, Glycine max
  Coding DNA Sequence Number=SeqID_106921
MVAPCNSSNNSSTIGIRTRSLMAMTGNYETLIEHFGNEFSHSFFFSVKAWGYVRLKFLVWPPLAWPYQWHDGWKKGLRTANSRQMSGERPERNN

SEQ ID NO: 223700 - protein, 58 aa, Glycine max
  Coding DNA Sequence Number=SeqID_106922
MPQPHGINMGLKEHSNRVSLPPRPRLRRIRLGLTFLIQPIQLSNNPYTYEFHDKKSPT

SEQ ID NO: 223701 - protein, 79 aa, Glycine max
  Coding DNA Sequence Number=SeqID_106923
MEQLVLEHFHHCQEWEPHNQDLAQKCHHHCQDLGTSSSISIATRKWILRSKEEDIGSENKCKEKGSFGSHFSDKKNAET

SEQ ID NO: 223702 - protein, 442 aa, Glycine max
  Coding DNA Sequence Number=SeqID_106924
  Gene Ontology: Mol. function=protein phosphatase type 2C activity; Cellular component=nucleus; Biological process=protein amino acid dephosphorylation
  Homolog annotation: Hit_ID=Q1SAL1; Match level="QueryCoverage=95%, HitCoverage=96%, E-value=0.0, Identity=83%"; Hit description=Protein phosphatase 2C-like
  Pfam annotation: Domain name=PP2C; Domain location=36-332; Score =108.3; E_value=2.3e-29; Accession=PF00481.12; Description=Protein phosphatase 2C
  Subcellular localization annotation: CTP_CleavageSite=52; ConfidenceScore=5.08e-01
MGCCVSTSSRSTCSSKSNGDMVSPSCLETGCCGQKRTRRTFSDHGRKGINQDAMIVWEDFMSEDTIFCGVFDGHGPHGHLVARKVRDALPTKLVSSLHSNESKRNGSGKTCFKGNVKPDSGDSEKDCSAEDKLNSTWREAFMKAYKAMDKELRSHPNLDCFCSGSTAVTIVKQGSNLFMGYIGDSRAIMGSKDSNDSIVAIQLTVDLKPDLPREAERIKKCKGRVFALQDEPEVPRVWLPFDDAPGLAMARAFGDFCLKEYGVISIPEFSHRQLTDRDQFIILASDGVWDVLSNEEVVEIVSSAPTRSSAARILVDSAAREWKLKYPTSKMDDCAVVCLFLDGKMDSESDYEEQGFSSATIQSNHSGNPIESDDGQKSEPSLQRNFTVRSSEENETNGALSVDVVEDATSSADDQNWSGLEGVTRVNSLVQLPRFSEEGPNS

SEQ ID NO: 223703 - protein, 85 aa, Glycine max
  Coding DNA Sequence Number=SeqID_106925
  Subcellular localization annotation: CTP_CleavageSite=57; ConfidenceScore=5.20e-01
MRFPNPGSGDDTFVPNPGYEVPIPGSGGSGAFSAKTSTGAKRGRGPLNTNTGTHAKRAALDKCEYSTGAKQAKREYADPNPFQQL

SEQ ID NO: 223704 - protein, 107 aa, Glycine max
  Coding DNA Sequence Number=SeqID_106926
MVEVEDSSPFSECRKLRLWNREDESWSERENRKRKGVKDREASQAATNKPRLPDNYSSSLFIYQGRCETWIFSNINHYSFLFHLNWYNLVQVGTIGLEPRGLGTTTL

SEQ ID NO: 223705 - protein, 227 aa, Glycine max
  Coding DNA Sequence Number=SeqID_106927
WWIHPQVYGESVETLDNDLLALVDGGWRRAKGGGGGCARGGVSSVAALAQARRGPEKVMDGSMGFQQFFLMYAKLIIGLSDSKVCIGLSRWLDDSGTCEDTRSTPDILLRKQGRPGVKGAVDLEFLDQSNVNLLLWEFSEYPVSLPSLELSVKFINVVLIPVPSYLYSEARGIPGGFPALSGHRSSFPHLAPCPESLGLALQSRLAQARRQASSSQFISALSALMLA

SEQ ID NO: 223706 - protein, 222 aa, Glycine max
  Coding DNA Sequence Number=SeqID_106928
  Pfam annotation: Domain name=GRP; Domain location=58-115; Score= -22.4; E_value=0.014; Accession=PF07172.2; Description=Glycine rich protein family
MAGAEVEAAMSDRSDQLLQAVCFCLVFEDKVTSWDINNVKVERVGFVTYAAEQTRRAMNVEVSVLALVVVDVEATWDKGNAGKGKSGVDLRHHGGGGGSGFSGYNRNGGGYGGGGDDENVGSNKDRDRDRDKEHDHECSSGRHTKVGALLDVHSGGERKGSGSMNRGDLGEDRVGARVDNQSRMTSSLAAISRVLVVMADRGFGKGRDRSSGWCVLTWQEQR

SEQ ID NO: 223707 - protein, 148 aa, Glycine max
  Coding DNA Sequence Number=SeqID_106929
  Gene Ontology: Mol. function=glutamate-ammonia ligase activity; Cellular component=chloroplast; Biological process=nitrogen compound metabolic process
  Homolog annotation: Hit_ID=P08281; Match level="QueryCoverage=98%, HitCoverage=42%, E-value=7e-49, Identity=56%"; Hit description =Glutamine synthetase leaf isozyme, chloroplast precursor
  Pfam annotation: Domain name=Gln-synt_N; Domain location=69-147; Score=18.8; E_value=0.00023; Accession=PF03951.9; Description =Glutamine synthetase, beta-Grasp domain
  Subcellular localization annotation: CTP_CleavageSite=44; ConfidenceScore=5.61e-01
MAQILAPSTQWQMRISKSSPNATPITSNMWGSLLWKQNKKVSLTSSAKFRVLAIKSDNSTINRLEGLRGIGIDVRSKSRTISKPVEDPSKLPRWNYDGSSTGQAQGDNSEVIYDSYTPQGEPIPSSLQTRDTEIFSNPKVQAEVPWYI

SEQ ID NO: 223708 - protein, 76 aa, Glycine max
  Coding DNA Sequence Number=SeqID_106930
MKEKKEFPKREFSDFSCWSGLGSVYSCLAHFACLALVPVFALSACCLLSVGVCIHAQRASSSLSTSAYFRAERTLG

SEQ ID NO: 223709 - protein, 63 aa, Glycine max
  Coding DNA Sequence Number=SeqID_106931
MSKCPRCGASRYKVKDDEDMNLKKCQNARGVDPPAKHMGIPAVTVLRVIMHAPSVKKTQATYN

SEQ ID NO: 223710 - protein, 78 aa, Glycine max
  Coding DNA Sequence Number=SeqID_106932
MCFPFFLPFISGGEGTRRCAMVVGFGCMWGTVIVGFKGRVWWCWVDGQGCASEGRGADYHKKKGAGSKNVNPKGNSRK

SEQ ID NO: 223711 - protein, 381 aa, Glycine max
  Coding DNA Sequence Number=SeqID_106933
  Homolog annotation: Hit_ID=Q10QE9; Match level="QueryCoverage=96%, HitCoverage=95%, E-value=2e-84, Identity=44%"; Hit description =Expressed protein
  Pfam annotation: Domain name=DUF677; Domain location=43-374; Score =510.1; E_value=2.5e-150; Accession=PF05055.3; Description=Protein of unknown function (DUF677)
MGGQSSKIPSSSDVPTPIKMGTHSLYAADLSSYEAACVEDPNLQSLDATIQERTNRVITSLAQGIEVHSISIESLGEVTGSLLEMNQDVAKVILECKQDIWNKKDRELFSLVEDFFENSLQTLEFCNALDKCLNRARERHVIVKSAITCFEEEVQNGVEGSTYLKTLQELKGFKEAGDPFTEEFYSLFQSVYQQQASMLKKLQIRKQKLDKKLKSLKTLKRVSNAIFVAAFVSVLIFSVVAAAIAAPPVVTALAGALAVPIGSVGKWCNSLFKRYETALKGQRELIISMQVGTYITLVDLKHIQVRIDQLEINIESMLQSSDFALRNEDAVKFAIDEIKKNIDTFAETIEALSKQADECSRQIRRARTMVVKKIINYTNTS

SEQ ID NO: 223712 - protein, 402 aa, Glycine max
  Coding DNA Sequence Number=SeqID_106934
  Gene Ontology: Mol. function=transporter activity; Cellular component= integral to membrane; Biological process=transport
  Homolog annotation: Hit_ID=Q6ATP9; Match level="QueryCoverage=93%, HitCoverage=93%, E-value=1e-106, Identity=48%"; Hit description =Expressed protein
  Pfam annotation: Domain name=MFS_1; Domain location=1-362; Score =68.9; E_value=1.6e-17; Accession=PF07690.6; Description=Major Facilitator Superfamily
RKPSSSVYKEVSETFNAGPSDLGYLTFIRNFVQVLSSPLVGILVINYDHPTILAMGTFCWALSTAAVGVCHDFLQVAFWRAINGFGLAIVIPALQSFIADSYKDGVRGTGFGLLSLIGNLGGIGGGVLATVMAGQQFWGIQGWRCPFILMATLSALIGFLVLLYVVDSRKRFPTTPDASESSDRGDSIYKGNASATSVWMDSWAATKAVIKVKTFQIIGLQVIIGSLPWTAMVFFTMWFELIGFDNNTSATLLSLFAIGCAMGSFSVGSIADKLSQVIPPPVSSFPTFSVTLFVMGLTTSWNGAAANAPMFAEVVPVLDYNSKSVDPIKGSSPEALALSKGLLSTMAVPFGLCCLCYTPLYYIFRRDRENARMLALKEEEMIIQVNHAIMVPSWLGCLLPED

SEQ ID NO: 223713 - protein, 324 aa, Glycine max
  Coding DNA Sequence Number=SeqID_106935
  Homolog annotation: Hit_ID=Q9FJV7; Match level="QueryCoverage=77%, HitCoverage=83%, E-value=1e-54, Identity=43%"; Hit description =Arabidopsis thaliana genomic DNA, chromosome 5, P1 clone:MFO20
  Pfam annotation: Domain name=DUF607; Domain location=129-311; Score =288.0; E_value=1.8e-83; Accession=PF04678.4; Description=Protein of unknown function, DUF607
  Subcellular localization annotation: CTP_CleavageSite=39; ConfidenceScore=5.50e-01
MAFRKALAQGLLNITKVSSQSLTNCRISSSSVIGKVSPRAAEPVDPGENGRFRSPQLAGRNLLDKLRTMGVAHNRIRLDGLTPPQIKMVDTVTIEDARKLLKVAQVEMLKAKLRQTRKSCITFSEFIAICAEHCSDQDQAVEIAKMLDDSAAVIVLGDVVFLRPEQVAKAIQGLLPVPGAKVPESIRREFEEMEKKRLAIDERADTMVRRELWGGLGFMMVQTMAFMRLTFWELSWDVMEPICFYLTSMYCMACYTFFLRTSKEPSFEGFYQARFSSKQKRLMKLHNFDIEKYNQLRAACSPTTMPPKFDPSMALPFDNSSIHQ

SEQ ID NO: 223714 - protein, 372 aa, Glycine max
  Coding DNA Sequence Number=SeqID_106936
  Homolog annotation: Hit_ID=Q1S569; Match level="QueryCoverage=82%, HitCoverage=85%, E-value=5e-90, Identity=56%"; Hit description =Cystinosin/ERS1p repeat
  Pfam annotation: Domain name=PQ-loop; Domain location=264-328; Score =26.8; E_value=2.8e-05; Accession=PF04193.5; Description=PQ loop repeat
  Pfam annotation: Domain name=PQ-loop; Domain location=31-97; Score =91.1; E_value=3.4e-24; Accession=PF04193.5; Description=PQ loop repeat
  Pfam module annotation: Pfam domain module=PQ-loop::PQ-loop; Domain location=264-328::31-97
MPMLPSYCVKESKPCVGWVEKYLGDCLCNLKDEISFGFGFISLICWGVAEIPQIITNFRAKSSHGVSLAFLLTWVAGDIFNLVGCHLEPATLYTITTIVLVLQSFYYDYIYKWGKRHGKINTDEAYKEEEKKPLRPKPGRDHSGIPIQNDGPKETPRRDYYYRSARSLAANDTPPFGTYLRAAKSVPSAIVMNDDSSSDDDEAHPLSSKKPVTQPRPIPRSVPATYGTFLVASMNFPRQGNALMEGYNRFNGRKLLLQEHNSMHTALGQWLGWLMAVIYMGGRLPQIWLNGLNPLMFVFALIANATYVGSMPTTDTLGRKLEVMMLIMETTEKPAKILCLDLWDCKTHVELPNIEPLQFHHDIQLLVRKRFY

SEQ ID NO: 223715 - protein, 325 aa, Glycine max
  Coding DNA Sequence Number=SeqID_106937
  Gene Ontology: Mol. function=lyase activity; Cellular component =anchored to membrane
  Homolog annotation: Hit_ID=Q1SGJ9; Match level="QueryCoverage=88%, HitCoverage=79%, E-value=1e-135, Identity=79%"; Hit description =Pectolytic enzyme, Pectin lyase fold
  Pfam annotation: Domain name=Pec_lyase_C; Domain location=78-263; Score=248.8; E_value=1.1e-71; Accession=PF00544.9; Description =Pectate lyase
WRLNPEWRRHRPQLATCSVGYTGTDDKQYIGKDLIHYIVIDPSDDPINPKRGTLRYGASVIQGKVWITFQRDMHIKLERPLLISSFTAIDGRGVNVHIANNACLMIFKATNIIIHGIRVHHCKPQAPGVVMGPEGKVIPLGHVDGDAIRLVTASKIWIDHNTLYNCQDGLLDVTRGSTDVTISNNWFRDQDKVMLLGHDDGYVRDQNMKVTVVYNHFGPNCNQRMPRIRHGYAHVANNLYLGWVQYAIGGSMGPSLKSEANLFIAPTIGSKEVTWRKSNHNNGDTWEFHSVKDAFENGASFTNRKKDLEVQFASLGIETYQMTRS

SEQ ID NO: 223716 - protein, 634 aa, Glycine max
  Coding DNA Sequence Number=SeqID_106938
  Gene Ontology: Mol. function=protein kinase activity; Cellular component=extracellular region; Biological process=protein amino acid phosphorylation
  Homolog annotation: Hit_ID=Q2R2M3; Match level="QueryCoverage=93%, HitCoverage=91%, E-value=1e-112, Identity=38%"; Hit description =Protein kinase domain containing protein, expressed
  Pfam annotation: Domain name=LysM; Domain location=123-167; Score =10.6; E_value=0.044; Accession=PF01476.10; Description=LysM domain
  Pfam annotation: Domain name=LysM; Domain location=188-232; Score =23.8; E_value=0.00063; Accession=PF01476.10; Description=LysM domain
  Pfam annotation: Domain name=Pkinase; Domain location=356-615; Score =74.7; E_value=2.9e-19; Accession=PF00069.15; Description=Protein kinase domain
  Pfam annotation: Domain name=Pkinase_Tyr; Domain location=357-615; Score=34.7; E_value=1.3e-14; Accession=PF07714.7; Description =Protein tyrosine kinase
  Pfam module annotation: Pfam domain module=LysM::LysM::Pkinase::Pkinas e_Tyr; Domain location=123-167::188-232::356-615::357-615
MHLFPFIPIIIFTLLIHNFSLILGQQPYIGLGTVACPRRGNKNSIRGYTCNGANHSCQSYLTFRSQPIYNSVKTISTLLGSDPSQLAKINSVSMNDTFETNKLVIVPVNCSCSGEYYQTNTSYVFQNSETYLLIANNTFEGLTTCQALENQNHNPANIYPGRRLLVPLRCACPTKNQTKKGIRYLLSYLVNWGDSVSFISEKFGVNFMSTLEANTLTLTQAMIYPFTTILVPLHDKPSSSQTVSPTQRISPPPSPPSSDHSSNKTWVYVVVGVVVGAIALTSVLCAVIFFKRYRKNRNKDDSLVAVPKSFEAIEEKPQVKVNEKLSENISGIAQSFKVYNFEELQRATDNFSPSSWIKGSVYRGVINGDLAAIKKIEGDVSKEIEILNKINHTNVIRLSGVSFHEGRWYLVYVYATNGDLSEWIYFNNVDGKFLSWTQRMQIALDVATGLDYLHSFTSPPHIHKDINSSNILLDGDFRGKVANLSLARCLEGGDDQFPTTRHIVGTRGYMAPEYLENGLVSTKLDVYAFGVLMLEMVTGKEVAAILTEDETKLSHVLSGIPGERSGKEWLKEFVDPSLGENCPLELAMFVIEMIDDCIKTDPASRPSVHEIVQSLSRTVNSSLSWERSMNVPRN

SEQ ID NO: 223717 - protein, 773 aa, Glycine max
  Coding DNA Sequence Number=SeqID_106939
  Gene Ontology: Mol. function=protein serine/threonine kinase activity; Biological process=protein amino acid phosphorylation
  Homolog annotation: Hit_ID=Q769C9; Match level="QueryCoverage=55%, HitCoverage=54%, E-value=1e-13, Identity=22%"; Hit description=PPR protein
  Pfam annotation: Domain name=PPR; Domain location=266-300; Score =33.8; E_value=6.1e-07; Accession=PF01535.11; Description=PPR repeat
  Pfam annotation: Domain name=PPR; Domain location=301-335; Score =22.0; E_value=0.0021; Accession=PF01535.11; Description=PPR repeat
  Pfam annotation: Domain name=PPR; Domain location=336-370; Score =16.8; E_value=0.077; Accession=PF01535.11; Description=PPR repeat
  Pfam annotation: Domain name=PPR; Domain location=580-614; Score =28.6; E_value=2.1e-05; Accession=PF01535.11; Description=PPR repeat
  Pfam annotation: Domain name=PPR; Domain location=615-649; Score =15.2; E_value=0.12; Accession=PF01535.11; Description=PPR repeat
  Pfam annotation: Domain name=PPR; Domain location=650-684; Score =38.8; E_value=1.8e-08; Accession=PF01535.11; Description=PPR repeat
  Pfam module annotation: Pfam domain module=PPR::PPR::PPR::PPR::PPR::PP R; Domain location=266-300::301-335::336-370::580-614::615-649::650 -684
MTTLFCGAVSLTQMYLSDSMVTCVKVMNCGLIPTLANCKNDERIGESENDERMGNAARHCGENDERVAKYGPLRSEEEAAAKGNKAGEEEGKQPFFREANLLNGLTSRVQARSYARRREPFPTKVSHYLHRAKLIDSIRLTLRSNTPNPSLPSLINHRLMDSFVATHALRSAPSADSALSFVRALEKSSHFSHTHHTLHSLATVLAKSGRSSELKSLVDDIRANRFGSVQISFMNLMQWHAAVRDLDTVLQVWEQYALENDHLCTESYNIVMTLYAQMGKDFEAVRVFRRMIDEGSLPNCRSYTVIIEHLVKSRKLSEALEVFNLLPSMRIKRTLRQYSVLLEGFVGSKQFDEVRILVEEMQVDGILPSRGMGLLLQQMKEEGILEGKEQLLRGILPDETIRSVSYSIDSGDEDENENEDQDENISDAGQCNHVDGIHLKPWMDPRALVSALRNWSPDEVAALESANFVWTTRLVCKMLRNFKTPEAAWSFFCWAANQRGFTHDIYTVQRITTLLARHGRTDLVDRLISKIRMERMRLPFSTIRMIIDFYGISKKADAALKVFNDDRILCGPISNVNLMLLYSSLLRTLTKCGRNSDALDMLDDMILNGICPDIQTFSGLMYYFSQLGDIKTVQKLFAMVRQSGLEPDAYLFKALIQGYCKSERAALAWRLFEDMKNSGLVPDSATKELLVKSLWKEGRRREAAAVEESYEEINTVLPLALQGHHTYYKGKTIKVLRKRFTIAIIARTTTAAASAFFRNIKDCDDCNHPNLKP

SEQ ID NO: 223718 - protein, 182 aa, Glycine max
  Coding DNA Sequence Number=SeqID_106940
  Gene Ontology: Cellular component=clathrin vesicle coat
  Homolog annotation: Hit_ID=Q2RBN7; Match level="QueryCoverage=99%, HitCoverage=8%, E-value=2e-64, Identity=66%"; Hit description =Clathrin heavy chain, putative, expressed
  Pfam annotation: Domain name=Clathrin_propel; Domain location=107 -138; Score=21.3; E_value=0.0035; Accession=PF01394.10; Description =Clathrin propeller repeat
  Pfam annotation: Domain name=Clathrin_propel; Domain location=28-63; Score=1.2; E_value=77; Accession=PF01394.10; Description=Clathrin propeller repeat
  Pfam module annotation: Pfam domain module=Clathrin_propel::Clathrin _propel; Domain location=107-138::28-63
MESDKYICVRETAPQNSVVMIDMTMPMQPLRRPITADSALMNPNTRILALKGDQTIRASYSLRYMIPIRSPAQCFVSFLLRAAQVPGSTQDHLQVFNIESKAKMKSYQMSQQVVFWKWITPKTLGIVTQSSVYHWSIEGDGEPVKVFDRTANLANNQIINYRCDPTEKWLLLQGLALGVIDK

SEQ ID NO: 223719 - protein, 370 aa, Glycine max
  Coding DNA Sequence Number=SeqID_106941
  Gene Ontology: Mol. function=oxidoreductase activity; Cellular component=membrane; Biological process=electron transport
  Homolog annotation: Hit_ID=Q2LAK5; Match level="QueryCoverage=69%, HitCoverage=97%, E-value=4e-92, Identity=68%"; Hit description =Cytochrome P450 monooxygenase CYP71D54
  Pfam annotation: Domain name=p450; Domain location=10-337; Score =63.2; E_value=8.7e-16; Accession=PF00067.12; Description=Cytochrome P450
PKTTITYKLPPGPKKLPLIGNLHQLAIAGSLPYLALRDLALKYGPLMHLQLGEISILVVSSPNMAKEIMKTHDLAFKTRQMQQQVDKIAYNILQEHQEKRDRALQESRVDLEEEDLVDVLLRIQQSDTIKIKITTTNINAVTLVVFTAGMDTSATTLEWAMAEIMRNPIVRKKAQTEVRQALGELKIIHETDVEELTYLKLVIKETLGLRTPSLLLLPRECSERTIIDGYEIPIKTKVMVNVWAIARDPQYWTDAERFVLERFDDSFIDFKGNNFEYLSFEARRRMCPDMTFGLVNIMLPLYHFNWELPNELKPEDMDMSENFGLTIYIGRKSQLCLMMCQARGEFLSGNSSAQSDSRTPCTDLGNSSVM

SEQ ID NO: 223720 - protein, 1534 aa, Glycine max
  Coding DNA Sequence Number=SeqID_106942
  Gene Ontology: Mol. function=binding; Cellular component=clathrin vesicle coat; Biological process=intracellular protein transport
  Homolog annotation: Hit_ID=Q2RBN7; Match level="QueryCoverage=96%, HitCoverage=86%, E-value=0.0, Identity=88%"; Hit description =Clathrin heavy chain, putative, expressed
  Pfam annotation: Domain name=Clathrin; Domain location=1119-1265; Score=121.7; E_value=2e-33; Accession=PF00637.10; Description=Region in Clathrin and VPS
  Pfam annotation: Domain name=Clathrin; Domain location=1268-1427; Score=82.4; E_value=1.5e-21; Accession=PF00637.10; Description =Region in Clathrin and VPS
  Pfam annotation: Domain name=Clathrin; Domain location=382-524; Score= 67.9; E_value=3.1e-17; Accession=PF00637.10; Description=Region in Clathrin and VPS
  Pfam annotation: Domain name=Clathrin; Domain location=531-673; Score= 106.9; E_value=5.9e-29; Accession=PF00637.10; Description=Region in Clathrin and VPS
  Pfam annotation: Domain name=Clathrin; Domain location=678-817; Score= 129.0; E_value=1.3e-35; Accession=PF00637.10; Description=Region in Clathrin and VPS
  Pfam annotation: Domain name=Clathrin; Domain location=824-969; Score= 125.9; E_value=1.1e-34; Accession=PF00637.10; Description=Region in Clathrin and VPS
  Pfam annotation: Domain name=Clathrin; Domain location=973-1114; Score=131.2; E_value=2.8e-36; Accession=PF00637.10; Description =Region in Clathrin and VPS
  Pfam annotation: Domain name=Clathrin-link; Domain location=175-198; Score=36.8; E_value=7.3e-08; Accession=PF09268.1; Description =Clathrin, heavy-chain linker
  Pfam annotation: Domain name=Clathrin_propel; Domain location=140 -174; Score=22.1; E_value=0.0019; Accession=PF01394.10; Description =Clathrin propeller repeat
  Pfam annotation: Domain name=Clathrin_propel; Domain location=39-79; Score=17.3; E_value=0.055; Accession=PF01394.10; Description =Clathrin propeller repeat
  Pfam annotation: Domain name=Clathrin_propel; Domain location=97-132; Score=15.2; E_value=0.24; Accession=PF01394.10; Description=Clathrin propeller repeat
  Pfam module annotation: Pfam domain module=Clathrin::Clathrin::Clathri n::Clathrin::Clathrin::Clathrin::Clathrin::Clathrin-link::Clathrin _propel::Clathrin_propel::Clathrin_propel; Domain location=1119 -1265::1268-1427::...
  Pfam module annotation: Domain location=382-524::531-673::678 -817::824-969::973-1114::175-198::140-174::39-79::97-132
MLPFFWGGRNSFRRPQLVKGNMQLFSVDQQRSQALEAHAASFATFRVAGNDKDSTLICFASKSINAGQVTSKMHVIELGAQPGKPSFSKKQADLFFPPDFADDFPVSMQISNKYGLIYVITKLGLLFVYDLETATAVYRNRISPDPVFLTTEASSDGGFYAINRRGQVLLATVNEATIVPFVSGQLNNLELAVSLAKRGNLPGAEELVVKRFQELFAQTKYKEAAELAAQSPQGVLRTPDTVAKFQSVPVQAGQTPPLLQYFGTLLTMGKLNAFESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMAQMEGGCPIDYNTITDLFLQRNLIREATAFLLDVLKPNLPEHGYLQTKVLEINLVTFPNVADAILANGMFSHYDCPRIGQLCEKAGLFIRALQHYTELPDIKRVIVNTHAIEPQALVEFFGTLSREWALECMKDLLLVNLRGNLQIIVQTAKEYSEQLGVDACIKLFEQFKSYEGLYFFLGAYLSSSEDPDIHFKYIEAAAKTGQIKEVERVTRESNFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVQRMDSDLWEKVLNPENEFRRQLIDQVVSTALPESKSPDQVSAAVKAFMTADLPHELIELLEKIVLQNSAFSGNFNLQNLLILTAIKADPSRVMDYINRLDNFDGPAVGEVAVEAQLYEEAFSIFKKFNLNVQAVNVLLDNLQTIDRAVEFAFRVEEDAVWSQVAKAQLREGLVSDGIESFIRADDSTHFLEVIKAAEDADVYHDLVKYLLMVRQNTKEPKVDSELIYAYAKIECLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEYYQNRGCFNELISLMESGLGLERAHMGIFTELGVLYARYRPEKLMEHIKLFSTRLNIPKLIRACDEQQHWKELTYLYIQYDEFDNTATTIMNHSPEAWDHMQFKDVIVKVASVELYYKAVHFYLKEHPDIINDMLNVIALRVDHTRVVDIMQKAGHLRLVKPYMVAVQSNNVSAVNEALNEIYAEEEDYDRLRESIDLHDNFDQIGLAQKIEKHELLEMRRVAAYIYKKAGRWKQSIALSKKDNLYKDCMETCSQSGDRELSEDLLVYFIEQGKKECFASCLFVCYDIIWPDVALELAWMNNMIDFAFPYLLQFIREYTGKIDELIKDKIEAQNEEKAKEKEEKEVLAQQNMYAQLLPLALPAPPMQGMGGGYAPSPPPPMGGMGMPPMPPFGMPPMGGGY

SEQ ID NO: 223721 - protein, 62 aa, Glycine max
  Coding DNA Sequence Number=SeqID_106943
MGGLASHCHERLTNTKRKQEVWKKMEEGVPKLSRRCALSRKVQAKPQMHAKPQMHAKPPDAC

SEQ ID NO: 223722 - protein, 112 aa, Glycine max
  Coding DNA Sequence Number=SeqID_106944
MGDTHEVPQDHTLADSEPCLGYATEGQAFGGIPLPNTLGGPQYHPQPQALHFAVGRVPPAMVEMPDIIIPPKFKVPDFDKYKGTTCPKNHLKMYRRKMGAYSKDEKLLMHFF

SEQ ID NO: 223723 - protein, 97 aa, Glycine max
  Coding DNA Sequence Number=SeqID_106945
  Gene Ontology: Mol. function=hydrolase activity; Cellular component =membrane
  Homolog annotation: Hit_ID=Q10Q31; Match level="QueryCoverage=64%, HitCoverage=11%, E-value=8e-21, Identity=71%"; Hit description =Heparanase-like protein 2, putative, expressed
MSLNIKLGSFLNVVYLDQLGIASCYNTKVYCRQTLIGGNYDLLNTTTFAPNPNYYSALLWHRLMGKKVLAVSSDVHIKDFYLQLGNTSGLRYLKKGG

SEQ ID NO: 223724 - protein, 441 aa, Glycine max
  Coding DNA Sequence Number=SeqID_106946
  Gene Ontology: Mol. function=nutrient reservoir activity; Cellular component=extraorganismal space; Biological process=defense response to bacterium
  Homolog annotation: Hit_ID=Q8W3X8; Match level="QueryCoverage=78%, HitCoverage=53%, E-value=1e-99, Identity=50%"; Hit description =PreproMP73
  Pfam annotation: Domain name=Cupin_1; Domain location=240-393; Score =97.0; E_value=5.8e-26; Accession=PF00190.13; Description=Cupin
MEPRKASPLSWVLIFFLTISLWGVKVSSEEHHHHGKSKEGPVVERDQRRTLLVTEFGEITAIDIKEGQKELPYHLQFITLEPNSLFLPVLLQADMVFYVHTGSGKLTWANDDGTSTIRLREGDVCSLNEGSVFYIQSNLEAERRKLRIYAMFTNTDDNTYDPSIGAYSRINELVKGFDKKIMQAALKVPEDLIEAIINKTETPAIVHAVPEKRNIVQELEASFLKNFLGVGSNSKKLETYNIFEHDPDFKNPIGWSTAVTKKQLKSLKRTNIGFLMVNLNMGSILGPHWNAKATELTVGVDGEGMVRVVCGSGNENETECQNMRFKVKEGDAFLVPRFHPMAQMSFNNGPFVFLGFSTSAKKNHPQFLAGKGSVLHILDKKILARSLGMQFLRRGRGEDNEGGGGGRGEQERRRREEEKRRGGGGRGEKEKRGEEERGRGS

SEQ ID NO: 223725 - protein, 76 aa, Glycine max
  Coding DNA Sequence Number=SeqID_106947
MAVDWRRRKGDWRCHFKEQMSQEQGALKYKGQNPTLLGYSKLVGALDRRLQEDWARDAKEGPRVLMSFRVDFGPMG

SEQ ID NO: 223726 - protein, 48 aa, Glycine max
  Coding DNA Sequence Number=SeqID_106948
  Gene Ontology: Mol. function=methyltransferase activity; Biological process=metabolic process
  Homolog annotation: Hit_ID=O80543; Match level="QueryCoverage=89%, HitCoverage=12%, E-value=2e-09, Identity=73%"; Hit description =Uncharacterized protein At1g22800
MYVWSFVDLVVSFLGLHWTNDLLGAMRQLALKPEGLFLAAILRVETLK

SEQ ID NO: 223727 - protein, 142 aa, Glycine max
  Coding DNA Sequence Number=SeqID_106949
MHRYLMVMHIFCQLEESEPVDTQRQTSSSAPLSSRDGESNDMRRYLIVIRTFCQLQASEPVDTQRLTSSSAPFSSRDGESDDIQRYLMVIHTFCQPEASEPVNMQRLMSSSTPFSSRDGESDDMRRYPSGYPYKHTSVNPDP

SEQ ID NO: 223728 - protein, 119 aa, Glycine max
  Coding DNA Sequence Number=SeqID_106950
MLNASYSVKQMVIQCFDRECEKYQKKGVQGSEVERIERREKEEEERRGNEVEVLPNHDYDQSLHRSLFGVLRATIGFDGCLLDPETKLKGKAKWSLFQDFKHPFTQASSSPGLIKFLQA

SEQ ID NO: 223729 - protein, 124 aa, Glycine max
  Coding DNA Sequence Number=SeqID_106951
  Gene Ontology: Cellular component=extracellular region; Biological process=cellulose and pectin-containing cell wall organization and biogenesis
  Homolog annotation: Hit_ID=Q06BI7; Match level="QueryCoverage=81%, HitCoverage=39%, E-value=5e-50, Identity=92%"; Hit description =Ripening-related expansin
  Pfam annotation: Domain name=Pollen_allerg_1; Domain location=31-108; Score=168.5; E_value=1.7e-47; Accession=PF01357.11; Description =Pollen allergen
MFTLKMRALLPTNTPSLRRFVGVPCRKVGGIRFTINGFRYFNLVLITNVAGAGDIARVSVKGSKTGWNSMSRNWGQNWQSNANLVGQALSFRVTGSDRRTSTSWNVAPSHWKFGQTFTGKNFRV

SEQ ID NO: 223730 - protein, 144 aa, Glycine max
  Coding DNA Sequence Number=SeqID_106952
  Gene Ontology: Cellular component=extracellular region; Biological process=cellulose and pectin-containing cell wall organization and biogenesis
  Homolog annotation: Hit_ID=Q8GZD2; Match level="QueryCoverage=68%, HitCoverage=38%, E-value=1e-54, Identity=94%"; Hit description =Expansin
MDEAADYILIGFRLFVCQENKEFGKRTINMKKLQPHLLCKFVLLYSPAVTDGHDAGFILSDLEEHGHGEVEVGPRRVAPAAVVAGKGKVGRAKIRGGDDDGRASRVAPPRILVALYLEARAAAQPVVEQRRAQGRGVHAIPLAV

SEQ ID NO: 223731 - protein, 127 aa, Glycine max
  Coding DNA Sequence Number=SeqID_106953
MVSYEQSTTKRKNMKQIRLSMFDRLEPQIEGTFNEPTYQITCPKLANMRRAMRRKEESMKYKKLRQQIQDNMELTHVSEIDDSPIPRSKKRMAKFNVEIRMKTLRITIDNKGRSTTRMIKPFTKARI

SEQ ID NO: 223732 - protein, 85 aa, Glycine max
  Coding DNA Sequence Number=SeqID_106954
MVLKFHDDPTVNDSEIVIFLRQVRWPTGKREGFGRREKKRNCEGEEAEEKHLSIMFAQFCIEFDGKFEYQVKATLVRERGKSCNH

SEQ ID NO: 223733 - protein, 74 aa, Glycine max
  Coding DNA Sequence Number=SeqID_106955
  Subcellular localization annotation: CTP_CleavageSite=37; ConfidenceScore=5.13e-01
MSKNLSDCTTTSVKQLNSASKNQNGAKKTPNLVLEVVVEAKAECANRMDGWGCTWVNRSKVKLHGVEFVFEVND

SEQ ID NO: 223734 - protein, 52 aa, Glycine max
  Coding DNA Sequence Number=SeqID_106956
MLENNLFSGVVHEDPMQHLRKFIMLTNTVRQYHVPTKGNKRVYLKLGKVCKR

SEQ ID NO: 223735 - protein, 65 aa, Glycine max
  Coding DNA Sequence Number=SeqID_106957
MMVTIHPNGVVCALQLLKALKVHYGHGESTTAVVKSDMEALGHYELTMALLVDHDPHEFTMALIN

SEQ ID NO: 223736 - protein, 122 aa, Glycine max
  Coding DNA Sequence Number=SeqID_106958
MDQAPRKVEVPTNRNLVASKEGVRRRLGDKEEVFKVFDPAINSSSSPTCNFVQATNKMKTIVAKPHPSVGKDDLPRKKVIPKYPRWSKKKGDRITIQALDYGVDDYIGGSVQKGKITLFEGD

SEQ ID NO: 223737 - protein, 343 aa, Glycine max
  Coding DNA Sequence Number=SeqID_106959
  Homolog annotation: Hit_ID=Q6MXU4; Match level="QueryCoverage=22%, HitCoverage=31%, E-value=8e-35, Identity=93%"; Hit description =Exported solute-binding protein
GAYLHKALRDVLGELPHVGDTRGRGLFAGVELVRDKATKSPFDPAVKLHAAIKANCMARGLLVYPMGGTLDGQYGDHILIAPPFIVTPQQLDFVVDTLNTDWDEQQRPLAEEIINGPRGALLPPFEPLLRSPELMAHAQRMGEFLRYRSALGQRLSELAILMTARHWSQPVEWAIHAPIAREKGISAAAVQAINEKRQPADLQPDEWVIYQFCQQLHQQQKISDATWQQAIELWGEKGVVDLIGINGYYSFLSMVMNGAQTPDKLTVGVDTAFVPFEFKQGDKYVGFDIDLWDAIAKKMHVSYELHPMDFGGLIPGLQSRNLDVAMAGITITDARKQVVDSAT

SEQ ID NO: 223738 - protein, 78 aa, Glycine max; identical to SEQ ID NO: 203167
  Coding DNA Sequence Number=SeqID_106960
  Gene Ontology: Mol. function=unspecific monooxygenase activity
  Homolog annotation: Hit_ID=O04892; Match level="QueryCoverage=97%, HitCoverage=19%, E-value=6e-11, Identity=47%"; Hit description =Cytochrome P450 like_TBP
  Subcellular localization annotation: CTP_CleavageSite=11; ConfidenceScore=5.10e-01

SEQ ID NO: 223739 - protein, 284 aa, Glycine max
  Coding DNA Sequence Number=SeqID_106961
  Homolog annotation: Hit_ID=Q9AVH2; Match level="QueryCoverage=72%, HitCoverage=100%, E-value=2e-72, Identity=54%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTLILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 223740 - protein, 258 aa, Glycine max
  Coding DNA Sequence Number=SeqID_106962
  Gene Ontology: Mol. function=hydroxypyruvate isomerase activity
  Homolog annotation: Hit_ID=Q0I1A8; Match level="QueryCoverage=99%, HitCoverage=100%, E-value=4e-97, Identity=63%"; Hit description =Possible hydroxypyruvate isomerase
  Pfam annotation: Domain name=AP_endonuc_2; Domain location=21-219; Score=171.1; E_value=2.8e-48; Accession=PF01261.14; Description=AP endonuclease family 2
MPKFAANLSMMFNEVPFLERFAAAAKQGFNAVEFLFPYEHPAELLAEKLRKHGLQQVLFNTGPGDVGAGEWGLAALPGREQDARADIDRALAYAIALACPCVHLMAGVVPAGADRQRYLDTFIANARYAADAFAPHGVKVLIEALSPPVKPDYLFASQHQAAEAVAAIERPNVFIQFDFFHAQLVDGNISGLLETLAGRYAHIQIASVPDRHEPDDGELNYPWLFDRLDALGYQGWVGCEYRPRGDTAAGLGWLKPYR

SEQ ID NO: 223741 - protein, 245 aa, Glycine max
  Coding DNA Sequence Number=SeqID_106963
  Gene Ontology: Mol. function=protein binding; Cellular component =membrane; Biological process=defense response
  Homolog annotation: Hit_ID=Q1S607; Match level="QueryCoverage=86%, HitCoverage=16%, E-value=1e-50, Identity=51%"; Hit description =Disease resistance protein; AAA ATPase
  Pfam annotation: Domain name=LRR_1; Domain location=128-150; Score =1.8; E_value=1.3e+02; Accession=PF00560.23; Description=Leucine Rich Repeat
  Pfam annotation: Domain name=LRR_1; Domain location=152-174; Score =9.7; E_value=4.3; Accession=PF00560.23; Description=Leucine Rich Repeat
  Pfam annotation: Domain name=LRR_1; Domain location=175-197; Score =12.8; E_value=1.1; Accession=PF00560.23; Description=Leucine Rich Repeat
  Pfam annotation: Domain name=LRR_1; Domain location=199-227; Score =8.6; E_value=7.2; Accession=PF00560.23; Description=Leucine Rich Repeat
  Pfam module annotation: Pfam domain module=LRR_1::LRR_1::LRR_1::LRR _1; Domain location=128-150::152-174::175-197::199-227
MAEGFLQQPHGEKPMELAGAECFDELLFRSLIEKDKTKAKEKFRMHNLIYDLAKLVSGKCYCYFESGEIPGTVRHLAFLTKWCDVSRRFEGLYDMNSLRTFRPQPRYPDFESYLTKMVSHIWLPKLRCLRILSLCQYTNITELPDSIGYLVLLQYLDLSYTSIKRLPDATFKLYKLQTLKLTNCKFLTHLPRQIGNLVNLRHLDISGTTLVEMHSNQRKKLRNLRNLLEMPLLLSEDMSPLRGKG

SEQ ID NO: 223742 - protein, 103 aa, Glycine max
  Coding DNA Sequence Number=SeqID_106964
  Gene Ontology: Mol. function=transporter activity; Cellular component= integral to membrane; Biological process=transport
  Homolog annotation: Hit_ID=P21727; Match level="QueryCoverage=60%, HitCoverage=14%, E-value=6e-14, Identity=63%"; Hit description =Triose phosphate/phosphate translocator, chloroplast precursor
MESRVRSRTGTLSSLPHLRKPPREAATPKALLASAEEGGLPPPAMPRHRRPRAVIPLGERSKGCSGGFFREVSGSGDWILLLHVLCHESGLCSVSLTFPKLNF

SEQ ID NO: 223743 - protein, 464 aa, Glycine max
  Coding DNA Sequence Number=SeqID_106965
  Homolog annotation: Hit_ID=Q7CJ63; Match level="QueryCoverage=28%, HitCoverage=54%, E-value=2e-36, Identity=53%"; Hit description =Putative transmembrane subunit
GINPGLYWRMMKINVVGTSGSGKSTLACQLAERLDVPYIEMDRLYWRPEWQGTPDDAFLARLEQTLAEAGGGWVLDGNYSRTQAIKWREVDYILWLDYGFCRTLWQAPRVDRAVDDPHLLEEPAKIPGGDGPYRCRAPFQALALSPPGRRFSTDAAAGSQQQAVMDPHYRFLDVLRPLPQAAGFVRFHLEKDREHAVRHVQRLRVAFDVQQQKVAIFRVGMFAVPVARQAVFDAFFAADQQMQRDVLLMHFGALFRRRHGGQRHHVHKDVVAVDRVMAQRQFGQAVVNHCYSPCERKSKEPAIQAKGKYADLSRGKQLTRLHSDVAVGRRVRRSGKAFEARLGANGQGGAHGGGDNRRQRQPLHAAQRDDLQRIWQRGGEDRHRQRHRQNIEVEQHAAGLPGADRAEHQRGDQGAERHRTGAVIAAGLLAEDDIDRPAGAGAERTGGTERIDPAHAVAERQQEP

SEQ ID NO: 223744 - protein, 36 aa, Glycine max
  Coding DNA Sequence Number=SeqID_106966
MAKICLRKARIAVKSADPRMRCGGFGQKKAVEYGRK

SEQ ID NO: 223745 - protein, 112 aa, Glycine max
  Coding DNA Sequence Number=SeqID_106967
MGVKCLKVINQGPHADNNCPRTKLRYDNTLTQFMQDNDEKKNKEGVEKENEKNDEVVTSEKVVREEELKKSNEQTLIKALEQMPTYAKFMKDFLMKRKRIMDDEIVKPWPQQ

SEQ ID NO: 223746 - protein, 68 aa, Glycine max
  Coding DNA Sequence Number=SeqID_106968
MFVWRLPVWEIPEWMAQVDDPALVGDPEESEDDFLVDNSGRASLDPFPVPRPPHREAPDALGGIIAFL

SEQ ID NO: 223747 - protein, 156 aa, Glycine max
  Coding DNA Sequence Number=SeqID_106969
MPKYDPEVVMEFYANAWPTEEGVMDKRSKVWGQWIPYDTDAINQFSGNPLILEDGQQCEYTTRRDAIHQFVGTEPPRHLVDQEKSNKALGFPALITGLCQFYGVPVQQLEQDQENQPVADAPPSPPHQPPSLESILAHLQRMKLLMHTYMRHLADQ

SEQ ID NO: 223748 - protein, 53 aa, Glycine max
  Coding DNA Sequence Number=SeqID_106970
MKPVKRRSVRGIRQKTLKSLENKEADDLDGLRKPTDLIVLEAKKTTIVLVERR

SEQ ID NO: 223749 - protein, 200 aa, Glycine max
  Coding DNA Sequence Number=SeqID_106971
  Homolog annotation: Hit_ID=Q86AU0; Match level="QueryCoverage=89%, HitCoverage=17%, E-value=5e-10, Identity=22%"; Hit description =Similar to Mus musculus (Mouse). Adult male liver tumor cDNA, RIKEN full-length enriched ...
  Homolog annotation: Hit description=library, clone:C730036A03 product:ESOPHAGEAL CANCER ASSOCIATED PROTEIN homolog
WLTVLKRQVNEVLSEFGLMKNQQDLGSVSCVSIILHHLLKELPIEVVSSNVVQILHLIEFSKDNSFDQHMNYRLLGFRLYERKSPVDIVDAVLDKVIQVIALYDSLDEYLKVVDAYTDLILQNQMDNHLKIILEGISKRTWNKGVTEDEMPSLQSLVVKLLSHFKHLEDVFSLDQFPEILDVMYGKSQDVVFLHILNMAT

SEQ ID NO: 223750 - protein, 589 aa, Glycine max
  Coding DNA Sequence Number=SeqID_106972
  Homolog annotation: Hit_ID=O81120; Match level="QueryCoverage=92%, HitCoverage=94%, E-value=0.0, Identity=65%"; Hit description=Nodule -specific protein Nlj70
  Pfam annotation: Domain name=MFS_1; Domain location=98-489; Score =21.9; E_value=3.2e-05; Accession=PF07690.6; Description=Major Facilitator Superfamily
  Pfam annotation: Domain name=Nodulin-like; Domain location=30-275; Score=446.2; E_value=4.2e-131; Accession=PF06813.4; Description =Nodulin-like
  Pfam module annotation: Pfam domain module=MFS_1::Nodulin-like; Domain location=98-489::30-275
  Subcellular localization annotation: CTP_CleavageSite=39; ConfidenceScore=5.07e-01
MASSKPHGVENVGSCLRNTKGFTLQVLTGCWFMEFSSFMIMSVSGASYMFSLYSRDIKSVLGYDQSTLNFLSFFKDLGSNIGIISGLINEVTPPWVVLTIGGVLNFFGYFIIWLAVARKIAKPQVWNMCLYIFIGANSHCSTNTGVIVTSVKNFPGTRGIVIGLLSGYLGLSAAIITQIYYAFYGNDSKFLILLMAWLPTAVTFVFLPVIRHHRGVQQPNDSKAFYNFLYTTLVLAGFLMVVIILQKSFTFTKSEYYITTSLMLLLLILPLAVVMVEEKKIWKRKQEHINSENPLKALNITTEMPNLEKSTQAPQKQASCWKSMFRPPSRGDDYTILQALFSLDMVILFLATICGLGGTLTVSNNLSQIGTSLGYSAHSITTFVSLMAIWIYMGKIVQGVVSEIIIAKFKVPRPMIFTLILVLPCAGYLLIAFDVPNGLYAASIIIGFCFGANWPLLFTIISELFGLKFYSTLYNVGSVASPIGSYLFSVRLAGYLYDKEATRQMAALGLKRRPGEELNCNGSECYKMAFIIITAVSLFGALVSLILVLRTREFYKGDIYKKFREEARTAEAEFCPTQNKNGQTAAYEG

SEQ ID NO: 223751 - protein, 261 aa, Glycine max
  Coding DNA Sequence Number=SeqID_106973
  Homolog annotation: Hit_ID=Q00X89; Match level="QueryCoverage=80%, HitCoverage=22%, E-value=2e-29, Identity=33%"; Hit description=[S] KOG3682 Predicted membrane protein
MEFRHRNYSAELESHALPRLRAGAHPLSAPPPPPPLSQVDAIDCGNTDFYDPLRGTNNDANAAPPDHDNLNEAADHQPTKEWTSFRRLLTQRFPVSKMVSVASMPDVLTRSGKLLEKSSTNMHLEELEDPQKFADEGVKTITWQEYVSRLHELKDEITRSWLAEDRVTSLKLSIKVAKLLMDTSVFEFYPTLFVLVTDIMDMLGNLVWQRIKRKAEFSEDGALRCNLAENFQARDICADAKETCYNWFNKIGAVQELLPRM

SEQ ID NO: 223752 - protein, 52 aa, Glycine max
  Coding DNA Sequence Number=SeqID_106974
AASEHSEPYKDGNMQMLLDLLILLSSLPSVGGCLKVAQAKTASKAILPAPSN

SEQ ID NO: 223753 - protein, 139 aa, Glycine max
  Coding DNA Sequence Number=SeqID_106975
  Homolog annotation: Hit_ID=Q9LT41; Match level="QueryCoverage=43%, HitCoverage=27%, E-value=1e-12, Identity=52%"; Hit description=RCD1
  Subcellular localization annotation: CTP_CleavageSite=19; ConfidenceScore=5.14e-01
MANLPQSISTSGATSFGASSATAKDRSRIASVEHLVLQLNNPDLRENALHELSKEIVSIFPVISPPNLTPAQSTRVCNALALFQWNRTVLRFRCCSNTVLLWLGGSRCVAEFRVIEIDTAIADCCGCGQHCNSNISAAI

SEQ ID NO: 223754 - protein, 320 aa, Glycine max
  Coding DNA Sequence Number=SeqID_106976
  Gene Ontology: Mol. function=double-stranded RNA binding; Cellular component=intracellular; Biological process=RNA processing
  Homolog annotation: Hit_ID=Q9LTQ0; Match level="QueryCoverage=91%, HitCoverage=61%, E-value=2e-55, Identity=43%"; Hit description =Similarity to CAF protein
  Pfam annotation: Domain name=Ribonuclease_3; Domain location=20-129; Score=117.1; E_value=4.9e-32; Accession=PF00636.16; Description =RNase3 domain
  Pfam annotation: Domain name=dsrm; Domain location=204-264; Score =38.4; E_value=2.5e-08; Accession=PF00035.15; Description=Double -stranded RNA binding motif
  Pfam module annotation: Pfam domain module=Ribonuclease_3::dsrm; Domain location=20-129::204-264
MQSESVNGSVFAGGSREYSKRLEFVGDPVLILGTTNYLFLAYPDLDPGQLSALRAANVSTEKLARVAVRIGLHRFVRHSAPPLVDKVERFVDAVKLEINPVAHGGSVKAPKVLADVVESVAAAIYVDVNFDLQTLWVVLYLFIRIHHQVYVFRMECHTLTQKQKLKVQVDRSYLHSIFSLLIDIMRGVLEPIVTPDALEKQPQPVTMLYEMCQKKGKQVDIKPSREGDLSVAKVFVDGEFVASASSSQKDHAKLEAAKIALGKLAHLVPSTDKKSATNMKLNFAADENGTWVVEAPKNKLRELCAVKKWPIPEYMYCSLT

SEQ ID NO: 223755 - protein, 400 aa, Glycine max
  Coding DNA Sequence Number=SeqID_106977
  Gene Ontology: Mol. function=dopamine beta-monooxygenase activity; Biological process=histidine catabolic process
  Homolog annotation: Hit_ID=Q7F1F1; Match level="QueryCoverage=86%, HitCoverage=86%, E-value=3e-53, Identity=36%"; Hit description =Putative auxin-induced protein
  Pfam annotation: Domain name=DUF568; Domain location=96-226; Score =54.8; E_value=2.8e-13; Accession=PF04526.4; Description=Protein of unknown function (DUF568)
MSSSLILPLTILTVLSFLSLAIGHRAQPCSEEFLKLAQQKNLSDCKTLRTLGAEFAWSYHNVTNKSIELEIMFRATLPTPQGWMAWGVNPGKRPEMIGTKAIIAIKHGDGTWKIDTYNVTKETRNGCSLLPSKIAFVTNMSVEQKVANRNTMYATLVLPSEVYNVTKLNHVWQVGYDIEDGHPLGHPTTLRNVDSTEVIDLTDNGRSTGQYRSYLRSVHGVLNIIGWGTLLPIGIITARYFRVFPFKWEPMWFNLHIGCQLTGFLVGITGWAIGLSLGHSSRYYTFHAHRNYGILIFTLSTVQMLAFRLKPKVTDDYRKYWNMYHHFLGYGLLAIIFINIFKGITILEGGVAWKWGYIGNLALLGTIAFGLEVFTWIRFFMLKHKQGHKANKNQPEPEAN

SEQ ID NO: 223756 - protein, 181 aa, Glycine max
  Coding DNA Sequence Number=SeqID_106978
MNKFNKSELLVLFVLTLLLAITPLLPSSLRPTYLYFIFNVLIIALAAEAGVLSVSSKPLEDKKQHVSVTQKPVMPPEVYEPEERVEVGASEHDEKKPKVVEKPASDEKIVGVTEVKKFPSMPNLLLIGGGESEGEVMDEEIEAEDEVGGVNGQELFAKAEAFIGNFYNQLKKDRDREFLAL

SEQ ID NO: 223757 - protein, 120 aa, Glycine max
  Coding DNA Sequence Number=SeqID_106979
MVAHNTGATHRRQVRWPLSARMKFEQGVRDVRAILRLTEVERGHTFDDVPLDEAVVVYVHHNYTNATILRSKTVEQDRLRMRVRESDIGDLGHVTVAAKAHDGGGVRAHYGSTLTKTKRT

SEQ ID NO: 223758 - protein, 216 aa, Glycine max
  Coding DNA Sequence Number=SeqID_106980
  Gene Ontology: Mol. function=dihydrolipoyllysine-residue succinyltransferase activity; Cellular component=oxoglutarate dehydrogenase complex; Biological process=tricarboxylic acid cycle
  Homolog annotation: Hit_ID=Q9SZ31; Match level="QueryCoverage=90%, HitCoverage=38%, E-value=7e-85, Identity=79%"; Hit description =Putative dihydrolipoamide succinyltransferase
  Pfam annotation: Domain name=2-oxoacid_dh; Domain location=11-214; Score=343.2; E_value=4.5e-100; Accession=PF00198.13; Description=2 -oxoacid dehydrogenases acyltransferase (catalytic domain)
MKLILDYYCHSLPYWSALNDRTNLMKLRSDYKDAFVEKHGVKLGLMSGFVKAAVNALQHQPIVNAVIDGDDIIYRDYIDISIAVGTSKGLVVPVIRNADTMNFADIEKQINAFAKKANDGTLSIDEMAGGTLTISNGGVYGSLLSTPIINPPQSAILGMHSIVSRPTVVGGNIVPRPLMYVALTYDHRIIDGREAVFFLRRIKDIVEDPRRLLLDI

SEQ ID NO: 223759 - protein, 214 aa, Glycine max
  Coding DNA Sequence Number=SeqID_106981
  Gene Ontology: Mol. function=dihydrolipoyllysine-residue succinyltransferase activity; Cellular component=oxoglutarate dehydrogenase complex; Biological process=response to oxidative stress
  Homolog annotation: Hit_ID=Q9FLQ4; Match level="QueryCoverage=83%, HitCoverage=37%, E-value=8e-35, Identity=49%"; Hit description=2 -oxoglutarate dehydrogenase E2 subunit
  Pfam annotation: Domain name=Biotin_lipoyl; Domain location=123-196; Score=83.9; E_value=5.1e-22; Accession=PF00364.12; Description =Biotin-requiring enzyme
MLPNPKNKRDERDNTETTMDIQGGDLLCLRSIVNPTFRSAFGVQLLGQSVQNIRSGPSVSARASSIAGKEIAFPSGGCGFVRNFSHITLGSWINSKPMRVVIHPEATVQTLGRLFSSESGDTVDVVVPPLAESISDGTLAQFLKRPGDRVNADEPIAQIETDKVTIDVSSPESGVILKLLANEGDTAEPGNKIAIISRSADATHVAPSETTSEK

SEQ ID NO: 223760 - protein, 545 aa, Glycine max
  Coding DNA Sequence Number=SeqID_106982
  Gene Ontology: Mol. function=GTPase activator activity; Cellular component=soluble fraction; Biological process=regulation of GTPase activity
  Homolog annotation: Hit_ID=Q9FLQ5; Match level="QueryCoverage=92%, HitCoverage=77%, E-value=1e-145, Identity=54%"; Hit description =Arabidopsis thaliana genomic DNA, chromosome 5, P1 clone:MCO15
MKDLIASSGVSSPARERAGLSFSAVKALVLREKEDNLHLSLLAMRKWLADNVIMLKNVLMLVLIFLNPLSVMIFHFRCNICKIFAEGDFLRRKIDSNLEETAMTSLPRDIHGAPPESLVVKLAEILGNYKTLRKMALFWCRVVAELRKLWFEEQYLPGVPQDEIPDLKSCLLYQQFQVINCCISRKRFRIIATESLDSMMMQANSDIKESTDCSAEASASPVLYARLNSGELVLRLGADHPAGDMTLLETGEPVYSPITQEGPLLTEDLIRETEEFVLRTGSVGAGCSQLLSDMQAFKAANPGCILEDFVRWHSPPDWTDNEASTEDSDVFDSGEPLSARGNLWRELWETSKPVPAVKQAPLFDEDLAVEGILNAFEEMHPSDLFGQLFVSLLGLGFGIAEPMLSGNSDFSKLFYDCKEYIITACQNNKLNEKVDGLVQVYETVEKMLLNPEEALKMIKQTEESTTVTGEPRSPFKRLSLIFGGKDKLLRKSVSKDQTNDEEKSGRQSFSSFFDSKSSLFGKKPPKSGSPSPSEKSSIDTGWPVV

SEQ ID NO: 223761 - protein, 146 aa, Glycine max
  Coding DNA Sequence Number=SeqID_106983
MGPFRKDDMFAKISPLTLKHKLIPISQAPTHSEQYGVPPPPTFTASFSFACKIQTAVTSYEAHHQTILAYYSPTSTWPALTFSKSTKYQGTSTFSGCCPSPIRAVLLSAYFIANFVVPGFFTNSFGYDKSSNEEQKVDDVNAIEDE

SEQ ID NO: 223762 - protein, 48 aa, Glycine max
  Coding DNA Sequence Number=SeqID_106984
MEDMDEIDAVPQSSVVGGMTLSAPFYGASLCRLLERTSLGRTSFNFMT

SEQ ID NO: 223763 - protein, 120 aa, Glycine max
  Coding DNA Sequence Number=SeqID_106985
  Gene Ontology: Mol. function=mismatched DNA binding; Cellular component=synaptonemal complex; Biological process=mismatch repair
  Homolog annotation: Hit_ID=Q56XI7; Match level="QueryCoverage=85%, HitCoverage=18%, E-value=6e-37, Identity=73%"; Hit description=DNA mismatch repair protein
  Pfam annotation: Domain name=MutS_V; Domain location=45-119; Score= -171.3; E_value=0.014; Accession=PF00488.12; Description=MutS domain V
MERAITRDLFSRILLFQTHLIKVATFAAELDCFLSMALVARQNNYVRPSLTEENLLDIKNGRHVLQEMTVDTFIPNDTKILHDGRINIITGPNFSGKSIYLKQDFDHTVLNSNYVEKVIL

SEQ ID NO: 223764 - protein, 338 aa, Glycine max
  Coding DNA Sequence Number=SeqID_106986
  Gene Ontology: Mol. function=mismatched DNA binding; Cellular component=synaptonemal complex; Biological process=mismatch repair
  Homolog annotation: Hit_ID=Q56XI7; Match level="QueryCoverage=42%, HitCoverage=25%, E-value=1e-50, Identity=71%"; Hit description=DNA mismatch repair protein
  Pfam annotation: Domain name=MutS_III; Domain location=126-309; Score= -72.1; E_value=0.0025; Accession=PF05192.9; Description=MutS domain III
MTVFGFNNWCSEISSKPFDGAAESPIVKLVKSSIFSYEQAWHRLVYLRVAGMDDGLNVKERIYYLSSMMNMGSEVQVRASGGLLAILENERIVDTLEQKESGNTSITIDSLAEISLFCPLLWRYRNNFLKLDTAAHEALQIFQIDKHPSHMGIGRAKEGFSVFGMMNKCVTPMGRRLLRFNQSLKKFDSPSSICTSFDWTALLKSICAMLHVNKIFEVGISEGLREELKYLNLDIVEKASSHITAELGYVYELVIGVIDVNRTKEKGYATVVKEGFCDELDELRQIYEELPEFLEEVAVGVSSLELAQLPVLCKDKRIPCIVYIQQIGTSDSELHVYP

SEQ ID NO: 223765 - protein, 115 aa, Glycine max
  Coding DNA Sequence Number=SeqID_106987
MAAGQCHHAKAWKKSSKSLCGTLGVEDSLWWQMETFVMSEKSEKGYLKSPASSGGFLWQFTVPSSATCWQLDPHLRLCMFMSLIFQVLGFAFVTVLYSLFLSTMFPAFPHCFHCP

SEQ ID NO: 223766 - protein, 173 aa, Glycine max
  Coding DNA Sequence Number=SeqID_106988
  Homolog annotation: Hit_ID=Q9FLQ5; Match level="QueryCoverage=56%, HitCoverage=15%, E-value=6e-23, Identity=54%"; Hit description =Arabidopsis thaliana genomic DNA, chromosome 5, P1 clone:MCO15
MEEEQQTFVSKARTAFHSAAAKAERVLLDFKSDRALTQFVDREEDHDKQSSPNTFTGQQPEAESPHTDENDSKLHSESKHIKWRPPHLGIKQDWQDKIKNIRRGRKEVEDTDKVGDASMAIPFYDDNLYLLNVKNDLEAKASEAMPSVEGLTAATKDPIPPSSVLKQLAIAVE

SEQ ID NO: 223767 - protein, 127 aa, Glycine max
  Coding DNA Sequence Number=SeqID_106989
MAKFNLEVVMEFYANAWPTKEGVRDMRSWEAIAQLLCIPGQDFTQTAAGRRVQIMRTSIAPTRHPVDPEKSDRALGFPALITGLYYTVAAGGGPIASCKCTTAASRGGTISEVHLRLPAEDRAPDAQ

SEQ ID NO: 223768 - protein, 70 aa, Glycine max
  Coding DNA Sequence Number=SeqID_106990
MEKIGGKQNNSRSMREKDQRTFRPDKFSARLPFKVVLDWRYPTPHEQRGKDRNTQLPLQKHYPRENPIGP

SEQ ID NO: 223769 - protein, 142 aa, Glycine max
  Coding DNA Sequence Number=SeqID_106991
MEAMKEQMATMMEAMMSMKKIMEANTVAVAATSAIAKVNPMPPSGLSQMNHPASARVGKDLGSTSGPYCVQFQNKNAFPPYGLPPNYTPPNVAYTPNEDVNNSTPILIESQQPQSDHAHVSRSMGETHEMPHHNLADFEPCL

SEQ ID NO: 223770 - protein, 124 aa, Glycine max
  Coding DNA Sequence Number=SeqID_106992
  Homolog annotation: Hit_ID=Q10RH2; Match level="QueryCoverage=81%, HitCoverage=21%, E-value=2e-37, Identity=68%"; Hit description=XS domain containing protein, expressed
MPTFRSAKDFPDMHALIMHTYNPDNADSRVDHLGLHKALCVLMGWNYSKPPDNSKAYQFLPADEAAANQDDLIMWPPLVIIHNTNTGKNRDGRMEGLGNKTMDNKIRGFPINIKLEAGTLETHP

SEQ ID NO: 223771 - protein, 158 aa, Glycine max
  Coding DNA Sequence Number=SeqID_106993
  Gene Ontology: Mol. function=oxidoreductase activity; Cellular component=membrane; Biological process=electron transport
  Homolog annotation: Hit_ID=Q9SML3; Match level="QueryCoverage=98%, HitCoverage=54%, E-value=1e-34, Identity=41%"; Hit description =Cytochrome P450 monooxygenase
MTSSCLTEPLHNLCQFSTMNNTALPSCPFHLLGGNSEKYATLNYLPTSLSMQQLVTDIHERGQMGEVVDVGTAAFKTTINLLSNTIFSVDLIHSTVLKMVDPQGIKRWLSKTVKKVIEMFDSLDIFVAETDTTASTLEWAMTELVRNPHVMSKAKQEL

SEQ ID NO: 223772 - protein, 286 aa, Glycine max
  Coding DNA Sequence Number=SeqID_106994
  Gene Ontology: Mol. function=pyridoxal phosphate binding; Cellular component=chloroplast; Biological process=cysteine biosynthetic process from serine
  Homolog annotation: Hit_ID=Q8W1A0; Match level="QueryCoverage=99%, HitCoverage=99%, E-value=1e-102, Identity=63%"; Hit description =Cysteine synthase
  Pfam annotation: Domain name=ADH_zinc_N; Domain location=68-250; Score=-9.8; E_value=0.036; Accession=PF00107.16; Description=Zinc -binding dehydrogenase
  Pfam annotation: Domain name=PALP; Domain location=12-262; Score =310.3; E_value=3.4e-90; Accession=PF00291.15; Description=Pyridoxal -phosphate dependent enzyme
  Pfam module annotation: Pfam domain module=ADH_zinc_N::PALP; Domain location=68-250::12-262
MAVEKSGIAKDGTELIGKTPLVYLNKIADGSAARVAAKLELMEPCSSVKDRIAYSMIADAEEKGLITPGQSILIEPTSGNNGIGLAILAAAKGYKLIITMPASMSLERRTILLSFGAELVHYETTGPEIWEGTGGKVDALVSGIGTGGTITGVGKFLKEKNPNIKLYSVEPVESPVLSGGKPGPHKIQGIGAGFVPGVLEVSLVDEVVQISSDEAIETAKLLALKEGLFVGISSGAAASAAIKIAKRSENAGKLIVVIFPSFGEWYLSSVLFESIRQEAESLTFES

SEQ ID NO: 223773 - protein, 182 aa, Glycine max
  Coding DNA Sequence Number=SeqID_106995
  Homolog annotation: Hit_ID=Q1STQ3; Match level="QueryCoverage=37%, HitCoverage=43%, E-value=2e-15, Identity=53%"; Hit description =Bromodomain
  Pfam annotation: Domain name=Bromodomain; Domain location=118-182; Score=13.2; E_value=0.00012; Accession=PF00439.15; Description =Bromodomain
MSYNIDYLNKEDEDQEEDEKRHNKKLKLVVKFNNNEEKDKDEDDSMPSHRGERGVHASYENEVEKEEQEEKEEEGNEEAKKYEEEREVKGKKVDSKGLYSTSVLGTPSKLPPGIPLPDKRTLEFILYKLQKKDTYGVYAEPVDSKELPDYHKVIKHPMDFATVRKKLENGSYPTLEQFEVCK

SEQ ID NO: 223774 - protein, 146 aa, Glycine max
  Coding DNA Sequence Number=SeqID_106996
  Gene Ontology: Mol. function=hydrolase activity, acting on ester bonds; Biological process=lipid metabolic process
  Homolog annotation: Hit_ID=Q9FIA1; Match level="QueryCoverage=74%, HitCoverage=29%, E-value=1e-30, Identity=58%"; Hit description =Putative GDSL-motif lipase/hydrolase
MGKRAFLIVHAFFVLFSFGSSKAEMVSAVYVFGDSLVDVGNNNYLTLSIAKANHRHYGVDFPTHKPTGRFSNGKNAADFVAEKLGFPTSPPYLSLITSKANKNNASFMDGVSFASAGAGIFDGTDERYGYGNLTQDDPGCLHPSLN

SEQ ID NO: 223775 - protein, 255 aa, Glycine max
  Coding DNA Sequence Number=SeqID_106997
  Gene Ontology: Mol. function=mismatched DNA binding; Cellular component=synaptonemal complex; Biological process=mismatch repair
  Homolog annotation: Hit_ID=Q56XI7; Match level="QueryCoverage=66%, HitCoverage=31%, E-value=3e-57, Identity=63%"; Hit description=DNA mismatch repair protein
  Pfam annotation: Domain name=MutS_V; Domain location=2-133; Score= -114.1; E_value=1e-06; Accession=PF00488.12; Description=MutS domain V
MWVCGLGHATSRSLCLVDEFGKGTLTEDGIGLLAGTINHFVTTDEPPKVFVCTHLMDLLHGHSLTKSEQIKFYTMSILRPDGNSTHIEDIVFLYRLVPGHAHHSYGLHCALLAGVPEEIIKRATAVLDTVSNNKHVERLSNENISAQDRQYKDAMEKLLEFDIDKGDLKIFFEDHTDPNVATSTLGSIPPGLGWIKVNVDAAVRMSDNEAVCGGVLRDHYGVFLHGFMANFGTCYILEAKLWAILNGLQLALDRG

SEQ ID NO: 223776 - protein, 287 aa, Glycine max
  Coding DNA Sequence Number=SeqID_106998
MVRLCSLKLSSKRAKKTTIGERSSTTPLVEIDFDGHRFQKIARRHWTQLAEPMTKYDLEVVMEFYANAWPTKEGVMDKRSRIRIHVAQLISDAIHQCVGIAPPRFPVDPEKSNKALGFPTLITGLCQFYGEPVMPKKLIWPPINRSFIEKYCMPRQVQQLGHDQQQQATIGAPPLPPHQPTCKGWNSKMHKYMQHLVDQQTFNHRGQKQLNDNFYHYTLHQHHQDPNPYPWPTPEQFRAIVAWAGHRPNFQVEARLADAQGAAQGDEGGAEDDGDMTDMLDYFIGGG

SEQ ID NO: 223777 - protein, 86 aa, Glycine max
  Coding DNA Sequence Number=SeqID_106999
MKNFDEKKVAWENLGRRGQGPRKKERMRDEGEGGVKSDFTPSPPFFSACTRPSELTTHPGDTPTERVECATSDRADLAIGSGVQVM

SEQ ID NO: 223778 - protein, 108 aa, Glycine max
  Coding DNA Sequence Number=SeqID_107000
MEKSYKKFFKDKKAKKSYITWEDNDMDSLRDLENEFVNLSFVAKNYVSKEERGKRVFSLSFLDPSLPGPPNYFGVKESARFGELVTSRVSINLPGRAVIAPSAHFPYK

SEQ ID NO: 223779 - protein, 51 aa, Glycine max
  Coding DNA Sequence Number=SeqID_107001
MDANFTKRCLPRSLLESYFTDQRPLEPERMKVIRIQWERYYLKVKNQTLGL

SEQ ID NO: 223780 - protein, 365 aa, Glycine max
  Coding DNA Sequence Number=SeqID_107002
  Subcellular localization annotation: CTP_CleavageSite=59; ConfidenceScore=5.37e-01
MDKGKGAKALATSLQNLDLNPPSNVKSKSSISITHPQFPGLLPMKTKPPSLVSLCIGVLGRHLEDIIADLSEIAINLPADIKIAVAAIARRRKLLNDDILIALADTSWEILDVSGSDVSDFGLIKAAEVCRFIKALDISRCTKITANGISELVKHCHLLETLRCGGCPRTDNTARRCLGIFKPKFDDYVEEDSWEELDTKEIASGAQSLSIGCCRDTYAALPPANGDGPNIDKNSLEDFSTECPRVVVNPKSSPFGFKGTEVPREALQNIILDDEVVKDIDPRTWTMHGFALKPISPSSSSTELSVAEKFRLAFVERDNRLAPKRAKNARQHQRRAVRELMLMSTRAKAMVLASQASKSLHGRSS

SEQ ID NO: 223781 - protein, 145 aa, Glycine max
  Coding DNA Sequence Number=SeqID_107003
MIYDCRNLPFGGRVTRGLTGVSSKIRKCAESPPTFIQGKHQKNRKRHGLQNLSVKGSGVVFTHGEGFQKFYGSITEATEAPEIIFQKRGGACRPVASSLSNPTSKVFQKGLDSNCYLHPYLDKFTPPSFVIYEKSYGSLMEAYMS

SEQ ID NO: 223782 - protein, 206 aa, Glycine max
  Coding DNA Sequence Number=SeqID_107004
  Homolog annotation: Hit_ID=Q6C339; Match level="QueryCoverage=64%, HitCoverage=53%, E-value=2e-10, Identity=35%"; Hit description =Yarrowia lipolytica chromosome F of strain CLIB122 of Yarrowia lipolytica
  Pfam annotation: Domain name=OPA3; Domain location=58-175; Score =112.2; E_value=1.5e-30; Accession=PF07047.3; Description=Optic atrophy 3 protein (OPA3)
MLKKFQYPGQSDAPKTKRRRESTSDGGASGGEASNTRSENRVQTNRQQAQEGGRLPPQVPKFHHQHCPGQANHRLTTRVQRRIYSHATDVAIRPLNEEKAVQAAADLLGELFVFSVGFKSKGLLRVRVAGAAIIFEVQRSSRSEARKEELRTQEIEEIKTKNEELAREIALLAQKLEELEQLSRGRGLLGTLNIKHSRVSQDRKSN

SEQ ID NO: 223783 - protein, 293 aa, Glycine max
  Coding DNA Sequence Number=SeqID_107005
  Gene Ontology: Mol. function=transferase activity, transferring hexosyl groups; Biological process=metabolic process
  Homolog annotation: Hit_ID=Q53UH2; Match level="QueryCoverage=92%, HitCoverage=58%, E-value=2e-88, Identity=57%"; Hit description =Glucosyltransferase
YPDSSIKLHAHEARAFAAKRKDTFGSNVLFYDRQFIALNEADVLAYRTCREIEGPYLDYIEKQFNKPVLATGPVILDPPTSDLEEKFSTWLGGFEPGSVVYCCFGSECTLGPNQFQELVLGLELTGMPFLAAVKAPLGFETVESAMPEGFEERVKGRGFVYGGWVLQQLILAHPSVGCFITHCGSGSLSEALVNKCQLVLLPNVGDQILNARMMGNNLEVGVEVEKGDEDGMYTRESVCKAVSIVMDGENETSKRVRGNHARIRELLLNKDLESSYVDSFCMRLQEIVEGIDL

SEQ ID NO: 223784 - protein, 58 aa, Glycine max
  Coding DNA Sequence Number=SeqID_107006
GADLDTIILAGADYGTGISQDWAAKGPLLEVKGVIALREFTVVELAYLDHGAILSYLI

SEQ ID NO: 223785 - protein, 260 aa, Glycine max
  Coding DNA Sequence Number=SeqID_107007
  Gene Ontology: Mol. function=nucleoside-triphosphatase activity; Cellular component=membrane; Biological process=cobalt ion transport
  Homolog annotation: Hit_ID=Q4ZYD9; Match level="QueryCoverage=95%, HitCoverage=96%, E-value=2e-89, Identity=67%"; Hit description=ABC transporter
  Pfam annotation: Domain name=ABC_tran; Domain location=36-227; Score =198.8; E_value=1.3e-56; Accession=PF00005.17; Description=ABC transporter
  Pfam annotation: Domain name=SMC_N; Domain location=10-230; Score= -111.2; E_value=0.0017; Accession=PF02463.9; Description=RecFRecNSMC N terminal domain
  Pfam module annotation: Pfam domain module=ABC_tran::SMC_N; Domain location=36-227::10-230
MQQLQALPARVEMINITKTYGSIRSLRGVNLQLAPGEVLGLVGDNGAGKSTLTKVLSGAVIPTSGAIRIDGEQQHFSNPADSRRCHIEMVYQDLSLCDTVDVAGNLFMGREPTRRILGVPFLDQATMHAQAREMLKGLGISIPDTRLLVRNLSGGQRQAIAIARAAAFDPKVLIMDEPTAALAVAEVEAVLELIRRVSARGVSVILITHRLQDLFLVCDRIMVMYEGTNVADRRVADTSLSDIVNLIVGEKFTAQSAAAH

SEQ ID NO: 223786 - protein, 75 aa, Glycine max
  Coding DNA Sequence Number=SeqID_107008
  Homolog annotation: Hit_ID=Q4ZYD7; Match level="QueryCoverage=93%, HitCoverage=21%, E-value=3e-07, Identity=42%"; Hit description =Regulatory protein, LacI:Periplasmic binding protein/LacI transcriptional regulator
  Subcellular localization annotation: CTP_CleavageSite=22; ConfidenceScore=5.04e-01
APAALSLVGFDDANYSDLTQPRISTIRQPARQLGHTAVSIMLRLLNNDSSIPMETRLPVEWIGRDSVGFVSDVPK

SEQ ID NO: 223787 - protein, 343 aa, Glycine max
  Coding DNA Sequence Number=SeqID_107009
  Gene Ontology: Mol. function=transporter activity; Cellular component= periplasmic space; Biological process=transport
  Homolog annotation: Hit_ID=Q7W0J5; Match level="QueryCoverage=97%, HitCoverage=78%, E-value=1e-105, Identity=54%"; Hit description =Probable extracellular solute-binding protein
  Pfam annotation: Domain name=SBP_bac_1; Domain location=4-305; Score =103.3; E_value=7.3e-28; Accession=PF01547.15; Description=Bacterial extracellular solute-binding protein
MYYPIAVGGKVSHTVEALVADFEKQHPEISIQPVYTGDYATTVTKALTAFRGGNAPQLAVMGDIEAWSLMDAGAIVAASDLATGEEGKQWIDSFYPAFLRRIEGKVWGVPFQRSTVVMYWNKQAFEKAGLDPNTPPATWQQVVAFSKKLTLKQASGVSQWGIEIPTTPNGYWNFQGLAATNGGRLDNGKGNAVYFNTPGNVETLQWLTDLGQKEEVSPKGAIAWGTTPQDFISGKTAMMVTTTGNLTNVHDNATFPFGVAMLPEKTQRGSPTGGGNLYVFKSASPAQQQAAMRFIRWVTAPEQAARWSIATGYVATSPAAWDTAAMKAYVQQVPQALAWRVSS

SEQ ID NO: 223788 - protein, 491 aa, Glycine max
  Coding DNA Sequence Number=SeqID_107010
  Gene Ontology: Mol. function=oxidoreductase activity; Cellular component=membrane; Biological process=electron transport
  Homolog annotation: Hit_ID=Q9SML3; Match level="QueryCoverage=86%, HitCoverage=97%, E-value=1e-140, Identity=56%"; Hit description =Cytochrome P450 monooxygenase
  Pfam annotation: Domain name=p450; Domain location=36-490; Score =381.2; E_value=1.6e-111; Accession=PF00067.12; Description =Cytochrome P450
MDSASCALLIVLTCAMVHALVGSFLAMATKANHKLPPGPSSFPIIGNLLELGEKPHKSLAKLAKIHGPIISLKLGQITTVVVSSAQMAKEVLLTNDQFLSNRTIPQSVSVLNHEQYSLAFMPISPLWRELRKICNTQLFAHKSLDASQDVRRKIVQQLVTDIHESSQMGEAVDIGTAAFKTTINLLSNTIFSVDLIHSTGKAEEFKDLVTNITKLVGSPNLADFFPVLKLLDPQSVRRRQSKNSKKVLDMFDNLVSQRLKQREEGKVHNDMLDAMLNISKENKYMDKNMIEHLSHDIFVAGTDTTASTLEWAMTELVRHPHVMSKAKQELEQITSKGNPIEEGDIGKLPYLQAIVKETLRLYPPVPFLLPRKADRDVDIGGYTIPKDAKVLVNMWTICRDPTLWDNPTMFSPDRFLGSDIDVKGRNFELAPYGAGRRICPGLSLANRMLLLMLGSLINSFDWKLGHDIETQDMDMDDKFGITLQKAQPLRI

SEQ ID NO: 223789 - protein, 549 aa, Glycine max
  Coding DNA Sequence Number=SeqID_107011
  Gene Ontology: Mol. function=adenylosuccinate lyase activity; Cellular component=cytoplasm; Biological process=purine ribonucleotide biosynthetic process
  Homolog annotation: Hit_ID=Q8VZX0; Match level="QueryCoverage=91%, HitCoverage=100%, E-value=0.0, Identity=66%"; Hit description =Adenylosuccinate-AMP lyase
  Pfam annotation: Domain name=ASL_C; Domain location=437-527; Score =137.9; E_value=2.8e-38; Accession=PF08328.2; Description =Adenylosuccinate lyase C-terminal
  Pfam annotation: Domain name=Lyase_1; Domain location=131-387; Score =40.3; E_value=4.6e-11; Accession=PF00206.10; Description=Lyase
  Pfam module annotation: Pfam domain module=ASL_C::Lyase_1; Domain location=437-527::131-387
MDILLIQIGYLLNRCKIAKYSAIFLFIPFFVKNLGKRVRAFFLQSHSWSSWHSLTLPNLGASTPLEPTFKVQHNTLFLFLMFLSLLPLAEVALAKPSSALTHPPTSTHNIFGPHSADFELSALTALSPLDGRYWGKVKELSPFLREYGLICFRLSQIPEIVEVPSFSEGATIFLQGLIDDFSVDDALEVKNIERVLEFFHFACTSEDINNLAHALMLKETMNSVMDKIIKALCDISEDNAHVPMLSRTHGQLHQLLWEKKCNICYEIKQRKEGTVSVGNYNAHVVSYPEVNWPHIAEQFVQSLGLSFNPYVAQIETHDYMAKLFHLLIQFNNILIEFDRDVWGYISLGYFNQTTKAGEVGSSTMPHKVNPIDFENSEGNLGVANGEGLDRFNCLKEHGCRHRAFSSCLQKHTSRNREASGCIYKVPVTDYLHNFRASFLSFLLNLEKIQQVNEARLSEDLNQCWEVLAEPIQTVMRRYGVSEPYEKLKELTRGRAVTQKSIRDFIEGLYIPEEAKMNLLKLTPDTYVGAAVELARTVKNVVNTVYGRKI

SEQ ID NO: 223790 - protein, 103 aa, Glycine max
  Coding DNA Sequence Number=SeqID_107012
  Homolog annotation: Hit_ID=P93101; Match level="QueryCoverage=31%, HitCoverage=11%, E-value=5e-07, Identity=78%"; Hit description=Cell division control protein 2 homolog
MDSDSTTTTKNYFFTKHILRRLYVTVLECHAVTVFSVPLKDHKVKIPSFHGLRYEKVENIGEGTYGVVYKGRDCVSNETTVLKKIHRGCYPNTNVLVIKALDS

SEQ ID NO: 223791 - protein, 65 aa, Glycine max
  Coding DNA Sequence Number=SeqID_107013
MKTISILLPLNNDTHGEVTQRLTSAKESSSKPALQSHEDLAKKLQNREPNADLLSESAYRIKALI

SEQ ID NO: 223792 - protein, 369 aa, Glycine max
  Coding DNA Sequence Number=SeqID_107014
  Gene Ontology: Mol. function=RNA-directed DNA polymerase activity; Cellular component=chromatin; Biological process=chromatin assembly or disassembly
MDYRALNAITIKDYFPMPTIDELLDEIGTVSWFSKLDLRQGFHQIQMHEEDIPKTAFRTHHGHYEFKVMPFGLTNTPPTFQDTMNDALRPFLRKFASVFFDDILVYSSSFSTHIEHLEAVFHALSDGSFYLRRTKCSFAERIAPDPEKIQVMLDWPVPSSPSDLRGFLGLTGFYRKFIRACAATASPLMALLCKDKFQWNPEAQSAFERLKSLMTQAPILAPPDFTIPFYLETNASGTAIGAILLQNSRPIAFFSKHLCPRMQRASTYVHELHAIMSAVRKWRHYLLGHHFFILTDHQSLKELMSQILQSPTDHPGNSIKQDLILFKNKIRLPPGHDFSQVLLDEFHRTPTGGHMGIAKTLRRIQQQFY

SEQ ID NO: 223793 - protein, 61 aa, Glycine max
  Coding DNA Sequence Number=SeqID_107015
MTDVVTLVLLFEESNDVEYGNFYISGDVGTDVVSCAFYIVFQKATMLNMGTSTSVVTYALM

SEQ ID NO: 223794 - protein, 246 aa, Glycine max
  Coding DNA Sequence Number=SeqID_107016
  Gene Ontology: Mol. function=RNA-directed DNA polymerase activity; Biological process=RNA-dependent DNA replication
  Pfam annotation: Domain name=Mak16; Domain location=55-228; Score= -61.0; E_value=8.7e-09; Accession=PF04874.5; Description=Mak16 protein
VGNLETSSRNTWLSPKQKQIGDDGEIEGDVNHRIQAGWMKWRKASGVLCDAKVPIKLKGKFYRTAVRPAILYGTECWAVKSQHENKVGVAEMRMLRWMCGKTRQDKIRNEAIRERVGVAPIVEKMVENRLREKIMTTPRKEKKREARREEKAEKAALLEKSIEKELLERLQKGVYQQSDIYNYPLEEYNKVLDMEKLQIADEEEDEEEPEVEYVEGYDELEEEEDMEDFGGFATLKSQGDYDNDEN

SEQ ID NO: 223795 - protein, 49 aa, Glycine max
  Coding DNA Sequence Number=SeqID_107017
MGVVWLRSEKTRGAAVNDEREGLTFRDDGGLREKALRIIQKGKKITINT

SEQ ID NO: 223796 - protein, 147 aa, Glycine max
  Coding DNA Sequence Number=SeqID_107018
  Gene Ontology: Mol. function=transferase activity; Cellular component= cytosol; Biological process=ribosomal large subunit biogenesis and assembly
  Homolog annotation: Hit_ID=Q2HUC0; Match level="QueryCoverage=98%, HitCoverage=39%, E-value=5e-64, Identity=90%"; Hit description=Mak16 protein
  Pfam annotation: Domain name=Mak16; Domain location=2-145; Score =140.8; E_value=3.6e-39; Accession=PF04874.5; Description=Mak16 protein
MQHDEVIWQVIRHNHCSYMAKIATGNFCRNPYNVTGVCNRSSCPLANSRYATIRDDNGVFYLYMKTIERAHMPKDLWERVKLPRNYEKALEIIDKHLVLWIMIGCVLELSALADVLAQTSYTQDKATFDQNDTDADTYEETCFEDKV

SEQ ID NO: 223797 - protein, 234 aa, Glycine max
  Coding DNA Sequence Number=SeqID_107019
  Homolog annotation: Hit_ID=Q8LCM1; Match level="QueryCoverage=49%, HitCoverage=26%, E-value=5e-09, Identity=37%"; Hit description =Glycoprotein homolog
  Pfam annotation: Domain name=Autophagy_N; Domain location=90-195; Score=-53.2; E_value=0.014; Accession=PF03986.4; Description =Autophagocytosis associated protein, N-terminal domain
  Subcellular localization annotation: CTP_CleavageSite=19; ConfidenceScore=5.42e-01
MMFPSSKEESRPVKSQPSRASSRDNSVSPSPSFSSESPAKNTEDSVRKKGFYKSCPPPPPPPPPTMFQKSVFMKPRFGGSSNEAPCFNKELKRSFTSERTTPVGKKSDEENKSMQPTLFRSNKFIGHASVPLVSQPAEKESLLVESDDDDDDDDTEIEDQDVEGGRTVAKNNDSGKSPPVIGGESSKTDGDEGPDVDKKADEFIAKFREQIRLQRIESIKRSTRSARNASSLRL

SEQ ID NO: 223798 - protein, 157 aa, Glycine max
  Coding DNA Sequence Number=SeqID_107020
MAKLPLPLLLLHFVLSMNSVAMNIWFGEQLGSVKVKALRWSAAAYEMDEDQWMYEGIMHEEVDMDYENEEECGVNEPHVDCLDTFNTSQDVLRWARSVAYENGFVAVIVRSDTNTGVASIGVGRKNSLEETLRLGNVGVPSSFVASQWLGDKAGRRS

SEQ ID NO: 223799 - protein, 568 aa, Glycine max
  Coding DNA Sequence Number=SeqID_107021
  Gene Ontology: Mol. function=phospholipase D activity; Cellular component=membrane; Biological process=phosphatidylcholine metabolic process
  Homolog annotation: Hit_ID=Q1RZP8; Match level="QueryCoverage=98%, HitCoverage=68%, E-value=0.0, Identity=80%"; Hit description=C2
  Pfam annotation: Domain name=PLDc; Domain location=411-438; Score =41.2; E_value=3.5e-09; Accession=PF00614.12; Description =Phospholipase D. Active site motif
  Pfam annotation: Domain name=PLDc; Domain location=82-121; Score =35.9; E_value=1.4e-07; Accession=PF00614.12; Description =Phospholipase D. Active site motif
  Pfam module annotation: Pfam domain module=PLDc::PLDc; Domain location=411-438::82-121
MKPTTRITLGELLKMKAEEGVKVLMLVWDDRTSVPDFKKDGLMATHDQETADYFKNTKVKCVLCPRNPDDGKSIVQGFETSTMFTHHQKTIVVDTQVAMGQQGQKRTIVSFVGGIDLCDGRYDTQEHPLFSTLDTVHKDDFHQPNFPGASIKKGGPREPWHDIHCKLEGSVAWDVLYNFQQRWEKQVGNQLLFSSSKLDEYFVPRSTVVTTNENETWNVQLFRSIDGGAASGFPPDPEEAAELGLVSGKDNIIDRSIQDAYISAIRRAKNFIYIENQYFLGSSYGWQASDIVVEDIGALHLIPKELSLKIVSKIEAGERFSVYVVIPMWPEGIPESGSVQAILDWQRRTMEMMYADIAKAIQRKRIQANPRDYLTFFCLGNREGKKDMEYTPTEAPEPDTDYARAQKARRFMIYVHAKMMIVDDEYIIIGSANINQRSMDGERDTEIAMGAFQPRHIAYNGAPRGQIYGFRRALWCEHLGDHGDTNIFDNPESVDCIRLVNHLAETNWDIYSKETFDEYREFHHLMRYPIEVTNNGAITILQGLEHFPDTKAKILGSQSVYLRPILTT

SEQ ID NO: 223800 - protein, 255 aa, Glycine max
  Coding DNA Sequence Number=SeqID_107022
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=1e-36, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAIRELYILTFRRLHALTFRGLHALAVRGLHVLAFRGIHVLLFRGLHALAFRGLHILAIRGLHALTFRGLHVLAIRGLHAFTFRGLHVLAIRGLHALTFRGLHVLAIRGLHALTFRGLYVLAIRGLHALTVGGLHALAFRGLHVLTFRGLHALAFRGLHVLAFRGLHALAFRGLHVLLFRGLDVLTFRGLHALPLRELHVLAFRGLHAVAFRDLHAVVFKGRHVLDFEGLHAPSPLEGYASSFSVGSISTP

SEQ ID NO: 223801 - protein, 80 aa, Glycine max
  Coding DNA Sequence Number=SeqID_107023
MPISPCGRIVPTRHPVDPEKPNRALGFPALVMGLYQSYRVPIPPARSCHRDIGIAPARHQVDSEKSNRVLGFLALITGLC

SEQ ID NO: 223802 - protein, 101 aa, Glycine max
  Coding DNA Sequence Number=SeqID_107024
MRRYPSGYPYKRFLLIWTREVRWEAKIPKWLSAHTHLLFLRLRVRSYADTNIVIFTFCQPEASKPVDTQSLTSSSAPLSSRDGESVDMRWWQAEIPEWLSV

SEQ ID NO: 223803 - protein, 241 aa, Glycine max
  Coding DNA Sequence Number=SeqID_107025
  Homolog annotation: Hit_ID=Q9AVH2; Match level="QueryCoverage=19%, HitCoverage=16%, E-value=9e-20, Identity=97%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSGLLGDLEGRDESKRQGLNLSGSWQQGPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 223804 - protein, 342 aa, Glycine max
  Coding DNA Sequence Number=SeqID_107026
  Gene Ontology: Mol. function=helicase activity; Biological process =protein amino acid phosphorylation
  Homolog annotation: Hit_ID=Q1SN45; Match level="QueryCoverage=99%, HitCoverage=22%, E-value=9e-69, Identity=38%"; Hit description=AAA ATPase
  Pfam annotation: Domain name=DUF889; Domain location=207-341; Score =70.8; E_value=4.2e-18; Accession=PF05970.5; Description=Eukaryotic protein of unknown function (DUF889)
MSKPEQVWDQTWHWMADDIVYNYKKSSTSPELFKIWSCLKLNNCCKQIKDRFRDYPSMPYPEDANCPTYLDNSLILAELNYNNEELRSEFEHLFSQMTDEQASIYNQIVEAVNKDKCASSGIASLLLPGGRTAHSKFKIPVLVFEDSTCNIHQGTQSAELLNQTSLIIWDEAPMAHKFCFEALDHSLRDIIKHNSKDNKIFGGKVMVFGGDFRQILPVIPRGSRSDIVNATINSSYLWDHCQILRLTKNMRLQNNMQATDQEETAAFAQWIIDIGDGIIGDENDGYATIEIPQELLITEYNDPIHSIISSTFPDLSHHHNDREYFQTRAILASTNETMQQVK

SEQ ID NO: 223805 - protein, 185 aa, Glycine max
  Coding DNA Sequence Number=SeqID_107027
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=6e-25, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=PT; Domain location=117-152; Score=6.2; E_value=0.15; Accession=PF04886.3; Description=PT repeat
  Pfam annotation: Domain name=PT; Domain location=13-48; Score=3.6; E _value=0.31; Accession=PF04886.3; Description=PT repeat
  Pfam module annotation: Pfam domain module=PT::PT; Domain location =117-152::13-48
GYTPLPLEGCTPSPSEGYTSSPSKGYTPSPFEDCTSSPSKDCTSLPSEGYMSLPSECCTSCPSEGYISSPSEGCTPSPSEDYVSLPSEGYMPSPSEDYTSSPSEGYTPSPLEGYMSSPSGDYTSLPLEGFTSSPTEGYTSSPSEGCTSSPSEDCMPSPLVGYTSSLLECSTSTPLGNSRSSSLNA

SEQ ID NO: 223806 - protein, 51 aa, Glycine max
  Coding DNA Sequence Number=SeqID_107028
MTLLLSNILPSDRSADLPLWKGSAHKTPSGLEGAQQGPRVSSSDYGPLSDL

SEQ ID NO: 223807 - protein, 130 aa, Glycine max
  Coding DNA Sequence Number=SeqID_107029
MRPVGNNSSSSSSSSRVLRLFGVDMECQPEHDDSGPSTPQCSYNSNNMLPSTQGTDHSHHNFYQQQPSNSNPSPHHMMVIENLSLSWSIREMHASAIWFVYFYGVLELNDVLFNPTHHRFKARMAEGTFS

SEQ ID NO: 223808 - protein, 1155 aa, Glycine max
  Coding DNA Sequence Number=SeqID_107030
  Gene Ontology: Mol. function=protein serine/threonine kinase activity; Cellular component=membrane; Biological process=protein amino acid phosphorylation
  Homolog annotation: Hit_ID=Q1SD49; Match level="QueryCoverage=70%, HitCoverage=99%, E-value=0.0, Identity=64%"; Hit description=Protein kinase; Curculin-like (Mannose-binding) lectin; Apple- like
  Pfam annotation: Domain name=B_lectin; Domain location=81-181; Score =72.9; E_value=1e-18; Accession=PF01453.15; Description=D-mannose binding lectin
  Pfam annotation: Domain name=PAN_2; Domain location=326-389; Score= -9.7; E_value=0.014; Accession=PF08276.2; Description=PAN-like domain
  Pfam annotation: Domain name=Pkinase; Domain location=493-763; Score =182.1; E_value=1.3e-51; Accession=PF00069.15; Description=Protein kinase domain
  Pfam annotation: Domain name=Pkinase_Tyr; Domain location=494-763; Score=99.2; E_value=1.2e-26; Accession=PF07714.7; Description =Protein tyrosine kinase
  Pfam annotation: Domain name=peroxidase; Domain location=921-1151; Score=121.1; E_value=3.1e-33; Accession=PF00141.13; Description =Peroxidase
  Pfam module annotation: Pfam domain module=B_lectin::PAN _2::Pkinase::Pkinase_Tyr::peroxidase; Domain location=81-181::326 -389::493-763::494-763::921-1151
MGKHWSFFHITGTLFLLCKVCLAGSQYSGRVLPGVLNGSQMNWIDRDGKFLVSKKVQFAFGFVTTTNDTTKFLLAIIHVATTRVIWTANRAVPVANSDNFVFDEKGNAFLQKDGTLVWSTSTSNKGVSSMELLDTGNLVLLGIDNSTVIWQSFSHPTDTLLPTQEFTEGMKLISDPSSNNLTHVLEIKSGNVVLTAGFRTPQPYWTMQKDNRRVINKGGDAVASANISGNSWRFYDKSKSLLWQFIFSADQGTNATWIAVLGSDGFITFSNLNDGGSNAASPTTIPQDSCATPEPCDAYTICTGDQRRCSCPSVIPSCKPGFDSPCGGDSEKSIQLVKADDGLDYFALQFLQPFSKTDLAGCQSSCRGNCSCLALFFHRSSGDCFLLDSVGSFQKPDSDSGYVSYIKVSTDGGAGTGSGGGGGVHKHTIVVVVIVIIALVVICGLVFGGVRYHRRKQRLPESPREGSEEDNFLENLTGMPIRYSYKDLEAATNNFSVKLGQGGFGSVYKGVLPDGTQLAVKKLEGIGQGKKEFRAEVSIIGSIHHLHLVRLKGFCADGTHRLLAYEYLSNGSLDKWIFKKNKGEFQLDWDTRFNIALGTAKGLAYLHEDCDSKIVHCDIKPENVLLDDHFMAKVSDFGLAKLMNREQSHVFTTLRGTRGYLAPEWITNYAISEKSDVYSYGMVLLEIIGGRKNYDPSKSSEKSHFPTYAYKMMEEGKLRDIFDSELKIDENDDRFQCAIKVALWCIQEDMSMRPSMTRVVQMLEGICIVPNPPTSSSLGSRLYATVFKSSSEGATSSGPSDCNSDAYLSAQSYSGLCGLCMLPALVHFVQVEIMRLGVSVSVRCSIGTASGNTQTDYPAKFQRSSFSTANFLPDNASSVSISSSSSRRGLIRIATLPCLLPLIGCLPANAMQPGSKEYLLIKEEVRKVLSKGKAAGVLRLVFHDAGTFDIDDSTGGMNGSIVYELERPENAGLKKSVKACSVSLFSHSPSTTSISITIWRIPHDSEVLQKAKTQIDAIQPVSWADMIAVAGAEAVEVCGGPPIQVSLGRLDTLVPDPEGRLPEESLNASGLKKCFQSKGFSTQELVALSGAHTIGSKGFGSPISFDNSYYKVLLEKPWTSSGGMPSMIGLPSDHALVEDDECLRFFIFDNLLCYS

SEQ ID NO: 223809 - protein, 107 aa, Glycine max
  Coding DNA Sequence Number=SeqID_107031
MKNPEITRKKMDRGMSRLKMKEYINCETEGLIRLVCGCGDEKGREKQLWEKSTKTTGQSTLHLTTSLSAWHVKGDQRCKRKEVEEEARSNSGLGAVKRIKGGIFLLF

SEQ ID NO: 223810 - protein, 475 aa, Glycine max
  Coding DNA Sequence Number=SeqID_107032
  Homolog annotation: Hit_ID=Q69Q42; Match level="QueryCoverage=32%, HitCoverage=42%, E-value=1e-50, Identity=62%"; Hit description =Putative BRI1-KD interacting protein 118
  Pfam annotation: Domain name=TPX2; Domain location=245-301; Score =108.6; E_value=1.9e-29; Accession=PF06886.2; Description=Targeting protein for Xklp2 (TPX2)
MDPSNLLPADGLEEVHQNGVHDELSIFGKDGIASNVDPGVTKIIETAATNGNLENFIQYDSTATDYSSKEEIKEGSNDNIYMNNVTISKEEEAEIIDRTEQLKVGKGPAKNKNAKPPSPRGSHASSVKKNKDGKDEEVASSVSNGTFASDSHPRQPIKNRSLSDKQARLSKHPGKSNAAHSEESMEKTRPQLSKKDPHDNLQGEAESSSYPFFSWLSIVYGVVSPTAEDAKPRRVGALPKYGFSFKCDERAERRKEFYTKLEEKIHAKEVEESNLQAKTKENQEAEIKMLRKSLGFKATPMPSFYQEPPPPRAELRKMPTTRAKSPKLGRKKSSINSEPEGNTSNSARQGRLSLDEKMSQTNPTNGISPVHPKKPQRKSLPPRLASEKISSSNSASVRTSSKAVNGGKTSLSSVTAEVTLSNARGKEKVQIAAAATEENNALLNETSKVLPVNGDLVVEEKPQLNLAQEPIAAEH

SEQ ID NO: 223811 - protein, 137 aa, Glycine max
  Coding DNA Sequence Number=SeqID_107033
MPDSDFKEMKSLQKAINNCRLSDGSHGWAPSGWQITSPIKKVQNHKGYTLSNTPVDRGLGKRRIHWNEFRDKVLGLDEAQRKGFKVSLSYAMGRSFRKPNLRKKKQVKEKQEACGEGGLPQKGPTKSIHKDFLMWAH

SEQ ID NO: 223812 - protein, 531 aa, Glycine max
  Coding DNA Sequence Number=SeqID_107034
MNALSAPAVLSQFIAYDEYFDLQMIALSPTLKILLERNVMIYHTEFDEFKTELERRNWHKELINFMDGSIDVAIAKEFYANLYDPKDKSPKQARVRGHLIKFDEDTLNTFLKTPVIIKEMENLPAYSKFCCLRPNPQELASRLYIPGRGFELNADGLPLKILWKNLTTLAQTWSVLSFSNLAPTSHTSNITLDRARLGFPALITTLCKARGVTFDSLTFESLSPAINLAYVKKNCWNLDDLSAPPSSALPTPAPSTSTAAPSALVSSLPAPVSAPSTSIAAHSTPTLSTPLPVPAPCLQSSGLQPIMNVDKFISRVAWPGVRPSPSGGGEASATQEPMPEEDEPIPPEPFVYETDASSAQEEVASPEPVPQSSLATVLDDMPEPSTPTSVPDQSISQDPLSAPSLEEKEHETRIMTENVSRFARLIVKECVNRNPMVVIIKKGENVNHVGFDDAKSVYLMMSQHALLRASEAWLTGALSKGGKMRGVATNEGISTSHVDKSGALAPTYPLSKRKSDLRSSFLYVNQVILFT

SEQ ID NO: 223813 - protein, 97 aa, Glycine max
  Coding DNA Sequence Number=SeqID_107035
MIQTLEESLSLAIKTSETFTVEKLREEVACLTKDFGKFLENSKTVTILLKFHQHPHDKSGLGFENGTSSSKSQSVSNKYGFYGQNAEETTIKLINVL

SEQ ID NO: 223814 - protein, 622 aa, Glycine max
  Coding DNA Sequence Number=SeqID_107036
  Homolog annotation: Hit_ID=Q2QM21; Match level="QueryCoverage=42%, HitCoverage=38%, E-value=5e-79, Identity=54%"; Hit description =Expressed protein
MSPMKFWVTQPNKQHAVKLTQLKLELGLFGARLGAANDKVAFEITGIATKKEKSKPKTTPLPLVPFSKRRHTHCHTTCSRRFLSSKSPSLVWDARDLCGFHLLLKDHSLDVCDIAFHVLYGEGESKAKMTAVGKVEMSVAVAELIVREEKKTQSNSHHQFQRRLPIKLRVNGLCIEATLLVSLRLLKLRDSNGGDSSGPSENLVQSEPEKKRGIIEKVKHLTSLGKKNNAKLDELEQTSPYDSDRSPVFDSDDSYDSTTSSGSSSNSGGIHNPRSTLSNGSERFTTSDTAKTRLSHLPRNISLNGWNYKTPTNEQRTQTSYPGPITKSDKLSPQLCHKGSARSWEYKDFSSRDGQTKLKTNVFFASFDQMSERASGESACTVLVALIAHWLHTNHGMPTRAQFERLITQGSSEWRKLCNGDYYSKLFPDKHFDLETIIEANLRPLVVLPQKSYTGFFSPEKFQCLKGAMSFDEIWDEIKSNVGDKEPRVYIVSWNDHFFVLKVEADAYYIIDSLGERLYEGCQQAFILKFDDLSVMYGKTDKAKEVPINRARSGESREKICRGKECCKEFIKRFLAAIPLWQLEKEEKKWSVSSPYLHRQLQIDFHYSSSSSSSASADSLWS

SEQ ID NO: 223815 - protein, 46 aa, Glycine max
  Coding DNA Sequence Number=SeqID_107037
MDLKTLLERTNDAIDTIIRRDEHTETGEYLCPCIEALTGGCALCSR

SEQ ID NO: 223816 - protein, 49 aa, Glycine max
  Coding DNA Sequence Number=SeqID_107038
MRFADEFMFMLSDGLLEIVGILFMTTKTIKRYHRSSFTPQEEHVECETQ

SEQ ID NO: 223817 - protein, 58 aa, Glycine max
  Coding DNA Sequence Number=SeqID_107039
MAVTGGAFVIGGLLFGVGAYFSFVNVAPGQERLKSPNGGVQENQGNLVVRVSGSSRIL

SEQ ID NO: 223818 - protein, 323 aa, Glycine max
  Coding DNA Sequence Number=SeqID_107040
  Gene Ontology: Mol. function=inositol or phosphatidylinositol phosphatase activity; Cellular component=intracellular; Biological process=abscisic acid mediated signaling
  Homolog annotation: Hit_ID=Q712G2; Match level="QueryCoverage=81%, HitCoverage=43%, E-value=1e-102, Identity=71%"; Hit description =Inositol 1,4,5-trisphosphate 5-phosphatase
  Pfam annotation: Domain name=Exo_endo_phos; Domain location=20-282; Score=-6.2; E_value=0.03; Accession=PF03372.13; Description =EndonucleaseExonucleasephosphatase family
ASDYSRPSDYSRWGSSDDDNGLGDSPSTVSPLSYGGPASTEDGYGMPGRSRYCLLASKQMVGIFLTIWVRSELKDHVRNMKVSCVGRGLMGYLGNKGSISISMSLHETSFCFICSHLTSGQKEGDELRRNSDVMEILKKTRFLRVHDADNEKSPETILEHEYEFTCIHLSITNTLNIRIIWLGDLNYRIALSYRFAKALVEMQNWRALLENDHLRIEQKRGRAFVGWNEGKVYFPPTYKYSTNSDRYAGDDMHPKEKRRTPACDVESAVSTSVLTSASMLKYYHTKTFLYFQRCRKRGFNIGADASTDVEMLTFKDVLGNAAM

SEQ ID NO: 223819 - protein, 227 aa, Glycine max
  Coding DNA Sequence Number=SeqID_107041
  Gene Ontology: Mol. function=protein dimerization activity; Cellular component=nucleus; Biological process=regulation of transcription
  Homolog annotation: Hit_ID=Q1S2K0; Match level="QueryCoverage=99%, HitCoverage=100%, E-value=8e-71, Identity=63%"; Hit description =AUX/IAA protein
  Pfam annotation: Domain name=AUX_IAA; Domain location=1-227; Score= -5.8; E_value=5e-09; Accession=PF02309.7; Description=AUXIAA family
MELESGLALPTHNSVEEFKLNKSKQIVSLELWRPSCGSDSEKRVKHNKRSFEESFGQFLKPFPLLVWSGQPNEEEDRNEKVQRNIHTPNKNGDEENHLVGWPPVKSWRRKELHRQQYPARGQIRNDRIQANENQSRRPNSLYVKVNMEGVAIGRKINLRLFNSYQTLTSSLISMFAKYQKFEEVGESYTLNFQNEQGDWLQVGHVPWQSFIGTVRRLVILRNGSETI

SEQ ID NO: 223820 - protein, 51 aa, Glycine max
  Coding DNA Sequence Number=SeqID_107042
MTDGLPVFTPHFDNHIVNAEKVRKGKMARLKTQQLTNISNSTLREPLPEYL

SEQ ID NO: 223821 - protein, 43 aa, Glycine max
  Coding DNA Sequence Number=SeqID_107043
MSLSNLDGGKICKAKRGKVLFSSLMDGPLQGSDMHQRTMTLVT

SEQ ID NO: 223822 - protein, 641 aa, Glycine max
  Coding DNA Sequence Number=SeqID_107044
  Gene Ontology: Mol. function=phospholipid binding; Cellular component= coated pit; Biological process=endocytosis
  Homolog annotation: Hit_ID=Q8LF20; Match level="QueryCoverage=94%, HitCoverage=95%, E-value=0.0, Identity=69%"; Hit description =Putative clathrin assembly protein At2g25430
  Pfam annotation: Domain name=ANTH; Domain location=29-357; Score =324.6; E_value=1.7e-94; Accession=PF07651.6; Description=ANTH domain
  Pfam annotation: Domain name=ENTH; Domain location=29-159; Score=4.5; E_value=1e-05; Accession=PF01417.11; Description=ENTH domain
  Pfam module annotation: Pfam domain module=ANTH::ENTH; Domain location=29-357::29-159
MAPTTIRKAIGVVKDQTSIGIAKVASNMAPEMEVAIVKATSHDDDPASDKYIREILNLMSHSRGYVHACVTAVSKRLGKTRDWIVALKALMLVHRLMNDGPPLFQEEILYATRRGTRLLNMSDFRDEAHSSSWDHSAFVRTYALYLDQRLELMLFDRKGTVSAANGGGDDRFGGRDNFQSPPYEYGGGEFRGEGAYGNGMRKTRSYGDMSESVGRGEEKRVVSVTPLRDMTPERVFGKMGHLQRLLDRFLACRPTGLAKNSRMVLIALYPVVKESFQLYADICEVLAVLLDKFFDMEYADCVKAFDAYASAAKQIDELVAFYNWCKDTGVARSSEYPEVQKITSKLLETLEEFVRDRAKRPKSPERKEEAPPVEKVEEEPAPDMNEIKALPPPENYTPPPPPEPEPKPQPQVTEDLVNLRDDAVTADDQGNKFALALFAGAPANNANGSWEAFPSNGQPEVTSAWQTPAAEPGKADWELALVETASNLSKQKAALGGGLDPLLLTGMYDQGMVRQHVSTTQLSGGSASSVALPGPGKTPVLALPAPDGSVQPVNQDPFAASLSVPPPSYVQMADMEKKQHLLVQEQQVWHQYARDGMQGQSSLAKLNGAGYYAGGPMPMMPYGMPPVNGMGPPTGYYHTPY

SEQ ID NO: 223823 - protein, 499 aa, Glycine max
  Coding DNA Sequence Number=SeqID_107045
  Gene Ontology: Mol. function=hydrolase activity, acting on ester bonds; Cellular component=cellular_component; Biological process =lipid metabolic process
  Homolog annotation: Hit_ID=Q9FJ45; Match level="QueryCoverage=68%, HitCoverage=97%, E-value=3e-68, Identity=41%"; Hit description=GDSL -motif lipase/hydrolase-like protein
  Pfam annotation: Domain name=Lipase_GDSL; Domain location=31-343; Score=144.1; E_value=3.7e-40; Accession=PF00657.12; Description=GDSL- like LipaseAcylhydrolase
MKIFIIFSITFTCGIFGNVNSNVNPLPYEAIFNFGDSISDTGNAAAYHHVPKDGKSPYGSTYFKHPSGPEAYGLPMLPAYLDLTKGQDIRHGVNFAFAGAGALDMNYFTNNRLKAPATNNSLSVQLDWFKKLKPSLCKNKKECNNYFKKSLFIVGEIGGNDINAPISYNNISKLREIVPPMIEEITKATIALIEEGAVEVVVPGNFPIGCNSGVLTVVNSGNKDDYDQFGCLAAYNVFIKYYNWRLNQAIEALRQQKNHVKIIYFDYYGDARRLFQAPQKYGFSSSKNETFRACCGTGEPYNVDEHAPCGSLTSTICSDPSKHINWDGAHFTEEAYKLIAKGLVEALSSSFVVGWYVSRCHCSVLPLPDFRTTMSFPPSSYLKSVEMKLELRQYIVMGHMYAYHGYERFIIANVRDLSQSRNYAWGAAALVYMYGNLNDACKSDVLDYEYFPYIVEAFTDQDYDERSPRACHWTSMKASTKALPASTYRKRLNQLKTVD

SEQ ID NO: 223824 - protein, 43 aa, Glycine max
  Coding DNA Sequence Number=SeqID_107046
MRPMYYRIATVIDFYICRNLPFDGRVMGGSQSGALALTYPQLR

SEQ ID NO: 223825 - protein, 57 aa, Glycine max
  Coding DNA Sequence Number=SeqID_107047
MENTCEVKDRKEGYKVGEGVRVTVLQSKLLDEKPIWGKETERAKPPRDERVAVPFLL

SEQ ID NO: 223826 - protein, 131 aa, Glycine max
  Coding DNA Sequence Number=SeqID_107048
MTLLLSNILPSNHNLDLPLLKCQLVYAILTQVSVHVAQLIFDAIYQAFIRKYYMPEEDQQQPIADAPPPPLGESQDPNPLPWPTPEQFEATVAWPGDETDFETRAGPAGAPGDDEGAQEDDDMADVLDFFT

SEQ ID NO: 223827 - protein, 268 aa, Glycine max
  Coding DNA Sequence Number=SeqID_107049
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=89%, HitCoverage=15%, E-value=2e-30, Identity=50%"; Hit description=Chromo
MMENRNKEYAARFETLETTLEMTLKDKTRDPGSISLAMNNHPFKVVPWYQMMTRENSFKTWIAFMRALETEFGPSPCECPRSQLFKLTQIGSVQSYYVQFTALANRVQGITQEALLDCFVGGLKPNIRMDVIAQSPTSLLRTVSLAKLYEEKYTPKLKPFSSSFSSKTQTSNTNSNLNTNQNSPQSLKSTSLPPLLPTPYTKPINVKKMTSAEMQLRRERGLSFTCDDKFSPSHRCPNKQHFVLQWEEEDDPALQPDPLDEVETVGDP

SEQ ID NO: 223828 - protein, 47 aa, Glycine max
  Coding DNA Sequence Number=SeqID_107050
MRLLRNSRDAASVEQFKHCQEKLGTLLLQEECFWLRDGDFNTRYFYA

SEQ ID NO: 223829 - protein, 212 aa, Glycine max
  Coding DNA Sequence Number=SeqID_107051
  Gene Ontology: Biological process=protein modification process
  Homolog annotation: Hit_ID=Q1S2J8; Match level="QueryCoverage=98%, HitCoverage=66%, E-value=6e-46, Identity=50%"; Hit description =Ubiquitin
MILFLADVEVANAATVAELKQAVEAVFSHVPQKGPGKILWPLVWRQFCLCYQGQKLVSEMDYIRDYGIKDGDQLHFVYHVSDTCSFERKQSKKRVVNLKQHMRSSSKVNRYQQKEHNDDKDIDLDDIVIENARIQHCNNAEENGGGKRSLAGILAGLFSHSRLAVVSRARIESRICCSMMARFIVSSFRKIRRILRYCRRQHYSRRPTWAEY

SEQ ID NO: 223830 - protein, 135 aa, Glycine max
  Coding DNA Sequence Number=SeqID_107052
  Gene Ontology: Mol. function=oxidoreductase activity, acting on the CH-OH group of donors, NAD or NADP as acceptor
  Homolog annotation: Hit_ID=Q84JM5; Match level="QueryCoverage=51%, HitCoverage=11%, E-value=2e-10, Identity=54%"; Hit description =Angustifolia
MTSLGKIESTAMLLHSLTYLPRASQCHLCSNHLILCLGLVDCIINFALAIDLGFCLVHIDTPHAKEIVNTVMAMIRRGGNGRTKKMNWHGWWWKDEEDELGEAMGPRVTAGTLLVVMAAAIAMESDDDVGQGKGS

SEQ ID NO: 223831 - protein, 611 aa, Glycine max
  Coding DNA Sequence Number=SeqID_107053
  Gene Ontology: Mol. function=protein kinase activity; Biological process=protein amino acid phosphorylation
  Homolog annotation: Hit_ID=Q67WD3; Match level="QueryCoverage=93%, HitCoverage=93%, E-value=0.0, Identity=54%"; Hit description=Protein kinase-like
  Pfam annotation: Domain name=Pkinase; Domain location=43-294; Score =58.8; E_value=1.8e-14; Accession=PF00069.15; Description=Protein kinase domain
  Pfam annotation: Domain name=Pkinase_Tyr; Domain location=43-294; Score=7.8; E_value=6e-13; Accession=PF07714.7; Description=Protein tyrosine kinase
  Pfam module annotation: Pfam domain module=Pkinase::Pkinase_Tyr; Domain location=43-294::43-294
MAQDTATPPVPFDFELLVGDHLRTVSASSSSSRADPWIEPERLKLRHRIGRGPFGDVWLATHHQSTEDYDEYHEVAAKMLPPIREEHMKTALEKFCELYFRCQGVGRICIIMNFYEGSVGDKMARLREGRISLPGVLRYGIDLAEGILELHSKGILVLNLKPSNVLLDDTDQAILGDIGIPNLLFGSSFLSSDMANRIGTPNYMAPEQWQPEVRGPISFETDSWGFGCTIVEMLTGNQPLYGSPVGEIYQSVVEKYEKPQIPSGLPSSVENILSGCFEYDLRNRPSVVDILAVFRSLLNAVANDGGWIYLGTKTIAKSSSTGYTQWSLSKDHLQVGDTVRSRKPSNSCNPQNMEVPQGNVVGLERNADHGFVLVRLHGVHDPVRIHASTLERVTNGLGAGDWVHLKEEDEKHSPVGILHSINRDGRVTVGFIGLQTLWNGNSSELEMAEPYCVGQFIRLKTNVLSPRFEWPRKREGAWATGKISWILPNGCLVVKFPGMLNFLDAPSTVLADPSEVDVVNFKNCPKMIEKYQHVEDHHWAVRPVLLAFGLLTAVKLGMSIGKKFGRNINVTAMESESHYTDSQNASTSSPTWTSSVASILFREGVNLPNGH

SEQ ID NO: 223832 - protein, 125 aa, Glycine max
  Coding DNA Sequence Number=SeqID_107054
  Homolog annotation: Hit_ID=Q1S2J7; Match level="QueryCoverage=64%, HitCoverage=35%, E-value=3e-07, Identity=45%"; Hit description=H+ -transporting two-sector ATPase, B/B subunit
MGRVRLKSKSAAFSISSAREGLAKTSGAIPPRRDSIWGFEIGSFSFKVGALGSEIWRMGTLGVGERELVQTGTRGLVEATIILRGLDLRARLSKFFATQIDEVVLCCVMLRPQLQQLSNIKACHG

SEQ ID NO: 223833 - protein, 268 aa, Glycine max
  Coding DNA Sequence Number=SeqID_107055
  Gene Ontology: Mol. function=neprilysin activity; Cellular component =cytoplasm; Biological process=proteolysis
  Homolog annotation: Hit_ID=Q3BPR9; Match level="QueryCoverage=90%, HitCoverage=85%, E-value=6e-93, Identity=74%"; Hit description =Uncharacterized stress-induced protein
QEVQAAADRLALLEHASDLDDVAAEAVQLLIHVQLLQPQHQLLFGTTRVDRVRQVSQAGGQLGALAVANGRNQGAHFGGNAFDAVHALTDGRRQLAAFAFTRLDEAVQYLVEQGQRLDLQGGGIGGLATGHAGQLQQLGETDLQIGEIGGQAVRQAAQLAQQGLVHLQVGGGFRRTQAHHQIQLAAAQARGDALAQLRFERPQFLGQAGADLQEAVVDRAQLAAQRAPRGDPLAAGIGGHASNHGLCPVRAKGEWYPSALIRAPLPAP

SEQ ID NO: 223834 - protein, 146 aa, Glycine max
  Coding DNA Sequence Number=SeqID_107056
MTLQHTQIKASFETSTNVVGHVFKVTLYKKLLGMVSRQKPFTLWMSHEDYPRSSMYQGLCEAEVTITEEMETMSVATYPFAGERGEAHGCVFQRRKMRRVATNVICEKRWKNRREPIMKNIPDSGVVFTFEEGISTSHVCPKGQLP

SEQ ID NO: 223835 - protein, 259 aa, Glycine max
  Coding DNA Sequence Number=SeqID_107057
  Homolog annotation: Hit_ID=Q1S2I7; Match level="QueryCoverage=25%, HitCoverage=52%, E-value=1e-25, Identity=83%"; Hit description=Plant lipid transfer/seed storage/trypsin-alpha amylase inhibitor
MEPGLQSMPRGSGEVPSCLCFGGLRLCIVVVTNRRGLGFPRSDRRRWNLWRGGYGGGAHVKSRSGNVAKKSRECTLRITLSVTGTFKFIPSTLALIAVHRQSAASKSAKPLTNAQHSLEGGVPTVTLTSPKMSAQTPSFNVSLGHEALGGEGGEGGGQPALGVGGVGGVGVGVGVGGVGFGVGGVGGVGFGGEGGGQPALGVGGVGVGVGGVGFGVGGVGFGVGGVGFGVGGVGFGVGGVGGVGFGDGDGVGVGGGQLA

SEQ ID NO: 223836 - protein, 658 aa, Glycine max
  Coding DNA Sequence Number=SeqID_107058
  Gene Ontology: Mol. function=phosphoinositide binding; Biological process=cell communication
  Homolog annotation: Hit_ID=Q1S2J1; Match level="QueryCoverage=87%, HitCoverage=81%, E-value=0.0, Identity=75%"; Hit description=Phox -like
MGKGYCTQPYPCICKEAVSGLKRILVEFLGHKKCFLIFIHRLLGYLTVTEYLSIAVIYILLWTTGQRRCSLEEWIAKLLSDIDISRCTAVASFLELEAAARSSFQDANQQNSETDPDSSNTVYSVQSPLQSSLSLVAGSSSVASDYGSDTAYEPSDLGTPRIGRDDNSEVGTDDLTLDEDMTNPIEKLVKYGITNIDEGLFMGQTILEQLEGLPRHKANARYVNYVAEKDKNNGNLYDSSLLANNNMELFSEPGHAKVFGHVRKLSNESVESDGSSIRGSDMSNFGIPSSSGDGSHDLPGSALVSRETDIMGHTKSKSTGDTQLVLPLDQRNKLNRILSTMQRRLGTAKTDMEDLIVRLNQEIAAKDFLATKLKDLEVELETTKQKNKENLQQAILIERERFTQMQWDMEELRRKSLEMEMKLKSESGRNSYQDLTKESIVQQNDVLYENLDATKEQLEILSKQYGELEAKSKADVKVLVKEVKSLRNSQTKLKKELSESIKEHSETEKLLLHEREKREQAEAARRKLLEKCRVLFNQLQECNVSLPYEYEDRTIVNSSSSTDAFNQLTTSDDQMDILLAEVENLEKDYGSAASNVDKTTNDIKDGVICDDEVRKIIADLFIDNVRLRKQTNRVTRQALKLDMTASDDSPSVETLTSI

SEQ ID NO: 223837 - protein, 128 aa, Glycine max
  Coding DNA Sequence Number=SeqID_107059
  Gene Ontology: Mol. function=transferase activity, transferring glycosyl groups; Cellular component=cytoplasm; Biological process =purine ribonucleoside salvage
  Homolog annotation: Hit_ID=Q42563; Match level="QueryCoverage=70%, HitCoverage=47%, E-value=1e-30, Identity=70%"; Hit description =Adenine phosphoribosyltransferase 2
  Pfam annotation: Domain name=Pribosyltran; Domain location=2-84; Score=21.9; E_value=7.6e-05; Accession=PF00156.17; Description =Phosphoribosyl transferase domain
MGVENQLSERGEVISEKYALEYGTDCLELHVGAVQPGERAIIIDDLVATGGTMSAGVKLLERVGAEVVECACVIGVPDVKGQCRRIGKPLYVLVEPRKADKCYPAQGPIWVPQHGCFYHMEKKKSYRL

SEQ ID NO: 223838 - protein, 86 aa, Glycine max
  Coding DNA Sequence Number=SeqID_107060
  Subcellular localization annotation: CTP_CleavageSite=53; ConfidenceScore=5.27e-01
MPRGRGSSGGVNHAPRPTPIQSDNRGSLFRTVTEGIAFGVGINGSPATATAPMANSLGGDTCNAPTKAFQDPFRPVLMILASAMGG

SEQ ID NO: 223839 - protein, 712 aa, Glycine max
  Coding DNA Sequence Number=SeqID_107061
  Gene Ontology: Mol. function=pyridoxal phosphate binding; Cellular component=nucleus; Biological process=biosynthetic process
  Homolog annotation: Hit_ID=Q1S2I5; Match level="QueryCoverage=92%, HitCoverage=39%, E-value=0.0, Identity=87%"; Hit description=MATH
  Pfam annotation: Domain name=MATH; Domain location=405-536; Score =44.2; E_value=4.3e-10; Accession=PF00917.16; Description=MATH domain
  Pfam annotation: Domain name=MATH; Domain location=66-191; Score =37.4; E_value=4.9e-08; Accession=PF00917.16; Description=MATH domain
  Pfam module annotation: Pfam domain module=MATH::MATH; Domain location=405-536::66-191
MKQASSEAVPSLSSAPSFTETATSSSWSAAAAEDLTVGSRDGGGGAQETVAVDRRGEYSALCRWTVHNFPRIKARALWSKYFEVGGYDCRLLIYPKGDSQALPGYISIYLQIMDPRGTSSSKWDCFASYRLAIVNLADDSKTIHRDSWHRFSSKKKSHGWCDFTPSNTVFDPKLGYLFNTDSVLITADILILNESVNFTRDNNEVQSSSSSSSNAMTSSVVAGPVSDVSSGKFTWKVHNFSLFKEMIKTQKIMSPVFPAGECNLRISVYQSSVNGVEYLSMCLESKDTDKTVVLSDRSCWCLFRMSVLNQKPGSNHMHRDSYGRFAADNKSGDNTSLGWNDYMKMSDFIGADSGFLVDDTAVFSTSFHVIKEFSSFSKNGAVIAGRSASGARKSDGHIGKFTWRIENFTRLKDLLKKRKITGLCIKSRRFQIGNRDCRLIVYPRGQSQPPCHLSVFLEVTDSRNTSSDWSCFVSHRLSVVNQRMEDKSVTKESQNRYSKAAKDWGWREFVTLTSLFDQDSGFLVQDTVIFSAEVLILKETSTMQDITENDSELSSSGSQVDGNGKRSSFSWKVENFLSFKEIMETRKIFSKFFQAGGCELRIESDQAVGSDPDKNFWVRYRMAVVNQKNPAKTVWKESSICTKTWNNSVLQFMKVSDMLESDAGFLVRDTVVFVCEILDCCPWFEFSDLEGDLFWILDTRLPVNPVYAYLLI

SEQ ID NO: 223840 - protein, 34 aa, Glycine max
  Coding DNA Sequence Number=SeqID_107062
MVARSLLEAIESSHSAGSDNISKAGHEKRHRITN

SEQ ID NO: 223841 - protein, 258 aa, Glycine max
  Coding DNA Sequence Number=SeqID_107063
  Gene Ontology: Mol. function=DNA binding; Biological process=DNA integration
  Homolog annotation: Hit_ID=Q2HT85; Match level="QueryCoverage=97%, HitCoverage=33%, E-value=7e-29, Identity=49%"; Hit description =Integrase, catalytic region; Zinc finger, CCHC-type; Peptidase aspartic, catalytic
MARTILYENSLPKHFLAEAVNTTCYVHNRILIIPLIKKTPYELWRGRRPNISYFHPFGCVCFILNTKDQLVKFDSKVDKGRFLAFLIIEDQTKEVKIRSSFKGLASCALVSEIEPKTIKKLLQMMTGSFPWKKNFSSLTKTTSELLFLNLKTKASLEQDGYLETNCITSNSDSKGIYIHQQKYTKELLKKFKMEDVKPMKTHMHASNPLSKDESGTTNQCLFYKKNQDFKLVGNCDADCAGDKVEIKSTSGGCHTTRK

SEQ ID NO: 223842 - protein, 559 aa, Glycine max
  Coding DNA Sequence Number=SeqID_107064
  Gene Ontology: Mol. function=calcium-dependent phospholipid binding; Cellular component=integral to membrane; Biological process=meiosis
  Homolog annotation: Hit_ID=Q1S2I1; Match level="QueryCoverage=95%, HitCoverage=96%, E-value=0.0, Identity=74%"; Hit description=C2
  Pfam annotation: Domain name=C2; Domain location=259-343; Score =100.6; E_value=4.6e-27; Accession=PF00168.20; Description=C2 domain
  Pfam annotation: Domain name=C2; Domain location=436-518; Score =111.1; E_value=3.3e-30; Accession=PF00168.20; Description=C2 domain
  Pfam module annotation: Pfam domain module=C2::C2; Domain location =259-343::436-518
  Subcellular localization annotation: CTP_CleavageSite=28; ConfidenceScore=5.07e-01
MGFISGMIVGIAIGIVLIVAFARQGSVRSKRRSDLAKTIAQFARMTVEDSRKILPPKFYPSWVLSWLNSQVEKIWPFVNEAASELIRTNVEPILEQYRPIILSSLTFSKLTLGTVAPQFTGVTIVEENSGPEGVTMDLEMQWDGNPNIVLDIKTRVGVVLPVQVKNIGFTGVFRLIFKPLVDEFPAFGAVCFSLKEKKDLDFTLKVIGGDLSTLPGISDAIEETIRDAIEDSITWPVRKVIPILPGDYSNLELKPVGKLEVKLVQAKNLTNKDIVGKSDPYAVIFVRPLRDRTKTSKIMNNQLNPVWNEHFEFIIEDASTQHLTVRIFDDEGVQASELIGCAQVSLKDLEPGKVKDVWLKLVKDLEVHRDNKYRGEVHLELLYCPFGVESAIRNPFDPDFSLTTFEKTLKSGTGDAEAEDLIGSRRRNNVIVRGVLSVTVISAEDLPAVDLMGKADPFVVLLLKKTEKKLKTRVVNESLNPVWNQTFDFVVEDGLHEMLILEVYDHDTFGKEKIGRVILTLTKVILEGEYNETYPLDGAKSGNISLHLKWTPQHKFRDP

SEQ ID NO: 223843 - protein, 907 aa, Glycine max
  Coding DNA Sequence Number=SeqID_107065
  Gene Ontology: Mol. function=pyridoxal phosphate binding; Biological process=biosynthetic process
  Homolog annotation: Hit_ID=Q1S2I5; Match level="QueryCoverage=99%, HitCoverage=53%, E-value=0.0, Identity=83%"; Hit description=MATH
IAGFLTGLRVYLDDPAKVKRLLLPTKLSGSCDGKKASKADESSPSLMNLLMGVKVLQQAIIDLLLDIMVECCQPSEVGPVADSVDACSKPSPNGSGAASPFECERENGAMESARVPVCERLDSVVQESSNASAVQSSDLKGNGLQEKALPGQPICPPETSATASENASLRSKTKWPEQSEELLGLIVNSLRALDGAVPQGCPEPRRRPQSAQKISLVLDKAPKHLQADLVALVPKLVEQSEHPLAAYALLERLQKPDAEPALRIPVYGALSQLECGSEVWERILFQSFELLTDSNDEPLTATIDFIFKAASQCQHLPEAVRSVRVRLKNLGLEVSPCVLDFLSKTINSWGDVAETILRDIDCDDDYGDSCSALPCGIFLFGEHDTAPSGLHVIDEQAYHASRHFSDIYILFEMLSIPCLVAEASQTFERAVARGVISAQSVALVLQSRLSQRLNNNGSYVSENCQHSDDATEGDACEQLGVQRDDYTSVLGLAENLALSRDPCVKEFVKLLYMIMFRWFANESYRGRMLKRLVDCATSNTDNGREVDFDLDILVTLVCEEQEFIRPVLSMMREVAELANVDRAALWHQLCASEDEIMRVREESKTEISNMAKEKSMISQKLTESEATSNRLKSEMRAEMDRFSREKKELAEQIQEVESQLEWIRSERDDEIAKLSAEKKALHDRLHDAETQLSQLKSRKRDELKKVVKEKNALAERLKNAEAARKRFDEELKRFATENVTREEIRQSLEDEVRRLTQTVGQTEGEKREKEEQVARCEAYIDGMESKLQACQQYIHTLEASLQEEMSRHAPLYGAGLEALSLKELETLSRIHEDGLRQIHALQQRKGSPAGSPLVSPHALPHSHGLYPTASPPMAVGLPPSIIPNGVGIHSNGHVNGGGGVGPWFNHS

SEQ ID NO: 223844 - protein, 395 aa, Glycine max
  Coding DNA Sequence Number=SeqID_107066
  Homolog annotation: Hit_ID=Q1SSW0; Match level="QueryCoverage=34%, HitCoverage=35%, E-value=9e-58, Identity=80%"; Hit description =Protein phosphatase 2C
MILDAALEYVVLQFIPYIRSGSFDDIGPERYMEDEHIRMDDLSSHLGSIYNFPKPSAFYGVFDGHGGPEAATYIRKNMIKFFFEDVNFLGTSEVDNIFLEEVEDSLRKAFLLVDSALANDRGVNSSSGTMALTAWIFGRPERVNIKGIIVETQIAMSPTTIIVASGCALDCLTMSKDWKKEIIQEIVDKLLYGKPHPNRVMPRVGSRDYVSDIYNFCIYKIMIGEKMQAFKDRFNPKVKKNPIPYGMLFIEILRLVKVEGEQVKPRLPRHKLDYSGCALDCLTMSKDWKKEIIQEIVDKLLYGKPHPNRVMPRVGSRDYVSDIYNFCIYKIMIGEKMQAFKDRFNPKVKKNPIPYGMLFIEILRLVKVESIGTQANPLDLESGVSSIDVGGASQA

SEQ ID NO: 223845 - protein, 51 aa, Glycine max
  Coding DNA Sequence Number=SeqID_107067
MATVNLSSGQDDNVGGQGLPIIPYSQLPHFLPRGGVPQQAKKIKITYQNNF

SEQ ID NO: 223846 - protein, 254 aa, Glycine max
  Coding DNA Sequence Number=SeqID_107068
  Gene Ontology: Cellular component=membrane
  Homolog annotation: Hit_ID=Q03730; Match level="QueryCoverage=80%, HitCoverage=52%, E-value=3e-16, Identity=28%"; Hit description =Uncharacterized vacuolar membrane protein YML018C
VNRKDSDLDRSTLAEVKPLVAKYNDNTNVLKVERQLNGKEIAAYGFYIAPIWFITEYLSNAALARTSVASTTVLSSTSGLFTLFIGAFMGQDSLNVAKVVAVLVSMAGVVMTTLGKTWAADESQLSDASGKHSLVGDLFGILSAMSYGLFTVLLKKFSGEEGERVDVQKLFGYIGLFTLVALWWLVWPLMALGIEPKIYHSPTLLKWMKWFLQMDLLESVLSDYFWALCVVWTTPLVATLGMSLTIPLAMVADM

SEQ ID NO: 223847 - protein, 176 aa, Glycine max
  Coding DNA Sequence Number=SeqID_107069
  Gene Ontology: Mol. function=carbohydrate binding
MASTRSLILCLFIQLCFYLLPLSFAQSPATGSAEGYTIYGRVKIPSVGTKDYILPGKISNVKVILNGGQRVRVDVSARHHGKIQAALTENRRGLSEFVLEPLKDEQYYEVREPFSIMSIVKSPMGLMMGFMLIVVFLMPKLMENMDPEEMRRAQEEMRNQGVPSLASLLPGAARSN

SEQ ID NO: 223848 - protein, 213 aa, Glycine max
  Coding DNA Sequence Number=SeqID_107070
MVVLVFQVMTQCPNLWVADVTEVLCELQLTIKKVKFILTHKFKKKESFSVCLFISLLSPQDAIIPFQILGGEAQVVQIMSKPQEKIIARPEGNKADLGGSRNDKVTTQKTPSFKEGWKDAMTFWLQVEGWHAHCLLPNNHKIRTITGIDLNVKMLVVLEKNIFWVKPDCGLKTRKYVEAMLSKFILMMPKTQVKNQESSKYQESKSRSIKIQD

SEQ ID NO: 223849 - protein, 390 aa, Glycine max
  Coding DNA Sequence Number=SeqID_107071
  Gene Ontology: Mol. function=aminoacyl-tRNA ligase activity; Cellular component=mitochondrion; Biological process=cysteinyl-tRNA aminoacylation
  Homolog annotation: Hit_ID=O82267; Match level="QueryCoverage=78%, HitCoverage=59%, E-value=1e-130, Identity=74%"; Hit description =Putative cysteinyl-tRNA synthetase
  Pfam annotation: Domain name=tRNA-synt_1e; Domain location=79-389; Score=442.0; E_value=8.1e-130; Accession=PF01406.10; Description =tRNA synthetases class I (C)
  Subcellular localization annotation: CTP_CleavageSite=48; ConfidenceScore=5.53e-01
MSTVSLLKCYRPFFSMLFPHSAPPRPHASIFRRKNFPSFCATSSPPPLTAEKGCGKFDSEGLALPEVWLHNTMSKTKELFKPKVDSKVGMYVCGVTAYDLSHIGHARVYVNFDLLYRYFKHLGFQVCYVRNFTDVDDKIIARAKELGEDPISLSRRYCEEFCQDMVTLNCLSPSVEPKVSEHMPQIIDMIEKILNNGYAYIVDGDVYFNVEKFPEYGKLSSRDLEDNRAGERVAVDSRKKNPADFALWKFGTYLRWISNAILQSAKPGEPFWESRWGPGRPGWHIECSAMSAAYLGYSFDIHGGGIDLVFPHHENEIAQSCAACKKSDISVWMHNGFVTIDSVKMSKSLGNFFTIRQTKTIKSIIKDPQFLFVDDYHSKGYILMPQTLFY

SEQ ID NO: 223850 - protein, 206 aa, Glycine max
  Coding DNA Sequence Number=SeqID_107072
MPPPSEASMFERDISGDHNDNDGGGSRGGNDNVVLVANGNDIGGGDGCDISGGGSGKEEGDISCGGGSSNVGGIDGDGGSNDSGVVVVTTNDDDDSGCSNIGGDFGGDGRGDIVGNCGGGGGGDNDSDNDIDGGGAKMMTITVVLTVTPSGGDDESGGSDCDNDDNNETNGFGGGNANGGDNSDDSDNSSDNNNSSDCSGDNQMNS

SEQ ID NO: 223851 - protein, 96 aa, Glycine max
  Coding DNA Sequence Number=SeqID_107073
MAERVAMSTLRAREMTDEPESQLARSRLNEGQSRAQITNLTKMVFGIKPSLYDTWPSSSIKSCCNHNNLVVVDPIVRYLAFVEDHATVDFVCKTRI

SEQ ID NO: 223852 - protein, 71 aa, Glycine max
  Coding DNA Sequence Number=SeqID_107074
MAAVCIWLLGGSVPSFWDRSVTRDAVHYLSVTFVQLLCVWCQFGCAAGLWNWNIEFLSSKLAYLNINKRQK

SEQ ID NO: 223853 - protein, 103 aa, Glycine max
  Coding DNA Sequence Number=SeqID_107075
  Gene Ontology: Mol. function=binding
  Homolog annotation: Hit_ID=Q6K378; Match level="QueryCoverage=56%, HitCoverage=6%, E-value=1e-07, Identity=38%"; Hit description =Tetratricopeptide repeat protein-like
  Pfam annotation: Domain name=TPR_1; Domain location=40-73; Score =19.0; E_value=0.017; Accession=PF00515.18; Description =Tetratricopeptide repeat
  Pfam annotation: Domain name=TPR_2; Domain location=40-73; Score =24.4; E_value=0.00041; Accession=PF07719.7; Description =Tetratricopeptide repeat
  Pfam module annotation: Pfam domain module=TPR_1::TPR_2; Domain location=40-73::40-73
MGKPTGKKGTVTPGAAYSHAMPGKSSKAFDEDTAVFMTMSQEFREEGNKLFQKKDHEGAMLKYEKALKLLPNNHIDVAHLRTNMVTCYKWHLYAIFISIVFQF

SEQ ID NO: 223854 - protein, 248 aa, Glycine max
  Coding DNA Sequence Number=SeqID_107076
  Homolog annotation: Hit_ID=Q8L8M8; Match level="QueryCoverage=51%, HitCoverage=58%, E-value=3e-38, Identity=62%"; Hit description =Serine-rich protein
  Subcellular localization annotation: CTP_CleavageSite=84; ConfidenceScore=5.90e-01
MASSSSRTKSSGPVLRSLSPSTRFCSYTTSKTPFSSPSSAFASSTSSGFSSSSFFNQPRQHHAHSHHRAASPTRVNLCSPAPLSSAVRFSIDPRSISPNRSISNQIITTKNNRPISGQKKTCMCSPTTHPGSFRCSLHKNIGSSNHNADSYPSNRLNMRRSAMKNSLVRIGGVEGEWVKRALTALIRPSSHQQRRRAGLQVVLDFTGLYSIPPLAPLSAARVGFRRSGWEAVASPLRRVLISSSGAEW

SEQ ID NO: 223855 - protein, 86 aa, Glycine max
  Coding DNA Sequence Number=SeqID_107077
MKEKTNAEKKKEEAATTQHGQSDNSSSSGTTNGRSQRHGTEGGKERVKGIFALPPGLLGAPNKNAGCPKQQPLNGLLSIPIGHNPT

SEQ ID NO: 223856 - protein, 395 aa, Glycine max
  Coding DNA Sequence Number=SeqID_107078
  Gene Ontology: Mol. function=calcium ion binding; Cellular component =intracellular; Biological process=defense response
  Homolog annotation: Hit_ID=Q1SH11; Match level="QueryCoverage=90%, HitCoverage=75%, E-value=1e-133, Identity=68%"; Hit description =Calcium-binding EF-hand
  Pfam annotation: Domain name=efhand; Domain location=106-134; Score =20.0; E_value=0.0087; Accession=PF00036.22; Description=EF hand
  Pfam annotation: Domain name=efhand; Domain location=140-168; Score =39.5; E_value=1.1e-08; Accession=PF00036.22; Description=EF hand
  Pfam annotation: Domain name=efhand; Domain location=334-362; Score =22.5; E_value=0.0015; Accession=PF00036.22; Description=EF hand
  Pfam module annotation: Pfam domain module=efhand::efhand::efhand; Domain location=106-134::140-168::334-362
MLLAVLHRHCLKNHPFLKAHMITCFLEANAYRSKVFFNYEKRLRLHSPPEKVFEYFASCRTLEGELLMKPVDLMRAVVPVFPPSESNLVREGYLKGERNPGHLFCPPSEFFMLFDVDNDGLISFKEYIFFVTLLSIQESSFSAAFKMFDKDNDGEIDKEEFKKVMQSMRSHTRQGVQHGDGRRTGLKANASVENGGLVEYLFGKDGKGRLKHDKFVQFIRDLHDEIVGLEFAHYDYKSRKTISAKDFAHSIVASADLSHLGRLLERVDELSNDPRFKDVCITFEEFKNFAELRKKLLPFSLAIFSFAEVQGLLTRDDFQRAASHVCGVSLSDNVVEIVFHLFDANEDGNLSTEEFVSVLQHRERDIAQPVETGIMGFLSCCWKCTDTSPSSRLFS

SEQ ID NO: 223857 - protein, 1052 aa, Glycine max
  Coding DNA Sequence Number=SeqID_107079
  Gene Ontology: Mol. function=protein binding; Cellular component =membrane; Biological process=primary shoot apical meristem specification
  Homolog annotation: Hit_ID=Q8H6S5; Match level="QueryCoverage=98%, HitCoverage=97%, E-value=0.0, Identity=49%"; Hit description=CTV.2
  Pfam annotation: Domain name=LisH; Domain location=8-34; Score=28.1; E_value=3.1e-05; Accession=PF08513.1; Description=LisH
  Pfam annotation: Domain name=WD40; Domain location=305-343; Score =5.2; E_value=9; Accession=PF00400.22; Description=WD domain, G-beta repeat
  Pfam annotation: Domain name=WD40; Domain location=412-452; Score =33.3; E_value=8.3e-07; Accession=PF00400.22; Description=WD domain, G-beta repeat
  Pfam annotation: Domain name=WD40; Domain location=456-496; Score =23.1; E_value=0.001; Accession=PF00400.22; Description=WD domain, G -beta repeat
  Pfam annotation: Domain name=WD40; Domain location=546-585; Score =0.7; E_value=30; Accession=PF00400.22; Description=WD domain, G-beta repeat
  Pfam annotation: Domain name=WD40; Domain location=782-817; Score =3.6; E_value=14; Accession=PF00400.22; Description=WD domain, G-beta repeat
  Pfam annotation: Domain name=WD40; Domain location=821-860; Score =4.0; E_value=12; Accession=PF00400.22; Description=WD domain, G-beta repeat
  Pfam annotation: Domain name=WD40; Domain location=864-902; Score =26.1; E_value=0.00013; Accession=PF00400.22; Description=WD domain, G-beta repeat
  Pfam annotation: Domain name=WD40; Domain location=937-975; Score =4.4; E_value=11; Accession=PF00400.22; Description=WD domain, G-beta repeat
  Pfam annotation: Domain name=WD40; Domain location=988-1027; Score =2.5; E_value=19; Accession=PF00400.22; Description=WD domain, G-beta repeat
  Pfam module annotation: Pfam domain module=LisH::WD40::WD40::WD40::WD4 0::WD40::WD40::WD40::WD40::WD40; Domain location=8-34::305-343::412 -452::456-496::546-585::782-817::821-860::864-902::937-975::988-1027
MEKSSLNKELVFLILQFLDEEGLKETAHKLERESGIYFDMKYFEDMLLAGKWDDAERYLSGFTSVDDNRHSTKVYFEIRKQKFLEALDMDDRGKALDILIKDLKVFSSGHEELFNEMTQLLIISNIREHASLSTYGDTDSVRKIVADDIKKVIEANPVFHEKLKCPVFKSQRLRYLLNQSLNWQHLLCKDPLPVPGIKTLLEDHVCKPSLNLSSLQSEENESIENSDPDKHLSNNNSGPSTITDSVPFPATLTNPVIILIIAYDGIFHGLSVETAMEDPSVISLKGRPCQTSNEVTSAIANVLPENVVQIFKEDSLPVTMDFHPIGHTLLLAGTNIGSIGLWDVNSGEKLFSENYRIWGIGASSINFKEAQEKDFRVSVKKIKWNPEGSLFGVAFSKHLVQLYSYHHGNDIISQHLEIDAHDGSVNDLAFSSLNEQLLVITCGDDKKIKVWDTVSGVRCYTFEGHDAPVCSICPHVKQQIHFIFSTSTDGKIKAWLYDSLGARVDFDAPGYGYTALAYSADDKRLFSCGTGKDGEPYLVEWDESEGYIKRTYKGLKKPCFSAIHFDSTQKGLLAAGDGHKVKFWNMDSVELWTSTDVDAELLENPCIRFNKKGTLLAVAAKENKIKILAIDDILQKQNEIRSIHVPNNQHETLKCTESPILVDAGAGVADEGIVMNGCQKGSEDGRSNSIEDSHNKSKFWNVSEICEPSQCQFLQLPVHPKISKIVRLAYTNAGCGILALASNGDHLLWQWPRDSLNLDGKATAQFSPHICRSRSGLQLMSNKLTSSYSGNPVSCFSLSKNDSYLMSTSGEAISLFNMLTFKTVTTIMTPPPMATCLSFYPRDNNILAIGMDNYSIIIYNVRTNKIISKLEGHSKRVTALAFSSSFDLLVSGDINAQIFVWNTNGWEKQKDGYLQIHGQKVPEILSDTHIQFHPYQRHFLAWVPEVSMVISQATFSSDGQAVYASFVDGTVGIFDTLKLQMHCRVNPSAYLSTTPSSSIYPLAIAAHPQKPSQFAVGLTDGRVIVFEPQKPGEDWSKFSLDDNEVINTGLWE

SEQ ID NO: 223858 - protein, 50 aa, Glycine max
  Coding DNA Sequence Number=SeqID_107080
MGCAHGASELGSSDVTGELWHDAMVRREEGSAAWVMILGVFKLGVATLSV

SEQ ID NO: 223859 - protein, 327 aa, Glycine max
  Coding DNA Sequence Number=SeqID_107081
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=99%, HitCoverage=25%, E-value=1e-100, Identity=51%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKLGFLKRTTEHGVYIKGSNTTNLTVVCLYVDGLLVTGNNETEIANFKGEMMREFEMTDLDLISYFLGIEFKRIDEGVIMHQGRYARDVLKKFRMVDCNSADTPTAIGVNLVKDPNKEEVDVTLYRQMVGSLRYMENPKLSHFRAAKRIMRYVKGTLDYGILFPSAAKKCNVLGYSDSDWCGDKSDRKSTAGYVFFYGDAPISWSSKKEQVVALSSCEAEYIVAAMETCQAQWLDNIFGELKMKDKGVITLMVDNKSAINLAKHPVAHGRSKHIETQFHFLREQVTKGKLSVKYCPTTVQVADIFTKPLKIDQFKELRSRLGVIQVQ

SEQ ID NO: 223860 - protein, 214 aa, Glycine max
  Coding DNA Sequence Number=SeqID_107082
  Gene Ontology: Mol. function=chitin binding; Cellular component =extracellular region; Biological process=chitin metabolic process
  Homolog annotation: Hit_ID=UPI000044A8F0; Match level="QueryCoverage =77%, HitCoverage=99%, E-value=4e-27, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VDSRGSHAFRGLRVLALRGKHALAFRRLHVLAFRELHALTFKGMHALAFRGLHVLAFRGLHTVAFRELHVLTLRGQHALAFRRLHTLAFRGPNAFAFRGQHVQTFRGLHALAFRGLHALAFRGIQVVVFRGLHALTFKGLHALAFRGLHALAFRGLHVLAFRGMHILTFRGLHVLTAARPHLQKATCPRLPRAKRPRLQRAARPRLQMVARLSL

SEQ ID NO: 223861 - protein, 53 aa, Glycine max
  Coding DNA Sequence Number=SeqID_107083
MLFFNTFALALLNSINILMFLVFNSALKGLEDTPQPKSKAGAWWIVVKLTFNI

SEQ ID NO: 223862 - protein, 252 aa, Glycine max
  Coding DNA Sequence Number=SeqID_107084
  Gene Ontology: Mol. function=kinase activity
  Homolog annotation: Hit_ID=Q74QY0; Match level="QueryCoverage=92%, HitCoverage=70%, E-value=2e-61, Identity=52%"; Hit description=PfkB family carbohydrate kinase
MTQVMTAPDGQRTFFHARGANAQLDVAHFAHLATAHRIFHLGYLLLLDKLDQPDAQYGTRSARLLAEMQQRGYLTSLDLVSRAGEYQALVKPALRWLDYLVINELEAQALTGIELRSSGTLASPAAFAAAARWLLAQGVRQRVVIHAPEGAWGQQSAGDGLWQPAWCLAAEEIVGSVGAGDAFCAGVLYASHQNYNLQQTLKLAHTCASFNLHAANALDGIRPLSEMQRWMNQAICVSRAAADGRITSAEKT

SEQ ID NO: 223863 - protein, 69 aa, Glycine max
  Coding DNA Sequence Number=SeqID_107085
MARTGVNAAMELTRTGGTPGAAPFPDSTAVPVASDIVALQAQYGVTNTLDPTATAATAAAYLKSCGTNG

SEQ ID NO: 223864 - protein, 111 aa, Glycine max
  Coding DNA Sequence Number=SeqID_107086
  Homolog annotation: Hit_ID=Q0KAE4; Match level="QueryCoverage=99%, HitCoverage=66%, E-value=5e-23, Identity=50%"; Hit description =Uncharacterized protein conserved in bacteria
MYPLTKQVQLVSDMSKGAGARLAGIDIPQYADDETSFDMLYARIDKTIIFLTGIKPAQLEGAATKEVVLTIRKVDLTFSALDYLEKWAMPNVYFHSTTAYNILRHLGVALG

SEQ ID NO: 223865 - protein, 95 aa, Glycine max
  Coding DNA Sequence Number=SeqID_107087
  Subcellular localization annotation: CTP_CleavageSite=72; ConfidenceScore=5.36e-01
MKSMDDMGLNQFRFFNMVHDILVKVKLEVTRTSTVLNVFGSRRSSDVTRFIFCPNFCKMVTSILQLNFFRKSMSLVQPYNPRNGNFDHQYFNNRS

SEQ ID NO: 223866 - protein, 128 aa, Glycine max
  Coding DNA Sequence Number=SeqID_107088
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=Q4VIA6; Match level="QueryCoverage=89%, HitCoverage=46%, E-value=3e-42, Identity=87%"; Hit description =Ribulose-1,5-bisphosphate carboxylase/oxygenase large subunit
  Pfam annotation: Domain name=RuBisCO_large; Domain location=1-115; Score=0.2; E_value=9.3e-10; Accession=PF00016.10; Description =Ribulose bisphosphate carboxylase large chain, catalytic domain
MMKRAVFARELGVPIVMHDYLTGGFTANTSLAHYCRDNGLLLHIHRAMHAVIDRQKNHGMHFRVLAKALRLSGGDHVHAGTVARNEGRDLAREGNEIIREASKWSPELAAACEVWKEIKFEFEAMDTL

SEQ ID NO: 223867 - protein, 113 aa, Glycine max
  Coding DNA Sequence Number=SeqID_107089
  Homolog annotation: Hit_ID=Q1SKA6; Match level="QueryCoverage=53%, HitCoverage=7%, E-value=2e-09, Identity=50%"; Hit description =Rad21/Rec8 like protein, C-terminal; Rad21/Rec8 like protein, N- terminal
MVYPSGTRHESLKIVVKGLNPDECIYGENLVEREIPPMSANKSLGVPTIIVEKIFYKKVEYVLEDCNEVLVKINKFFVNKEGLVCVETLCMPVTIPERFELDAFELDKPEDAG

SEQ ID NO: 223868 - protein, 207 aa, Glycine max
  Coding DNA Sequence Number=SeqID_107090
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=61%, HitCoverage=11%, E-value=1e-44, Identity=71%"; Hit description =Tyrosine protein kinase, active site
HVSDFGTAKFLNPDSSNWTSFVGTFGYAAPELAYTMEVNEKCDVYSFGVLAWEILFGKHPGDVISSLLGSSPSTLVASTLDHMALMDKLDQRLPHPTKPIGKEVASIAKIAMACLTESPRSRPTMEQMIPVAANDVAFSIHAVLLTAITLFQIAIYERGSQKVSKVSIGIVSVAWLVAAVCFFIALPNNSWLWLLSVFKYVVVPASL

SEQ ID NO: 223869 - protein, 71 aa, Glycine max
  Coding DNA Sequence Number=SeqID_107091
MNFKSLKRSQLSIVVFLVLSRTLPPISLLGFPNVGEKEKGLKPPFYGPTCDASFSLNRHYFANPNGENMQK

SEQ ID NO: 223870 - protein, 86 aa, Glycine max
  Coding DNA Sequence Number=SeqID_107092
  Gene Ontology: Mol. function=lyase activity; Cellular component =membrane; Biological process=electron transport
  Homolog annotation: Hit_ID=Q97ZA4; Match level="QueryCoverage=99%, HitCoverage=30%, E-value=1e-25, Identity=83%"; Hit description =Formate hydrogenlyase subunit 4
MRSIRRCGLVESNERGFGKLISATPKKTVISVASDKKVKERILLTPNATKLLPLSREAIIFMNAAKEKSNAPPKKSTVGVSKMGTG

SEQ ID NO: 223871 - protein, 217 aa, Glycine max
  Coding DNA Sequence Number=SeqID_107093
  Gene Ontology: Mol. function=NADH dehydrogenase (ubiquinone) activity; Cellular component=integral to membrane; Biological process=ATP synthesis coupled electron transport
  Homolog annotation: Hit_ID=Q97ZA9; Match level="QueryCoverage=96%, HitCoverage=33%, E-value=1e-109, Identity=98%"; Hit description =Formate hydrogenlyase subunit 3
  Pfam annotation: Domain name=Oxidored_q1; Domain location=1-184; Score=-100.9; E_value=0.013; Accession=PF00361.10; Description=NADH -Ubiquinoneplastoquinone (comple
MGMMPFLVSEWLPIAHGTAPSNFSAILSATMTLMGVYGILKITILTQTIPIGFSLTIMAIGAFNIFSGALYGYVNENTKGILAFSTIENNGAILVALSLYMISKQLNITSIEHISLITVILYSFAHSVAKTGLFLSSGLQEKQSITYSKKIRNIEIGLTLLASSMSGLLPNIGGVASWLLLENLFMFSYVLHNVISILFIMTGAIIAMGEEYKRTIK

SEQ ID NO: 223872 - protein, 158 aa, Glycine max
  Coding DNA Sequence Number=SeqID_107094
MRGAPTEESLSPFLVRDFDAQSFKIIQRVHKAWESPLRKDKELRGIRNGIIGGYHEWLKVRTRGLDWLSKLKIIDEENFEAPEEDEEVRALKTELGKARLAKEKFKLVATDVRKECAGLREENAATVRALEQETKREATVSSSFEGKRKTNHEHIAWS

SEQ ID NO: 223873 - protein, 256 aa, Glycine max
  Coding DNA Sequence Number=SeqID_107095
  Gene Ontology: Mol. function=methylenetetrahydrofolate reductase (NADPH) activity; Cellular component=cytosol; Biological process =methionine biosynthetic process
  Homolog annotation: Hit_ID=Q84CU6; Match level="QueryCoverage=93%, HitCoverage=95%, E-value=1e-109, Identity=79%"; Hit description=5,10- methylentetrahydrofolate reductase-like protein MetF
  Pfam annotation: Domain name=MTHFR; Domain location=6-256; Score =224.7; E_value=2e-64; Accession=PF02219.7; Description =Methylenetetrahydrofolate reductase
MANLRKVRHELAAFSPEFFSVTFGAGGSTRDRTMESVLEIQAEGFGAAPHISCISSSKEEIRELLQAYQSKGIKRLVTLRGDIPSGEVSAGDFKYANELVGFIRAETGDWFHLEVAAYPEFHPEAGSAQKDLENFKRKIDAGADSAITQYFYNVDAYFRFVEAAQKLGVTAPIIPGIMPIYNYTQLARFSNVCGAEIPRWLRLRLEAYGDDLASLRAFGVDVVSEICAKLITAGVDKMHFYTLNQAGIIGQIIRQL

SEQ ID NO: 223874 - protein, 240 aa, Glycine max
  Coding DNA Sequence Number=SeqID_107096
  Subcellular localization annotation: CTP_CleavageSite=75; ConfidenceScore=5.16e-01
MVTSISHANNDPKNISGEDVIRPQVQTSVGEISLPQNNVVSTTNTSPFSSTRPWGNALAIPRNQPGNRHIIQMLQGQNGPNRGLGLEAIQNPKIIQMMELALNMYCFGIGNAQPPYFVSAFLDYILASELPRVSAPLSREEVNQALEEFKKEEEFPLAEESLVEFLLKKQKVEKEVMLCLCCNVVFDKSTAKAFEASKNSKSFQKVQEANVKEKGKQSISLTASQVQRPYNLSQKKSYVP

SEQ ID NO: 223875 - protein, 71 aa, Glycine max
  Coding DNA Sequence Number=SeqID_107097
DNVPKGKLYKVPEFQQTLLTVTKIRIWGSHGHVAPHATGLLGHGNKRWGGRQKQGFCSYVSSICDEELRPT

SEQ ID NO: 223876 - protein, 193 aa, Glycine max
  Coding DNA Sequence Number=SeqID_107098
MGFKTRIWVVDARRCMARLGSGCLTPDSAGPINQNNISVQNQISKEATLADTDNGHSSNATLIDHRVSFELTGEDVARCLANKTGVLLRNMSGSSQGILSKDPVDRERVQKDTDTCTEKTDDKPDNSVGGEQCLHKQNSVNSSKEFNFDNRKGDVSVTAGSGSEWWTNRKVAGKEGRSANSWAFFPMLQSEMN

SEQ ID NO: 223877 - protein, 195 aa, Glycine max
  Coding DNA Sequence Number=SeqID_107099
  Homolog annotation: Hit_ID=Q6K6Z8; Match level="QueryCoverage=68%, HitCoverage=31%, E-value=4e-27, Identity=49%"; Hit description =Hydroxyproline-rich glycoprotein-like
  Subcellular localization annotation: CTP_CleavageSite=49; ConfidenceScore=5.33e-01
KPFRRRPFPISGNRKMIPFAHPNPGMASRNNYNRATAETVFAAANAIVAAESRVQPTDAPSSKSSKRIGHAVLVPEPAAPTGPAAAAAAPNPSAAIVMPFIAPPSSPASFLQSDPPSGIQSPPGLLSLSALAANAYSSGGPASMFTIGPYAYETQLVSPPVFSAFTTEPSTAPYTPPPESVQQTTPSSPDVPFAQ

SEQ ID NO: 223878 - protein, 141 aa, Glycine max
  Coding DNA Sequence Number=SeqID_107100
MARERRMNSDSYGRVTTGFYKKGHAWRQWRWRLRQGRATWHVATVTGDKGLHIAALIGASKGAWKRWFDQRLQHLHFCNHRLQHLQLQGPSWKAPLEVAIWVKKKVVAVEREVAGGCLCVESGADQFVFFHFIKAFLGSIR

SEQ ID NO: 223879 - protein, 45 aa, Glycine max
  Coding DNA Sequence Number=SeqID_107101
MIVVTTARSNSCGDRVGGDDSGHGDDGVVTIDGGCDDNQLRQKRS

SEQ ID NO: 223880 - protein, 1301 aa, Glycine max
  Coding DNA Sequence Number=SeqID_107102
  Gene Ontology: Mol. function=RNA-directed DNA polymerase activity; Cellular component=chromatin; Biological process=chromatin assembly or disassembly
  Pfam annotation: Domain name=Chromo; Domain location=1198-1252; Score= 36.9; E_value=6.9e-08; Accession=PF00385.14; Description='chromo' (CHRromatin Organisation MOdifier
  Pfam annotation: Domain name=RVP_2; Domain location=166-293; Score= -22.8; E_value=6.1e-05; Accession=PF08284.2; Description=Retroviral aspartyl protease
  Pfam annotation: Domain name=RnaseH; Domain location=641-762; Score= -20.0; E_value=0.0042; Accession=PF00075.14; Description=RNase H
  Pfam annotation: Domain name=rve; Domain location=896-1052; Score =120.4; E_value=5e-33; Accession=PF00665.16; Description=Integrase core domain
  Pfam annotation: Domain name=zf-H2C2; Domain location=837-878; Score =13.6; E_value=0.0056; Accession=PF09337.1; Description=His(2)-Cys(2) zinc finger
  Pfam module annotation: Pfam domain module=Chromo::RVP_2::RVT _1::RnaseH::rve::zf-H2C2; Domain location=1198-1252::166-293::407 -576::641-762::896-1052::837-878
GSVDNYITEFEYLTAQIPKLPEKQFQGYFLHGLKEEIKGKVARAVERETVRDGSGFARSSKPGQGSSRFGSVGPNKGGASDWVLVKGGKEAITKPTGPGPRNERFGQGDRRSGPRDRGFNHLSYNEVMERRRKNQCFKCAGPFSSTHQCPDKHLRLLITDDGGGEESELLAVEGTIHEVPVVILIDSGATHNFISQQLAKKMNLVTTNTPPLNIRLGDGSCSKTTGACKKLEIDIDDLHVVVDVQLFELGGMDVVLGIEWLRTLGDMIINWKQHTMSFWYNKRWVTLHGVDGNMKGMETLQSIISKPKRSQEVWGREVGSKVDGGSFHALELEQSRELEHLLNLCADVFQEPKGLPPKRKKEHVITLKEGEGPVNVRPYTYPHHHKNEIERQVKEMLETGIIRPSTSSFSSPVILVKKKDGSWRMCIDYRALNKATIPDKFPIPVIEELLDELHGAKFFSKLDLKSGYHQVRIKEEDIHKTAFRTHEGHYEFMVMPFGLMNAPSTFQSLMNEVFRPWLRKFVLVFFDDILVYSNDWQTHLQHLEEVLRLLQTHGLVANKKKCLFGQMSVEYLGHLISGEGVAVDPSKVISVTNWPIPKNVKGVKGFLGLTGYYRKFIKDYGKIAKPLTEFTKKDAFVWNFDKDFVIECDAAGHGIGAILMQEKRPIAYFSKALGVRNLTKSAYEKELMAVVLAIQHWRPYLLGRKFIVSTDQKSLKQLLQQRVVTAEQQNWSAKLLGYDFEIVYKPGNLNRGADALSRVNEEGGLCQIHTRIQWEQEEIVKREAATDPQLQQIIKDLQIDETSRPGYEFRQGVLLYEGRLVLSKHSTLSPRMLEEFHTTPQGGHSGFYRTYRRLAANLYWIGMKNTIQDFVKGCDVCQRQKYMASSPGGLLQPLPIPDRIWEDLSMDFITGLPKSKGYEAILVVVDRLSKYAHFVPLKHPYTARVIAEVFVKEVVRLHGIPLSIVSDRDPIFMSNFWQELFKLQGTKLKVSTAYHPETDGQTEVVNRCLETYLRCFIADQPKTWSMWMAWAEYWFNTSFNVSTGKTPYEVVYGRVPPTLTRWVQGEIRVEAVQRELLDRDEAIKQLREQLLKAQDRMKQLADRKRCDRSFEEGEWVFVKLRAHRQQSVVSRIHAKLAARYFGPYPIIARVGAVAYKLKLPDGSRVHPVFHVSLLKKAVGNYHEEDKLPELEGEGGVLIEPEEVLASRIIQVQGEKVNQVLIRWKGQMVDEATWEDKIAMRSQFPNFCLEDKAVLSGGSIDRPRTQKEEPSEALAHHHSAVDPKVWYVYSRRKKNVANTNDS

SEQ ID NO: 223881 - protein, 101 aa, Glycine max
  Coding DNA Sequence Number=SeqID_107103
MDERIAALEGEITGIKASLLTLEQGQATLIAMFERSLDKKKEGDVVLIEGTPESGSGPSNDEAQMEFRQAVKKVELPMFDGGDPAGWISRAKVYFPGTRNE

SEQ ID NO: 223882 - protein, 172 aa, Glycine max
  Coding DNA Sequence Number=SeqID_107104
  Gene Ontology: Mol. function=chromatin binding; Cellular component =chromatin; Biological process=chromatin assembly or disassembly
  Pfam annotation: Domain name=Chromo; Domain location=85-135; Score =27.4; E_value=5.2e-05; Accession=PF00385.14; Description='chromo' (CHRromatin Organisation MOdifier
MTPFEVTFGRKPPTFPQYVTGTATVDAVDDLLNQREVIFTLLRQKLLKAQTRMKAIVDRHRRDHGFQIDAVAELPQLAVDNQLVSMPLAILAHKTIPSESGPKHLVLVQWKGLHPDETSWEEWTAFQAIHHLEDKVLFEGRENDMNRREGVHTARPKRQSITHMHLKDYVTT

SEQ ID NO: 223883 - protein, 1216 aa, Glycine max
  Coding DNA Sequence Number=SeqID_107105
  Gene Ontology: Mol. function=RNA-directed DNA polymerase activity; Cellular component=chromatin; Biological process=chromatin assembly or disassembly
  Pfam annotation: Domain name=Chromo; Domain location=1160-1202; Score= 10.6; E_value=0.054; Accession=PF00385.14; Description='chromo' (CHRromatin Organisation MOdifier
  Pfam annotation: Domain name=RVP_2; Domain location=326-450; Score= -27.6; E_value=0.00014; Accession=PF08284.2; Description=Retroviral aspartyl protease
  Pfam annotation: Domain name=rve; Domain location=918-1074; Score =94.9; E_value=2.4e-25; Accession=PF00665.16; Description=Integrase core domain
  Pfam module annotation: Pfam domain module=Chromo::RVP_2::Retrotrans _gag::rve; Domain location=1160-1202::326-450::116-206::918-1074
MAYGIVRKLLVHRRFLDLELKAFSLSTHRTTTDRLEEAISILSEKHSELASKVNAMCERFSHMNTAPHPPSLHYDHPHPPVKLEVPHFDDHDPLGWIFKISQFFDYQGTPEEDRITVASFYLDGVALNWFQWMFKNGFITSWSALLQAIETRFAPSFYDDPRGTLFKLVQRGSVTEYLTEFERLANSIVGLSPSVLLSYFISGLNPEIHREDKINDRRKHSRTSFPSPQQPASAPSTQTQTPRPKTPFIQRTQEEMTYRREKGLCYNYDEKWNLSHRIKGRVLFFIAASNDLSPSDIALLENSPPLPIETPPPFDPTPLHPHISLHAMAGVPATDTFRLYGVVNHACVTILVDSGSTHNFVQPRVAKFLNIPMEYMIPLRVMVGNGSVLDCRQVCSATNLLIQGHSFTVTLRVLPLSGADIVLGVEWLRTLGPIIIDYTSFTMHFTHLGQPVTLRADVQSDTDPVSAHQVKRMIHTHSTSALFHLSLLPAHKTEPPIDLPHPISAINEFLLRFSSLFEQLSTLPPPRHHDHHIKLVPSANIVNIRPYRYPHFQKTEIEKQVDYRALKSITVRDRFPLLKIDELPNELGRASWYSKLDLRQGFHQILMADEKKFAAVFFDDILIYNESLPNHLHHLECVFTLLSQPQYYLKHFKCLFGQCQLDYLGHVVSKNGVQPDPSKIQAIVDWPTPRSLRDLRAFLGLTGFYQKFVKGYATIAAPLTRLLCKDAFQWVPESQDAFATLKHAMTSTPMLALPDFSLPFALETNASGTAMGVFLQQQSHPIAFFSKPFRSCMQHASTYVRELHAITAAIHKWRQYLLGHKFIIFTDHRSLHDLMPQDHPQFTIINELIFFKEAIWINSWNPFIPLLLHEYHATLLSGHFGVKKTLHRLRSNFQWSTMVTDVKSFIPQLQHLSTGQTHHPQSRKDLSMDFITHLPSSHGFTIIFVVVDRFSKGVHLDALPTQFTAFKVANLFLDIVCKLHGFPHNIISDCDPVFINSFWHELFRLSGTKFRMTTTYHPQSNGQTKVMNRTVEQYLRSFVHKKPVECYKFLALVEWAYNTSQHSGTGVTPYEITYGKPPPSIPSYILGSSRNDAVDTLLRTRADLPDTFRRKLLKAHDTMKHFADKKRRDVQYEIGQMWNALVVLHIVYNYQRDLESTLCSIMDLSTDPPTRLVLVQWVGLAPEDSTWEKWDEVCNAHHLEDKEYHMSEASRRLRVN

SEQ ID NO: 223884 - protein, 429 aa, Glycine max
  Coding DNA Sequence Number=SeqID_107106
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=77%, HitCoverage=27%, E-value=6e-49, Identity=51%"; Hit description=Chromo
MDTCQWMRKLRETGKACELRGRMCYIRILLRMYFNFLLIQKAYYLFTTVALVISLSSMAEHNDRTRQSHTIGGSNSNGGTPGSSNDIPVTSIATVSAVRHISLGFPHFDGNTPVLEWIFKAEKFFNYHNTPNLDRVDIASIHFEKDVIPWFQMLQRMQVVSTWAELTRALESQFGASLFDCPMAELFKLQQSGTIADYYLKFMALANRSEGLTPEALCNYFISGLNKDIRRDVVAQAPNKFSFTHKCPNRQLLLLQTESDDVELEFHDSKDIIDNVADNSEVILEDHHLSLNVLKGGRGVGTIRFTAYIDKLPVKVLVDGGSSDNFLQPRVAKFLKLLVEPTPSFKVMVGNGNYMVAEGVVNKLTIKAQNAKFQLPVFLLPISGVDLILGSSWLKTIGPHIADYDKLQLKFMYDGKFTTLQGETDMIPA

SEQ ID NO: 223885 - protein, 180 aa, Glycine max
  Coding DNA Sequence Number=SeqID_107107
  Subcellular localization annotation: CTP_CleavageSite=51; ConfidenceScore=5.23e-01
MGKGSFSFCHFASHHRPKKTVTLPLLPSPSQPLYAAEIFVSPNDNNCLLVAASALTKAKKNIGDTQLWIRYGFVCGEVQSRSGFVKCIANLGLCVCNEVSHGKPSLESQVIIDQKRPEIELNDLDLLSSVVGEEDVDVGWKSFYLSNPTKHNIEGLAFLFSLKTTLVIIFHTSVSNNIVV

SEQ ID NO: 223886 - protein, 260 aa, Glycine max
  Coding DNA Sequence Number=SeqID_107108
  Gene Ontology: Mol. function=chitin binding; Cellular component =extracellular region; Biological process=chitin metabolic process
  Homolog annotation: Hit_ID=UPI00006A17C9; Match level="QueryCoverage =86%, HitCoverage=100%, E-value=3e-34, Identity=31%"; Hit description= UPI00006A17C9 related cluster
DLIEAQRSSLHRSPTSKLPSKGLHVLAFRGLHVLAFKGLRALTFKGLCAISLRGLHVLTFRGLHVLTFIGLHVLTFIGLHALTFKGLHALVFRGLRILTFRVLHVLTFIGLHALTFRGLHALAFRGLHVLTFRGLHVLTFGGLHVLTFRGLYVLTFRGLHVLTFRGLHAFTLRGLHAFAFRGLHALTFRALHALAFVGLHALAFKGLHVLAFKGLYALAFRGLHVLAFRGLHALAFIGLHALTFIGLHMHAFKELKILRP

SEQ ID NO: 223887 - protein, 272 aa, Glycine max
  Coding DNA Sequence Number=SeqID_107109
  Gene Ontology: Mol. function=nucleic acid binding; Biological process= DNA integration
  Homolog annotation: Hit_ID=Q0KIN0; Match level="QueryCoverage=88%, HitCoverage=14%, E-value=2e-31, Identity=31%"; Hit description =Integrase core domain containing protein
MASSGPVFSGTPTITTAKLNWKNYPSWSASVELWFLGQGHHDHLEKTSDSVSDDKRPEWEKLDYQLCVVLWQSVEPDILEILRSFKSCRSFWKKAQEIFANDIQSLFDATVKVTALKQTSHDMIAHVGKARAAVEELRKFLLADSLEEVNRKLDKFYMVLILRNLHSDFDHVHDQVLAGDKIPSMDSLITRLLRVPHLLKDENPTDGVETSAMVASRGRGSSRNNRGGRSGRGERPHCTYCKRMGHTQEEFLFVAWVSRQGRTCLSFRESRV

SEQ ID NO: 223888 - protein, 107 aa, Glycine max
  Coding DNA Sequence Number=SeqID_107110
MAMAVWSDGRRPGDAEIVYASTEKAERELNWNYAKTQAYMQCGTMSVKNLVGRLGVHDKTNHTICFARMLQPYVINIGLKEHSNRVTPKAYTPKSPSGPLLPDSGPT

SEQ ID NO: 223889 - protein, 134 aa, Glycine max
  Coding DNA Sequence Number=SeqID_107111
MPEHTTRQTSLERLKEAVNKLTQSQATLTQNHQTLSQAHNALNNKLDSMLDRLATLTFALFSPKPPPSPPPLSPTRPHMKLDVSRFDGQDPLGWIFKISQFFDYQCIPDAKRLTIVSFYMEGPTLCWFQWMSRN

SEQ ID NO: 223890 - protein, 161 aa, Glycine max
  Coding DNA Sequence Number=SeqID_107112
  Gene Ontology: Mol. function=protein serine/threonine kinase activity; Cellular component=membrane; Biological process=protein amino acid phosphorylation
  Homolog annotation: Hit_ID=Q1EPA3; Match level="QueryCoverage=57%, HitCoverage=14%, E-value=2e-17, Identity=51%"; Hit description =Protein kinase family protein
MRPDEEGLLDFKVRGGAVPNGGVCEGFDGGSYTSDGGGCEGFVSGGSTSEGGGYVRSGEGANGHCYVQQPIPSPPLANNYGNGNMSMQHLGASFDSAQFKSVQIIFTYEMVMEMTNAFSNQKLIGEGGFGCVYKGWVPDGKTVAVKQLKAGSGQGERELKA

SEQ ID NO: 223891 - protein, 220 aa, Glycine max
  Coding DNA Sequence Number=SeqID_107113
  Gene Ontology: Cellular component=cytoplasm
  Homolog annotation: Hit_ID=O04237; Match level="QueryCoverage=57%, HitCoverage=43%, E-value=1e-40, Identity=54%"; Hit description =Transcription factor
  Pfam annotation: Domain name=HABP4_PAI-RBP1; Domain location=103-216; Score=75.7; E_value=1.5e-19; Accession=PF04774.5; Description =Hyaluronan  mRNA binding family
MEKMECHLHDYQLRDLGPAAKILTLNLSSRKNVCVSPRVLAAENRDSVDVDAGRSGHPPFWLLGFIHRKRGHGGPHGPYRGGGSRHGHRGGFSNGEAGDEGRPRRAFKLHSGTGRGNEFKREGFGRGNWGTQNDDIAEVIEEVVNETEKILADEKRIGEEDAAEGNKDSPANENEEKESEDKAQKTEARKLDIKEFASMKGSDKDKHKDALEKEEKSKKV

SEQ ID NO: 223892 - protein, 69 aa, Glycine max
  Coding DNA Sequence Number=SeqID_107114
MWYHFPVKNLVGRLGVHDRTCLTMGRPVRVTLFCENAPTMWDRHRLTGALKPDDPQGLHSEESVRASPS

SEQ ID NO: 223893 - protein, 52 aa, Glycine max
  Coding DNA Sequence Number=SeqID_107115
MDKSLITVELNKLWMHKLLQEMDTYTRNLPRSLVSKIGDRGFTIVHAPYSTN

SEQ ID NO: 223894 - protein, 165 aa, Glycine max
  Coding DNA Sequence Number=SeqID_107116
MTLLKFTNFNDMLLACAKAAYAHVDCEALRQVVMTTNDIKHVFEAIIANKSVTYHPTNPFSGEPSTGSPKSTIGSKTCKLIGYPDWWHELQAWKKRDTTNIGWNISQATLVVVEPHLSLIPPNCSSKERDFELGNIGFTLVTLSLDSDHGAWLLDYRAINHMTFD

SEQ ID NO: 223895 - protein, 105 aa, Glycine max
  Coding DNA Sequence Number=SeqID_107117
MTSKRHSRWQSRLRCQHGGHRRWRSGLLARAHTSRCWGTGTGQPSIRRRLGRPLPKFSTNGTVDVRILIKLTLTIIHQIDMKLLLTVFHMVRHHAIPDTDQGRKY

SEQ ID NO: 223896 - protein, 1257 aa, Glycine max
  Coding DNA Sequence Number=SeqID_107118
  Gene Ontology: Mol. function=protein binding; Cellular component =integral to membrane; Biological process=xylan catabolic process
  Homolog annotation: Hit_ID=Q1T435; Match level="QueryCoverage=98%, HitCoverage=90%, E-value=1e-140, Identity=35%"; Hit description =Leucine-rich repeat; Leucine-rich repeat, cysteine-containing type
  Pfam annotation: Domain name=LRRNT_2; Domain location=23-61; Score =60.8; E_value=4.6e-15; Accession=PF08263.3; Description=Leucine rich repeat N-terminal domain
  Pfam annotation: Domain name=LRR_1; Domain location=1015-1037; Score =6.2; E_value=20; Accession=PF00560.23; Description=Leucine Rich Repeat
  Pfam annotation: Domain name=LRR_1; Domain location=108-131; Score =13.9; E_value=0.58; Accession=PF00560.23; Description=Leucine Rich Repeat
  Pfam annotation: Domain name=LRR_1; Domain location=1086-1108; Score =13.9; E_value=0.58; Accession=PF00560.23; Description=Leucine Rich Repeat
  Pfam annotation: Domain name=LRR_1; Domain location=1110-1132; Score =16.2; E_value=0.12; Accession=PF00560.23; Description=Leucine Rich Repeat
  Pfam annotation: Domain name=LRR_1; Domain location=1134-1156; Score =14.1; E_value=0.52; Accession=PF00560.23; Description=Leucine Rich Repeat
  Pfam annotation: Domain name=LRR_1; Domain location=1158-1179; Score =10.8; E_value=2.8; Accession=PF00560.23; Description=Leucine Rich Repeat
  Pfam annotation: Domain name=LRR_1; Domain location=133-155; Score =14.1; E_value=0.5; Accession=PF00560.23; Description=Leucine Rich Repeat
  Pfam annotation: Domain name=LRR_1; Domain location=157-179; Score =15.8; E_value=0.16; Accession=PF00560.23; Description=Leucine Rich Repeat
  Pfam annotation: Domain name=LRR_1; Domain location=181-203; Score =17.5; E_value=0.047; Accession=PF00560.23; Description=Leucine Rich Repeat
  Pfam annotation: Domain name=LRR_1; Domain location=205-227; Score =18.5; E_value=0.024; Accession=PF00560.23; Description=Leucine Rich Repeat
  Pfam annotation: Domain name=LRR_1; Domain location=290-317; Score =7.1; E_value=13; Accession=PF00560.23; Description=Leucine Rich Repeat
  Pfam annotation: Domain name=LRR_1; Domain location=319-342; Score =9.0; E_value=5.9; Accession=PF00560.23; Description=Leucine Rich Repeat
  Pfam annotation: Domain name=LRR_1; Domain location=345-368; Score =8.4; E_value=7.7; Accession=PF00560.23; Description=Leucine Rich Repeat
  Pfam annotation: Domain name=LRR_1; Domain location=371-394; Score =10.7; E_value=2.8; Accession=PF00560.23; Description=Leucine Rich Repeat
  Pfam annotation: Domain name=LRR_1; Domain location=397-419; Score =17.3; E_value=0.056; Accession=PF00560.23; Description=Leucine Rich Repeat
  Pfam annotation: Domain name=LRR_1; Domain location=422-444; Score =8.9; E_value=6; Accession=PF00560.23; Description=Leucine Rich Repeat
  Pfam annotation: Domain name=LRR_1; Domain location=446-468; Score =5.9; E_value=22; Accession=PF00560.23; Description=Leucine Rich Repeat
  Pfam annotation: Domain name=LRR_1; Domain location=476-497; Score =19.0; E_value=0.017; Accession=PF00560.23; Description=Leucine Rich Repeat
  Pfam annotation: Domain name=LRR_1; Domain location=499-521; Score =13.6; E_value=0.74; Accession=PF00560.23; Description=Leucine Rich Repeat
  Pfam annotation: Domain name=LRR_1; Domain location=523-545; Score =14.8; E_value=0.32; Accession=PF00560.23; Description=Leucine Rich Repeat
  Pfam annotation: Domain name=LRR_1; Domain location=547-569; Score =9.7; E_value=4.4; Accession=PF00560.23; Description=Leucine Rich Repeat
  Pfam annotation: Domain name=LRR_1; Domain location=576-597; Score =11.1; E_value=2.3; Accession=PF00560.23; Description=Leucine Rich Repeat
  Pfam annotation: Domain name=LRR_1; Domain location=599-620; Score =12.0; E_value=1.6; Accession=PF00560.23; Description=Leucine Rich Repeat
  Pfam annotation: Domain name=LRR_1; Domain location=623-645; Score =10.2; E_value=3.5; Accession=PF00560.23; Description=Leucine Rich Repeat
  Pfam annotation: Domain name=LRR_1; Domain location=647-669; Score =8.4; E_value=7.8; Accession=PF00560.23; Description=Leucine Rich Repeat
  Pfam annotation: Domain name=LRR_1; Domain location=676-697; Score =7.9; E_value=9.5; Accession=PF00560.23; Description=Leucine Rich Repeat
  Pfam annotation: Domain name=LRR_1; Domain location=699-721; Score =12.6; E_value=1.3; Accession=PF00560.23; Description=Leucine Rich Repeat
  Pfam annotation: Domain name=LRR_1; Domain location=723-746; Score =8.9; E_value=6.1; Accession=PF00560.23; Description=Leucine Rich Repeat
  Pfam annotation: Domain name=LRR_1; Domain location=748-768; Score =8.1; E_value=8.8; Accession=PF00560.23; Description=Leucine Rich Repeat
  Pfam annotation: Domain name=LRR_1; Domain location=773-795; Score =3.3; E_value=69; Accession=PF00560.23; Description=Leucine Rich Repeat
  Pfam annotation: Domain name=LRR_1; Domain location=797-820; Score =2.5; E_value=97; Accession=PF00560.23; Description=Leucine Rich Repeat
  Pfam annotation: Domain name=LRR_1; Domain location=868-889; Score =3.5; E_value=62; Accession=PF00560.23; Description=Leucine Rich Repeat
  Pfam annotation: Domain name=LRR_1; Domain location=894-916; Score =12.4; E_value=1.4; Accession=PF00560.23; Description=Leucine Rich Repeat
  Pfam annotation: Domain name=LRR_1; Domain location=918-940; Score =16.8; E_value=0.077; Accession=PF00560.23; Description=Leucine Rich Repeat
  Pfam annotation: Domain name=LRR_1; Domain location=942-964; Score =14.0; E_value=0.55; Accession=PF00560.23; Description=Leucine Rich Repeat
  Pfam annotation: Domain name=LRR_1; Domain location=966-989; Score =10.3; E_value=3.3; Accession=PF00560.23; Description=Leucine Rich Repeat
  Pfam annotation: Domain name=LRR_1; Domain location=991-1013; Score =7.9; E_value=9.6; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1; Domain location=23-61::1015-1037::108-131::1086-1108::1110 -1132::1134-1156::1158-1179:...
  Pfam module annotation: Domain location=:133-155::157-179::181 -203::205-227::290-317::319-342::345-368::371-394::397-419::422 -444::446-468::476-497::499-521::523-545::547-569::576-597::599 -620::623-645::647-669::676-697:...
  Pfam module annotation: Domain location=:699-721::723-746::748 -768::773-795::797-820::868-889::894-916::918-940::942-964::966 -989::991-1013
MEGIIILMMLQVVVSAQDHIMCIQTEREALLQFKAALVDDYGMLSSWTTSDCCQWQGIRCSNLTGHVLMLDLHGQLRFSHAFADDITDIGWQRYMRGDIHKSLMELQQLKYLNLSWNSFQGRGIPEFLGSLTNLRYLDLEYCRFGGKIPTQFGSLSHLKYLNLALNSLEGSIPRQLGNLSQLQHLDLSANHFEGNIPSQIGNLSQLLHLDLSYNSFEGSIPSQLGNLSNLQKLYLGGSHYYDDAYGGALKIDDGDHWVSNLISLTHLSLVFISNLNTSHSFLQMIAKLPTLRELSLSECSLSDQFILSLRPSKFNFSSSLSILDLSWNSFTSSMILQWLSNVTSNLVELHLSYNLLEGSTSSNHFGIVLNSLQHLDLSYNLLEGSTSSNHFGIVLNSLQHLDLSHNLLEGSISNHFGRVMNSLEHLDLSYNIFKGEDFKSFANICTLHSLYMPANLLTEDLPSILHNLSSGCVRHSLQDLDLSDNQITGSLPDLSVFSSLRSLFLDGNKLSGKIPEGIRLPFHLKSLSIQSNSLEGGIPKSFGNSCALSSLDMSGNNLNKELSVIIHQLSGCARFSLQELNIGGNQINGTLSELSIFSALKTLDLSENQLNGKIPESTKLPSLLESLSIGSNSLEGGIPKSFGDACALCSLDMSNNSLSEEFPMIIHHLSGCARYSLERLDLGMNQINGTLPDLSIFSSLRELNLDGNKLYGEIPKDYKFPPQLERLDMQSNFLKGVLTDYHFANMSKLDILELSDNSLVTLAFSQNWVPPFQLRFIGLRSCQLGPVFPKWLKTQNQFQGIDISNAGIADMVPKWFWDNLAFREWISMNISYNNLHGIIPNFPIRNIQHSLILGSNQFDGPIPPFLRGFLFLDLSKNKFSDSLSFLCVNVKVETLYQLDLSNNRFSGKIPDCWSHFKSLIYLDLSHNNFSGRIPTSMGSLLQLQALLLRNNNLTDEIPFSLRSCTNLVMLDIAENRLSGLIPAWIGSELQELQFLSLGRNNFHGSLPLPICYLSDIQLLDVSLNSMSGQIPKCIKNFTSMTQKTSSQGHSYYVNDNGLITNQTYDLNAFLMWKGSEQMFKNNGLLLLKSIDLSSNHFSGEIPLEIENLFGLVSLNLSRNHLTGAIPSNIGKLTSLDFLDLSRNHLIGSIPWSLTQIDRLGVLDLSHNNLSGEIPTGTQLQGFNASCYEDNLDLCGPPLEKLCIDGKPAQEPIVKLPEDEKLLFTREFYMSMAIGFVISFWGVFGSILIKRSWRHAYF

SEQ ID NO: 223897 - protein, 516 aa, Glycine max
  Coding DNA Sequence Number=SeqID_107119
  Gene Ontology: Mol. function=RNA-directed DNA polymerase activity; Cellular component=chromatin; Biological process=chromatin assembly or disassembly
  Pfam annotation: Domain name=rve; Domain location=140-302; Score =38.0; E_value=3.3e-08; Accession=PF00665.16; Description=Integrase core domain
  Pfam annotation: Domain name=zf-H2C2; Domain location=81-122; Score =30.1; E_value=7.6e-06; Accession=PF09337.1; Description=His(2) -Cys(2) zinc finger
  Pfam module annotation: Pfam domain module=rve::zf-H2C2; Domain location=140-302::81-122
MSAVKKWRQYLLGHHFTIITDHRSLKELVNQAADALSRLPEQDHVTLMVLSVLCLTFLDELRAQIFPRGLPLATTLLTEFHATPTGGHAGIAKTTARLSENFAWPGLRDDVAQYVSHCADCQVTKYEAKRLAGLLCPLPVPFRPWEDLSLDFITGLSHYRGNSVILVMVDRFSKGIHLGMLPTSHTASSVASLFVDIVVKIHGFPRSLVSDRDPLFVSQFWQALFRTSGTQLRLSSTYHPQSDGQTETTRSVGQAPAMGRMVPQFQLECRNMLDVVDSILVERDVVIQAIRRKLLKAQECMKRYADQKRRDVDFNCGEWVLVKLRPHRQTSAKGSQHTSGKLSKRFYGPFRILERIGPVAYRLHLPEGACIHPVYHVSALKQFKGPPDRAIMDLLDDFEGDQPLIFPIAILNSRRKDSTPNAPWEVLMQWRGLLPEETSRENWSQLCQDFHLEDKVTLQRPGDDTEAGVEQGKGTAIANQEGNIEAGSKPRDESCLKDWSCRPQGSTAPILLGLLG

SEQ ID NO: 223898 - protein, 171 aa, Glycine max
  Coding DNA Sequence Number=SeqID_107120
MGEVEEAQEQMKADMEGMKEAVAKVNPMPSSGLNQINHPTSAMVGKDLGIGGIPLQNTLEGPQYHPQPHPLHSTPGKNHHAMAEMGKMDHLKERLRAIEGGEDYAFASLEELFLVSNIITPPNFKMPDFDKYKGNNCPKSHLKMCCQKMGAYAKDEELLIHFFQESLTGVA

SEQ ID NO: 223899 - protein, 227 aa, Glycine max
  Coding DNA Sequence Number=SeqID_107121
  Homolog annotation: Hit_ID=Q1IYC9; Match level="QueryCoverage=33%, HitCoverage=43%, E-value=1e-07, Identity=38%"; Hit description =Conserved hypothetical membrane-anchored protein
RGTDPARGAGFGGGDAQAGGHRIKLLPKLPAFTAKLKIQDEEEITVAIRCQLINCKRNNTMKKDELASRDYPVQEDMRWQRRESVIQRIGEYVLMVIVILGACGLFSKGILSDGQAQSADGSVSIRYERFGRIDSNMNLRIRVAPQSGERFTVTLGSGALDDLQIQTLQPQPQQAITRDNTLQLTYASEAAEAAGGGTGCAERARQSSGTGKGIAVDLPIKGERYGN

SEQ ID NO: 223900 - protein, 91 aa, Glycine max
  Coding DNA Sequence Number=SeqID_107122
MAIVPHTEPVDVQIGDRIEDKIRDLGQEGFRQAHAPYYDNLQSDSKQSLYSGCTTFTWLSAVLALVNSKARFGWSDKSFIELLFFIEEYAS

SEQ ID NO: 223901 - protein, 108 aa, Glycine max
  Coding DNA Sequence Number=SeqID_107123
  Homolog annotation: Hit_ID=Q9JKS4-3; Match level="QueryCoverage=46%, HitCoverage=7%, E-value=4e-07, Identity=49%"; Hit description =Isoform 3 of Q9JKS4
MDTLEPYTRAMKDTIREPQANLGAVPIAFRGLHALAFRGLHILAFRGLHTLAFRGLQVLTFGGLHALAFRGLHALTFRGLTSSPLEGCKPLPSEGSTSAPLELKVFCP

SEQ ID NO: 223902 - protein, 44 aa, Glycine max
  Coding DNA Sequence Number=SeqID_107124
MTHGQPAGDQVQSQSRTRLVAHDPRNLNKTSTSSEGRKIPWICM

SEQ ID NO: 223903 - protein, 431 aa, Glycine max
  Coding DNA Sequence Number=SeqID_107125
  Gene Ontology: Mol. function=sequence-specific DNA binding; Cellular component=nucleus; Biological process=regulation of transcription
  Homolog annotation: Hit_ID=Q1RWH4; Match level="QueryCoverage=96%, HitCoverage=91%, E-value=3e-87, Identity=40%"; Hit description=WRKY DNA-binding domain, putative
  Pfam annotation: Domain name=FLYWCH; Domain location=290-358; Score =0.1; E_value=0.068; Accession=PF04500.7; Description=FLYWCH zinc finger domain
  Pfam annotation: Domain name=WRKY; Domain location=159-217; Score =105.1; E_value=2.1e-28; Accession=PF03106.6; Description=WRKY DNA -binding domain
  Pfam annotation: Domain name=WRKY; Domain location=301-360; Score =129.8; E_value=7.8e-36; Accession=PF03106.6; Description=WRKY DNA -binding domain
  Pfam module annotation: Pfam domain module=FLYWCH::WRKY::WRKY; Domain location=290-358::159-217::301-360
MEEDEETQQRVTDSSLSTESRTSTPSDGAPPNSETLVHRSSLPHDLATHMQGSSTAHKGGKAESKVSAQPPDEETIEKDAVEAPQKQTENQLQSVCSTSLSELSPTSVSHSLSSALSPTVSQQRPSPPKANSVQVSKGDKGTPSDGTTLSSVSAVRASASDGYNWRKYGQKQVKNPMGSRSYYKCTHSNCCAKKIKFCDHSGHVIEIVYKSQHNHDPPHKIDTTKESKLLPSSEPKEESSVPKQSTKVLNNSDPSSSPKEPLQEAPCNGDKNLENSSNVENVKHGKKPKFVVHATEDVGISGDGYRWRKYGQKLVKGNPHFRNYYRCTSSGCPVRKHIETAVDNSKALIITYKGVHDHDMPVPKKRHGPPSASLVAAAAPASMNNVQFKKTGLLQSQETEAQCSEDTEGELMGEAMDLEAVIFACTHVQLV

SEQ ID NO: 223904 - protein, 281 aa, Glycine max
  Coding DNA Sequence Number=SeqID_107126
  Gene Ontology: Mol. function=nucleic acid binding; Cellular component= mitochondrion; Biological process=DNA integration
  Homolog annotation: Hit_ID=Q1SNY3; Match level="QueryCoverage=85%, HitCoverage=18%, E-value=4e-49, Identity=40%"; Hit description =Integrase, catalytic region; Zinc finger, CCHC-type; Peptidase aspartic, catalytic
MEHFLVSIMQRTHLVLIILYQISDDSTKSVHNKVITQITRSYTALISEVEPKHIDEAMQDDNWVKDMQEELNQFQKNDVGKVSRATKGQEDYWNQVVFLTSWMRMIWFAFLNGLIQEEVYVEQPTGFESDTLPYHQTSNGIYIHQTKYVKKLLKKFNMDNEKEMKTPMHPTTYLGLDKESKKEDGTQYKAMIGSLLYLTTSKPDLIFGVCLCARFQKEPREVHLSSTKCIFRYLIGTSNLGLCFKRRTISDSQVTVVLTMWEISLKGRELVEVVTSLVATW

SEQ ID NO: 223905 - protein, 114 aa, Glycine max
  Coding DNA Sequence Number=SeqID_107127
MDDNIVNEESASKQLETSHEATPNEKDVPDVVIIYSTSLSHTPINYAPPNIGTKGQVQEMIGQAMDTFVERQRQENEKLKLYAKHYQHSTHQSWCCIDSELATSSVYDNKDINS

SEQ ID NO: 223906 - protein, 258 aa, Glycine max
  Coding DNA Sequence Number=SeqID_107128
  Gene Ontology: Mol. function=DNA binding; Cellular component =mitochondrion; Biological process=DNA integration
  Homolog annotation: Hit_ID=Q1T192; Match level="QueryCoverage=79%, HitCoverage=40%, E-value=7e-29, Identity=33%"; Hit description =Polynucleotidyl transferase, Ribonuclease H fold
MIEKLASALVNASRRLQQYFQGNQVVVHTDYPIAKVLRKPKLARRMVAWPIELSKFSIGYEPRGPIKAQWLTNFISELHPLTLITKLSGQWARVILEGLGELKHIVSDYNSKDDELTKLASTKKPRQHHTIIKHTFLDLSISGKECKEVTIEQAEWMAPILAYLKEGILLENKKEAQKLKIQEARYTTIAGELYRKGFSATLLSSLQRHNQNTSWRRSKRYMWDAFRREINGNSCPIGQVLLANTLPIFLRIIRIKIQ

SEQ ID NO: 223907 - protein, 169 aa, Glycine max
  Coding DNA Sequence Number=SeqID_107129
  Gene Ontology: Mol. function=RNA-directed DNA polymerase activity; Cellular component=chromatin; Biological process=chromatin assembly or disassembly
MCFTDISPEELVSHRNHDLCYYCDECFTTGHHYEGRFLVLLANKDNTCDDFVPLLTSHAEPGPMIIEDTTTSPIISFNAIYNMPASETFRLYGHIVSSRVTILVDSESTHNFVQTKWQNISTFPRWQPIPFKSWSLNSITVKDYFPMPTIDKLLDDLGGASWFSKLDLR

SEQ ID NO: 223908 - protein, 74 aa, Glycine max
  Coding DNA Sequence Number=SeqID_107130
MTGPLSNPRGPSVLGCVATNFLLWEIHLVLKVKTKVNVISFLPTGVLRIAKGSTKGLSFDEVGRKEYKKDGKGP

SEQ ID NO: 223909 - protein, 99 aa, Glycine max
  Coding DNA Sequence Number=SeqID_107131
MAINSWGSEQDLMVEDARTALGNQFVGLGLDGGGCMNGNQFMGIRIRFDGGGHTNNARKSIRGAPDSMAINSWGSGLDGGGCMNGNQFMGLQTTFDGGG

SEQ ID NO: 223910 - protein, 83 aa, Glycine max
  Coding DNA Sequence Number=SeqID_107132
  Subcellular localization annotation: CTP_CleavageSite=30; ConfidenceScore=5.25e-01
MPIYRQRVTFGQSQLAQVDKSGALAPTYPPSKRKSDLRSSFQRGESSDSFLLGRWSLKALDLKMIHFYLVRKAEALDLKTFFQ

SEQ ID NO: 223911 - protein, 51 aa, Glycine max
  Coding DNA Sequence Number=SeqID_107133
MASMKICILAEHQQQSRALSARSLLHTRTEQPGHRIPEQPQAYFRKRALEA

SEQ ID NO: 223912 - protein, 61 aa, Glycine max
  Coding DNA Sequence Number=SeqID_107134
MKQRRVKRKKARLAMTVALIGLQNALSLRSWAYRATRLPLIKSDPGLVPLHALSALPMVSK

SEQ ID NO: 223913 - protein, 352 aa, Glycine max
  Coding DNA Sequence Number=SeqID_107135
  Gene Ontology: Mol. function=zinc ion binding; Cellular component =integral to membrane; Biological process=ubiquitin cycle
  Homolog annotation: Hit_ID=Q1SCX5; Match level="QueryCoverage=92%, HitCoverage=95%, E-value=6e-66, Identity=45%"; Hit description=Zinc finger, RING-type
  Pfam annotation: Domain name=C1_4; Domain location=121-165; Score= -11.0; E_value=0.056; Accession=PF07975.2; Description=TFIIH C1-like domain
  Pfam annotation: Domain name=PHD; Domain location=121-166; Score= -2.4; E_value=0.1; Accession=PF00628.19; Description=PHD-finger
  Pfam annotation: Domain name=zf-C3HC4; Domain location=122-163; Score= 32.5; E_value=1.5e-06; Accession=PF00097.15; Description=Zinc finger, C3HC4 type (RING finger)
  Pfam module annotation: Pfam domain module=C1_4::PHD::zf-C3HC4; Domain location=121-165::121-166::122-163
MDFVSQRHLLHSMQQAHSPCTTPLSDVTNPSPYNYSFLVILVIGMMFTAFFLIGYYILVVKCCLNWPHVDHVRIFSLSRSHEDPSAPYSTASEPRGLEEAVIKLIPVIQFKPEEGERSFSECSVCLSEFQQDEKLRVIPNCSHVFHIDCIDVWLQNNAYCPLCRRTVSLTSQVHHHVDQVNLLLTPRLSPQGQSQNNENLIGAAEDEGGFVVIDLDGEHDRDQNLQERQELPTCRIISLSSQMKLLEEKKARKLQKVTSLGDECIGVRSKDERLSVQAMRRSFSMDSSVDRKFYEAVQEALQQPQQQNGNVLEVSTIEACDGSGRVKRSFFSFGHGSRSRSAVLPETPDFFI

SEQ ID NO: 223914 - protein, 322 aa, Glycine max
  Coding DNA Sequence Number=SeqID_107136
  Gene Ontology: Mol. function=DNA binding; Cellular component =intracellular; Biological process=DNA integration
  Homolog annotation: Hit_ID=Q1S3H4; Match level="QueryCoverage=89%, HitCoverage=65%, E-value=7e-94, Identity=52%"; Hit description =Integrase, catalytic region
MCDVSDYAVGVVLGQQKEKVFHSIYYASKVLNGAQLNYATIEKELLAIVYALEKFRSYLVGSRMVVFNDHAAIKYLITKEDSKPRLIRWILLLQEFDLVIKAKKGSENLVADHLSRLINEEVTREKLEIRDDSLMRSELALEKKNSFMMHIFKIGADNLLRRCMTREEARSILWHCYNSPYGGHYSGDKTTAKRTRGISRRNEMPLQNIIKVEVFDCWGIDFIDPLPSSYRNEYILVVVDYVSKWVEAVATSKNDAKMAHTFAMSNCRRYWGIIMSLTRWLHLIIPKPMVRIVSFPDGLSEGLSSVSRDRAQGLLGTEIPEF

SEQ ID NO: 223915 - protein, 113 aa, Glycine max
  Coding DNA Sequence Number=SeqID_107137
  Gene Ontology: Mol. function=RNA-directed DNA polymerase activity; Cellular component=intracellular; Biological process=RNA-dependent DNA replication
MKYVFLEENEAKPAVISNDLSSNEKFRLVEVLKKHKAAIGWHILGLKGISPSYCMHKIMMETDYKHAWVSSVQVIPKKGGMIVKRPCPSTIHGPDAQEEDAIWAMQRSSHILE

SEQ ID NO: 223916 - protein, 239 aa, Glycine max
  Coding DNA Sequence Number=SeqID_107138
MERSVVHVDPTPGKIDGPHRKKLRTYLGIVARDKAKFDILEAFDQRTKKKILKASQYHDQTILWTDFKKLPDIYAYHSQRAGATDTKIRDQLEESITEKGLVLPPESEVGPSVARVNIKGGCVDPSRKDPNMGELDNLKGLTTVYNILLGNDQVKVGVEEGTEGPTKPVDRLEPDDDPLYQMTLTISELFLKPMQVSWDSTGFGVYNDGIPLYIKHEDFSEIAHNGQCLNISMIQMWIL

SEQ ID NO: 223917 - protein, 164 aa, Glycine max
  Coding DNA Sequence Number=SeqID_107139
MSFRTYEKAWIVLERKTNDQSEQRAISRANLGVEESNFDSELIWARLDERKGAAESWLVQKSAYVWLAVERVVQNEFWMIASRSQRSQCRLMYYRPPLVLFECCFAWMLWKLGRIDGDPVLRETRIWATWEYVSSDGGGQQGMVGLCAHCGCGKLVVHHRPTAT

SEQ ID NO: 223918 - protein, 134 aa, Glycine max
  Coding DNA Sequence Number=SeqID_107140
MSTQREITESGAMRKRMKPEVVEKVGDETKSKTIEEEEFEANIAGSEEMELSISLILEKIENYTQMVYELLESGKTMLKELTNAFEGKLIMIHKEQVEKWQEEIRELCALDASNEEANALLLNARYLLQPTCDH

SEQ ID NO: 223919 - protein, 207 aa, Glycine max
  Coding DNA Sequence Number=SeqID_107141
  Gene Ontology: Mol. function=enzyme inhibitor activity
  Homolog annotation: Hit_ID=Q1RYM1; Match level="QueryCoverage=57%, HitCoverage=67%, E-value=3e-19, Identity=43%"; Hit description =Pectinesterase inhibitor
MAIERRSDQGKIVIDKLVLYQKTNCYKGKELLIEDDEDASPIRFECCFSLKPDEKPLADAVHHEVGQYYQTLNHTCFTQETSFNMSPLPTNARAHGRDMIGQKLHKGIEGQNFLKGLVKAKSSPAIALCANFVIYNGVVNGFKVAMVELKHDPMMANYDAGVISDEPATCERALADERTVDPAISAVNNHITLLSAVAPYAIDKVTA

SEQ ID NO: 223920 - protein, 77 aa, Glycine max
  Coding DNA Sequence Number=SeqID_107142
MIWFRDPAILVVVAKVRVQEVLGDDDGVDLGTKALSLLLTTIHEHDVGEVEEVLDTITSRMLSRGKGKGLGWAYLSR

SEQ ID NO: 223921 - protein, 88 aa, Glycine max
  Coding DNA Sequence Number=SeqID_107143
  Subcellular localization annotation: CTP_CleavageSite=36; ConfidenceScore=5.10e-01
MSPANSKFLCSGLLDLANRYYSSFNSYVPYLPPNVRASLLSDSRMRCFAYEPEVCKLVYCYIDDQAQVLHPSMQQISCSQERCSKDKI

SEQ ID NO: 223922 - protein, 970 aa, Glycine max
  Coding DNA Sequence Number=SeqID_107144
  Gene Ontology: Mol. function=protein tyrosine phosphatase activity
  Homolog annotation: Hit_ID=Q6F2V0; Match level="QueryCoverage=99%, HitCoverage=98%, E-value=0.0, Identity=47%"; Hit description =Expressed protein
MLDLSKYMIGIPRSNSVGRVSQCLTNVADYIPNSEEAIRRGEYTVIRSLIRVLEGGVEGKRQVDKVIDKCASMQNLREAIGTYRNSILRQPDEMKKEASLSFFVEYLERYYFLICFAVYIHSEMATLCSCSADHSSFTDWMRNRPELYSIIRRLLRRNPMGALGYSSLKPSLKKIAESTDGRPSEMSVVAALRNGEVLGSQTVLKSDHCPGCQHPRLPERVEGAPNFREVSGFPVYGVANPTIDGIRSVICRIGSSKGGSPVLWHNMREEPVIYINGKPFVLREVERPYKNMLEYTGIGRERVEKMEARLKEDILREAEQYGNAIMVIHETDDGHIYDAWEHVTSEMIQTPLEVFKSLEADGFPIKYARVPITDGKAPKSSDFDTVAFNIASAAKDTAFVFNCQMGRGRTTTGTVIACLVKLRIDYGRPIKILRDDMTCEEADGGFSSGDEVGGYVTALTPNTLQIKPDEKQSHAFGINDILLLWKITTFFDNGVECREALDAIIDRCSALQNIRQAVLEYRKVFNQQHVEPRVRRVALYRGAEYLERYFRLIAFAAYLGSEAFDGFCGQGEYKMAFKNWMHERPEVQAMKWSIRLRPGRFFTVPEELRAPRESQHGDAVMEAFVKARSGSVLGKGYILKMYFFPGQRTSSYMQIHGAPHIYKVDEYPVYSMATPTISGAKEMLSYLGAKPKANVSSSQKVILTDLREEAVVYIKGTPFVLRELNKPVDTLKHVGITGLAVEHMEARLKEDILAEIRQSGGLMLFHREEYNPSTNQSSVVGYWENVLADDVKTPAEVYSTLKDEGYDIIYLRIPLTRERDALASDIDTIQYCKDDSAESYLFVSHTGFGGVAYAMAIICVRLGAEANFASKVPQPLFGPHQWAATEENLPSRASNEAALKMGDYRDILSLTRVLIRGPQSKSDVDIVIERCAGAGHLRDDILYYHKEFEKFTDGDDEERAYLMDMGVKAL

SEQ ID NO: 223923 - protein, 161 aa, Glycine max
  Coding DNA Sequence Number=SeqID_107145
  Homolog annotation: Hit_ID=Q6SA75; Match level="QueryCoverage=32%, HitCoverage=6%, E-value=1e-13, Identity=97%"; Hit description=ANT -like protein
  Pfam annotation: Domain name=AP2; Domain location=48-104; Score= -16.1; E_value=0.036; Accession=PF00847.10; Description=AP2 domain
MKRICDSISCKKEGQTRKGRQERVVGFQGVPQCTEELQGLNPPLMLCRHHQHGRWQARIGRVVGNKDLYLGTFICIILSQGTYNKELKFIAQKAKRIFVGLRCTLADFSRHRTTLVTLRNYMYLICLGFLAYEWERKEGLLAKKLHPDRNKDDLEAEKKFQ

SEQ ID NO: 223924 - protein, 87 aa, Glycine max
  Coding DNA Sequence Number=SeqID_107146
EGTPLKEHLDELNYVLMELHDIDVEMEDKDLSMILLAFLPPSYENFVSSLSVELEKNLVSVGVMDSKGFSCWVESGVMHMRGKGESV

SEQ ID NO: 223925 - protein, 74 aa, Glycine max
  Coding DNA Sequence Number=SeqID_107147
MSPQNLLKKQSKQHITSNSKRKYIVFFEIAARIEGLRIERRLSGGVRVGENAEGGVVVVNGALVVPLGLFGKGS

SEQ ID NO: 223926 - protein, 444 aa, Glycine max
  Coding DNA Sequence Number=SeqID_107148
  Gene Ontology: Mol. function=acetyl-CoA C-acyltransferase activity; Cellular component=glyoxysome; Biological process=fatty acid biosynthetic process
  Homolog annotation: Hit_ID=Q6TXD0; Match level="QueryCoverage=96%, HitCoverage=96%, E-value=1e-174, Identity=76%"; Hit description=3 -ketoacyl-CoA thiolase
  Pfam annotation: Domain name=Thiolase_C; Domain location=315-439; Score=205.1; E_value=1.6e-58; Accession=PF02803.8; Description =Thiolase, C-terminal domain
  Pfam annotation: Domain name=Thiolase_N; Domain location=53-308; Score=247.4; E_value=2.9e-71; Accession=PF00108.13; Description =Thiolase, N-terminal domain
  Pfam module annotation: Pfam domain module=Thiolase_C::Thiolase_N; Domain location=315-439::53-308
MEKAIQRQRVLLEHLQPISSSSNFSSQTHQSTDLSASLCFAGNSSHGQTGGSDDDVVIVAYNFSSITSAYRTAICKAKRGGFKDTLPDDLLATVLKAVIEKTNVDLRKLEILSWAQYWHLDQIEELSAEWLPFMQVSQCSSGLQAVSDVAAYIKAGFYDIGIGAGLESMTVDRVNRLPNINPKVETFAEARDCLLPMGITSENVAQRYGVTRLEQDQAAVESHKRAAAATAAGKFKEEIIPVSTKFVDPKTGVEKKIIVSVDDGIRPNTNLADLAKLKPAFQKDGTTTAGNASQISDGAAAVLLMKRRVAVQKGLPILGIFRSFAAVGVDPAVMGVGPAVAIPAAVKSAGLELGNIDLFEINEAFASQYVYCLKKLGLDPRKVNVNGGAIALGHPLGVTGARCVATLLNEMKRGGKDCRFGVISMCIGDFFFWSLSISHIPVKS

SEQ ID NO: 223927 - protein, 131 aa, Glycine max
  Coding DNA Sequence Number=SeqID_107149
SSGNFPEEGVFWKVLSEALKGHPEEPFFRKFSGRTTSSGRGVPEAFRKTFHYFRKNPSSGNLPEHVLPEVPEEPETDLSEGTYLECKWVQGKNKQRARGEGSRRRRPPPPRLIAEERREEVRMLLRKREVK

SEQ ID NO: 223928 - protein, 220 aa, Glycine max
  Coding DNA Sequence Number=SeqID_107150
  Homolog annotation: Hit_ID=UPI0000D9D93C; Match level="QueryCoverage =76%, HitCoverage=33%, E-value=7e-08, Identity=23%"; Hit description =PREDICTED: similar to B5 receptor
MHLVILFPILVCQVAEPQVSRLCVEAEEFIVMGKWLELASLMITSAELIFSKVSEKDIESIFTIICNLVTKTENPDEVMEIVKVITTKILQQPNEKPAVRLKIMISLYNLLETPYCQFYVYMKLLNLAVDGKVTEHIIPSFNKIDNFLKDWKIGIPEQRELFLAVSNILKENKSMSKDAFKFLTSYLATFSGDDSHVLSEAKEEAARAIVEFVRAPDVFQ

SEQ ID NO: 223929 - protein, 763 aa, Glycine max
  Coding DNA Sequence Number=SeqID_107151
  Gene Ontology: Mol. function=ATP-dependent helicase activity; Cellular component=nucleus; Biological process=metal ion transport
  Homolog annotation: Hit_ID=Q2HUZ8; Match level="QueryCoverage=99%, HitCoverage=100%, E-value=0.0, Identity=67%"; Hit description =Helicase, C-terminal; Zinc finger, CCHC-type
  Pfam annotation: Domain name=DEAD; Domain location=118-291; Score =241.7; E_value=1.5e-69; Accession=PF00270.19; Description=DEADDEAH box helicase
  Pfam annotation: Domain name=GUCT; Domain location=523-651; Score =124.4; E_value=3.2e-34; Accession=PF08152.3; Description=GUCT (NUC152) domain
  Pfam annotation: Domain name=Helicase_C; Domain location=361-436; Score=118.9; E_value=1.5e-32; Accession=PF00271.21; Description =Helicase conserved C-terminal domain
  Pfam annotation: Domain name=ResIII; Domain location=114-286; Score= -21.1; E_value=0.0027; Accession=PF04851.6; Description=Type III restriction enzyme, res subunit
  Pfam annotation: Domain name=zf-CCHC; Domain location=740-757; Score =35.8; E_value=1.5e-07; Accession=PF00098.13; Description=Zinc knuckle
  Pfam module annotation: Pfam domain module=DEAD::GUCT::Helicase _C::ResIII::zf-CCHC; Domain location=118-291::523-651::361-436::114 -286::740-757
  Subcellular localization annotation: CTP_CleavageSite=45; ConfidenceScore=5.83e-01
MASTVGISSSISICKNPSFQLLRRPTATTTSVFFNTLPRNRNATLSSLPSAIATPTSSILTEQPFKGLTLDDASNSNQFGYDYEPDTNVSDHELDISKLGLPSPLVHSLQQRGITSLFPIQRAVLVPALEGKDIIARAKTGTGKTLAFGIPILKGLTDDDEQSSHRRSGRLPKALVLAPTRELAKQVEKEIQESAPYLKTVCVYGGVSYVTQQGALSHGVDVVVGTPGRIIDLVNGNSLKLSEVQYLVLDEADRMLAVGFEEDVEVILDKVPAQRQTMLFSATMPGWVKKLSRKYLNNPLTIDLVGEQEEKLAEGIKLYALSATASSKRTVLSDLITVYAKGGKTIVFTQTKKDADEVSMALTSSIASEALHGDISQHQRERTLNGFRQGKFTVLVATDVAARGLDIPNVDLVIHYELPNDAETFVHRSGRTGRAGKEGTAILMYTSSQRRTVRSLERDVGCKFEFVSPPAMEEILESSAEQVVATLNRVHPESVDFFIATAQKLVEEQGARALAAALAQMSGFSQPPSCRSLINHEQGWTTLQLTRDPDTSARYFSARSVTGFLSDVYSPAADEVGKIHLIADERILVRNFSIIKIITTLFNLFQCWYCLYQVQGAVFDLPEEIAKELLTKDLPSGNTISKITKLPPLQDDEPASDFYGKFSDRDRSNRRGSRDQRGFRSSRGWEGGQDSDDEFGQGGRSFRSGNKFRMGKSSGDDWLIGGSSRSSRFSSSNRSGGHGGACFNCGKPGHRASDCTTKKRVFF

SEQ ID NO: 223930 - protein, 162 aa, Glycine max
  Coding DNA Sequence Number=SeqID_107152
MFGRFQVLLNDIEALGNVYSKAQVNLKILDNLLKVHMKNRDQLPHKDFAALKSRERISNKEENKSPTKALKVRIIESEASDDSSIKSIDDEKVGTHDGLMSQAQQKQVLWWARRNVKGASSKRENAWESPPTFFKKNVRKTKKRSVNFEKKGSGVVYGWGRY

SEQ ID NO: 223931 - protein, 62 aa, Glycine max
  Coding DNA Sequence Number=SeqID_107153
MGEKPWSRGWTSGGNMVKSRFGLGVDCGFGFGDRHGPIFVTQGLNHQVWVNAIINYQKPKEF

SEQ ID NO: 223932 - protein, 75 aa, Glycine max
  Coding DNA Sequence Number=SeqID_107154
MAAMMESEGETKYPISRFLFPSILPSGNMHNGHRIIPHIGGAFLQQSTSSWRCLYCTNDPLSARLSKLRLIPFDG

SEQ ID NO: 223933 - protein, 255 aa, Glycine max
  Coding DNA Sequence Number=SeqID_107155
  Gene Ontology: Mol. function=RNA-directed DNA polymerase activity; Cellular component=chromatin; Biological process=chromatin assembly or disassembly
  Subcellular localization annotation: CTP_CleavageSite=28; ConfidenceScore=5.40e-01
REHNSRNKGASNKSQKKNYQTFIPQRVCVRKKFAELAGTGPRSQQQLFPSFVSTFGALVVIMPNPEKDLGSSDQLEDALLRLINQNMYLGESGWIFKINQFFEYHGTPEQDRLTVASFYMEGRALAWYQWMNANGHVTSWSSFLQAMHAHFAPTPYDDPTSALFKLTQKGTVAQYLTEFEDLATHVVGISHPLLLSCFISGLFLEIHREVQAHQPLSMVQAAELARLQEEKVLDQRPLPRPPTPSPFPSQPRPNP

SEQ ID NO: 223934 - protein, 441 aa, Glycine max
  Coding DNA Sequence Number=SeqID_107156
  Gene Ontology: Mol. function=RNA-directed DNA polymerase activity; Cellular component=chromatin; Biological process=chromatin assembly or disassembly
MQGLTFTIDLYVLPISGANIILGVQWLRTLEPVLTDYAKLSMQFFYDDQLVTLQGDKDVNLGMLSSPQFQRLFCKQGPGLYFHITVLTANPTPDPSVDLPADIRTLLIKFGALFHPLHAMPPTRETDHHIHLLPQATPVNVRPYQYPHFQKQEIEAQVASMLQNGLIQPSTSPFSPPILLVKKHDGSWRFCIDYRALNTITIKDRFLIPTIDELLNELGDAQCFSKLDLLQGYHQIRMHFGDIPKTNFRTHHSHYEFKATMNLIFRPYLRCFVIVFLDDILIYSSSFSDHLRHLELTLQVEYLGHLVSSHGVEHVASKVAVVAQWPVPRSTRALQSFLGLASFYRCFIKGYAIIADPLVKATIIEPFQWSPQAQTTFDRLKHALSTALILALPNFHQPFTIETDASGIGMGEVLSQQGHPIAYFSKPFTAKLLRSSTYVRE

SEQ ID NO: 223935 - protein, 967 aa, Glycine max
  Coding DNA Sequence Number=SeqID_107157
  Gene Ontology: Mol. function=RNA-directed DNA polymerase activity; Biological process=RNA-dependent DNA replication
DDLVPLNLEIEATCRKKTTTRGREQQEVQANQGDRGASSSVSSSSFFVIFEEPTMTNSQPIFEEPIMVKDQPPRGNSLQTWEEVVEKFLKKCFSESKTAEGKAEISLFHQIHNESLSEALDRFHGLLRNSSLMLPCTTSSKQAPGQANKNPHGDSEQASSQLHVVLPASSSIMQVGGCNICGGSHESGMVPSRRKFLSKSRPRLEIPILVANTKKNPKEKCKAVLTRSQRKEIVEKEKRVEGAMEDKFKDPGSVIIPCFIGTVSVGKALIDLVASINFMPLSMCRRIENPRIAPTIMTLQLVRQFTFPMDFVIMDIDEDSDIPLILGRPFMLTAKCVLDMGNDNLEMSVEDQKVTLSLFEVIKHPTNSKNCFKVEAIEQEADCLVQCLTFHSILEKALMNFVDCLTNEEEKDLRACLEDLDRLKEISSEEYAFEELKKDNTTEKPKVELKVLCAHLMYVFLEENDAKPVMINNDLSSDEETQLVEVLKKHKAAIGWHIFYLKGISPSYCMHKIMMEANYKQKEVLKLLEDGLIYPISGSAWTVIGWRMCIDYRKLNDATRKDQFPLPFMDQMLERLTGKSFYCFLDGYLGYNQIVVDPKDQEKTAFMCPFGVFAYRRMSFGLHNAPAIFQRCMLVIFANTEGIMLGHKISTWGIEVDKAKIDVIEKLPPPINVKGIKSFLGHDRLVYAPVMVAPDWSKEFELMCDASDYAVGVVLRQQKDKWKKFLHDACFYVWGDPHLFKTGVDNLLRRIKQLRRYYKLDFFGLQSSRTPMIIEVKVEAVAAPENDAKTFIKKACHLLVEIENMVYWALKFLNFDESLSDEKRKLQLVKLEEMRLNAYESSKIYKQKMKAYHDQKLQKKNFQPRQQSKWSGPFTIKDVKPYRVIEFMGPTLIDLEQSWIVNGQRLKIYNGCKAFTIEDVKPYRVIELMVPTLTDPEWSWIINGQRLKIYNGDNIERLTTIIHIQDP

SEQ ID NO: 223936 - protein, 107 aa, Glycine max
  Coding DNA Sequence Number=SeqID_107158
MRRACRKIWRSVPCTSRKSLRNDSRKDMEEILRAKLSTIKEEPELCDENLASPRHVCMAKKQGKKVQGKDKTGRCLVPHDLHPKVPLLGFFNANLYLLSPYSIPIRT

SEQ ID NO: 223937 - protein, 161 aa, Glycine max
  Coding DNA Sequence Number=SeqID_107159
MVVEDLEQLTQKIKDQLEESITQNVTQQLMMSFSHMQSQMQSQGFALPLEIEVGPSAAHVSTKEISVDPPGQDLKMGDSDKFGLYVDDSPPRLVAFGSVYEESTTFHNVPLGNDQVKVGVEEVRDADVRILDKQVAEGPTKPVDMADPDIDPMYLMTLTIP

SEQ ID NO: 223938 - protein, 144 aa, Glycine max
  Coding DNA Sequence Number=SeqID_107160
MIHVDLVTRKVDGPHRKKLRTYLGIVTRDKVDVIYDNWEQVFVAQKDLIWEDIQTEFDIPESFDLRTKKKNTSDRRRAVERSFMGGCLREGTGHSETKHYPHMLSHGGYDFLEKKLMEKQKKQLEEAAQSESTDTVVDPSSPIK

SEQ ID NO: 223939 - protein, 105 aa, Glycine max
  Coding DNA Sequence Number=SeqID_107161
  Subcellular localization annotation: CTP_CleavageSite=53; ConfidenceScore=5.64e-01
MPSSFPPFAISIFFNKSKGSVMANIFVPFPSSPSHKCNIKLWSIFAAMTRQVWAVMVKQALWVTFGYYLWILNFFHLRGKLPCERNSHLTRRFLKYKCEVKSHIV

SEQ ID NO: 223940 - protein, 378 aa, Glycine max
  Coding DNA Sequence Number=SeqID_107162
  Gene Ontology: Mol. function=RNA binding
  Homolog annotation: Hit_ID=Q1T290; Match level="QueryCoverage=88%, HitCoverage=85%, E-value=8e-55, Identity=42%"; Hit description =Cyclin-like F-box
  Pfam annotation: Domain name=F-box; Domain location=31-78; Score =36.9; E_value=6.8e-08; Accession=PF00646.23; Description=F-box domain
MEGKETEGMLKMTTDKRQQKRSRSDREEERDRLSELPDCVVLHIMEFMDTKYAVQTCVLSKRWKDLWKRLTYLGFNTTLFNNVVKFNKFVSRVLSGRDGSVSLLNLEFTRRGMAEPKLFNRLMKYAVLHNVQQFTVSLNLSFRQSFEFRPYIFSCESLTFLKLSFNSFDTSIVALPGSLNMPALKSLQLEAVSFTARDNDYAEPFSTCNVLNTLILDGCSLHKDAKFLSISNSSLSSLTISGSFEGGAYKIVLSTPNLSSLTVTGHNNHTISSACNLSFLEEVTIDTLGYTLFPNTDLLIISWLQVLTNVKILRLYSGTLLTILRDISNPASVSTQPPCCVQLKSLILENQPSADISFEQLKRAVEYLLQNSPQRRID

SEQ ID NO: 223941 - protein, 1123 aa, Glycine max
  Coding DNA Sequence Number=SeqID_107163
  Gene Ontology: Mol. function=G-protein coupled photoreceptor activity; Cellular component=membrane; Biological process=regulation of transcription, DNA-dependent
  Homolog annotation: Hit_ID=P42500; Match level="QueryCoverage=97%, HitCoverage=98%, E-value=0.0, Identity=87%"; Hit description =Phytochrome A
  Pfam annotation: Domain name=GAF; Domain location=218-400; Score =114.5; E_value=3e-31; Accession=PF01590.16; Description=GAF domain
  Pfam annotation: Domain name=HATPase_c; Domain location=1005-1116; Score=57.5; E_value=4.5e-14; Accession=PF02518.16; Description =Histidine kinase-, DNA gyrase B-, and HSP90-like ATPase
  Pfam annotation: Domain name=HisKA; Domain location=893-957; Score =37.0; E_value=6.7e-08; Accession=PF00512.15; Description=His Kinase A (phosphoacceptor) domain
  Pfam annotation: Domain name=PAS; Domain location=618-733; Score =101.4; E_value=2.8e-27; Accession=PF00989.14; Description=PAS domain
  Pfam annotation: Domain name=PAS; Domain location=748-873; Score =113.2; E_value=7.3e-31; Accession=PF00989.14; Description=PAS domain
  Pfam annotation: Domain name=PAS_2; Domain location=69-185; Score =222.1; E_value=1.2e-63; Accession=PF08446.1; Description=PAS fold
  Pfam annotation: Domain name=PAS_4; Domain location=624-738; Score =26.3; E_value=0.00011; Accession=PF08448.1; Description=PAS fold
  Pfam annotation: Domain name=Phytochrome; Domain location=411-590; Score=411.7; E_value=1.1e-120; Accession=PF00360.10; Description =Phytochrome region
  Pfam module annotation: Pfam domain module=GAF::HATPase _c::HisKA::PAS::PAS::PAS_2::PAS_4::Phytochrome; Domain location=218 -400::1005-1116::893-957::618-733::748-873::69-185::624-738::411-590
  Subcellular localization annotation: CTP_CleavageSite=21; ConfidenceScore=5.16e-01
MSTSRPSQSSSNSGRSRRSARAMALATVDAKLHATFEESGSSFDYSSSVRISGTADGVNQPRHDKVTTAYLHHMQKGKMIQPFGCLLALDEKTCKVIAYSENAPEMLTMVSHAVPSVGDHPALGIGTDIKTLFTAPSASALQKALGFAEVLLLNPVLIHCKTSGKPFYAIIHRVTGSMIIDFEPVKPYEVPMTAAGALQSYKLAAKAITRLQSLPSGSMERLCDTMVQEVFELTGYDRVMAYKFHEDDHGEVIAEITKPGLEPYLGLHYPATDIPQASRFLFMKNKVRMIVDCHAKHVRVLQDEKLPFDLTLCGSTLRAPHSCHAQYMANMDSIASLVMAVVVNDNEEDGDTDAIQPQKRKRLWGLVVCHNTTPRFVPFPLRYACEFLAQVFAIHVNKEIELEYQIIEKNILRTQTLLCDLVMRDAPLGIVSESPNIMDLVKCDGAALIYKNKVWRLGVTPSESQIREIAFWLSEYHMDSTGFSTDSLSDAGFPSALSLGDVVCGMAAVRVTAKDVVFWFRSHTAAEIRWGGAKHEAGEKDDGRRMHPRSSFKVFLDVVKARSLPWKEYEIDAMHSLQLILRNAFKDTESMDLNTKAINTRLSDLKIEGMQELEAVTSEIVRLIETATVPILAVDVDGLVNGWNIKIAELTGLPVGEAMGKHLLTLVEDSSTDRVKKMLNLALLGEEEKNVQFEIKTHGSKMDSGPISLVVNACASRDLRDNVVGVCFVAHDITAQKNVMDKFTRIEGDYKAIVQNRNPLIPPIFGTDEFGWCCEWNPAMTKLTGWKREEVMDKMLLGELFGTHMAACRLKNQEAFVNLGVVLNKAMTGLETEKVPFGFFARNGKYVECLLSVSKKLDVEGLVTGVFCFLQLASPELQQALHIQRLSEQTALKRLNALSYMKRQIRNPLCGIIFSRKMLEGTALGTEQKQLLRTSAQCQQQLSKILDDSDLDSIIDGYLDLEMAEFTLHEVLVTSLSQVMTKSNGKSIRIVNDVAEQIVMETLYGDSLRLQQVLADFLLISINFTPNGGQVVVAGTLTKEQLGKSVHLVKLELSITHGGSGVPEALLNQMFGNNGLESEEGISLLISRKLLKLMNGDVRYLREAGKSAFILSAELAAAHNLKG

SEQ ID NO: 223942 - protein, 173 aa, Glycine max
  Coding DNA Sequence Number=SeqID_107164
  Homolog annotation: Hit_ID=Q1T2D5; Match level="QueryCoverage=49%, HitCoverage=6%, E-value=2e-08, Identity=46%"; Hit description=Chromo
MDSAIGIGRQAGDKVAKSASRPLEVVLEGFLPKVNSYGEIPEPKCIEESRQLCPIGTHVASYGGRVILCEQARNKRRPQGQPNATTFKTTMVCKNGEKVTQKILSPFLYRDSNGEEFPHISGSLKEFGDNTAPMPAPDASVYNVKVRVKSNKCRTGAVVSAFFNSLKASSVAE

SEQ ID NO: 223943 - protein, 58 aa, Glycine max
  Coding DNA Sequence Number=SeqID_107165
MALHSLAQSSVEGGYNDWWAAMEVMKMMIGKRWSMVVWGGGRSVGVMWIWKYALASSF

SEQ ID NO: 223944 - protein, 132 aa, Glycine max
  Coding DNA Sequence Number=SeqID_107166
MAREKEWSREKETLELGRKEMEVVYYGRNDNHPPVSPLANAPSPPPGPGSEVAELVPPGECPSRVVILGGGEPGLKCLKERGPRSELTITGHPLKPRQSSTFHVAGSYSKAFMCAEDGETRIRIAVDNEGEW

SEQ ID NO: 223945 - protein, 67 aa, Glycine max
  Coding DNA Sequence Number=SeqID_107167
MKVGYVVRNAIAHTFTDGICEIIFVEGEKESHEDSTSGGFNPFSVSLTFGNSIRAVGGKIGGILGKR

SEQ ID NO: 223946 - protein, 378 aa, Glycine max
  Coding DNA Sequence Number=SeqID_107168
  Gene Ontology: Mol. function=RNA binding
  Homolog annotation: Hit_ID=Q1T290; Match level="QueryCoverage=82%, HitCoverage=78%, E-value=9e-54, Identity=43%"; Hit description =Cyclin-like F-box
  Pfam annotation: Domain name=F-box; Domain location=31-78; Score =36.9; E_value=6.8e-08; Accession=PF00646.23; Description=F-box domain
MEGKETEGMLKMTTDKRQQKRIRSDREDERDRLSELPDCVVLHIMEFMDTKYAVQTCVLSKRWKDLWKRLTYLGFNTTLFNNVVKFNKFVSRVLSGRDGSVSLLNLEFTRCGMAEPKLFNRLMKYAVLHNVQQFTVSLNLSFRQSFEFRPYIFSCESLTFLKLSFNSFDTSIVALPGSLNMPALKSLQLEAVSITARDNDYAEPFSTCNVLNTLILDGCSLHKDAKFLSISNSSLSSLTISGSFEGGAYKIALSTPNLSSLTVTGHNNHTISSACNLSFLEEVTIDTLGYTLFPNTDLLIISWLQVLTNVKILRLYSGTLLTILRDISNPVSVSTQPPCFVQLKSLILANQPSADISFDQLKRAVEYLLQNSPQRRID

SEQ ID NO: 223947 - protein, 316 aa, Glycine max
  Coding DNA Sequence Number=SeqID_107169
  Gene Ontology: Mol. function=nuclease activity; Cellular component =nucleus; Biological process=DNA repair
  Homolog annotation: Hit_ID=Q1S2G9; Match level="QueryCoverage=100%, HitCoverage=84%, E-value=1e-141, Identity=77%"; Hit description =Helix-hairpin-helix motif, class 2
  Pfam annotation: Domain name=5_3_exonuc; Domain location=210-301; Score=-4.6; E_value=0.00037; Accession=PF01367.11; Description=5'-3' exonuclease, C-terminal SAM fold
  Pfam annotation: Domain name=XPG_I; Domain location=127-229; Score =75.5; E_value=1.6e-19; Accession=PF00867.9; Description=XPG I-region
  Pfam annotation: Domain name=XPG_N; Domain location=1-88; Score=93.3; E_value=7.3e-25; Accession=PF00752.8; Description=XPG N-terminal domain
  Pfam module annotation: Pfam domain module=5_3_exonuc::XPG_I::XPG_N; Domain location=210-301::127-229::1-88
MGIKGLTKLLADNAPKSMKENKFESYFGRKIAIDASMSIYQFLIVVGRSGTEMLTNEAGEVTRYVFDGKPPDLKKQELAKRYSKRAEATEDLSEALETANKEDIEKFSKRTVKVTKQHNDDCKRLLRLMGVPVVEALVSTGTLRSRGSVCCPLQSWKGKFISVVYAVASEDMDSLTFGSPKFLRHLMDPSSKKIPVMEFEVAKILEELNMTMDQFIDLCILSGCDYCDSIRGIGGLTALKLIRQHGSIENILENLNKERYQIPDNWPYQEARRLFKEPMVITDEKELDIKWSSPDEEGLITFLVNENGFNSDRVTK

SEQ ID NO: 223948 - protein, 191 aa, Glycine max
  Coding DNA Sequence Number=SeqID_107170
  Gene Ontology: Cellular component=cellulose and pectin-containing cell wall
  Homolog annotation: Hit_ID=Q15B61; Match level="QueryCoverage=60%, HitCoverage=51%, E-value=3e-52, Identity=79%"; Hit description =Pectin acetylesterase
  Pfam annotation: Domain name=PAE; Domain location=45-189; Score=88.3; E_value=2.3e-23; Accession=PF03283.4; Description=Pectinacetylesterase
MRTGNLFWLGIVAALVFSFWVDAFSANQYYPHHHFNETEFSSLESQEQAHSSLLGRTPLMVGLTLIQSAAAKGAVCLDGTLPGYHLHRGYGSGANSWVVNLEGGGWCNDVRSCVYRKKTRRGSSTFMEKQIPFTGILSNSAEDNPDFFNWNRVKIRYCDGASFAGDGEDKVDFDVLELLKIETMFNSVEAD

SEQ ID NO: 223949 - protein, 236 aa, Glycine max
  Coding DNA Sequence Number=SeqID_107171
  Gene Ontology: Cellular component=cellulose and pectin-containing cell wall
  Homolog annotation: Hit_ID=Q153F8; Match level="QueryCoverage=98%, HitCoverage=72%, E-value=1e-115, Identity=78%"; Hit description =Pectin acetylesterase
  Pfam annotation: Domain name=PAE; Domain location=1-220; Score=374.1; E_value=2.2e-109; Accession=PF03283.4; Description=Pectinacetylesteras e
VAQLQFRGQRIWLAAMEDLKSKGMRFAKQALLSGCSAGGLATIIHCDEFRGFFPETTKVKCLSDAGLFLDAIDVSRGHTIKNLFSGVVRLQCFFPQNLIAGIRTPLFILNTAYDSWQVQTSLAPSSADPHGFWHDCRLNHAKCTSSQIQYLQGFRNQMLNAIKGFSRSPQNGLFINSCFAHCQSERQDTWFADNSPVIGNKAIALAVGDWYFDRAVVKAIDCPYPCDNTCHHLVFR

SEQ ID NO: 223950 - protein, 67 aa, Glycine max
  Coding DNA Sequence Number=SeqID_107172
  Gene Ontology: Mol. function=catalytic activity; Biological process =metabolic process
  Subcellular localization annotation: CTP_CleavageSite=21; ConfidenceScore=5.02e-01
MTALLTGGCSSTYFPTPTPNRCSTSQTTFLEEEDHRREERVANSRMRFWKLSGGREDGGYKGNTQTF

SEQ ID NO: 223951 - protein, 147 aa, Glycine max
  Coding DNA Sequence Number=SeqID_107173
MTGFFGAMFLNQSMGAEVIWQKYEVARIQLSNVEYWRLGSCRDAKFWLDNRNGDTVFGLWLTSIAGYSQILVIRMPWWLKWDIRYPPKKTMLFLEGPMGIGKLCCVAAWDLAKHRAWAWINAKGKGRKFSYCEWEMNPRACLNCLTL

SEQ ID NO: 223952 - protein, 128 aa, Glycine max
  Coding DNA Sequence Number=SeqID_107174
MHLLGYDDIFTTNTSLTRVRAVPAYSFSINTLEELNYQTEQLHEGCKGKESGKREREEEAVRSETLFEGDSFETGRDRGKALKGRFSGVLVSRLSILRRKRRGAKIQEDDDSPESSSKDHACSFMHYF

SEQ ID NO: 223953 - protein, 827 aa, Glycine max
  Coding DNA Sequence Number=SeqID_107175
  Gene Ontology: Mol. function=protein serine/threonine kinase activity; Cellular component=cell surface; Biological process =protein amino acid phosphorylation
  Homolog annotation: Hit_ID=O64477; Match level="QueryCoverage=94%, HitCoverage=95%, E-value=0.0, Identity=58%"; Hit description =Putative receptor-like protein kinase
  Pfam annotation: Domain name=B_lectin; Domain location=75-189; Score =138.3; E_value=2.1e-38; Accession=PF01453.15; Description=D-mannose binding lectin
  Pfam annotation: Domain name=PAN_1; Domain location=346-431; Score =5.1; E_value=0.049; Accession=PF00024.16; Description=PAN domain
  Pfam annotation: Domain name=PAN_2; Domain location=346-412; Score =102.3; E_value=1.5e-27; Accession=PF08276.2; Description=PAN-like domain
  Pfam annotation: Domain name=Pkinase; Domain location=496-766; Score =167.2; E_value=4.1e-47; Accession=PF00069.15; Description=Protein kinase domain
  Pfam annotation: Domain name=Pkinase_Tyr; Domain location=497-766; Score=83.3; E_value=7.6e-22; Accession=PF07714.7; Description =Protein tyrosine kinase
  Pfam annotation: Domain name=S_locus_glycop; Domain location=204-329; Score=184.6; E_value=2.4e-52; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=75-189::346- 431::346-412::496-766::497-766::204-329
  Subcellular localization annotation: CTP_CleavageSite=43; ConfidenceScore=5.05e-01
MRNNKPQLWLSLSLFITCFSFHTSLAALTTISANQSLSGDETLVSQGGEFELGFFNTGNNSNKFYIGMWYKKISQRTYVWVANRDQPVSDKNSAKLTILDGDLVLLDQYQNLVWSTNLNSPSSGSVVAVLLDSGNLVLSNRANASASDAMWQSFDHPTDTWLPGGKIKLDNKTKKPQYLTSWKNREDPAQGLFSLELDPAGRNAYLILWNKSEQYWTSGAWNGHIFSLVPEMRLNYIYNFTFQSNENESYFTYSVYNSSIITRFVMDGSGQIKQLSWLDNAQQWNLFWSQPRQQCEVYAFCGGFGSCTENAMPYCNCLNGYKPKSQSDWNLNDYSGGCVKKTNFQCENPNSSNKDKDRFLPILNMKLPNHSQSIGAGTSGECEATCLSNCSCTAYAYDNSGCSIWNGDLLNLQQLTQDDSSGQTLFLRLAASEFHDSKSNKGTVIGAAGAAAGVVVLLIVFVFVMLRRRRRHVGTGTSVEGSLMAFSYRDLQNATKNFSDKLGGGGFGSVFKGTLADSSIIAVKKLESISQGEKQFRTEVSTIGTVQHVNLVRLRGFCSEGTKKLLVYDYMPNGSLESKMFYEDSSKVLDWKVRYQIALGTARGLNYLHEKCRDCIIHCDVKPENILLDADFVPKVADFGLAKLVGRDFSRVLTTMRGTRGYLAPEWISGVAITAKADVYSYGMMLFEFVSGRRNSEASEDGQVRFFPTYAANMVHQGGNVLSLLDPRLEGNADLEEVTRVIKVASWCVQDDESHRPSMGQVVQILEGFLDLTLPPIPRTLQAFVDNHENIVFFDDSSSTQSSQVKSNASSASSQAKSNISSSKSST

SEQ ID NO: 223954 - protein, 257 aa, Glycine max
  Coding DNA Sequence Number=SeqID_107176
MRSFSKNKFLLCFRPVVDIDCMIKSEVAPHRSSTCRFPRIPSSENHNVMKNSETKSVYFPHLSPKRRISRNRRDHHKNRYIHDSFGPKYLSYGGETKTLQSPLSTSSSSHGLASPSLSSHASSFQSKNVSSYYSTKEKRKEGTGHGGPLEKQKKFECLGIYLILISLAFTVFWGKLFGIILTSTLLYFFAVWDSSSPCQKRFPSCPRPRQSLQGKDNRNYFTGRNYHMAMVPINFHKNGREKFFQKVEFIGKYAPRQ

SEQ ID NO: 223955 - protein, 139 aa, Glycine max
  Coding DNA Sequence Number=SeqID_107177
  Gene Ontology: Mol. function=RNA-directed DNA polymerase activity; Cellular component=intracellular; Biological process=RNA-dependent DNA replication
MPDLSSDIVQHRLPLNPKCSPIKQKLRRMRPETSLKIKEEVKKQFDAGFLVVARYPEWVANIVPVPKKDGKMAPEDMEKTTFITLWGTFCYKVMSFGLKNIGATYQRAMVALFHDMMHREIKIYVDDMIAKSKTEEEHL

SEQ ID NO: 223956 - protein, 35 aa, Glycine max
  Coding DNA Sequence Number=SeqID_107178
MSTSSCRLSGSSPESYSLAPYCCHSAPTKKVCDHH

SEQ ID NO: 223957 - protein, 237 aa, Glycine max
  Coding DNA Sequence Number=SeqID_107179
  Gene Ontology: Mol. function=protein binding; Cellular component =integral to membrane; Biological process=defense response to fungus
  Homolog annotation: Hit_ID=Q1SWI6; Match level="QueryCoverage=82%, HitCoverage=87%, E-value=9e-44, Identity=45%"; Hit description =Leucine-rich repeat, plant specific
  Pfam annotation: Domain name=LRRNT_2; Domain location=5-45; Score =49.5; E_value=1.2e-11; Accession=PF08263.3; Description=Leucine rich repeat N-terminal domain
  Pfam annotation: Domain name=LRR_1; Domain location=115-137; Score =14.9; E_value=0.29; Accession=PF00560.23; Description=Leucine Rich Repeat
  Pfam annotation: Domain name=LRR_1; Domain location=162-187; Score =11.6; E_value=1.9; Accession=PF00560.23; Description=Leucine Rich Repeat
  Pfam annotation: Domain name=LRR_1; Domain location=189-211; Score =14.3; E_value=0.44; Accession=PF00560.23; Description=Leucine Rich Repeat
  Pfam annotation: Domain name=LRR_1; Domain location=88-113; Score =6.4; E_value=18; Accession=PF00560.23; Description=Leucine Rich Repeat
  Pfam module annotation: Pfam domain module=LRRNT_2::LRR_1::LRR_1::LRR_ 1::LRR_1; Domain location=5-45::115-137::162-187::189-211::88-113
ESVCIPSERETLLKFKNNLIDPSNRLWSWNHNNTNCCHWYGVLCHNLTSHLLQLHLNSSDSIFNDDWEAYRRWSFGGEISPCLADLKHLNYLDLSANEYLGEGMSIPSFLGTMTSLTHLNLSHTGFMGKIPPQIGNLSNLVYLDLRAVADGAVPSQIGNLSKLQYLDLSGNYFLGEGMAIPSFLGTMTSLTHLDLSYTGFYGKIPPQIGNLSNLLYLGLGGHSSLEPLFVENVEWVS

SEQ ID NO: 223958 - protein, 109 aa, Glycine max
  Coding DNA Sequence Number=SeqID_107180
MAPKKLPAKRSRKDATGEGSSAAPQADVDFDRHRFRSVEHQQRFEAIKGCSFLRERRVLLRDEDFWGIHRFWRKASTVSSHRGGVRPPASMRRLSIGCYACQGRTLPRA

SEQ ID NO: 223959 - protein, 92 aa, Glycine max
  Coding DNA Sequence Number=SeqID_107181
MLPALCLRSPNTTPAPGIGKESHTNPKHFGVNYAFQVPIATKYRYVITKVPFYMLITCLKRVFLQHLRSTHSNDLRLQKTTKAQTETQNRIV

SEQ ID NO: 223960 - protein, 156 aa, Glycine max
  Coding DNA Sequence Number=SeqID_107182
MHLKCDTSVEASFMMMNQAILMMPKAQVIDSRLIQDFKIKHQESNPRFKIQKKKSRSNKGYIYLGCNTENKRGYISCGSVQVEGTSTWFFKENKEGYIPCGSMLVKDLQGYWKSQEPVIAWGLDVGTGCGRTRHGSERDGKHNGKRNSGHGVREDQ

SEQ ID NO: 223961 - protein, 131 aa, Glycine max
  Coding DNA Sequence Number=SeqID_107183
  Gene Ontology: Mol. function=nucleic acid binding; Biological process= DNA integration
MPKYAKFLKGIISNKKKLEDFAIVSLNKECSIIVLNKLYLKLKDPRSFLVPSTTGNLSFDRALCDVGRLTWWLGEEEEVFKMFGTTKSSFSPLSCNLVQSTNKVKVTVAKPHSSVGKKDPPGNKVIPKDPG

SEQ ID NO: 223962 - protein, 402 aa, Glycine max
  Coding DNA Sequence Number=SeqID_107184
  Gene Ontology: Mol. function=sequence-specific DNA binding; Cellular component=nucleus; Biological process=regulation of transcription, DNA-dependent
  Homolog annotation: Hit_ID=O04136; Match level="QueryCoverage=99%, HitCoverage=100%, E-value=1e-162, Identity=72%"; Hit description =Homeobox protein knotted-1-like 3
  Pfam annotation: Domain name=ELK; Domain location=302-323; Score =35.1; E_value=2.5e-07; Accession=PF03789.4; Description=ELK domain
  Pfam annotation: Domain name=Homeobox; Domain location=324-381; Score= -11.0; E_value=0.07; Accession=PF00046.19; Description=Homeobox domain
  Pfam annotation: Domain name=KNOX1; Domain location=137-181; Score =74.5; E_value=3.4e-19; Accession=PF03790.4; Description=KNOX1 domain
  Pfam annotation: Domain name=KNOX2; Domain location=190-245; Score =105.9; E_value=1.2e-28; Accession=PF03791.4; Description=KNOX2 domain
  Pfam module annotation: Pfam domain module=ELK::Homeobox::KNOX1::KNOX2 ; Domain location=302-323::324-381::137-181::190-245
MAYHNPQDLPLHHFTDQQQHHNHTLPHNSLLSDPASKPASDPHQPAPNWLNNALLRTDYTHTTTTTTTNTAANNSNNSTNFLNLHTSASDSGQWQARPILNRNHSEVIDDVAGAGAESGDLKGETAPVDGLLNWQNARLKAEILTHPLYEQLLSAHVACLRIATPVDQLPRIDAQLAQSQNVVAKYSAFGQAIVGDDKELDQFLSHYVLLLCSFKEQLQQHVRVHAMEAVMACWEIEQSLQSLTGVSPGEGTGATMSDDEDEQVDSDANLFDGALDGPDSMGFGPLIPTENERSLMERVRHELKHELKQGYKDKIVDIREEILRKRRAGKLPGDTTSVLKAWWQSHSKWPYPTEEDKARLVQETGLQLKQINNWFINQRKRNWHSSPSTSTVLKSKRKRYSY

SEQ ID NO: 223963 - protein, 213 aa, Glycine max
  Coding DNA Sequence Number=SeqID_107185
  Gene Ontology: Mol. function=nucleic acid binding
  Homolog annotation: Hit_ID=Q1T034; Match level="QueryCoverage=92%, HitCoverage=40%, E-value=6e-12, Identity=24%"; Hit description=Zinc finger, CCHC-type
MVTWDDLYSEKSSSSYDEQANICLMVDIDDKVEVKTYFEFDTSSCASSNNEEDMPYDVLLQNYHMIYLQCKRFKEKFKVFAYEHIELKKSNQDLKKKIQTLKKSLSLASKTDETSIVEKLREEVACLTNDFGKFLETSKTFTTLLKFHQHPHDKSSLGLEKGTTSSKCTHKKKQMSKSTNYVGPKKIWVPKSQIVPIAYILGRKRPGFKLIPR

SEQ ID NO: 223964 - protein, 126 aa, Glycine max
  Coding DNA Sequence Number=SeqID_107186
  Homolog annotation: Hit_ID=Q9ZTB2; Match level="QueryCoverage=92%, HitCoverage=25%, E-value=1e-50, Identity=82%"; Hit description =Nodulin
MELLRKTLIIVKKKETEGLWAHGQAQGAYLRTLLDAFGGNYGSLRDYLMINSGMFQEIAKTNADAIRGLEPKISIWTNGGEANGASGGIKEVAGVYKMLPPLFKTVQEQTGMLPPAWMGTLPDNSS

SEQ ID NO: 223965 - protein, 204 aa, Glycine max
  Coding DNA Sequence Number=SeqID_107187
MVDKSVLIPKADCYKGKEKMHSQHDMLKQDQADSSNMKWLLYIKNRNLQVEGGNLYKGIMDFEPIPLVWNLRRSHHQIEFIPRQVAAIRLSITIPLWLIHHPTTFAMEARFCFHLPYSSFTFVHHVQPIIEEVNSNDEIPIVVVDMTMEVYNDPPPSLEEAKRWKVLGEHLLRKCVDVLFDSSIDDESGDELFHKLKVEEEVVN

SEQ ID NO: 223966 - protein, 194 aa, Glycine max
  Coding DNA Sequence Number=SeqID_107188
  Gene Ontology: Mol. function=RNA-directed DNA polymerase activity; Biological process=RNA-dependent DNA replication
MGPGSQARRDHEYHQLELLGSGQPERSGVLVLLWTKPFDCNLINFSQNFINVSVHEASSPVWRLTGYYGYLERQRRRESWNLLRYLVADTSLPWCIFADFNDHPTWLLRGFRETIINCNLHDLPMEGHQYTWARRRGKHDFMEDKHVRGLATMNWIYIFPNFKLTNGILAKSDHSPILIYLNNALRKKTQKIQI

SEQ ID NO: 223967 - protein, 506 aa, Glycine max
  Coding DNA Sequence Number=SeqID_107189
MTPPRKNEPSNIPIINNVEDAIQGFPEDWFIPTKWIHFQNLKEEGFDVKGLFGKVGWKPFLEKFNTWHYGPYALFWGTIRQDGVRIKGTVVETRVVISSTTIVAAFGCAMDGLTMSKDWEKDITQESVDKVLYVKPYPNGDDKKALNTFLRIANLTYMCRMIHSVLFNIFMPRVVSGDYVSDKDCFYIYKIMVGEEEAYSLWNALHLDPKACWSGEPEPSLPILAPPSSEVEILEIHTPVPLSLLAFPSHRSPKPASTPLYKAEVVAIAKAKQCLIVDAKRRAKSDKTTKTKAQEETSRKLRQATASDQVLDEVVLKAAKVASEEELQKEEFDARVQSTLETTLHVAMLQSVIEVSLQGSDVVAGSNSIETDPGVSPLHSHVVADDPEVVLDALLGQPMLELNISRLESIYEATKSISFDAMKKIELQKLNLVKLWKEGMSRIDSFSYSSSETLEEEKVHALFNYIGRESHIREFLSRNPFAPNLNNIIFEYISSKRKVYPLGATI

SEQ ID NO: 223968 - protein, 86 aa, Glycine max
  Coding DNA Sequence Number=SeqID_107190
MLGACVLVVVRGGHPNFEIGISLPNHVLIPPRCPSQAKYWTVYNLSNIDSYDMEYNPPSIESNGIKCSRVGHPYSVLRFLRHPSRV

SEQ ID NO: 223969 - protein, 77 aa, Glycine max
  Coding DNA Sequence Number=SeqID_107191
MAQPPTRMCGGLIQIKTIFFELHFVVENDCSGQSKAKRYIIIISMEQLRRREFGSKSDTQIMLFARVKRDVHFVLLS

SEQ ID NO: 223970 - protein, 92 aa, Glycine max
  Coding DNA Sequence Number=SeqID_107192
VEGVTRSTKATAPSTLVEAREEEVLDDDGEEEREALDLLNMLKKEEEMLFAIKDRQSKVVQCLDGDKEFSRDVFDERAKKAEAWHCDSAVCG

SEQ ID NO: 223971 - protein, 89 aa, Glycine max
  Coding DNA Sequence Number=SeqID_107193
MKKRDTGYQSVSLENKTGDSTVLKIGDSAKVVMKQDMKGRKHKYGFNNNKREKTEKKRVVDDETGDKHDLYDCSYIAVVQVLGVGASLI

SEQ ID NO: 223972 - protein, 107 aa, Glycine max
  Coding DNA Sequence Number=SeqID_107194
AIEGGEDYAFANLEELFLVPNIITPPKFRVLDFDKYKGTTCPKNHLKMYCQKMRVYAKDEELLIHSFQESLTGVAVTWYTSLEPSRAHDWKDLMVTFVRQCHYNGFG

SEQ ID NO: 223973 - protein, 92 aa, Glycine max
  Coding DNA Sequence Number=SeqID_107195
MASSSVKCSIGMPAGDPCGVLSSSTGVDTGDAYGLASAIIGSASGSVSGIGASAVDVWGATEDGPSDPLTLALRVPRKMTVGSSKFQQFFFM

SEQ ID NO: 223974 - protein, 91 aa, Glycine max
  Coding DNA Sequence Number=SeqID_107196
MYNSIITYIGLHCSAHWQMVIILPKENVVIWFCSLHTRPDNYLKGIINSALKDLTILHKVNPRLVLGGLLLKQKGSTECGYYVMHWMSTII

SEQ ID NO: 223975 - protein, 72 aa, Glycine max
  Coding DNA Sequence Number=SeqID_107197
MGEQWRQFKYDLTSKWAFAADKESVDDTDMRKKAQANQKHNIAPHVLSREGYEYSENKLMDEKRKKKLEEAA

SEQ ID NO: 223976 - protein, 232 aa, Glycine max
  Coding DNA Sequence Number=SeqID_107198
GNGYGGEKTEPTVDLEGGCGISVTGVRVVKVGVLNIRIGLGVGNGMRQAPRKTEGDKLNEIEGLGHVTIPKSRAVMTVGESMTNSLSVTSDTNRFSANQAEPATATSGYTGNSASTKRCRRKKTFAELKEEESSLLKESIYLKKLDVGSKYQNNPSSTSVEPQRLPAGQPHQRIVVSTEALIRPIQEDTHSLASESRPNRIKSTGESFFLIPDLNMVPSEDVSCTDALCGMS

SEQ ID NO: 223977 - protein, 46 aa, Glycine max
  Coding DNA Sequence Number=SeqID_107199
MYLRLVVLISSLVLLGENKPRKTKSEVAEENEDGNRVKEKVLRTEK

SEQ ID NO: 223978 - protein, 108 aa, Glycine max
  Coding DNA Sequence Number=SeqID_107200
MREEEMVENITSILQKKNKVNGGVESFIPHPSHPLTEAPSLRNHAPPSIRSSESPPFSTMPFTVGQGGQSARISGSLRCKSAVSADSAHVASVYQKLTLKRRISKICS

SEQ ID NO: 223979 - protein, 975 aa, Glycine max
  Coding DNA Sequence Number=SeqID_107201
  Gene Ontology: Mol. function=cellulose synthase (UDP-forming) activity; Cellular component=membrane; Biological process=cellulose biosynthetic process
  Homolog annotation: Hit_ID=Q2IB43; Match level="QueryCoverage=99%, HitCoverage=100%, E-value=0.0, Identity=78%"; Hit description =Cellulose synthase 1
  Pfam annotation: Domain name=C1_3; Domain location=7-40; Score=8.5; E_ value=0.051; Accession=PF07649.3; Description=C1-like domain
  Pfam annotation: Domain name=Cellulose_synt; Domain location=161-969; Score=2082.3; E_value=0; Accession=PF03552.5; Description=Cellulose synthase
  Pfam module annotation: Pfam domain module=C1_3::Cellulose_synt; Domain location=7-40::161-969
MMESGAHFCNSCGEQIGLDANGEVFVACHECYFPICKACFEYEINEGRKVCLRCATPYADRAKDNNDTKVYENQSTTAAQINVSQDVGLHARHVSTVSTVDSELNDESGNPIWKNRVESWKEKDKKKKKKKSAPKAENEAPIPPEQQMEEMQSSEAAAAEPLSMVIPISKTRLAPYRTVIIVRLIILGLFFHYRVTNPVDSAFGLWLTSIICEIWFAFSWVLDQFPKWSPVNREAFIDRLSLRYERPGEPSQLAAVDFFVSTVDPLKEPPLITANTVLSILAVDYPVDKVSCYVSDDGAAMLSFESLVETADFARKWVPFCKKFSIEPRAPEFYFSQKIDYLKDKVQPSFVKERRAMKREYEEFKVRVNALVAKAQKTPDEGWTMQDGTSWPGNNSRDHPGMIQVFLGHSGAHDIEGNELPRLVYVSREKRPGYQHHKKAGAENALVRVSAVLTNAPFILNLDCDHYVNNSKAVREAMCFLMDPVVGRDLCYVQFPQRFDGIDRSDRYANRNTVFFDVNMKGLDGIQGPMYVGTGCVFNRQALYGYSPPSMPKLPKSSSCCCCPSKKQTKDVSELYRDAKREELDAAIFNLREIDNYDEYERSMLISQMSFEKTFGLSTVFIESTLMENGGLPESADPSMLIKEAIHVISCGYEEKTAWGKEIGWIYGSVTEDILTGFKMQCRGWRSVYCMPLRPAFKGSAPINLSDRLHQVLRWALGSVEIFFSRHCPLWYGFAGGRLKWLQRLAYINTIVYPFTSLPLVAYCTLPAICLLTGKFIIPTLSNLASALFLGLFLSIIVTSVLELRWSGVTIEALWRNEQFWVIGGVSAHLFAVFQGFLKMLAGVDTNFTVTAKAADDTEFGDLYIIKWTTLLIPPTTLIIINMVGVVAGFSDALNGGYESWGPLFGKVFFAFWVIFHLYPFLKGLMGRQNRTPTIVILWSVLLASVFSLVWVKINPFISRPDSASISQTCISIDC

SEQ ID NO: 223980 - protein, 90 aa, Glycine max
  Coding DNA Sequence Number=SeqID_107202
  Subcellular localization annotation: CTP_CleavageSite=67; ConfidenceScore=5.03e-01
MTRAYIQSSSNLLRFPFLVKIIYKQRATKDVPSLVLFDQPSRCTLYLKRTTKDVPSLVFTITTKKLPASYTKFSNVQFFEFSIWAKNSQT

SEQ ID NO: 223981 - protein, 60 aa, Glycine max
  Coding DNA Sequence Number=SeqID_107203
MDVQGKVAICCFSQNSALERMLNDGDCLKSKCHIKESLEHSTGVMATMEHNHYLSKILLG

SEQ ID NO: 223982 - protein, 563 aa, Glycine max
  Coding DNA Sequence Number=SeqID_107204
  Gene Ontology: Mol. function=transporter activity; Cellular component= membrane; Biological process=transport
  Homolog annotation: Hit_ID=Q6DXT0; Match level="QueryCoverage=99%, HitCoverage=99%, E-value=0.0, Identity=83%"; Hit description =Putative permease
  Pfam annotation: Domain name=Xan_ur_permease; Domain location=31-477; Score=121.4; E_value=2.5e-33; Accession=PF00860.11; Description =Permease family
MAAPKPEEISHPPMDQLQGLEYCIDSNPSWVETIVLGFQHYILALGTAVMIPSFLVPLMGGSDKIDIDISNIDTMIQDDKVRVVQTLLFVEGINTLLQTLFGTRLPTVIGGSYAFMVPIISIIHDSSLTRIEDPHLRFLNTMRAVQGAMIVASSIQIILGFSQLWAICSRFFSPLGMVPVIALVGFGLFDRGFPVVGHCVEIGIPMLILFVVFSQYLKNFHTRQLPILERFALLISTTVIWAYAHLLTASGAYKHRPDLTQHNCRTDRANLISSAPWCQEASTFELLPMTLLHVAYRIKIPYPLEWGAPTFDAGHAFGMMAAVLVSLIESTGAYKAASRLASATPPPAHVLSRGIGWQGVGILLNGLFGTLTGSTVSVIIHYRENVGLLGSTRVGSRRVIQISAGFMIFFSMLGKFGALFASIPFPIFAAVYCVLFGLVASVGLSFLQFTNMNSMRNLFILGVALFLGFSVPEYFREYTSKALHGPTHTRAGWFDDFLNTIFFSSPTVALIVAVFLDNTLDYKDSAKDRGMPWWAKFRTFNGDSRNEEFYTLPFNLNRFFPPR

SEQ ID NO: 223983 - protein, 44 aa, Glycine max
  Coding DNA Sequence Number=SeqID_107205
MHLSNSPLIDPYRYARARPPIKEPYEGKIKHKPSQESGKGLKEY

SEQ ID NO: 223984 - protein, 439 aa, Glycine max
  Coding DNA Sequence Number=SeqID_107206
  Homolog annotation: Hit_ID=Q1RV51; Match level="QueryCoverage=99%, HitCoverage=94%, E-value=1e-113, Identity=54%"; Hit description =HCNGP-like
  Pfam annotation: Domain name=HCNGP; Domain location=266-351; Score =124.5; E_value=2.9e-34; Accession=PF07818.3; Description=HCNGP-like protein
MASKKKHSEGIALLSMYNDEEDDEMEDAEDDDGEEEEVDAGMRMEEDVAGDAKFSAGEDSANRTAAVDSGNEGGADVGFIPAEKSRVGTSTPQTNNLISPPLEQPRIGRKGALTIVDYGHDEVAMSPEPEEGEIYGSGRVMIGDQLHYSIYCVLTWVFVNEVEQKECIDGSVSLLVMLMNGYVNTKGNNSMLYLMEYVIAGDLQDRSPLGTVQVLTPSNQANTPQFSEPLKSDTMNKDAMIRSDDAEFGEADQDEQKYVDPLDKFLPPPSKTKCSEELQAGKSFNAEVRNRKDYRNPDFLLHAVRYQDIDQIGSCFSKDVFDPHGYDPSDFYDEIEADMRRESERKEQEKKKAQKVEFISGGAQPGIVASASRISMPIAGASAVTASGLPLVPPTADSINRDGRQNKKSKWDKDSVSTIGVHAAILSAANAGGGYMQFA

SEQ ID NO: 223985 - protein, 97 aa, Glycine max
  Coding DNA Sequence Number=SeqID_107207
  Subcellular localization annotation: CTP_CleavageSite=49; ConfidenceScore=5.51e-01
MNPKSHRTSRNRKKRPVPGPARPTTSSKSQVNNKPPQQLVMGQVKILKRGELLSQTTPDPQPQTESVEKKTETVVKKGLTSTVEAGRSSQECKSLIA

SEQ ID NO: 223986 - protein, 257 aa, Glycine max
  Coding DNA Sequence Number=SeqID_107208
  Gene Ontology: Mol. function=zinc ion binding
  Homolog annotation: Hit_ID=Q1SZI5; Match level="QueryCoverage=97%, HitCoverage=87%, E-value=7e-58, Identity=49%"; Hit description=Zinc finger, RING-type; RINGv
  Pfam annotation: Domain name=zf-C3HC4; Domain location=158-219; Score= 30.6; E_value=5.4e-06; Accession=PF00097.15; Description=Zinc finger, C3HC4 type (RING finger)
MDQHRGEVLDPVHDRNLSHSVEGVAIARASISGEVGEVDEDLGSDKELKDDVKGQDKHDQENISDKLPGVDQGTSYNSNNLVNQEVIETVVVIESVQTEYANEDNTKLEAKVDESGLSLVSMKAPKGVSETDKNSCVIDIKCSSRKKIYKSSEGERICRICHLTSGQSSDATTVGTSDSATSADLIQLGCACKGKPGIAHVHCALAWFKLKGNMLCEICGEAAKNVSGVTINGFMEEWNERRLMDTEGNASHRVVGC

SEQ ID NO: 223987 - protein, 87 aa, Glycine max
  Coding DNA Sequence Number=SeqID_107209
MAVPKKILKIQIAQCSSSLRDHEVNIEKLDTTLRGSVQICTAQSFSSRYSYIVFSFAKKSCMFASNDLKIERRLVTCFNACLVDHIE

SEQ ID NO: 223988 - protein, 58 aa, Glycine max
  Coding DNA Sequence Number=SeqID_107210
MVDACDFLLVNVVCTIDQYKSWTEKHNVNSGVWIIYENGWYKQFVGVSLHHHPLFLFL

SEQ ID NO: 223989 - protein, 91 aa, Glycine max
  Coding DNA Sequence Number=SeqID_107211
  Subcellular localization annotation: CTP_CleavageSite=15; ConfidenceScore=5.15e-01
MATPSSSPLPESASSLSMSKRIRKAIQLRSYSARLVRVERPLVHVDPTTWKADGPHQKKLRTYLGAKFDILEVSDKRTKKKILQIAAVSTS

SEQ ID NO: 223990 - protein, 185 aa, Glycine max
  Coding DNA Sequence Number=SeqID_107212
  Gene Ontology: Mol. function=protein binding; Biological process =lipid metabolic process
  Pfam annotation: Domain name=Transposase_21; Domain location=113-185; Score=-101.1; E_value=5.6e-06; Accession=PF02992.5; Description =Transposase family tnp2
VEPVHLLVDAWATAIASSANQALAPMYDTLESDLKKPLYSRCKKSLTLLSAVLSLANVKAKYGWSDKSFTSSLKKIHACPNDCILCRHLPQVLWYLSITPRSKGLFANGDDAKDLTWHANRRNCDGMLCHPTYSSQWKKINWPRQLGNDIDVYLNPLIEDLRKLWDEWVDVFDGSQNETFKLRAM

SEQ ID NO: 223991 - protein, 217 aa, Glycine max
  Coding DNA Sequence Number=SeqID_107213
  Gene Ontology: Mol. function=catalytic activity; Biological process =metabolic process
  Homolog annotation: Hit_ID=Q2HTV0; Match level="QueryCoverage=42%, HitCoverage=7%, E-value=1e-41, Identity=86%"; Hit description=Zinc finger, RING-type; Transcription factor jumonji, jmjC; Zinc finger, C2H2-type
MVHPILDQSFFLDNTHKMRLKEEFKIEPWTFEQHVGEAVIIPSGCPYQIRNPKCCVHVELEFVSPENVSESIQLIDEVRLLPKDHKAKVEKLEPNSWEDTMRDELDRKKYPRMPWHNVHCALWGPPCRDIARHFVQHWNHAKRTKAPNEHGIPLLMPHHHMVLPHYMGRSKEIDINEKKDKDKRKGIGRQDSFSFNPKNKITAVPAEEEEIWGAFFK

SEQ ID NO: 223992 - protein, 909 aa, Glycine max
  Coding DNA Sequence Number=SeqID_107214
  Gene Ontology: Mol. function=RNA-directed RNA polymerase activity; Cellular component=nuclear RNA-directed RNA polymerase complex; Biological process=electron transport
  Homolog annotation: Hit_ID=Q1RZP1; Match level="QueryCoverage=99%, HitCoverage=74%, E-value=0.0, Identity=81%"; Hit description=RNA -binding region RNP-1 (RNA recognition motif); RNA dependent RNA polymerase
  Pfam annotation: Domain name=RdRP; Domain location=576-906; Score =465.3; E_value=7.7e-137; Accession=PF05183.3; Description=RNA dependent RNA polymerase
MDLEGSEKDSVVTQISIGGFGSEVKASDLVNYLEDKIGLVYRCRLKTSWTPPESYPEFNIIDTANIRRTDNYKKVEPHAFVHFASPESVTAALNASGCCDLFLKNQPLKVSCGPENPYFLNQRRRTTTPFKMSDVLVEIGTLVSPGEFFVSWRGPDKGVKFLVDPFDGMCRFCFSRDTAFSFKGIEKKAVIKCDFQVGFLVRDINEIKRYNDTSYLVVLLHLASSPWVWYRTADDDIEESVPFDLLDDDDPWIRTTDFTPSGAIGRCNFYRISIPPRHGAKLMKAMLYLKGQRVQMQELALKQTLRTLNEPDFGVPMSDAFFYIHFQKDIAFDIMFLVNAIVHKGIFNQHRLSDRFFELLKNQPKELNVAALKHLCSYKRPVFDATKRLKIVQEWLLRNPKLYQISKQLDDIVEVRRLVITPSKAYCIPPEVELSNRVLRKFREVSDCFLRVTFMDEGMQTINVNALNYYVAPIVKEITSNSFSQRTKIYKRVKTILEQGFYFCGRKYSFLAFSSNQLRDRSAWFFAEDKIRCDDIRNWMGKFNQRNVAKCAARMGQCFSSTYATVEVAANEVNSMLPDVERNNYIFSDGIGVITHDLAREVAEKLKLDNVPSAYQIRYAGFKGVVASWPAKGDGVRLSLRPSMNKFQSTHNILEICAWTRFQPGFLNRQIITLLSALGVPDEVFWQMQEAMLLKLNQMLVDADIAFDVLTKSCAEHGNAAAIMLSCGFSPLTEPHLRGMLTSTRAAQLWGLREKSRIFVSSGRWLMGVLDESGVLEQGQCFVQVSTPSLENCFSKHGSRFSETKNLHVVKGFVIIAKNPCLHPGDVRVLEAVDAPDLHHLNDCLVFPQKGDRPHTNEASGSDLDGDLYFVTWDENLIPPSKRSWIPMEYAPQESKLKTRQVMTRVCPF

SEQ ID NO: 223993 - protein, 126 aa, Glycine max
  Coding DNA Sequence Number=SeqID_107215
  Homolog annotation: Hit_ID=Q1RYZ1; Match level="QueryCoverage=92%, HitCoverage=47%, E-value=9e-49, Identity=81%"; Hit description=SPX, N-terminal
  Pfam annotation: Domain name=SPX; Domain location=1-126; Score=45.8; E_value=1.4e-10; Accession=PF03105.10; Description=SPX domain
MKFWKILKSQIEQTLPEWRDQFLSYKDLKKQLKVMCPKDALTPPRLDADELNHFLRLLELEIDKFNAFFVDKEEEYIIKWKELQDRVARAIGSNLELMSLGRGIVDFHGEMVLLENYTALNYTGML

SEQ ID NO: 223994 - protein, 72 aa, Glycine max
  Coding DNA Sequence Number=SeqID_107216
  Gene Ontology: Mol. function=electron transporter, transferring electrons within the cyclic electron transport pathway of photosynthesis activity; Cellular component=integral to membrane; Biological process=...
  Gene Ontology: Biological process=photosynthetic electron transport in cytochrome b6/f
  Homolog annotation: Hit_ID=Q6EW21; Match level="QueryCoverage=78%, HitCoverage=33%, E-value=6e-26, Identity=100%"; Hit description =Cytochrome b6-f complex subunit 4
MEVIPIDATFMPVRNVPKPLKERPITYWALYEVFEIRERNTIRVIFPKELQMDPRVPQSWMVLEPLSLRYRQ

SEQ ID NO: 223995 - protein, 352 aa, Glycine max
  Coding DNA Sequence Number=SeqID_107217
  Gene Ontology: Mol. function=catalytic activity; Biological process =Mo-molybdopterin cofactor biosynthetic process
  Homolog annotation: Hit_ID=Q2BNV9; Match level="QueryCoverage=86%, HitCoverage=87%, E-value=9e-64, Identity=44%"; Hit description=MobAB fusion protein; probable molybdopterin-guanine dinucleotide biosynthesis protein
  Pfam annotation: Domain name=MobB; Domain location=163-287; Score =135.2; E_value=1.8e-37; Accession=PF03205.4; Description =Molybdopterin guanine dinucleotide synthesis protein B
GKPLYQHVLQRLQPQVNIVLISANRNIDRYQASGCQVIRDSLPDYPGPLAGMLSGLRHSQTEWVAFCACDTPWLPQDFVARLWQQRGAAAAVWVTSGQRDHPALALVHRALADDLEAWLLRGERRLMQFMREHGGHGVLFDDDEAAFRNINTPDDLVNEESAGTGKTTLLQQVIPLLRAQGIRPGLIKHTHHQMDIDTPGKDSYLLRKAGADQVIVASEQRWALMCETPQQPLSLAQLAGRMDVASLDLVLVEGFKQEPVPRMVLWRRGVKGEIDELLDDWVIAVATDEALALQVPVLDINQPDQYGRKKAPDSRPGLLHWFDAWQFPTLAWGGPTLPSALRRFTSEFGMGS

SEQ ID NO: 223996 - protein, 284 aa, Glycine max
  Coding DNA Sequence Number=SeqID_107218
  Gene Ontology: Mol. function=serine esterase activity; Biological process=metabolic process
  Homolog annotation: Hit_ID=Q1LCP2; Match level="QueryCoverage=98%, HitCoverage=81%, E-value=2e-64, Identity=45%"; Hit description =Hypothetical protein precursor
  Pfam annotation: Domain name=DUF1214; Domain location=178-282; Score =32.7; E_value=1.7e-08; Accession=PF06742.2; Description=Protein of unknown function (DUF1214)
  Pfam annotation: Domain name=DUF1254; Domain location=1-80; Score= -2.7; E_value=0.00057; Accession=PF06863.3; Description=Protein of unknown function (DUF1254)
  Pfam module annotation: Pfam domain module=DUF1214::DUF1254; Domain location=178-282::1-80
VFHHDRELAPLSQQPVIRQNRDTLYSVAVTDLAEGGATLTIPDAGDRYISVMVINQDHYINRVFHEAGVYELTADEFDTAYVVIAARILFDPSDEADLAEVHRLQDALTVTAGSQREFVYPDYHPVSYKGVRDALLVLGKTMSGLNGCFGAAGKVDPIRHLVATASGWGGLPDAEAQYINIDPRRPRGRYTMTFGTDVPADAFWSLSVYNGDGYFEPDASNVTNVNSVFGAKDDDGSTTVHLGDWPSDAPNRISLPEGWNLLVRLYRPRLGQLAAWSIPEIVAH

SEQ ID NO: 223997 - protein, 188 aa, Glycine max
  Coding DNA Sequence Number=SeqID_107219
  Gene Ontology: Mol. function=oxidoreductase activity; Biological process=metabolic process
  Homolog annotation: Hit_ID=UPI00005273F8; Match level="QueryCoverage =99%, HitCoverage=38%, E-value=2e-87, Identity=82%"; Hit description =putative short chain dehydrogenase
MAPGSSSLEKHADGTAIDAGGLVPDVNRVNSWVQSVDQVDPLEMLEVQLANTTAPFLLISRLRASMAASTAHRKYVVNVSAMEGQFSRRYKGPGHPHTNMAKAALNMLTRTSAGEMLEKDGILMTAVDTGWITDERPHYTKVRLAEEGFHAPLDLVDGAARVYDPIVRGEAGEDIHGVFLKDYEPSPW

SEQ ID NO: 223998 - protein, 73 aa, Glycine max
  Coding DNA Sequence Number=SeqID_107220
MTLLFPEEQKVQKTVSASACYQAFCLTDSKRMGANNHKNDQTWSLRAIGHNCVCLAKGGADNRKVSPRIMGAE

SEQ ID NO: 223999 - protein, 42 aa, Glycine max
  Coding DNA Sequence Number=SeqID_107221
MARVLEKKSHHFQLTNIPVQFANERGFQNGVVVRSPTKLVRN

SEQ ID NO: 224000 - protein, 177 aa, Glycine max
  Coding DNA Sequence Number=SeqID_107222
  Gene Ontology: Mol. function=transcription factor activity; Cellular component=nucleus; Biological process=regulation of transcription, DNA-dependent
  Homolog annotation: Hit_ID=Q1RZP2; Match level="QueryCoverage=98%, HitCoverage=94%, E-value=2e-59, Identity=63%"; Hit description =Pathogenesis-related transcriptional factor and ERF
  Pfam annotation: Domain name=AP2; Domain location=4-60; Score=99.0; E_ value=1.4e-26; Accession=PF00847.10; Description=AP2 domain
MGQTKKFRGVRQRQWGSWGKRRVWLGTFETAEAAARAYDQAAILMNGQNAKTNFPTSKNQAEADDNNNTDTFLSPKALSELLSTKLRKYCKDPAPSLTCLRLDADNSHIGVWQKGAGPHSGSNWVMRLELGKKQITEEGSESTESPQSSTNGATENNEVEEEDRVALQMIEELLNWN

SEQ ID NO: 224001 - protein, 88 aa, Glycine max
  Coding DNA Sequence Number=SeqID_107223
MVTWVVDKPPTLEKRASYYVSNHSIETKMPQLLHGTLKVTIFEVDRLHTGCHLDFCQKKVNAYIIKTKVYNFTQQAGAGPEIFIEQLT

SEQ ID NO: 224002 - protein, 43 aa, Glycine max
  Coding DNA Sequence Number=SeqID_107224
MPHLLHGRLDVIIYEVDTLPTLNDCNLNLCSKIRSQIKNKWGG

SEQ ID NO: 224003 - protein, 438 aa, Glycine max
  Coding DNA Sequence Number=SeqID_107225
  Gene Ontology: Mol. function=phospholipase D activity; Cellular component=membrane; Biological process=phosphatidylcholine metabolic process
  Homolog annotation: Hit_ID=Q1RZP4; Match level="QueryCoverage=99%, HitCoverage=52%, E-value=0.0, Identity=71%"; Hit description=C2
  Pfam annotation: Domain name=PLDc; Domain location=279-306; Score =42.2; E_value=1.7e-09; Accession=PF00614.12; Description =Phospholipase D. Active site motif
MHRNDFHQPTFPNASIDKGGPREPWHDIHCKLEGPIAWDVLYNFEQRWEKQVGKKLLYSLDDLDEILVHPSEAQKSEVGVEETWNVQLFRSIDGGAASGFPQTPKEVSELGLVSGKDNVIERSIQDAYIHAIRRAKNFIYIENQYFLGSSYGWQASGDIVVEDIGALHLIPKEISLKIASKIEAKERFSVYIVIPMWPEGVPSSDSVQAILDWQKRTMEMMYSDITDALKKTGIQARPRDYLTFFCLGKRENKDPGDYTPLEKPEPDSDYGRAQNSRRFMIYVHSKMMIVDDEYIIVGSANINERSMEGARDTEIAMGAFQPRHLASSGRPKGEIYRFRRALWYEHLGDDGFGSKIFDFPEHLECINHVNKLAEANWDMYSMETFVENKRQFHHLMCYPIQVTNDGAITNLPGFEYFPDTKARILGCKSKLIPSILTT

SEQ ID NO: 224004 - protein, 267 aa, Glycine max
  Coding DNA Sequence Number=SeqID_107226
  Homolog annotation: Hit_ID=Q8S268; Match level="QueryCoverage=48%, HitCoverage=56%, E-value=2e-17, Identity=46%"; Hit description =Putative holocarboxylase synthetase
MDTILKPLVLEVGQNLDLISQNELEYGGEEAPVSPRQPMHQQNSQTAMHNTNFGASIPSNAFGATVAGQGIRAGQPDQQPKNSVFSNALSSPIRRSLQPYHLAQGSFPSCNIMSSGNGTRNSDMTYPNGQNRDTNSSNSSDCMDMHSDSPEIVTVVLGGFDRGRKIYGDGDGDGGGGGGTIDTDFLTKKKKQVSVQLPSLTSPVSTVRFCDLNFGRLQPSDDELDPHNRFEFGNFVARQALLHEEYWTAAWLRAEEWASRTDKLYDT

SEQ ID NO: 224005 - protein, 1190 aa, Glycine max
  Coding DNA Sequence Number=SeqID_107227
  Gene Ontology: Mol. function=RNA-directed DNA polymerase activity; Biological process=RNA-dependent DNA replication
MVKYRVQKNANAALDAKGETRDRWCKREVGEDDIKKTRTNGEDAGWKVVRNRKWRNRDIVSFFITNFPDYDWKELYQIFRRYGLVKEVFVAARRNRGEKRYNSVRVDAAWVLVMVLSIQAMRIDTQVRIKNKICRICLMEENVVQVVQCRCSRDSEEEHLREVVDEKGQDDWRASQRPCSDEVMVQKPVGNSKKTKDSTNYPPNGGNQKNLDLESCLVKGFLEARKKVMEVGLGLKEGTVENMDDDREERGLNFEEKIFEMKDEGPTEHNACVDKGGGNREHSSLESVEKSVSLIGLGSKNKKALWVHSEEEEANKVWETGQGLGVRLQGNKEAMIQNRVLLQKRDYSQKPGPCASKKEGTGSGNDVNDETKKEVVNKELCCALWGNNDVQWEMTLSINAIGGLLCLWCKEAFKLNNTFRGNGFLGLEGIWREGRVENRDVTLVNIYLPCDMEGKRRLWRELKDKKGSSTNPTWCVMGDYNCVRRLGERVGINGEQHGGREDDKPNGKAKSRIDRVLISRKWLDSWQGCTQYVLNRNAWDHCLILVKNNSFDWGPRSFKIFNCWFQDKRLHELVKKWNKEEFGILNEKQARIEKEINALDVRIGVLARMISIVDCNFKKNFARLPCIMNPFLAKSLKLYGGVGGGPTQSERGSEEVQEIKLAIWSCNNSKCTGLNGFNFCFFREFWEVLDKVIDHRQNVFLCGRQLLHSMMVTNEFLTCMLKRLDFNDTWVSWIKGCLNSSWSSVLVNGNPTQEVRCSTGLRQGDLLAPFLFLVVAKGLSSLMREANATNSLRGYEVGREKCVISLLQYVDDTIFVGEANARNVFTIKVILRMFKLASDLKVYFFKSSFRAIGVGSEEVATWNPIIDKFKKRLATWKHKQIVFRCLMNLVLVGWRLFKKLRERKRKPEKKDACKSKKNGGHGVKDLAIFNDVLSLMTDDDLPWESLRWRHLRKTCGIRNEEKWFDSGVSWKVGSGDKISFWKDEWMEGQSLEVLFPRLYILSEQKEHLIGHMGIWREETWHWDLKWQRVLFEWENQLIIQLNGFLANVQVCREDMDLWLGRDALRGFTQHSRLVNGDYKSMWLGKLGRHATWLSSDFVTVDSNNLKGHCWQHMDLGRSKSESQAWRRLNFWSGHGSILQQNGSNPPLCSGITTLQLLCMEGANTLTEMKGGCWIMYWDPVLCCLVAAGLC

SEQ ID NO: 224006 - protein, 87 aa, Glycine max
  Coding DNA Sequence Number=SeqID_107228
  Gene Ontology: Mol. function=protein binding; Cellular component =ribonucleoprotein complex; Biological process=mRNA metabolic process
  Homolog annotation: Hit_ID=Q1SJB9; Match level="QueryCoverage=61%, HitCoverage=41%, E-value=4e-24, Identity=98%"; Hit description=Like -Sm ribonucleoprotein-related, core
  Pfam annotation: Domain name=LSM; Domain location=10-61; Score=17.7; E_value=0.002; Accession=PF01423.12; Description=LSM domain
MSRSLGIPVKLLHEASGHVVTVELKSGELYRGSMIECEDNWNCQLESITYTAKDLIEDLKFGNATLNWVLRPGIRDKVGCVWDTCNN

SEQ ID NO: 224007 - protein, 156 aa, Glycine max
  Coding DNA Sequence Number=SeqID_107229
  Subcellular localization annotation: CTP_CleavageSite=71; ConfidenceScore=5.76e-01
MIQTPFSWTPSTFSIVPTSASPFLLLATIPVFSNPPQQPPTPSPPLLPLSRHRNGKSLELWLTRVGCVGSEASVVGGTRVAPQLEVTLNLRVGDADSDPHLPPNDLEEIRLVCNAAVLPAFNNLVANDTKDDAVAEILNNRYIMPQESCFYMVFNS

SEQ ID NO: 224008 - protein, 112 aa, Glycine max
  Coding DNA Sequence Number=SeqID_107230
  Subcellular localization annotation: CTP_CleavageSite=38; ConfidenceScore=5.44e-01
MSLCYAIEVTLTTSPSTSASVSLPRRCAIVPQQLRVVLAQRRRGCPHGLSFYFCFSESSPPLPLRRRATPTSGHLCTTPSRSPSPSPSPSTSPFSNKTTFSALVFAYLVLWY

SEQ ID NO: 224009 - protein, 384 aa, Glycine max
  Coding DNA Sequence Number=SeqID_107231
  Homolog annotation: Hit_ID=Q6K5X9; Match level="QueryCoverage=45%, HitCoverage=70%, E-value=3e-64, Identity=58%"; Hit description =Transmembrane protein-like
  Pfam annotation: Domain name=TPT; Domain location=18-154; Score=39.2; E_value=1.5e-08; Accession=PF03151.7; Description=Triose-phosphate Transporter family
MNVSLMWNSVGFYQIAKLSMIPVSCFLEVILDNVRYSRDTKLSISLVLLGVAVCTVTDVSVNAKGFIAAAVAVWSTSLQQYLFIIISCTIAVGTNLSQFICIGRFTAVSFQVLGHMKTILVLALGFVFFRKEGVNLQVILGMTIAIAGMIWYGNASSKPGGKERLSLPLNHTPKTQEVRVRVRATSTVSCKDDPTLVWHDGAAGNLDGVVQGRPEVAEERWRSGGEDSLRQRDRERDRGAARLLEEGDSGEAGTHEAEKEYIMGDRLVVDQQHTGDAQLPSSPPSKDDMVSCVMALEAALLPFDVDRYARDFMEAAKKLQLYFISLQREDKPTKLEMLRKEVALMEEELNKKNELIKKQENLIQEWKKELKDQLDKHKIELDRV

SEQ ID NO: 224010 - protein, 124 aa, Glycine max
  Coding DNA Sequence Number=SeqID_107232
  Homolog annotation: Hit_ID=Q1SJB9; Match level="QueryCoverage=26%, HitCoverage=25%, E-value=1e-10, Identity=96%"; Hit description=Like -Sm ribonucleoprotein-related, core
MEVGAWMFGMNNNRYKDLGLRPFVYARSIGPWEATSCTMSVPWSLLRTLLGFRVQALLVWEMSKFMVIPDMLKNAPMFKRLDARIKGKGASLGVGRGRAVAMRAKAQAAGRGAAPGRGVPPVRR

SEQ ID NO: 224011 - protein, 572 aa, Glycine max
  Coding DNA Sequence Number=SeqID_107233
  Gene Ontology: Mol. function=transferase activity; Cellular component= membrane; Biological process=metabolic process
  Homolog annotation: Hit_ID=Q1SJC3; Match level="QueryCoverage=99%, HitCoverage=89%, E-value=0.0, Identity=88%"; Hit description=Plant neutral invertase; Glycoside transferase, six-hairpin
  Pfam annotation: Domain name=Invertase_neut; Domain location=90-553; Score=1190.7; E_value=0; Accession=PF04853.3; Description=Plant neutral invertase
MGVSFHDYKTYSRPRLQTCKCQQAESASGITTGDENGSRLVNDGETSNSVSNGMSAKHILEFEDVEAQQLKQEKEVLSSNLTNGSITDSFDTIGRNSIEEEAWDLLRESVVYYCGNPIGTIAAKDPTSSNVLNYDQVFIRDFIPSGIAFLLKGEYDIVRNFILYTLQLQSWEKTMDCHSPGQGLMPASFKVRTVPLDGDDSATEEVLDPDFGEAAIGRVAPVDSAYGKCSGDLSVQERVDVQTGIKMILKLCLADGFDMFPTLLVTDGSCMIDRRMGIHGHPLEIQALFYSALLCAREMLTPEDGSADLIRALNNRLVALSFHIREYYWIDMKKLNEIYRYKTEEYSYDAVNKFNIYPDQISPWLVEWMPNKGGYLIGNLQPAHMDFRFFSLGNLWSVVNSLATEEQSHAILDLIEAKWSDLVAEMPFKICYPALDGQEWQIITGSDPKNTPWSYHNAGSWPTLLWQLTVACIKMKRTHIAAKAVEIAERRILRDRWPEYYDTKRSRFVGKQSRLYQTWSIAGYLVAKLLLADPSKANTLITEEDSELVNALISANPRGKRGRKNLRQTYIV

SEQ ID NO: 224012 - protein, 157 aa, Glycine max
  Coding DNA Sequence Number=SeqID_107234
MDPYLTSKYDLDYVLSLLIDFPETSSTNKFPWNTNGCQAIKVRVIGSQVKAINTSNGRNLPECPTLIFEFCWTWGLKRLLLHYSITLFINIQEIEICMGEEDGYMMTNCGAVNFLVHRFLVINFAPLLDVAKDDSKNNVQQSQQKVHGMQPQLQQQQ

SEQ ID NO: 224013 - protein, 757 aa, Glycine max
  Coding DNA Sequence Number=SeqID_107235
MDFSLGSEDPPILKLHKWDLSEAQIGLSDFREAFLSPTREILLLHSYEREALLLPLSKGELHSGGAEGGYDYDDNHNPGSANVSSEASTRPSESVLVNDSPCTSGSDVDIDTDLVGIKCSKSNSLPYISDVNSLAWARCEDGYDQHKDALFREVLFVSGRCGVTVHAFLKLTKTKGMVQPMLEGNFRQGRWVEWGPVAALSSDFSHGVSGDQNVNLTGDGGVESLRGSATKRYLESFFTKVETTVSDGILLTKFPENNEFPCLTEVVSFSIFDGSLSLDHLLKEKTVQSKENWQEPVDSARDASDRSSLSFCGADTKLDCDEDQRGRSRDLLLVAKLDNWGIRWVSMVKLDERINTVQSVEWMDFQFSDNLLVCLNSSGLIVLYSAMSGEYVTHLNVLQACGLNPHFNLQGLEKLYSHDNIYAKQECSINDNMSDQQSDSFRGSFKRLVVASHSSLLAVVDECGVIYVISLGEYIPDKIYSSEKLLPYCQQFVQGMLVGWEVGGSDIDRQAVYSNLSGHFRSNDLNIKHGNVALSDKAVAGNALQKINGCTFKEKGDLFGSYSSGFSATSKVNNGHTFLGYDVKLPVMRKIFLPNFRVCEDDSICFSPLGITIFSKKKCVKNQNSSQLIHFNLEVKLEVHDDNFLDSVYDVYHFDGKDVIGEAIGCTFQGCFYIVRDGGLSVYIPSISILSNFLPVEYIGYRQSSKDMEISVLLKDNLEIKEPIKRFSPWKVEILDRVLLYEGTEMADQLFLKNGKC

SEQ ID NO: 224014 - protein, 275 aa, Glycine max
  Coding DNA Sequence Number=SeqID_107236
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=100%, E-value=4e-46, Identity=30%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GKHALTLKGLHGLIFKGLHTITFRGIHVLAFRGLHVLTIRGLHVLPFRGLHALTFRRLHVLAFIGLHVLPFSGVHVLTFRGVHILAFRGLHVLAFKGLDILGFRGLHRVNFRGLHVFTSRGLHALTFRGLHVLAFRGLHILAFRGLHALTFNGLPVLALRGVHGLTFRGLHALTLKGLQVLAFRGLHTLAFRGVHALAFRGLHVLTFRGLHVLTFRGQHALTLKGLHALAFQGLHTLTFRGLLILAFKGLHVLNFRGLHVLTLRVLHTLTFRGLH

SEQ ID NO: 224015 - protein, 59 aa, Glycine max
  Coding DNA Sequence Number=SeqID_107237
AAGSGAAGWAWSAGGRLRTNSARMSAAERSERREGRGGTGLPDAVVDRQKDCKENPCSP

SEQ ID NO: 224016 - protein, 105 aa, Glycine max
  Coding DNA Sequence Number=SeqID_107238
IVLADEIKIPARISSTGKNIVFDITNGKLDPAALATTSNGLVFAGDVTITANDVSNSKAWEEIGGLDADPTYSLTLFGPNGAEIAGTITGLPERIGGVAVIGAKQ

SEQ ID NO: 224017 - protein, 193 aa, Glycine max
  Coding DNA Sequence Number=SeqID_107239
  Gene Ontology: Mol. function=S-adenosylmethionine transporter activity; Cellular component=mitochondrial inner membrane; Biological process=chloroplast organization and biogenesis
  Homolog annotation: Hit_ID=Q94AG6; Match level="QueryCoverage=87%, HitCoverage=52%, E-value=2e-71, Identity=78%"; Hit description =Putative mitochondrial carrier protein
  Pfam annotation: Domain name=Mito_carr; Domain location=89-179; Score= 120.3; E_value=5.3e-33; Accession=PF00153.17; Description =Mitochondrial carrier protein
  Pfam annotation: Domain name=Mito_carr; Domain location=9-84; Score =18.4; E_value=7.2e-05; Accession=PF00153.17; Description =Mitochondrial carrier protein
  Pfam module annotation: Pfam domain module=Mito_carr::Mito_carr; Domain location=89-179::9-84
MALPWLKTVSLDDFIFLHAPQVIKQRMQTGQFASASGAVRFIASKEGFKGFYAGYGSFLLRDLPFDAIQFCIYEQIRIGYMLAAQRNLNDPENAIIGAFAGALTGAITTPLDVIKTRLMVQGSANQYKGIVDCVQTIIKEEGPRAFLKGIGPRVLWIGIGGSIFFGVLESTKRFLSERRPTVPQNTYSEKSKD

SEQ ID NO: 224018 - protein, 2392 aa, Glycine max
  Coding DNA Sequence Number=SeqID_107240
  Homolog annotation: Hit_ID=UPI000060EA85; Match level="QueryCoverage =56%, HitCoverage=46%, E-value=2e-19, Identity=24%"; Hit description =UPI000060EA85 related cluster
SLEMLVDVDLAEEGILRLLFAAVYLIFNKGGNDSETPAASRLLALAACFATKMLHKYGLLQHKKDTCIAEGFNKMGLLSLPPIEPVKLQTEVDFAQKLCEIAHFLEIIRNLQCRHRSIFQRASQGLADRGEESSLISTDMLQEESQLSILPSDLESLDVLNQHELSFPRPGSNNNENLALVPVDSESHLVSDEFGYISHLTPLGGILGKKVLPVENPREMMARWKVDNLDLKTVVRDALLSGRLPLAVLHLHQMNDFVADKEPHDTFTEVRDIGRAVAYELFLKGETELAVATLQRLGENVESYLKQLLFGTVRRSLRIQIAEEMKRYGYLGPYEWKILDDMSLIESLYPSSSFWKSYNHRLKEISIAPDSVLPVENKLRLLHNHSFDSHVIECGEIDGIVFDAWIDISESSSALEVDEDDAHVGYWAAAAVWFDAWDQRTVDRMILNQSVHSDNSILWESQLEYHVCRNHWKEVFRLLNLMPAYVLSAGSLQLNLDLVEPASSLGCNMNMKSSNYGNFLCSFEELDSVCMEVPNVQMYRFSPDICSGWMRMLVEEKLAKRFIFFKEYWEGTLEMIALLARSGFISGRDKVCLEDDLTKTSSVRDGAVQALHKIFVHHCAQNNLPNLLDLYLDHHSLVLDNDSLYALQETAVDCEWARWLLLSRVKGCEYEASLANARSIMSRNLVPRSDLSVLELDEIIRTVDDIAEGGGEMAALATLMHAAVPIQSCLNSGGVNRHSNSSAQCTLENLRPTLQKFPTLWRTLIGACLGQDTMALLVPKAKTDYLNWRDDIFFSTSHDTSLLQMLPCWFPKPIRRLIQLYVQGPLGCQSFSGFPTGETLLHRDIDLFINADVHAEINAISWEATVQRHIEEELYGPLLEENGFGLEHLLHRGRALAAFNQILGHRVQNLKSEEESSTSAHGQTNIQSDVQTLLSAVEQSEETLLSSVLPVAIMHFEDSMLVASCAFLLELCGLSANKMRIDIAVLKRISLFYKSSENNENLWQLSPKGSVFHAISHEGDVTESLARALADEYLHKDSPATATETVSKQASRALILVLHHLEKASLPQLVDGKTYGSWLLSGNGDGNELRSQRKAASQHWTLVTNFCRLHQLPLSTKYLAALARDNDWIEFLSEAQIGGYSFDTVVQVASKEFSDPRLRLHMLTVLRGMQSKKKASTALFLDTLEKGSETTFPDENMCVPVELFQILAECEKQKCPGEALLRKAKELSWSILAMVASCFLDVSPLSCLTVWLEITAARETSSIKVNDIASQIADNVGAAVNATNALPVGDRVLTFHYNRQSPKRRRLITLVSLDSSASAISDICSSSISEEIFDSKGKTMENDRKIEHFGCINVPSDSHEGPASLSKMVAVLCEQQLFLPLLRAFEMFLPSCPLLPFIRALQAFSQMRLSEASAHLGSFSARIKEEPFYLQANVGREAQIGASWISSTASTAADAVLSTCASPYEKRCLLQLLAATDFGDGGHTAAHYRRVYWKINLAEPLLRKDNELHLGDEISDDASLLSALENNRHWEQARNWAKQLEPNGAPWKSAMHHVTESQAESMVAEWKEFLWDVPEERVALWSHCHTLFIRYSFPSLQAGLFFLKHAEAVEKDLPARELHELLLLSLQWLSGMISLSNLVCPLQLLREIETKVWLLAVESETQVKSEGDFNFTFSTRESGIKNDPSIIDRTASIIAKMDNHINTMRSRIVEKYESRENNQIPHKNQVMDAGLSTTFGGNTKTKRRAKGYMAPRRPPLESADKSADTDDGSSTNSLKNEFQLQEENVKVEMSFSRWEERVGAAELERAVLSLLEFGQIAAAKQLQYKFSPGQIPSEFRLVDAALKLAAISTPPSNVSVPMLDEEVRSVMHSYGIMNDKHYVDPLQVLESLVTIFIEGNGRGLCKRIIAVIKAANTLGLSFSEAFNKQPTELLQLLSLKAQDSFEEANFLVRTHPMPAASIAQILAESFLKGVLAAHRGGYMDSQKEEGPAPLLWRFSDFLKWAELCPSEPEIGHALMRLVITGQEIPHACEVELLILSHHFYKSSSCLDGVDVLVALATTRVDAYVLEGDFPCLARLITGVGNFYALNFIFGILIENGQLDLLLQKYSAAADTNTGTAEAVRGFRMAVLTSLKHFNPNDLDAFAMVYNHFDMKHETAALLESRAEQSCEQWFRCYNKDQNEDLLDSMRYFIEAAEVHSSIDAGNKTRKDCAQASLLSLQIRMPDFQWLYRSETNARRALVEQSRFQEALIVAEAYNLNQPSEWALVLWNQMLKPEVMEEFVAEFVAVLPLQPSMLFDLARFYRAEVAARGDQSHFSVWLTGGGLPAEWAKYLGRSFRCLLKRTRDLKLRTQLATVATGFGDVIDACTEEMDKVPDNAAPLVLRKGHGGAYLPLM

SEQ ID NO: 224019 - protein, 276 aa, Glycine max
  Coding DNA Sequence Number=SeqID_107241
  Gene Ontology: Mol. function=unfolded protein binding; Cellular component=endoplasmic reticulum; Biological process=protein folding
  Homolog annotation: Hit_ID=Q01B04; Match level="QueryCoverage=46%, HitCoverage=16%, E-value=6e-25, Identity=44%"; Hit description =Homology to unknown gene
MAGCRRDALLLTRDKGQSSVGSRIVVTGVLFGCIFALFTGVPTPLHIPSPSKMVSSACKSPEQVNALKVDILSAKEKNSELKKQVKDLMEKLRLAEQGKGHAQEQFVVLGESHKAGPFGTVKGLRTNPPVIPDESVNPRLAKILGEVAIYKELIVALANSNVKEMLQLWFTNIKRVGIPNYLVVALDDNIEEFCKSNDVPVYRRDPDQGVDVVGKSGGSHAVSGLKFRILREFLQLGYSVLLSDVDIVYLQNPFDYLYRDSDVESMSDGHNNSLRV

SEQ ID NO: 224020 - protein, 417 aa, Glycine max
  Coding DNA Sequence Number=SeqID_107242
  Gene Ontology: Mol. function=monooxygenase activity; Cellular component=membrane; Biological process=electron transport
  Homolog annotation: Hit_ID=Q1S220; Match level="QueryCoverage=86%, HitCoverage=71%, E-value=2e-92, Identity=47%"; Hit description=E -class P450, group I
  Pfam annotation: Domain name=p450; Domain location=62-414; Score=6.5; E_value=2.8e-11; Accession=PF00067.12; Description=Cytochrome P450
MHHLLLFVILVVLLVFLARVAYSIIWVPWVIARHFREQGIRGPSYRPIKGNTDEIRGMYAEVQSRPMALCHDILERVCPFYHKWSRMYGKTVLYWHGSDPRLVLSDPDMIKEILLKTGDWFERIDPNPSAKRFFGEGILVLKRDKWAVHRAIANQAFKIERVKCWIPQIIDSTKTMFYKWEDENKGVDEFEIEVSKDLHDLTSDIISKVAFGSNYEEGKGIFDLLEQHYHLVSLASRSVYLPGFRFLPTKKNRERKRLEKKTSESIQVLINDNYKAEQNSENLLSLLMSSHKFIKNETQKLSMVEIVDDCKNFYMAGKETSANSLSWALLLLGINQEWQSKAREEVLSVLGPNTSPTSEALNDLKLVNLILQETLRLYPNPGTLRYSFVVSPTYAHGPMLLMTVTPQYGMQIVFRRL

SEQ ID NO: 224021 - protein, 179 aa, Glycine max
  Coding DNA Sequence Number=SeqID_107243
  Gene Ontology: Mol. function=peptidase activity; Cellular component =cytosol; Biological process=protein targeting
  Homolog annotation: Hit_ID=Q10QF4; Match level="QueryCoverage=92%, HitCoverage=67%, E-value=5e-75, Identity=77%"; Hit description =UPF0326 protein hag1, putative, expressed
  Pfam annotation: Domain name=DUF862; Domain location=41-173; Score =233.1; E_value=6.2e-67; Accession=PF05903.5; Description=Eukaryotic protein of unknown function (DUF862)
  Subcellular localization annotation: CTP_CleavageSite=32; ConfidenceScore=5.09e-01
MKFKSKKGWKSIVPLHLKGKSATRFSLFRKVNSAAYGPGKTPVYLNVYDLTPMNGYVYWAGLGIYHSGVEVHGVEYAFGAHDYPTSGVFEVEPRQCPGFKFRKSIFIGTTSLDSTQVREFMERQSASYNGDTYHLIVKNCNHFCKDICYKLTGKSIPTWVNRLARLVCLDGGNGEKERE

SEQ ID NO: 224022 - protein, 91 aa, Glycine max
  Coding DNA Sequence Number=SeqID_107244
  Gene Ontology: Mol. function=binding; Cellular component=membrane; Biological process=transport
  Homolog annotation: Hit_ID=Q1RTU6; Match level="QueryCoverage=86%, HitCoverage=100%, E-value=8e-18, Identity=63%"; Hit description =Mitochondrial substrate carrier
  Subcellular localization annotation: CTP_CleavageSite=36; ConfidenceScore=5.06e-01
MGLFTLSVMVNDSAISLPDTCTKRKQNLLLKNSFASVSMGDEKPFDFLRTLFEGVIAGGTAGVVVETALYPIDTIKTRLQAGFYDKNCNED

SEQ ID NO: 224023 - protein, 262 aa, Glycine max
  Coding DNA Sequence Number=SeqID_107245
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q1RTU8; Match level="QueryCoverage=94%, HitCoverage=87%, E-value=5e-58, Identity=60%"; Hit description =Glycoside hydrolase, family 17; X8
  Pfam annotation: Domain name=Glyco_hydro_17; Domain location=28-163; Score=-135.2; E_value=0.0023; Accession=PF00332.9; Description =Glycosyl hydrolases family 17
  Pfam annotation: Domain name=X8; Domain location=184-260; Score=70.2; E_value=6.4e-18; Accession=PF07983.3; Description=X8 domain
  Pfam module annotation: Pfam domain module=Glyco_hydro_17::X8; Domain location=28-163::184-260
MWACCMNLVLAHCQLQGGEGAEAAVSGVGVNWGAIASHPMEPHIVVNLLKENVSAFSGTDIEVMVGIPNDQLKKLSKDLDHAEDWVKQNVSKHAHDEGVNIRFYQGFLKKMASNKGTLLHPGPVNSYLVSLFDENMKSVAPDDFERHWGIFHYDGKPEFPIDFSGKGEDKMPIGAKGVRYQEQKWCVLKSNANRSELGGYLSYACAGGDCTSLGNLDASGNASYAFNQYFQINDQSVEACDFEGVATIASKENVFFPCINHQ

SEQ ID NO: 224024 - protein, 89 aa, Glycine max
  Coding DNA Sequence Number=SeqID_107246
  Homolog annotation: Hit_ID=O49929; Match level="QueryCoverage=92%, HitCoverage=38%, E-value=2e-25, Identity=62%"; Hit description=Pore protein of 24 kD
MNLRFKFMNTVVIGEKPLKFSYEHSRGNNTTLLEGTFELDPANKVSVNYAFDSKICKLKYTYVHEELTTFEPTYDMAKNTWDFATVITR

SEQ ID NO: 224025 - protein, 659 aa, Glycine max
  Coding DNA Sequence Number=SeqID_107247
  Gene Ontology: Mol. function=electron carrier activity; Biological process=electron transport
MASWQKGKFFIFSLLFLFSSLHVSSAPLDPESCSIVQSKLDHDSCQEHVPEQPQIANNLNQQVLLDRLEELVRNLSDLVSRLESKLPDPPKEKGRFTHRKGGGDDDDEDDARSSSKGVEDGEFEGKIRDGERARGTSVTKYTPFWSERFQFASAVKLDSEVTCINVLPFRDHEGLSKYVAVSDERGRVYVFTRNGDVLVEFDTSLESSITAMVSYTSVYKNESFVVTGHRNGEILIHRVWEGGSSGEDYSSVFMENVGKFLSPENHEDGLPVSLLEVHYVGRMKYILSADTSGKIKVFKENGSLHGSASPSSRPLVFLKQRLMFLTETGAGSLDLRGMKIRESECEGLNHSIARTYVFDAMERSKAYGFTSDGDLIYVLLLGDVMNFKCRVRYKKKFDVDEPLVALQAIKGYLLIANPEKVFVYNVSSPHYVRVGVPRPVFSSSIDELRSSFLNNNPTPSLDGETRVTPLIASDREKLVIVGLGGGYVGMYHSNLPIFKGEFNTMLWTSPVLFFILFLFGAWHFFAKKKEALTSWGPDDPFSSTSATTSAPLASASGDRSFADSSSRSSEVMDLRGGNLRAPPRRYGSPSRYPGGGAATSYRLGVGGASADHNARPASVDPDFRAASELKFRASTMDPPGFPKRRDGMFVGNQVVNDRS

SEQ ID NO: 224026 - protein, 374 aa, Glycine max
  Coding DNA Sequence Number=SeqID_107248
  Gene Ontology: Mol. function=helicase activity; Cellular component =nucleus; Biological process=metabolic process
  Homolog annotation: Hit_ID=Q1RTU9; Match level="QueryCoverage=99%, HitCoverage=35%, E-value=1e-154, Identity=76%"; Hit description =DEAD/DEAH box helicase, N-terminal
  Pfam annotation: Domain name=DUF1726; Domain location=97-191; Score =197.4; E_value=3.4e-56; Accession=PF08351.1; Description=Domain of unknown function (DUF1726)
  Pfam annotation: Domain name=DUF699; Domain location=270-374; Score =66.4; E_value=9.4e-17; Accession=PF05127.4; Description=Putative ATPase (DUF699)
  Pfam module annotation: Pfam domain module=DUF1726::DUF699; Domain location=97-191::270-374
MASEQGIGPCSSSLATSLETSLYCVQIVNLHYMLSKAQIKSRPTVLWCYKDKLELSSHKKKRSKQIKKLVQRGLYDPEKGDSFDLFLAGGGFTYCLYKESEKVLGNTFGMCVLQDFEALTPNLLARTIETVEGGGLIVLLLRSLSSLTSLCTMVMDVHDRFRTESHNEAAGRFNERFLLSLASCKACVVMDDELNILPISSHIRSITPVPVKEDSDELSEAEQDLKNLKEQLNEDFPVGPLIKKCCTLDQGKAVVTFLDVILDKTLRSTVALLAARGRGKSAALGLSVAGAIAVGYSNIFVTAPSPENLKTLFDFICKGFDALNYKEHIDYDVVKSANPEFKKGTVRINIYKHHRQTIQYILPHEHEKLSQVEL

SEQ ID NO: 224027 - protein, 49 aa, Glycine max
  Coding DNA Sequence Number=SeqID_107249
MKPVGCEVGYVGGDGLTLSFVFQIVASVNLAEELKAPKLVAETTWNFEM

SEQ ID NO: 224028 - protein, 550 aa, Glycine max
  Coding DNA Sequence Number=SeqID_107250
  Gene Ontology: Mol. function=helicase activity; Cellular component =nucleus; Biological process=metabolic process
  Homolog annotation: Hit_ID=Q1RTU9; Match level="QueryCoverage=99%, HitCoverage=58%, E-value=0.0, Identity=65%"; Hit description =DEAD/DEAH box helicase, N-terminal
MKQLEEQSHVSTKSTKDTGRLFKKIELSESIRYASGDPIESWLNSLLCLDASNTIPNISRLPPPSECDLYYVNRDTLFSYHRDSELFLQRMMALYVASHYKNSPNDLQLMADAPAHHLFVLLGPVDESKNQLPDILCVIQVSLEGQISRKSAIQSLTDGHQPFGDQIPWKFCEQFRDTVFPSLSGARIVRIATHPSAMRLGYGSQAVELLIRYYEGQLIPISEIDVEDKVQAPRVRVTEAAKQNAVTGEHTCMILKPLNNDEIEADGSNQLGFFSPFYQDFRQRFAKLLASTFRVMEYKLALSIIDPKINFKNQDPTEATSDKCLQSVKDYLSPHDMKRLEAYVDNLADFHLLGERGVLMTKILDLVPTLTHLYFQEKLPVTLSYAQASVLLCIGLQNQNISYIEGQTNLERQTILSLFIKVMKKFYKYLDGLASKEIESTLPRLKEIVMEPHSVSLDEDLNNAAKQVEDDMKSKAEATFTPELLQQFAIEGESGFETVLQNNGGKIPIGGLISVKSSKVKHEKEKGSHKSDKKRSKDNHNHKSSKRKRS

SEQ ID NO: 224029 - protein, 96 aa, Glycine max
  Coding DNA Sequence Number=SeqID_107251
MTFGVEFGPIPNSNMLSEFTLMVVRKTIRPPVIQLLLDHLQMSSPANYESVLGTFNLFPQRLGILDTGGTNLAICLELENWLLYILLEGSFTVDFQ

SEQ ID NO: 224030 - protein, 933 aa, Glycine max
  Coding DNA Sequence Number=SeqID_107252
MLQQQYLLQLHSQAQQMPLIDKLLLLKQQQKQEEQQQLLRQQQQLLSQVLQDQQSSQLFNNSSFGQLQGVLPMGNLYADPSQLQQPQEIFPISSQMPIPSVHNEDSSNSLNLPLNVSQDTSGNVSSEASIRLPHQLFGATSPENWGPSLTEQINEKYQNEIFPISTLVECSPLLDQNRPKEEPHIGPEPHSLSDYAAKSVEQLPPSHFTPDVVTSISKPDENSGHLQCVAPTIASSSAGSNRIELLPASDPGMEVKTKSDIVHQEQHSGRDSSVSDPSPADIRSIEAHEPKKATEKKSKKQKSAKSQSSDQIKGVLKNVTSQPSNQPEAEIPKLSELGEAYRAESLHETNMQQTRVKGTQIGSAVIEAVDHQQAGGWPAIVAGNLTETVDVGEAKAASSISMQKVEVPAGRAWKPAPGFKPKSFLEIQQEEQRKAETEILVSDIAVSVNSMSLVSPWAGVVSNPDSVNVSSECHKGVHTEYPVKSETSQNLKSKKSPLHDLLAEEVLKKSNEIEAEVPDSILPSHNIAAHSESLDDGNFIEAKDTKRSRKKSGKSKGLGTKASLPVASSEAPIASSPIEKGKNSRSAQQEKEELPAIPAGPSLGDFVLWKGEREPPSPSPSPAWSTDSGRVPKPTSLRDILKEQERKGSSALPVTVSPMPPPQKSQPPQSTWSTVSSRSISASSPSKNASPIQINSQASQSKYKGDDDLFWGPIEQSKQDTKQSDFPQLASQGSWGSKNGPLKGNSPGLLTRQKSVSGKPTERSLASSPASSQSVLKLKKDAMTRHSEAMDFRDWCENECVRLIGTKDTSFLEFCLKQSRSEAEMLLIENLGSYDPDHEFIDKFLNYKELLPSDVLDIAFQSSRNDKKVTRHGAAGTASANADIQDVDYTEGGSSKGGGKKKGKKGKKVSPSVLGFNVVSNRIMMGEIQSVED

SEQ ID NO: 224031 - protein, 54 aa, Glycine max
  Coding DNA Sequence Number=SeqID_107253
MECRVNNKASSVVERFMFGLCWKQQGEMEITFYAWLWMKNLTNSDVCSFAQWQS

SEQ ID NO: 224032 - protein, 269 aa, Glycine max
  Coding DNA Sequence Number=SeqID_107254
  Gene Ontology: Mol. function=calcium ion binding
  Homolog annotation: Hit_ID=Q5JMC7; Match level="QueryCoverage=98%, HitCoverage=69%, E-value=3e-50, Identity=66%"; Hit description =Violaxanthin de-epoxidase-related-like
MTIKLQRELLNADILVIVAVTNKESVEWINNNCKTIENVICLDSSPDLKNKLGGYDVPSEVRGSIFGNFFGKSQSDKAKESYEVVQTVSEAWDRHNSDDIRFCLLVLINAYIRPVPGLKNLGAKGFSTLNCMLKNCGRQVLNCLLDPNCRKALQCLNKCSPVDQGRTRHMINFHANTSFSIGEKQKGHFGMSPYSSVLDNGVVSNEFWTIVDVSDNLSWGLFYYHGAARVAGQSYTGAVLVSPDGAFPNDTERTKIVAALDKCEIKEWE

SEQ ID NO: 224033 - protein, 96 aa, Glycine max
  Coding DNA Sequence Number=SeqID_107255
MAKAKLQGGRDSTRSCGGCKSGLPRFWNDAFHAAYDHLVSDVRSVRDAAVSEIAKMSLHSLPLHHLKSHSIVQNIMGSRKMKQAESSMDTTIDNNQ

SEQ ID NO: 224034 - protein, 174 aa, Glycine max
  Coding DNA Sequence Number=SeqID_107256
  Gene Ontology: Mol. function=transcription factor binding; Cellular component=intracellular; Biological process=regulation of transcription, DNA-dependent
  Homolog annotation: Hit_ID=Q1RTV3; Match level="QueryCoverage=99%, HitCoverage=90%, E-value=2e-84, Identity=81%"; Hit description=Ras GTPase; Sigma-54 factor, interaction region
  Pfam annotation: Domain name=Arf; Domain location=1-165; Score=-83.7; E_value=0.0026; Accession=PF00025.11; Description=ADP-ribosylation factor family
  Pfam annotation: Domain name=Miro; Domain location=12-117; Score =19.6; E_value=6.8e-05; Accession=PF08477.3; Description=Miro-like protein
  Pfam annotation: Domain name=Ras; Domain location=12-167; Score =212.1; E_value=1.3e-60; Accession=PF00071.12; Description=Ras family
  Pfam module annotation: Pfam domain module=Arf::Miro::Ras; Domain location=1-165::12-117::12-167
MDISQRKRTLLKIIVLGDSGKFSQQYKATIGADFVTKEIQVDDKLVTLQIWDTAGQERFHSLGAAFYRGADCCVLVYDVNIHKTFDTLNNWHDEFLKQGDMNDPEAFPFVLLGNKVDVDGGNSRRVTEKKARDWCASRGNIPYFETSAKEGYNVEEAFSCVAKIALENEHDQDM

SEQ ID NO: 224035 - protein, 153 aa, Glycine max
  Coding DNA Sequence Number=SeqID_107257
  Homolog annotation: Hit_ID=Q338G4; Match level="QueryCoverage=53%, HitCoverage=78%, E-value=4e-13, Identity=46%"; Hit description =Expressed protein
MRCIRTPSQTLQLAQRNHLLKKKKPQGKDKCKSRVCWLVIPAVIQRASAEIVVFLQSVKTETRKNAPWLSVPQFGDWDQKGQVPDYSLDFSKIRETRKQNKTNISRASLGNEEEFMDSTTSSSVNTAHSSEHPQPHYHQTHSPTVRFLSTQAA

SEQ ID NO: 224036 - protein, 146 aa, Glycine max
  Coding DNA Sequence Number=SeqID_107258
  Homolog annotation: Hit_ID=Q1RTW4; Match level="QueryCoverage=85%, HitCoverage=83%, E-value=7e-14, Identity=43%"; Hit description=6,7 -dimethyl-8-ribityllumazine synthase
MDKFSRTILFFLLFCVLIILQFQPATLDHEEGGQNVDQDHPEKPKLSESHIKVPGRKSKLSYMIFKCSFLHQIWKIMYFFFLSFRGTGWVGDREYDGVKRTFREAVEKNFGKSKETVEESAETAAKLVEEAIHKTTEKVKESSDSA

SEQ ID NO: 224037 - protein, 71 aa, Glycine max
  Coding DNA Sequence Number=SeqID_107259
  Subcellular localization annotation: CTP_CleavageSite=58; ConfidenceScore=5.53e-01
MDVKAAPRLQLSAVVQPESIGRRPPSTCRLGVSREPQSLRVFVSSTMMRRRTTALEVSCSYGNISGSHSNQ

SEQ ID NO: 224038 - protein, 850 aa, Glycine max
  Coding DNA Sequence Number=SeqID_107260
  Gene Ontology: Mol. function=binding; Cellular component =intracellular; Biological process=protein amino acid phosphorylation
  Homolog annotation: Hit_ID=Q1RY75; Match level="QueryCoverage=97%, HitCoverage=83%, E-value=0.0, Identity=77%"; Hit description =Tetratricopeptide-like helical
  Pfam annotation: Domain name=PPR; Domain location=120-154; Score =20.8; E_value=0.005; Accession=PF01535.11; Description=PPR repeat
  Pfam annotation: Domain name=PPR; Domain location=156-190; Score=9.0; E_value=0.65; Accession=PF01535.11; Description=PPR repeat
  Pfam annotation: Domain name=PPR; Domain location=222-256; Score =41.5; E_value=2.9e-09; Accession=PF01535.11; Description=PPR repeat
  Pfam annotation: Domain name=PPR; Domain location=257-291; Score=4.5; E_value=2.2; Accession=PF01535.11; Description=PPR repeat
  Pfam annotation: Domain name=PPR; Domain location=323-357; Score =41.5; E_value=2.8e-09; Accession=PF01535.11; Description=PPR repeat
  Pfam annotation: Domain name=PPR; Domain location=424-458; Score =37.5; E_value=4.5e-08; Accession=PF01535.11; Description=PPR repeat
  Pfam annotation: Domain name=PPR; Domain location=525-559; Score =29.9; E_value=9e-06; Accession=PF01535.11; Description=PPR repeat
  Pfam annotation: Domain name=PPR; Domain location=626-660; Score =44.2; E_value=4.4e-10; Accession=PF01535.11; Description=PPR repeat
  Pfam annotation: Domain name=PPR; Domain location=661-695; Score =22.6; E_value=0.0014; Accession=PF01535.11; Description=PPR repeat
  Pfam annotation: Domain name=PPR; Domain location=696-730; Score=6.2; E_value=1.4; Accession=PF01535.11; Description=PPR repeat
  Pfam module annotation: Pfam domain module=PPR::PPR::PPR::PPR::PPR::PP R::PPR::PPR::PPR::PPR; Domain location=120-154::156-190::222-256::257- 291::323-357::424-458::525-559::626-660::661-695::696-730
MMRSQHRLLLGISHFKFLNKDNVSQTLHFSTLLPPFLQPHDSPILIQRKIGRELGKLLQLPSPNILTSHYYKKIHAHIVVLGFHQHDVFLVNTLLHAYSKMNLQSDAQKLFDTMPHRNLVTWSSMVSMYTQHGYSVEALLLFCRFMRSCSEKPNEYILASVVRACTQLGNLSQALQLHGFVVKGGFVQDVYVGTSLIDFYAKRGYVDEARLIFDGLKVKTTVTWTAIIAGYAKLGRSEVSLKLFNQMREGDVYPDRYVISSVLSACSMLEFLEGGKQIHGYVLRRGFDMDVSVVNGIIDFYLKCHKVKTGRKLFNRLVDKDVVSWTTMIAGCMQNSFHGDAMDLFVEMVRKGWKPDAFGCTSVLNSCGSLQALQKGRQVHAYAIKVNIDNDDFVKNGLIDMYAKCDSLTNARKVFDLVAAINVVSYNAMIEGYSRQDKLVEALDLFREMRLSLSPPTLLTFVSLLGLSSSLFLLELSSQIHCLIIKFGVSLDSFAGSALIDVYSKCSCVGDARLVFEEIYDRDIVVWNAMFSGYSQQLENEESLKLYKDLQMSRLKPNEFTFAAVIAAASNIASLRHGQQFHNQVIKMGLDDDPFVTNSLVDMYAKCGSIEESHKAFSSTNQRDIACWNSMISTYAQHGDAAKALEVFERMIMEGVKPNYVTFVGLLSACSHAGLLDLGFHHFESMSKFGIEPGIDHYACMVSLLGRAGKIYEAKEFVKKMPIKPAAVVWRSLLSACRVSGHVELGTYAAEMAISCDPADSGSYILLSNIFASKGMWASVRMVREKMDMSRVVKEPGWSWIEVNNEVHRFIARDTAHRDSTLISLVLDNLILQIKGFGYVPNAATFFLDD

SEQ ID NO: 224039 - protein, 127 aa, Glycine max
  Coding DNA Sequence Number=SeqID_107261
  Gene Ontology: Mol. function=nucleic acid binding; Cellular component= ribonucleoprotein complex; Biological process=RNA processing
  Homolog annotation: Hit_ID=Q9LHL3; Match level="QueryCoverage=83%, HitCoverage=23%, E-value=2e-37, Identity=68%"; Hit description=RNA -binding protein-like
  Subcellular localization annotation: CTP_CleavageSite=26; ConfidenceScore=5.04e-01
PITVIASTKKVKSLVSNINMLTQAIRSSSKLVLSVDGKKVKRKHPYTEREKEDLQSRTVVAENLPDDHSHQNLQKIFGMVGSVKTIRICHPQEPNSSRPKSDFFVSNKSFLPHVTWSLNQAPCACGV

SEQ ID NO: 224040 - protein, 60 aa, Glycine max
  Coding DNA Sequence Number=SeqID_107262
MENWRTALRNNFAGLQTPLGNNIHGAPKKSGAWRIGEQRYAITSRGSRLEGGGSMNSARQ

SEQ ID NO: 224041 - protein, 288 aa, Glycine max
  Coding DNA Sequence Number=SeqID_107263
  Gene Ontology: Mol. function=nucleotidyltransferase activity
  Homolog annotation: Hit_ID=Q9SJ03; Match level="QueryCoverage=89%, HitCoverage=88%, E-value=9e-95, Identity=63%"; Hit description =Expressed protein
MANTSLLPKPYYYRNFHYQHQRCFKINLPKWTTRASSAAPGVDLNTLESAISKKDSDAVKEALNQLSEVGWAKKWSSQPYVSRRTTSLRELTSLGIKNAENLAIPSVRNDAAFLFTVVGTTGFLGVLAGQLPGDWGFFVPYLIGSISLVVLAVVAYLLGLPIFDYSLDIGKEHVNLIDERLEKLIYSGQLDAKELDRLAVVSMAGLAAEGLTYDKVVGQSADLFSLQRFINRTKPPLSKDQQQNLTRWAVLFAASILKNNKVTHEALMAAMAKKASVLECIRVIENAA

SEQ ID NO: 224042 - protein, 322 aa, Glycine max
  Coding DNA Sequence Number=SeqID_107264
AKTHASFSSKKKPINFQASKQPILNMMHEELEAQWDSNRFTSPAIQDRFNNVTINWHLSPKRKDSIDETLVMEFYTNAYDPKSTYPTKAKPLPGTDNLLTHMTSKYHKMMAAKLCKLRKGFEMSHDASWRIHKESMNTLTSLGVYTPTTTLCPLLTLLTSTLVGQISQVLKSLRMDLDLGYFKRYCMVLSDIAIVLPEVPTKSCNMHHLSLHQPLTTLEVFSGHVQWPGVRPTILDEEGVVIAAKDARNRANDDEDNGGVYVKVGQAIEEDQDEGLGLKYGHVEKGSHAIHSTRPTSKSLWVEEIAIPFGNFEELPKQVGLN

SEQ ID NO: 224043 - protein, 113 aa, Glycine max
  Coding DNA Sequence Number=SeqID_107265
MEELGRTKEKDKRVLERWEGNFSSGVIVVTFQITCSRKCSMRMTMPRSRQTRREALSFLLPSFGLTHLLHPMTLSACNVHAAPISHNIFNYCTDRTSPYYPTSCLPYMHGKTE

SEQ ID NO: 224044 - protein, 176 aa, Glycine max
  Coding DNA Sequence Number=SeqID_107266
MGSSCIGVPLRPSLLCEPEYQVVWRLYDVTHATRWKALRGIERALPARERLDDLQMDAIVWCPYEDHGGVRPFVEQTFFSDFIKCGTDVRPYCSERVSLPYVILPEKGKPSHGPINLPSILVQPQPLADYVPGGEYSCQGMSHHQVIQQALQSLHEELVARCSSDTKIMEEACQGW

SEQ ID NO: 224045 - protein, 108 aa, Glycine max
  Coding DNA Sequence Number=SeqID_107267
MLDFGDELTLDGFRIPWLIWIQLLVFLLLLALLFCLSVIALDPSHHTTSPSASATATDSDLHTQQPSNHHSTAVTNRLQSTRVVDLSGSNSGFAVTTYNTPPTDFNYL

SEQ ID NO: 224046 - protein, 128 aa, Glycine max
  Coding DNA Sequence Number=SeqID_107268
MWPTTAANRARALAIATLELHLEESWAFAHLPTFGYCKAKTNALDDSIAKRWKPTRDQFRMALGAIQSLLDLKVVLEGTSHHQTIQQTLQLLQEGFKAGCTSERQRKKIAKAKDKDGDKGSKKGSKGI

SEQ ID NO: 224047 - protein, 242 aa, Glycine max
  Coding DNA Sequence Number=SeqID_107269
MENETLVTTTKLDRVDAKTAKMSMEHLFDIPKLGMNSKFAYLMILVRTICGVKVNISTNSIQEAISKFKGKDQILEYKDLIDEAKISKQLCNKYSTQGWFKGLHLCSSMFCLVPLVDKADKNVVKKKCPKIVKLLTDSYGVSIVERKIQNVMKIQENKRITRQGAQVDDFDNQEIEEMINKRNYPSPTTSKPASKLTSKKAKTLKTSINFSTKSDISDSDDSDDNQAINVVYEKRAREKMST

SEQ ID NO: 224048 - protein, 706 aa, Glycine max
  Coding DNA Sequence Number=SeqID_107270
  Gene Ontology: Mol. function=nucleic acid binding; Biological process= regulation of transcription
  Homolog annotation: Hit_ID=Q1T5G4; Match level="QueryCoverage=96%, HitCoverage=100%, E-value=0.0, Identity=75%"; Hit description=Zinc finger, CCCH-type
  Pfam annotation: Domain name=Ank; Domain location=119-154; Score =34.1; E_value=4.7e-07; Accession=PF00023.20; Description=Ankyrin repeat
  Pfam annotation: Domain name=Ank; Domain location=84-117; Score=16.9; E_value=0.072; Accession=PF00023.20; Description=Ankyrin repeat
  Pfam annotation: Domain name=zf-CCCH; Domain location=282-307; Score =26.4; E_value=0.0001; Accession=PF00642.15; Description=Zinc finger C-x8-C-x5-C-x3-H type (and similar)
  Pfam module annotation: Pfam domain module=Ank::Ank::zf-CCCH; Domain location=119-154::84-117::282-307
MCGGPEKSKSLSTPSSSAVEGSTNGKDMNKLTVHAADSFSCLLELASNNDFEDFKLALVRDVSLISEVGLWYVRQIGSKQIVLEHRTPLMVAAMYGSIDVLKLILSCPETDVNFSCGTDKSTALHCAASGGSVNAVDIVKLLLSAGADISCVDANGNRPVDVIVVPPKLEGLKATLEDLLSDTASDGSIAAHLSPPENGLPSSPMASKFTDAAVNSVSEKKEYPIDPSLPDIKNSIYATDEFRMFSFKVRPCSRAYSHDWTECPFVHPGENARRRDPRKFHYSCVPCPDFRKGACRRGDMCEYAHGVFECWLHPAQYRTRLCKDGTSCNRRVCFFAHTAEELRPLYVSTGSAVPSPRSSASTPNVMDMAAAMSLFPGSPSSISSMSPSPFAQPMSPSTSGISHSSNAWPQPNVPALHLPGSNIQTSRLRSSLSARDMPPEDLDVLQDFDGQQHLLNDLGCFSQPHPGGISVSRSGRSKTLTPSNLDELFSAEISSSPRYSDPAVASVFSPTHKSAIMNQFQQLQSSLSPINTSVLSPRNVEHPLFQASFGVSSPGRMSPRSMEPISPMSSRLSFAQREKQHQQLRSLSSRDLGANIPVSMVGSPVNSWSNWGSPHGNGKVDWSVNGNELGRLHRSSSFELGNNGEEPDLSWVQSLVKESPSEIKELGGSGPVAFADGPSSNPQVESVDHSVLGAWLEQMQLDQLVV

SEQ ID NO: 224049 - protein, 113 aa, Glycine max
  Coding DNA Sequence Number=SeqID_107271
MLVSGVGMSGSGTWCEGGNGLNERREEEESLFHTLFWCKPALEIWHTYYKWCGLQSVFPGTIKEHYLQRVLIKEKKNVWCGLYGRQETTLSSGEVSSITTRSCKKLSFICGHG

SEQ ID NO: 224050 - protein, 184 aa, Glycine max
  Coding DNA Sequence Number=SeqID_107272
MLYGKLRHNTLDQDYYKSINYIKMLAPMILDDLDLDPRTHKDNKVKPVEESCTFKLGDKERQVSQIGDHLNVGVSPSGQSISYCICILILTDDHVSYVMDMRYQISMQDSSLLQSQRYVYRPLDKGGHAICVATQKYLREKCLSHQIPMLSHQLASRPYSASCSHGLSKGVLLSMLGDQGQHIL

SEQ ID NO: 224051 - protein, 182 aa, Glycine max
  Coding DNA Sequence Number=SeqID_107273
  Gene Ontology: Mol. function=nucleic acid binding; Biological process= DNA integration
  Homolog annotation: Hit_ID=Q8RUQ2; Match level="QueryCoverage=73%, HitCoverage=13%, E-value=4e-20, Identity=38%"; Hit description =Putative retroelement
MELEQIDVKISFFHGRLEEDILVQQLEGFEVEGNKNYVYRLKSEFEMKDMGAAKKIIGMEIKRDRIHKKLFFVLERIHSKSFESFSDDIFKTNLDARRFVTRYAFMINNFLVSWKATLQPTVALYTTKVEYVALAEATKEGIWLKGIEKPIIGLNEEDTLMPCVQSRFLDKGTNATRWIWLQ

SEQ ID NO: 224052 - protein, 53 aa, Glycine max
  Coding DNA Sequence Number=SeqID_107274
  Gene Ontology: Cellular component=chloroplast
MPWMIHISGSGANEHIKLSMWLRALTVQAQQRNYQGRALPLIKIRRTIAHVIL

SEQ ID NO: 224053 - protein, 184 aa, Glycine max
  Coding DNA Sequence Number=SeqID_107275
  Gene Ontology: Mol. function=nucleic acid binding; Cellular component= intracellular; Biological process=metabolic process
  Homolog annotation: Hit_ID=O49677; Match level="QueryCoverage=94%, HitCoverage=36%, E-value=2e-41, Identity=33%"; Hit description =Putatative protein
  Pfam annotation: Domain name=PPR; Domain location=120-154; Score =28.0; E_value=3.3e-05; Accession=PF01535.11; Description=PPR repeat
  Pfam annotation: Domain name=PPR; Domain location=19-53; Score=23.5; E_value=0.00074; Accession=PF01535.11; Description=PPR repeat
  Pfam module annotation: Pfam domain module=PPR::PPR; Domain location =120-154::19-53
  Subcellular localization annotation: CTP_CleavageSite=95; ConfidenceScore=5.10e-01
MVTHYCGVTPCINRFSTLFTWNSNFRHLVNQGHAQNALILFRQMKQSGITPNNSTFPFVLKACAKLSHLRNSQIIHAHVLKSCFQSNIFVQTATVDMYVKCGRLEDAHNVFVEMPVRDIASWNAMLLGFAQSGFLDRLSCLLRHMRLSGIRPDAVTVLLLIDSILRVKSLTSLGAVYSFGIRIG

SEQ ID NO: 224054 - protein, 479 aa, Glycine max
  Coding DNA Sequence Number=SeqID_107276
  Gene Ontology: Mol. function=oxidoreductase activity; Cellular component=membrane; Biological process=electron transport
  Homolog annotation: Hit_ID=Q8W228; Match level="QueryCoverage=95%, HitCoverage=90%, E-value=1e-133, Identity=52%"; Hit description =Cytochrome P450
  Pfam annotation: Domain name=p450; Domain location=8-468; Score =374.4; E_value=1.7e-109; Accession=PF00067.12; Description =Cytochrome P450
KKKGKRLPPGPKGLPILGNLHKLGSNPHRDLHELAQKYGPVMYLRLGFVPAIIVSSPQAAELFLKTHDLVFAGRPPHEAAKYMAWEQKNLAFGEYGSYWRNVRKMCTLELLSQTKINSFRPMREEELDLLIKNLRGASNDGAVVDLSAKVATLSADMSCRMILGKKYMDQDLDQKGFKAVMQEVLHLAAAPNIGDYIPYIGKLDLQGLIRRMKTLRRIFDEFFDKIIDEHIQSDKGEVNKGKDFVDAMLDFVGTEESEYRIERPNIKAILLDMLVGSIDTSATAIEWTISELLKNPRVMKKLQRELETVVGMKRKVGESDLDKLKYLEMVVKEGLRLHPVAPLLLPHHSREDCMVGEYFIPKNSRVIVNAWTIMRDPSAWDEAEKFWPERFEGSNIDVRGKDFRFLPFGSGRRVCPGLQLGLNTVLLTVAQLVHCFDWKLPNNMLPCELDMTEEFGLSMPRANHLLVIPTYYRLHDQSC

SEQ ID NO: 224055 - protein, 426 aa, Glycine max
  Coding DNA Sequence Number=SeqID_107277
  Gene Ontology: Mol. function=oxidoreductase activity; Cellular component=membrane; Biological process=electron transport
  Homolog annotation: Hit_ID=Q8W228; Match level="QueryCoverage=91%, HitCoverage=89%, E-value=1e-108, Identity=53%"; Hit description =Cytochrome P450
  Pfam annotation: Domain name=p450; Domain location=27-425; Score =47.0; E_value=4.1e-13; Accession=PF00067.12; Description=Cytochrome P450
MIWIALFLVSLAFLRLWRSNKNAKKLPPGPKGLPILGSLHKLGPNPHRDLHKLAQKYGPVMHLRLGFVPTIVVSSPKSAELFLKTHDLVFASRPRFVADQYISWGQRNLGFAEYGSYWRNMRKMCTLELLSQSKINSFRRMREEELDLLIKLVREAANDGAAVDLSVKVATLIADMSCRMILGKKYMDQDMCGRGFKAVIQEAMRLLATPNVGDYIPYIGAIDLQGLTKRFKVLYEIFDDFFEKVIDEHMESEKGEDKTKDFVDVMLGFLGTEESEYRIERSNIKAILLGDEETPNGIGNCGGYEEEGGGIGPGQVEVFGDGCKGKHEAPSSDPSAWVEAEKFWPERFEGSNIDVRGRDFELIPFGSGRRACPGLQLGLITVRQTVAQLVHCFDWKLPNNMFPDDLDMTEAFGLTMPRANHLHAIP

SEQ ID NO: 224056 - protein, 108 aa, Glycine max
  Coding DNA Sequence Number=SeqID_107278
MILNIKWREEDHPPFPLHRTTTVPAFIIERRSTTLLEIDHNKHSNQTSKTKLTNEVEAAENESSSRVSVAVPLSVGCRGVGGSGFGGEVQPAGSESAAVPELRDGAGG

SEQ ID NO: 224057 - protein, 69 aa, Glycine max
  Coding DNA Sequence Number=SeqID_107279
MAELLGLSPNSADAAIFRNGSLKTNSASTVSEEIHKGSYGNMLRPVLVADLIAVLLVMIPIGCSIYRIN

SEQ ID NO: 224058 - protein, 328 aa, Glycine max
  Coding DNA Sequence Number=SeqID_107280
  Gene Ontology: Mol. function=protein binding; Cellular component =nucleus; Biological process=ribosome biogenesis and assembly
  Homolog annotation: Hit_ID=Q9ZUN8; Match level="QueryCoverage=83%, HitCoverage=54%, E-value=3e-91, Identity=61%"; Hit description =Putative WD-40 repeat protein
  Pfam annotation: Domain name=WD40; Domain location=147-185; Score =16.9; E_value=0.073; Accession=PF00400.22; Description=WD domain, G -beta repeat
  Pfam annotation: Domain name=WD40; Domain location=193-232; Score =37.4; E_value=4.8e-08; Accession=PF00400.22; Description=WD domain, G-beta repeat
  Pfam annotation: Domain name=WD40; Domain location=237-276; Score =30.6; E_value=5.7e-06; Accession=PF00400.22; Description=WD domain, G-beta repeat
  Pfam annotation: Domain name=WD40; Domain location=83-122; Score =10.0; E_value=2.5; Accession=PF00400.22; Description=WD domain, G -beta repeat
  Pfam module annotation: Pfam domain module=WD40::WD40::WD40::WD40; Domain location=147-185::193-232::237-276::83-122
MHVHVPQAEKPSWNSIGIFKVSNITGKRREPVPKLGTDDTEMDGEDSDSDDDSEDEEGGAQGPSLQATSSSFEFLLFHFLTASNPMLRKVAHQGCVNRIRSMPQNPHICAAWADTGHVQVWDLNSHLNALAESETEGVQGVAAVFNQDPLYKFKHKDEGYAIDWSPLVPGRLASGDCNNCIYLWEPTSAGTWNVDNAPFTGHTASVEDLQWSPTEPDVFASCSVDGNIAIWDTRLGKSPAASFKAHNADVNVMSWNRLASCMLASGSDDGTISIRDLRLLKAYYIEFVKLSDMSFFFPCFIITSFFYHSCANQVPINPCMKELLDALW

SEQ ID NO: 224059 - protein, 209 aa, Glycine max
  Coding DNA Sequence Number=SeqID_107281
METKQSSVTVTLSYGALTCAAEFLATLLASAVVKASLLAPGIKVKSQGSGFVWVIRLDMPLSDLYRLLLINTPTAKGESKIQSEDKQRDAEGEDGNDDEGDDDDDGDGGFGEGEEELSSEDGGGYGNNSNNKSNSKKAPEGGAGGAEENGEEDEDEDGDDQDDDDEDDDDDDEEDEAGEEEDEDGAEDEENEEDEEDEEALQPPKKRKK

SEQ ID NO: 224060 - protein, 91 aa, Glycine max
  Coding DNA Sequence Number=SeqID_107282
  Homolog annotation: Hit_ID=Q2XPX3; Match level="QueryCoverage=45%, HitCoverage=8%, E-value=2e-17, Identity=92%"; Hit description=WD-40 repeat protein-like protein
MTRGIKHRQKAKSKKKVSKKESGSSSSLAPEIPAKVWQPGVDKLEEGEELQCDPSAYNSLHAFHIGWPCLRKRKENKTLSFFDRQTCLFLL

SEQ ID NO: 224061 - protein, 726 aa, Glycine max
  Coding DNA Sequence Number=SeqID_107283
  Gene Ontology: Mol. function=protein serine/threonine kinase activity
  Homolog annotation: Hit_ID=Q9FJP7; Match level="QueryCoverage=52%, HitCoverage=78%, E-value=4e-70, Identity=44%"; Hit description =Genomic DNA, chromosome 5, P1 clone:MQN23
  Pfam annotation: Domain name=DUF367; Domain location=75-198; Score =261.2; E_value=2.2e-75; Accession=PF04034.4; Description=Domain of unknown function (DUF367)
  Pfam annotation: Domain name=DUF618; Domain location=254-316; Score =80.3; E_value=6.2e-21; Accession=PF04818.4; Description=Protein of unknown function, DUF618
  Pfam module annotation: Pfam domain module=DUF367::DUF618; Domain location=75-198::254-316
MAMGRRCVVEVEIESERSPLGYNNFAKWGITDKGDSELIAHNQVDTTTNNSYSENGEGEEEEEELTEPKIKLAIPAGNQCVSREDYSLIQKKGLAVVDCSWARLDDVPFVRLRCTAPRLLPWLVAANPVNYGRPCQLSCVEALSAALTICGEEKTANLLLDKFKWGHAFMSLNGELLRAYSKCQNSAEIISVQNAWLSQESQIPRAPTDSEVIMLPDDLVEVIGSTGNSLSIHEDKAVKAELVVGTWNKQFHNSEKVQRVPLLYLANDILQNSRRKGNEFVTEFWKVLPSALKDVLEKGDDQENRAVFRLERRVFGSQAKSLKNVILGEEAPPQLEFNKKRSRSVRIVKKDSRSIKTVRLRVLVKLSIGGTAEKIVSAFHTVLNEHSNEDAEMSRCKSAVHRVRKMEKNVDIACAVVKDPKRKTLSKELVEEENILKECIENLKLVEASRTALSWCPLAIVCAFMYQESELENVRTQIQVAQAQVEEASYMRKRLDDEDSSYKASISTTSLTDVNTKSEAATKKSAAAIAAEVADKLTASTSSQLIMTSVLSTFAAEEAKSACLTSESMSKPEKSIPISDPNVFVSSQQLIATPNHSYPSVLVPQPTLQNPAAASQGQYQMLCNSSSQHYLQSTGGVISSYGYGSITPLPPGPLPPHMVGPVVPLTHQAMQITQQQPTPIAQHQPIKMTQQAPAPPSFRPLQPPGMVYYANSMLTGVELENAWTPG

SEQ ID NO: 224062 - protein, 160 aa, Glycine max
  Coding DNA Sequence Number=SeqID_107284
  Gene Ontology: Mol. function=DNA binding; Biological process=DNA integration
  Homolog annotation: Hit_ID=Q1SKC8; Match level="QueryCoverage=75%, HitCoverage=32%, E-value=1e-23, Identity=46%"; Hit description =Integrase, catalytic region
MALSQFSLWWAFSGDRTTAKVLQAGFFWPSIFKDAHDHALKFVNFDDSLSGEKHKLQLLELEEMRLNAYESSKIYKQKMKVYHDRKMIKRNFQLGQQGKLKSKWSGLFKTKEVKSYRAVELMDPTSNEPKRSWIVNGQRLKIYNGGNIERLSTIIHLQDP

SEQ ID NO: 224063 - protein, 274 aa, Glycine max
  Coding DNA Sequence Number=SeqID_107285
  Gene Ontology: Mol. function=binding
  Homolog annotation: Hit_ID=Q1SJ53; Match level="QueryCoverage=96%, HitCoverage=11%, E-value=1e-112, Identity=78%"; Hit description=C2
  Pfam annotation: Domain name=C2; Domain location=136-235; Score=38.9; E_value=1.7e-08; Accession=PF00168.20; Description=C2 domain
KHIYPSPLYISNKVFILIAAIEKDLWASGTVNDEYLKALNSLFTNFPRLRATEPATLSIPHLVTALKTGSEACQEAALDALFLLRQAWSACPAEVSRAQSIAAADAIPLLQYLIQSGPPRFQEKAEFLLQCLPGTLVVIIKRGNNMKQSVGNPSVYCKLTLGNTPPRQTQRGHLILSVYALGSSDMDIKVVSTGPNPEWGESFSWTFESPPKGQKLHISCKNKSKVGKSKFGKVTIQIDRVVMLGSVAGEYALLPQSKSGPPRNLEIEFQWSNK

SEQ ID NO: 224064 - protein, 39 aa, Glycine max
  Coding DNA Sequence Number=SeqID_107286
MPPLVAVLIIWKRAVQEKRTHKSMELESTGYENANGGRK

SEQ ID NO: 224065 - protein, 43 aa, Glycine max
  Coding DNA Sequence Number=SeqID_107287
MTKRVTTINISMTRNLGRVDVYASKTRKMMSRDMQGANLEEAR

SEQ ID NO: 224066 - protein, 195 aa, Glycine max
  Coding DNA Sequence Number=SeqID_107288
  Gene Ontology: Mol. function=peptidyl-prolyl cis-trans isomerase activity; Cellular component=chloroplast thylakoid membrane; Biological process=protein folding
  Homolog annotation: Hit_ID=Q9SCY3; Match level="QueryCoverage=81%, HitCoverage=73%, E-value=2e-64, Identity=71%"; Hit description =Probable FKBP-type peptidyl-prolyl cis-trans isomerase 4, chloroplast precursor
  Pfam annotation: Domain name=FKBP_C; Domain location=96-181; Score =93.4; E_value=6.9e-25; Accession=PF00254.18; Description=FKBP-type peptidyl-prolyl cis-trans i
  Subcellular localization annotation: CTP_CleavageSite=32; ConfidenceScore=5.00e-01
MALSVSSPSCVRVPSCFWKPNGKSCKERTKVSCAAHNDNKNPLVGIGIGVVTSCVMGLTALDADATRIEYYATVAEPLCEYNYVKSGLGYCDIAEGFGDEAPLGELINVHYTARFADGIVFDSSYKRARPLTMRIGVGKVIKGLDQGILGGEGVPPMRIGGKRKLQIPPHLAYGPEPAGCFSGYVSSHFGNCYII

SEQ ID NO: 224067 - protein, 125 aa, Glycine max
  Coding DNA Sequence Number=SeqID_107289
  Homolog annotation: Hit_ID=Q1S960; Match level="QueryCoverage=46%, HitCoverage=9%, E-value=7e-20, Identity=81%"; Hit description =Prefoldin
MSRRSEIENGEIAGERWKKGEAERGEFVSGKWRKLVSNFLILQDRLVAKIRQSATESPNPKPEVGEIDTSPPFQSVKDVVSLFGEGAFSGEKPIFKKAKPYSAEVIVIFIFALVLNHKSHGARQH

SEQ ID NO: 224068 - protein, 139 aa, Glycine max
  Coding DNA Sequence Number=SeqID_107290
  Subcellular localization annotation: CTP_CleavageSite=26; ConfidenceScore=5.00e-01
MWSSALFGDLSIFRPRLLQSPLPQPEASKPVDMRRPNKVIFSFSKTLVSSDRDYCSLHFINRRQASPLTRKDKYGHWFFLETLVSFDRDYCSLHFINRRQASPLTCRDQIKSYTPFWRPQCLPTETTTVSISSSRDKQA

SEQ ID NO: 224069 - protein, 374 aa, Glycine max
  Coding DNA Sequence Number=SeqID_107291
  Homolog annotation: Hit_ID=Q2HRX8; Match level="QueryCoverage=95%, HitCoverage=60%, E-value=5e-18, Identity=34%"; Hit description=IMP dehydrogenase/GMP reductase
  Pfam annotation: Domain name=DUF1723; Domain location=96-139; Score =37.8; E_value=3.8e-08; Accession=PF08330.1; Description=Protein of unknown function (DUF1723)
MTGAADAVQTEGVATDGSLGSPAADEGFLGGPRDPSILTDFAEHVAHNIWSGQERPDLKLVSHGRKVDKIGRPAPEIEGLIAGTGLSPLIRCSVITTDPGLISAFVESTFHLPVGELTITLDDVASLLHLPITGALHTFEPLVTSDAIGLLTELLEDQTMGCCSLHVSAPLGGLYSFRQQEFNPCTCRAPGGFHGPGPGRGICLGSGCIGPHVRASERRVAGLYTADGRLHYTSLVHTCVVHDAYDEGSPRACRWLTGKAHMTGIKGALYRTRMDALTVTDVCWMPYAEHHGVRGFDLISSYTGQLRWGQIVVYVRPERVLRQFGYIQIVPPPPVCDSLTIDDIDDWWLHFSDHLLPAGELCVVPGQVVPDYMD

SEQ ID NO: 224070 - protein, 199 aa, Glycine max
  Coding DNA Sequence Number=SeqID_107292
  Homolog annotation: Hit_ID=Q1T493; Match level="QueryCoverage=95%, HitCoverage=38%, E-value=1e-11, Identity=25%"; Hit description =Nucleic acid-binding, OB-fold, subgroup
MSHKENLLCELNTEKGTWKIVVRITDIWRLNKHNGRQSIEMVLMDHTGTKIGATLWQELFPEFEPKLHCGGAYVIQNVKVVDTHSDYKTTSVKEVDRPEIPPNVHSITSFADIISGVAKPDTLVDVVGVIAEVIERKTVNPVYRVTVKLRDNSHVEIIMTVWEEYALQLDDTIEKNHFVQKPLVVMLTLAKIKEPKGQY

SEQ ID NO: 224071 - protein, 345 aa, Glycine max
  Coding DNA Sequence Number=SeqID_107293
  Homolog annotation: Hit_ID=Q1S8W8; Match level="QueryCoverage=28%, HitCoverage=39%, E-value=2e-42, Identity=81%"; Hit description=RNA -binding region RNP-1
  Pfam annotation: Domain name=RRM_1; Domain location=178-249; Score =90.1; E_value=6.6e-24; Accession=PF00076.12; Description=RNA recognition motif. (a.k.a. RRM, R
MTTRFWRKRHFHFCMVLMNVVEVHDNKGHTLVIVVCTKSQSINPSPLAVEVQGCLMSGISVHLGYFGVQKAKDGFKEVITLIGRSFSNIEVRLQISGIHLRFRTTKQSPPPLSLGVWNRDCVCFANCEAAGEIAPNMRGRSCSYSPSPSPPRRYSRRRHSLSPRGRYRGCDRDLPTSLLVRNLNRDCRPEDLHGPFGQFGPLKDVYLPRDYYTGEPRGFGFVQYVDPADAADAKYHMDGRILLGREITVVFAEENRKKPAEMRAREHRRDRSHDYRRSSRTYSPSPDYSPSPRRRRHYRICSVCTHLYYDSGQSHQGTESIGIDHTLDHLMHQEAAAEVGVTIGV

SEQ ID NO: 224072 - protein, 286 aa, Glycine max
  Coding DNA Sequence Number=SeqID_107294
  Homolog annotation: Hit_ID=Q1SMF0; Match level="QueryCoverage=65%, HitCoverage=37%, E-value=1e-19, Identity=31%"; Hit description =Tetratricopeptide-like helical
MNEENEEATGVNEEHVDCSDAFNTSQVFATRDDVLQWARLVAYEIGFVAVIMRSNTNTSMRGMTSVVLIGFERSGQHRSRKKDFVRIDTCSRKCGCSFKFHGKPVVGGQGRMVKLMYESPYVGRLTKDEKTIIADMTNSMVKPRNILLMLKEHNANSCITIKQIYNARSAYRSSIRDSDTEIQHLIKLLERDQYIHWHKLKDEDIIVPTKQIGFMDKWMDITDMGYVIASRYNFILGSLSLQQSMTLFPLRTQPPTDFSVHCIICIGHFFGNHFFLGRFIVMIFLN

SEQ ID NO: 224073 - protein, 848 aa, Glycine max
  Coding DNA Sequence Number=SeqID_107295
  Gene Ontology: Mol. function=helicase activity; Biological process =viral genome replication
  Homolog annotation: Hit_ID=Q1SN45; Match level="QueryCoverage=86%, HitCoverage=71%, E-value=1e-104, Identity=38%"; Hit description=AAA ATPase
  Pfam annotation: Domain name=DUF889; Domain location=732-845; Score= -70.7; E_value=1.1e-06; Accession=PF05970.5; Description=Eukaryotic protein of unknown function (DUF889)
MSTLNSSPCTAPHTTTGCRPTQIGMTSQHINSGRYTIFNSKLIEHISDDTDDELDITQEDIVTDYSFDDIATKDFADIDYDGNLDAPYDNENTGYKDIGDSIWQCKQCKAKMCRDSQAKKFQQNICLYNLMFAFTSPGVKVDTSYNTGRGPPTLRIHGQSHHLIGSLLPMPDNSPKFAQLYIYDTENEVNNRLSQYPIKNNVDEDIIIGIKNMLDTHNPYAQKFRMARDKLESSAVCDLKLKLISDRQSDGRLYNLTNASEVAALIVGDEHTVNNRDIIIEKQTGMLQRINELHPAYLPLQYPLLYPHGEDGYRPNILHKDHPNNHAAKRNKVTMREYVSAPEACWKIFAFPMHGRAPAVERLYFHLENQQSVYWKDSQEIGTVLDKSTIKESMFTAWMDFNKIYHHGRDLTYGEYVSKFVYDARKRCWKPRKQGNTIGGLIWVPPSSGELFCMRMMLSSAKGSQCYEDIRTVENVVYHTFREACFAKGFLGSDQEFVEYVWKQTWQWMADDIVFNHRRQGIQLTDKEKMHLCLTEIENLLQANRKILRDFPSMSYPLGYAANPHQNNLIYNELAYDRDILATEFDKCYQSLTDEQASIFNKIMHVVATQSGGVYFLYGYGGTGKTFVWKTLSSAILSTGGIVLTVASSGIASILLSGGRTTHSKFAILVPATQNSTRNIHQGSDLAELLHITKLIIWDEAPMCHRYSIEALDKSLQDIMHNGNPFGGKVIVFGGDFHQILPVVPRGDGKLEEPNDGYGEITIPDEFLIKDFQDPIQAIVEATYPDLLHNYNNGDFLQKKVVLASTKDVVDKINDYVLSLIPDIRNTQSQAQNQGWYSHHPTTKSGPS

SEQ ID NO: 224074 - protein, 148 aa, Glycine max
  Coding DNA Sequence Number=SeqID_107296
MTQRGEAKVRGDARSIKGGVESVPHFAATRFVFLLAYKIIVAPPSLSPSSASVGSVDAVHTTTVTIPPHSPGSRLCFEDIDGKLMHFSNYLTSETCQAIAERLERLLNLRIVTEGTKTYDIMQDYLRITRGVTVDRNLVTALSEDDNS

SEQ ID NO: 224075 - protein, 93 aa, Glycine max
  Coding DNA Sequence Number=SeqID_107297
MAVVEGYDYDLIGKLSLGSSPHKCVKGMRQCSKCCSVDNYQRIGIVGAACWACEAVLHMRNCMENLHAVDGGGHGINDDHQIDHDEETVSWVH

SEQ ID NO: 224076 - protein, 583 aa, Glycine max
  Coding DNA Sequence Number=SeqID_107298
  Gene Ontology: Mol. function=inositol or phosphatidylinositol phosphatase activity; Biological process=abscisic acid mediated signaling
  Homolog annotation: Hit_ID=Q9FJQ6; Match level="QueryCoverage=85%, HitCoverage=91%, E-value=0.0, Identity=62%"; Hit description =Inositol-1, 4, 5-trisphosphate 5-phosphatase-like protein
  Pfam annotation: Domain name=Exo_endo_phos; Domain location=140-544; Score=149.5; E_value=8.9e-42; Accession=PF03372.13; Description =EndonucleaseExonucleasephosphatase family
  Subcellular localization annotation: CTP_CleavageSite=41; ConfidenceScore=5.17e-01
MSSFTGARSKANANSEMTKANEINLCPVNTSTITSTSPDTSAKNEKKKKSILPKIFGSKRNGRGSDEETLKTSSAEEGDGVTLDLENKIETRRKAFLEAAPIMRKSFSERESSPGIEGLNLSNFERPMITMETELQSFRIFVATWNVGGKSPSYDLNLQDFLLVEGSADIYVLGFQEIVPLSAGNVLVIEDNEPAAKWLALISQALNKPRNEYSDSSDSGTGSKTQSSSKESKSPASLNFFQKPSLKVISKNFRAEGSSLLKACNCPVESPSRERRRMRKFSDPMSKLDPELRGDDTVEELLSIAEIPSSASQSRYSLISTKQMVGIFLTIWTKKELVPHIGHLRADSVGRGIMGCLGNKGCISISMSLHQTSFCFVCSHLASGEKEGDELKRNSDVAEILKGTQFPRICKNPCRRAPEKIVDHDRIIWLGDLNYRVALSYEETRVLLEDNDWDTLLAKDQLNMERDAGRVFNGFKEGRVVFAPTYKYSHNSDSYAGETVKSKKKRRTPAWCDRILWRGNGIEQLSYIRGESRFSDHRPVCAVFSVDVEVRSRNNRFRKGYSYTSPRPEYEDFIPQRHSFYDY

SEQ ID NO: 224077 - protein, 453 aa, Glycine max
  Coding DNA Sequence Number=SeqID_107299
  Gene Ontology: Mol. function=transcription regulator activity; Cellular component=nucleus; Biological process=regulation of transcription, DNA-dependent
  Homolog annotation: Hit_ID=Q1T1X6; Match level="QueryCoverage=99%, HitCoverage=99%, E-value=1e-111, Identity=48%"; Hit description =Ethylene insensitive 3
  Pfam annotation: Domain name=EIN3; Domain location=3-355; Score =578.9; E_value=4.8e-171; Accession=PF04873.4; Description=Ethylene insensitive 3
MVEIHEEINPFDQEENEDIGEEEIDYDQLKKRMWKDRILLQKMKEKRPKEEPVQEAKQEASRRKKMSRAQDSVLKYMMKIMEVCNAQGFVYGIVPEKGKPVTGSSDSLREWWKEKVKFDQNAPSSIAEYLPLLETDELDPSSYIHLLNDLQDTTLSSLLSALMQHCIPPQRRFPLERGLAPPWWPTGAENWWGEQGLLAHEHGPPPYKKPHDLKKAWKVSLLAAVIKHMSPDLYKLRRSVTQSKTLQDKMTTRDTATWSKVMNQEETLLQLANKCLKISPSEEDDKNECESSTSSSTIIHEGSHLGGSIEKRKSDLVFDLDAVIDKLYACQYYQCPQSEMGMGFLDKNTRMNHESLCAYRTNEGQRVLLQDSLSNDTQNENNNLVGHLINDEFRDIAGKTSEEDYGGLWPNSLEDLDLQAALNQMDMDLNPNPEQDTPHGQDVTSIWDLAYKY

SEQ ID NO: 224078 - protein, 76 aa, Glycine max
  Coding DNA Sequence Number=SeqID_107300
  Gene Ontology: Mol. function=dihydroxy-acid dehydratase activity; Cellular component=mitochondrion; Biological process=branched chain family amino acid biosynthetic process
  Homolog annotation: Hit_ID=Q9LIR4; Match level="QueryCoverage=96%, HitCoverage=12%, E-value=3e-20, Identity=64%"; Hit description =Dihydroxy-acid dehydratase
GDRNVVVVPLRCHDSLNVVGNEVLGREAVAHATCAHGDGVTDANDVEVEGHHAGGDAVSHGLEEVEVHVVGVALVL

SEQ ID NO: 224079 - protein, 75 aa, Glycine max
  Coding DNA Sequence Number=SeqID_107301
MYENSNDVSKKSARQLVEYIKLLQIYEHFTTVASSIAVEHYHERKPRACHWKSRKALPKSAYRKRLDRLTFDVLC

SEQ ID NO: 224080 - protein, 68 aa, Glycine max
  Coding DNA Sequence Number=SeqID_107302
MDDLQGTLGYNGRKGSKNLGELVSEDYPTFRVFYPTTWRVGLHHLTTNNFQLEPSSKEDEDDPFEDSS

SEQ ID NO: 224081 - protein, 77 aa, Glycine max
  Coding DNA Sequence Number=SeqID_107303
MGWCGVGDGRELVLSEKMWWYNRWRPYFLRFGLYLMMNDRWLWTVGESSFSLALAYQVITSEVSISLTLVNFPVLEV

SEQ ID NO: 224082 - protein, 94 aa, Glycine max
  Coding DNA Sequence Number=SeqID_107304
MVLQASNNQENYHFDTIEKEREKEMKNMVKYFCVALTRKNIRGKFILLKEDGEKWTLEPMSVGGGFKTFDLMGFDGGVRKQNCISMLRMHLACG

SEQ ID NO: 224083 - protein, 390 aa, Glycine max
  Coding DNA Sequence Number=SeqID_107305
  Gene Ontology: Mol. function=carbohydrate binding
  Homolog annotation: Hit_ID=Q6ZLH2; Match level="QueryCoverage=76%, HitCoverage=61%, E-value=1e-82, Identity=49%"; Hit description =Lipase-like protein
  Pfam annotation: Domain name=DUF620; Domain location=125-378; Score =471.9; E_value=8.1e-139; Accession=PF04788.3; Description=Protein of unknown function (DUF620)
PWSSSLCTHAFSSFCVVCFTFQQPEEEKAVMGRLAPLSEEPINEENEGYNNNSNPKKCLQSWRNWNWIKTHFSLVFNKKSNLKILLSVLGCPLFPVPVSSSAQYIIQHFRAATGCRKLEGTVKNVFTTGKVTMDVVDELGSAGGSVNLEKGCFVMWQMVPDKWQIELVLGGQKVVAGSNGAIAWRHTPWLGVHAAKGGVRPLRRALQASSSSSSCLGLDPLAVSSVFCAAQYMGEKEISGMDCFVLKLSAEQKDLVERSDSKAEMIKHAIFGYFSQRSGLLVYLGDSYLTRIQAPGSHPTYWETTMSTKIEDYRIVDGVMIAHAGSSTTLITRFGDNLKAGPSITRLEESWTIDDVAFYVKGLSLDCFIPPQELQRDCSSDDELGWRSHA

SEQ ID NO: 224084 - protein, 54 aa, Glycine max
  Coding DNA Sequence Number=SeqID_107306
MTKVLMLDMTMAEGVDAREVKVRPNEGVAVVARGVDDGEGDVRRRDDGREEEDG

SEQ ID NO: 224085 - protein, 103 aa, Glycine max
  Coding DNA Sequence Number=SeqID_107307
  Gene Ontology: Mol. function=amino acid transporter activity; Cellular component=integral to membrane; Biological process=amino acid transport
  Homolog annotation: Hit_ID=O64759; Match level="QueryCoverage=88%, HitCoverage=16%, E-value=6e-12, Identity=44%"; Hit description =Putative amino acid transporter
MSLLGVIQELGKLRSSGDGDTVEVEGSCGDTIGGPHASGGDEGSESHEMNKMLNWWDLTWFRIGIVTGFDIFVLTDLKARMVVRPVVVLSYISGGLWSSHRND

SEQ ID NO: 224086 - protein, 618 aa, Glycine max
  Coding DNA Sequence Number=SeqID_107308
  Homolog annotation: Hit_ID=Q08891; Match level="QueryCoverage=55%, HitCoverage=55%, E-value=1e-119, Identity=62%"; Hit description=Male sterility protein 2
  Pfam annotation: Domain name=Branch; Domain location=466-618; Score =147.1; E_value=4.5e-41; Accession=PF02485.11; Description=Core-2I -Branching enzyme
  Pfam annotation: Domain name=NAD_binding_4; Domain location=124-417; Score=294.8; E_value=1.6e-85; Accession=PF07993.2; Description=Male sterility protein
  Pfam annotation: Domain name=RmlD_sub_bind; Domain location=171-400; Score=-186.4; E_value=0.043; Accession=PF04321.7; Description=RmlD substrate binding domain
  Pfam module annotation: Pfam domain module=Branch::NAD_binding _4::RmlD_sub_bind; Domain location=466-618::124-417::171-400
  Subcellular localization annotation: CTP_CleavageSite=34; ConfidenceScore=5.35e-01
MAYSYSSSLLTKLIFGVSQNNELCHSRRKGNVVYCQGGGKNVIKSSSSGSLSSVLTERSSLVGTDHEAAVTLMDAGSLVLSQNGKSQAEIVVKDLVPYGGTTTLIGLEDGIGIVKFLGGKKFFITGATGFLAKVFIEKILRTEPDVGKMYLLIKAKNNQAAMERLQNEIINTQLFRCLQEIHGKSYQAFMLSKLVPVVGNICEHNLGLDEDISNVIAEEVDVFVNSAANTTFDERYDTAININTIGPCRLMNIAKKCKKLKLFLHVSTAYVNGQKQGRIMERPFSIGECIAREKYISEVSPKYLPTLDIEGEINLVSNYKGDIEDNLLTQKMKEIGLERARRYGWQDTYVFTKAMGEMMIDKLRGDIPVVVMRPSVIESTFSEPFPGWMEGNRMMDPIVLWYGKGQLTGFLICSLFLLFLATLTSPEGTPILPFYRSITAASYSVFVESKLRPLPVVSSLPPPPSLAYLVSGSKGDDAAVTRVLLALYHPNNRYVVHLDLESSPEERSDLVRFVEGHALFKRFGNVRVIKKANLVTYRGPTMVANTLHAVAILLRELGDWDWFINLSASDYPLVTQDGTSHQRARPIIVDPGLYMNKKQDVFWITQRRSRPTTFKLFT

SEQ ID NO: 224087 - protein, 90 aa, Glycine max
  Coding DNA Sequence Number=SeqID_107309
  Gene Ontology: Mol. function=DNA binding; Cellular component =chromatin; Biological process=DNA integration
MCETTTHTMCVIPTLGTSTHAIHPYTTKEVAELFIKEVVRLHGFPASIVSDRDRLFMSLFWKELFKRPGTQLKMSTAYCPQIDGQTEVVN

SEQ ID NO: 224088 - protein, 125 aa, Glycine max
  Coding DNA Sequence Number=SeqID_107310
  Gene Ontology: Mol. function=oxidoreductase activity; Cellular component=integral to membrane; Biological process=metabolic process
  Homolog annotation: Hit_ID=Q6ADC0; Match level="QueryCoverage=96%, HitCoverage=42%, E-value=1e-35, Identity=63%"; Hit description =Oxidoreductase
  Pfam annotation: Domain name=KR; Domain location=7-125; Score=-75.5; E_value=0.0055; Accession=PF08659.1; Description=KR domain
  Pfam annotation: Domain name=Shikimate_DH; Domain location=3-114; Score=-27.0; E_value=0.073; Accession=PF01488.10; Description =Shikimate  quinate 5-dehydrogenase
  Pfam annotation: Domain name=adh_short; Domain location=4-125; Score =6.3; E_value=2.1e-06; Accession=PF00106.15; Description=short chain dehydrogenase
  Pfam module annotation: Pfam domain module=KR::Shikimate_DH::adh _short; Domain location=7-125::3-114::4-125
MVIRRAVVTGASSGIGAATVRALRARGWDVVGVARREDRLSALVAETGASAIACDLTDQSAVDALVSELAASGPVHALVQVAGRTRGTDRVEDASVEDWLLMFDANVLAAQRLVEKLLPLLMQGL

SEQ ID NO: 224089 - protein, 297 aa, Glycine max
  Coding DNA Sequence Number=SeqID_107311
  Homolog annotation: Hit_ID=Q6ADC1; Match level="QueryCoverage=12%, HitCoverage=8%, E-value=3e-09, Identity=78%"; Hit description=O -acetylhomoserine (Thiol)-lyase
VRGGLVDRRGACLGDRVGASAGVDLLGLEAPGLGCGHVFPQEPRNPVALGRRGRRRDVSVASDRGVSGRCRVLYCVGQGVHGESRTETGGSQMAENPGIGTADAAGESGGSRAGLQRRTVLAGAAWSLPIVAAAVATPAAAASTGALGRFVIETMQGGTWVNPDYYGASLQLRNDDTQATTLPVADITSGTVTVTFPLADAGPLEPVIIANAGGTSPSVPALPNTDPTWTPAGVADNGDGTVTYTLAYAGSLAGQGVTHVTFGIRGPSPLHSGVSVTVTSTGSPTDGTVHTRTATLF

SEQ ID NO: 224090 - protein, 160 aa, Glycine max
  Coding DNA Sequence Number=SeqID_107312
  Gene Ontology: Mol. function=nucleic acid binding
MNLSVTNFDEDMNHAQSPTKPRDRGDGGSQVKVSFRDETMWEQVFKKREIRDLIAQKKFCVEYEHGDRLKPKCFEDDFILKELLDPWKEAVNVKFLGEDYQFFTEGKNAGWFGFYMVKIDISPNREKEINDGPWMIFDHYLVIISWVPDFIASEVQIEST

SEQ ID NO: 224091 - protein, 358 aa, Glycine max
  Coding DNA Sequence Number=SeqID_107313
  Gene Ontology: Mol. function=ATP-dependent helicase activity; Cellular component=nucleus; Biological process=translational initiation
  Homolog annotation: Hit_ID=Q84W89; Match level="QueryCoverage=100%, HitCoverage=57%, E-value=1e-130, Identity=67%"; Hit description=DEAD- box ATP-dependent RNA helicase 37
  Pfam annotation: Domain name=DEAD; Domain location=180-357; Score =225.6; E_value=1.1e-64; Accession=PF00270.19; Description=DEADDEAH box helicase
  Pfam annotation: Domain name=ResIII; Domain location=176-355; Score= -31.7; E_value=0.021; Accession=PF04851.6; Description=Type III restriction enzyme, res subunit
  Pfam module annotation: Pfam domain module=DEAD::ResIII; Domain location=180-357::176-355
  Subcellular localization annotation: CTP_CleavageSite=27; ConfidenceScore=5.39e-01
MRTSWADSADNSTIGSGNSNSSACPPRGAYVPPHLRNRVFSSEVPPAASHPVAPGNDRVNHGGPAPHQGSGYFKADHGRQPQQGFGYGSGFQSGGGGGWNGRGAGRDRGRREANPFENVEAEDQSFSELENTGINFDAYDDIPVETSGENVPPPVNTFAEIDLGEALNQNIQRCKYVKPTPVQRYAIPISLAGRDLMACAQTGSGKTAAFCFPIISGIMREQYAQRPRVARTAYPLALILSPTRELSCQIHDEAKKFSYQTGVKVVVAYGGAPINQQLRELERGVDILVATPGRLVDLLERARVSLQMIRYLALDEADRMLDMGFEPQIRKIVEQMDMPPPGMRQTLLFSATFPKEIQ

SEQ ID NO: 224092 - protein, 149 aa, Glycine max
  Coding DNA Sequence Number=SeqID_107314
  Gene Ontology: Mol. function=phosphoprotein phosphatase activity; Cellular component=protein phosphatase type 2A complex; Biological process=negative regulation of tyrosine phosphorylation of Stat3 protein
  Homolog annotation: Hit_ID=Q07100; Match level="QueryCoverage=99%, HitCoverage=44%, E-value=5e-68, Identity=85%"; Hit description =Serine/threonine-protein phosphatase PP2A-3 catalytic subunit
  Pfam annotation: Domain name=Metallophos; Domain location=55-148; Score=33.1; E_value=9.8e-07; Accession=PF00149.18; Description =Calcineurin-like phosphoesterase
MGANSLPSAESNFDLDEQISQLMQCKPLSEHQVRVLCEKAKEILMEESNVQPVKSPVTICGDIHGQFHDLAELFRIGGKCPDTNYLFMGDYVDRGYYSVETVTVLISYSLQLLVSLKVRYPQRITILRGNHESRQITQVYGFYDECLRK

SEQ ID NO: 224093 - protein, 239 aa, Glycine max
  Coding DNA Sequence Number=SeqID_107315
  Gene Ontology: Mol. function=RNA-directed DNA polymerase activity; Biological process=RNA-dependent DNA replication
  Homolog annotation: Hit_ID=Q2HUG4; Match level="QueryCoverage=96%, HitCoverage=75%, E-value=2e-19, Identity=35%"; Hit description=RNA -directed DNA polymerase
MANFKRATKGIFLLKDGDRLLSTQDDIHDLAKTVIPVIMLTNIPTKEEVEVVVFVMDGDSAPRPDGFGGSFYQAFCDIIGFDVDGSVFAVFLVGLVSARCCIFSGSIQSSTIGSIILKSARMNNIRECLGFGASNLPFNYLGVPIFLGKPSSRYLMPLTDKIKVYSWHVSLLKMVEGWRRNFLWSSDINVRKLGGLGLKSLRALNKAFLLKLAWELTNSDLEWACLLRARVITTKYKLI

SEQ ID NO: 224094 - protein, 83 aa, Glycine max
  Coding DNA Sequence Number=SeqID_107316
  Subcellular localization annotation: CTP_CleavageSite=38; ConfidenceScore=5.18e-01
GAGLCASSMLGRNVSLILSLHTVLPTTPFSRSWESGVVVTSRDESWPPQRNLGYGTWGELFLLSKSVLPRQSTWTIYIDGGLS

SEQ ID NO: 224095 - protein, 506 aa, Glycine max
  Coding DNA Sequence Number=SeqID_107317
MNSISEQAALSEFISTHSKRALLAKLPTLNGKFEELVPLSVAFKELSAYPYDGCQLSGPCLAKRPMASRKHKSSDSRPQDQNDNRRFQSEEAWNRYIDNILDRRILSERNVELYHSEFDEFKAELERRNLHKHLANFQEGSIDVAVVKELYANFYSAADQAPKCARIRGHLIKIDADNLNEFLQTPVLLEEGESLPTYSRFCRLRSDPREMEASLCIPGKGFILSIEGQPWKLLRKDLTTLAQTWSIFSYSNLAPTSRTSDLNTDRARLVYGLITRMDMNIGSLISGQMTMMAQSNSSRLGFPALITALCRLRGVGSDALTSYENLRPVIDLAYIIRNCWNANEPKVNFLEAKKTKLRAADVPYSFAPIAGIPASSTSTPLPALADLSAQSSQTSDAKLQSLFKGQILIMQSLQELAQQRPIMSVEQFIEKAPQQHELEPENDHSSEAIIPGAVDFSKRRLETRSNEAAHPGPVLVSADVPFPGVDSSSPQHAADSSTPVLEIPKG

SEQ ID NO: 224096 - protein, 109 aa, Glycine max
  Coding DNA Sequence Number=SeqID_107318
  Gene Ontology: Mol. function=ATP-dependent helicase activity; Cellular component=RNA-induced silencing complex; Biological process= multicellular organismal development
  Homolog annotation: Hit_ID=Q84W89; Match level="QueryCoverage=84%, HitCoverage=14%, E-value=4e-39, Identity=82%"; Hit description=DEAD -box ATP-dependent RNA helicase 37
MIAMTLLKKWALASDFLSNYVFLAVGRVGSSTDLIAQRVEYVLESDKRSHLMDLLHAQRETGVNGKQGLTLVFVETKKGADALEHCLCVNGFPAASIHGDRTQQWLGAV

SEQ ID NO: 224097 - protein, 160 aa, Glycine max
  Coding DNA Sequence Number=SeqID_107319
  Homolog annotation: Hit_ID=Q2R1M8; Match level="QueryCoverage=26%, HitCoverage=6%, E-value=1e-11, Identity=78%"; Hit description=DEAD -box protein 3, X-chromosomal, putative, expressed
MGLATAFFNEGNLNLAKSLADLMQEANQEVPAWLSRYAARAIYSGGNRNRKSGGSRFGGRDFRKEGSFNKATDYYGSGTGGGYGGNYGGGYGQDFNGEKAVSSQPRLCLNPCIPYDRKSFIVVKIYHFLVLLKREREEGVNRLVGDQWSDITEFKWVLSI

SEQ ID NO: 224098 - protein, 56 aa, Glycine max
  Coding DNA Sequence Number=SeqID_107320
MEREKGITRRQYIWRLQSFLRLSHVCELYRSSRRKNWRNLREPLEMPLSLSEDTDP

SEQ ID NO: 224099 - protein, 65 aa, Glycine max
  Coding DNA Sequence Number=SeqID_107321
  Homolog annotation: Hit_ID=Q8S8F2; Match level="QueryCoverage=100%, HitCoverage=8%, E-value=8e-10, Identity=44%"; Hit description=F-box protein family, AtFBL11
MWAKHSKSFGKLPYDLLLSLVKHPHLTVDSELHLSDALLLWLESNTENLERPSKSEENCYEVLKQ

SEQ ID NO: 224100 - protein, 158 aa, Glycine max
  Coding DNA Sequence Number=SeqID_107322
  Gene Ontology: Mol. function=DNA binding; Cellular component =mitochondrion; Biological process=DNA integration
MDVNSDFLNSYIEEEVYFFQPPGFEDHKNPNHVYKLNKALYGLKRTPRKCEAYGPWNISPSNKILQGTSQEVQNVDDIIFVFTNKSLCGEFVYKMQEEFEMSMTWELNYFLGLQVKHMNHVTFLHQTKYCKELLKKFEKDKSKEAATPMATNYYLSGG

SEQ ID NO: 224101 - protein, 83 aa, Glycine max
  Coding DNA Sequence Number=SeqID_107323
  Subcellular localization annotation: CTP_CleavageSite=51; ConfidenceScore=5.90e-01
MKACRNRSSGDFASTSRTSQSLTNSSQAHRTTSSSSSANMHSSSFFQILPRAQPRSVALSGWLAKPEDRLSERVKISTSKLLA

SEQ ID NO: 224102 - protein, 40 aa, Glycine max
  Coding DNA Sequence Number=SeqID_107324
MKVGGEIERKTQGSMVCGGDLKDIGVGVWDQAWVPAGFIT

SEQ ID NO: 224103 - protein, 154 aa, Glycine max
  Coding DNA Sequence Number=SeqID_107325
  Gene Ontology: Mol. function=ribonuclease P activity; Cellular component=nucleus; Biological process=tRNA processing
  Homolog annotation: Hit_ID=Q6AWV1; Match level="QueryCoverage=99%, HitCoverage=100%, E-value=3e-52, Identity=63%"; Hit description =Probable ribonuclease P protein subunit 2
  Pfam annotation: Domain name=RNase_P_Rpp14; Domain location=7-118; Score=72.1; E_value=1.7e-18; Accession=PF01900.9; Description=Rpp14 family
MVGFRNRYMVMEVFLNPNRDKVGDASVIITQFNVSKAVRDSILVNFGECGLASSLGSFQVKYVNPITNVCIIRASREEYQKVWAAITMVTNIGNCPVMFNLLDLSGSIRACKNAALKCEESKFEQYKLMLGDRFSADHTHRMNTYLDRIKVLEH

SEQ ID NO: 224104 - protein, 145 aa, Glycine max
  Coding DNA Sequence Number=SeqID_107326
  Gene Ontology: Mol. function=structural constituent of ribosome; Cellular component=ribonucleoprotein complex; Biological process =translation
  Homolog annotation: Hit_ID=Q2PMQ2; Match level="QueryCoverage=91%, HitCoverage=96%, E-value=5e-71, Identity=100%"; Hit description =Chloroplast 30S ribosomal protein S11
  Pfam annotation: Domain name=Ribosomal_S11; Domain location=28-137; Score=253.5; E_value=4.5e-73; Accession=PF00411.9; Description =Ribosomal protein S11
  Subcellular localization annotation: CTP_CleavageSite=15; ConfidenceScore=5.14e-01
MAKPISKKGSRKNVRIGSRKHTRKIPKGVIHVQASFNNTIVTVTDVRGRVISWSSAGTCGFKGTRRGTPFAAQTAAGNAIRTVSDQGMQRAEVMIKGPGLGRDAALRAIRRSGILLNFIRDVTPMPHNGCRSPKKRTCVKTKKKH

SEQ ID NO: 224105 - protein, 356 aa, Glycine max
  Coding DNA Sequence Number=SeqID_107327
  Gene Ontology: Mol. function=zinc ion binding; Biological process =transcription
  Homolog annotation: Hit_ID=Q9SWG3; Match level="QueryCoverage=46%, HitCoverage=20%, E-value=2e-45, Identity=48%"; Hit description=Far -red impaired response protein
  Pfam annotation: Domain name=Transposase_12; Domain location=233-339; Score=-39.6; E_value=0.073; Accession=PF01610.8; Description =Transposase
MPYFSFVITQILTLQASPNSNCELYCNAATHKLKVINNTMIGKQHTKDVMEGRSVGDHVQEVWINDHAFMQMGLEKNGISFQEEAFDKDVEKEGVRFENEREETTCKGIIKDELCVGLKQEPVKFANENGDHVAQKIDNNDIAGLEANGGQEPYMGMKFESHEYAYFFYNHYAKCVGFGIIRRCKCNVAVFYAYARRKSKKNYAIDLDGKSYVRHIFWVDAKGRDDYQEFGDVISFDATYITKRYKMPLAHFVDVNNHFQSRLLGCALITYETSKTFSWLMKTWPKAMDGKPPNAIITNQEKAMKVAIKEVHPNARHHFCLWHILRKVPKKVSHVLRKHEDFMTYLNTCIYKSWST

SEQ ID NO: 224106 - protein, 67 aa, Glycine max
  Coding DNA Sequence Number=SeqID_107328
  Homolog annotation: Hit_ID=Q00M75; Match level="QueryCoverage=39%, HitCoverage=4%, E-value=1e-07, Identity=100%"; Hit description=PPR -repeat containing protein
MAIPEPREVFNFLTTYIFLVLGAAVKLCLGDLLVMGSNPETASLHMQGEKAMGVYLAWTRDIDSSVE

SEQ ID NO: 224107 - protein, 62 aa, Glycine max
  Coding DNA Sequence Number=SeqID_107329
MHCWIRYTPRPHGYPCDPRCPGIGEQSNDAVLLKGHCHIPPLYNFGTLVTLTSQPHTMASVM

SEQ ID NO: 224108 - protein, 162 aa, Glycine max
  Coding DNA Sequence Number=SeqID_107330
QGTQFGKDYSFEDYQWESEWQPCYQNEAEGLSNLDDLLMQFKGIVDSMQQAFKRAETQIGKLVDDMTKVVVRRKEEYAEIETHQESILQVNTIHHQLINNEEKDEVSIIPEYSCMVTTGYDVGKDKGRLELSVEDHNISFDLFKGMKHPDMSDACFEEEEVE

SEQ ID NO: 224109 - protein, 113 aa, Glycine max
  Coding DNA Sequence Number=SeqID_107331
MVAREEEDGGDPCGSAVGGGSGDRFHDLELEYTHAPLLCLPPSRDTIRAWLNTSPLASSTNLSLSIRLRLHKIQSLSLNLIFRLTQKVLDDCLTQNLGLNLENLVREVDERGK

SEQ ID NO: 224110 - protein, 85 aa, Glycine max
  Coding DNA Sequence Number=SeqID_107332
MTTKLKPNSVVLVTPRSEVVCDAMLLDLEGVGCVNLDKGSSGTARSGKFYGWDATVLGGVQHCLTGLGLCREFGLVDKRDISSFW

SEQ ID NO: 224111 - protein, 58 aa, Glycine max
  Coding DNA Sequence Number=SeqID_107333
MKKYMHSMQQPQPSDASSNDGNYPFRDIRACSDLVGQRILCCTKLGVEPEVRARSNIN

SEQ ID NO: 224112 - protein, 472 aa, Glycine max
  Coding DNA Sequence Number=SeqID_107334
  Homolog annotation: Hit_ID=Q1T1W2; Match level="QueryCoverage=99%, HitCoverage=99%, E-value=2e-61, Identity=39%"; Hit description=VQ
  Pfam annotation: Domain name=VQ; Domain location=173-203; Score=47.4; E_value=4.8e-11; Accession=PF05678.4; Description=VQ motif
MDSANTSGSLQSSSGADEEYDSRAESSPLSMFLTNQPQPQPPPSQVAPFIPPPHQQLQHHQNTHMFDPLSNYLDPIPQSSASLLNLDVMWSKQVRSEPNQTDLVSLIPHNQAFVSSQTRGNNSGAFPTLPPESGSRGLMLSVSAANNDQIQTHTNNSSSNMVRNPKKRSRASRRAPTTVLTTDTTNFRAMVQEFTGIPAQPFTSSSFPRTRLDLFASAATPTLMRSNVNVNPLDPPTQPPYLLRPFAQKLQLRSLHPFPPSFSNTFLPPSTNSSTNSTSINYQQQQQQLSEHFGFVKQPLNFNNTTPDNSTLEAYHQLKHHLGNSSSVLVSRTQQHHSLEIPPNLKNGVFEELGLRHDHVNTDLGCLHQSMVSSTSVGVGALSSGNNNNNNLSNATNSSTEWAQRTGTITNNDCDHGGGGALSGTINYSDTNGKVHYSASSSDFHGEKGPDFTVTATRTQGMVESWINCSSD

SEQ ID NO: 224113 - protein, 147 aa, Glycine max
  Coding DNA Sequence Number=SeqID_107335
MERREGDKVKRDSDYLHIEQQNEVWERDKERERFFLVVERQASFLQKVLPPTHVFKALSLQEYCNWHTVLESLLLNLCLHKRVLRKQGNKQTTDDHAFNILGAERGCEYKLLCLGLERVREVFAMSLASFFVLGFGLPLQIVKRIKY

SEQ ID NO: 224114 - protein, 141 aa, Glycine max
  Coding DNA Sequence Number=SeqID_107336
MHKALQANAPFPYPQLVTLFLRHFQIPLDDEPFVQVKRSFAIGAGAVTSFGYHKDRNGQWLKKDALPPQDERTPSPPPQRDDSALMTEVLSELRGLRTYVGEHFDSLDTRFAGMDIRLTQLEEDVGYIHQSFDLPPPPPPS

SEQ ID NO: 224115 - protein, 204 aa, Glycine max
  Coding DNA Sequence Number=SeqID_107337
  Homolog annotation: Hit_ID=Q2HRX8; Match level="QueryCoverage=74%, HitCoverage=22%, E-value=7e-09, Identity=27%"; Hit description=IMP dehydrogenase/GMP reductase
  Pfam annotation: Domain name=DUF1723; Domain location=16-65; Score =24.2; E_value=0.00046; Accession=PF08330.1; Description=Protein of unknown function (DUF1723)
MNQSRLVDLATTWYHATNRGLVNVLLERQHQEVSSFHLSVKEMTITLDDVSCLFLFLVISKPIDHVPLFFNIKAVKILLMSHLGILIVTKASTAANAGVRVRLTWLEDLYRRYVESGFYVWAATTYLLHLINNMIFGDKYTTHVHVSYLQYLDTWMFATIMGICAFVHCWLLRDGGLYCGRLDSHQMVVVERFRVCPSSQGETG

SEQ ID NO: 224116 - protein, 45 aa, Glycine max
  Coding DNA Sequence Number=SeqID_107338
MGNNFPQGKCGCGGLIFWRPPPNNNNNNSNANKFENLSNASDTKK

SEQ ID NO: 224117 - protein, 42 aa, Glycine max
  Coding DNA Sequence Number=SeqID_107339
MAVTSRASSLRWWNIIAERKTTEKGTMRGKKIFAYVLLKTKQ

SEQ ID NO: 224118 - protein, 426 aa, Glycine max
  Coding DNA Sequence Number=SeqID_107340
  Gene Ontology: Mol. function=binding; Cellular component=thylakoid; Biological process=photosynthesis
  Homolog annotation: Hit_ID=Q1T1X0; Match level="QueryCoverage=91%, HitCoverage=74%, E-value=1e-148, Identity=65%"; Hit description=IMP dehydrogenase/GMP reductase
  Pfam annotation: Domain name=TPR_1; Domain location=125-158; Score =11.3; E_value=0.24; Accession=PF00515.18; Description=Tetratricopepti de repeat
  Pfam annotation: Domain name=TPR_1; Domain location=159-193; Score =13.3; E_value=0.14; Accession=PF00515.18; Description=Tetratricopepti de repeat
  Pfam annotation: Domain name=TPR_1; Domain location=235-268; Score =1.3; E_value=3.8; Accession=PF00515.18; Description=Tetratricopeptide repeat
  Pfam annotation: Domain name=TPR_1; Domain location=312-345; Score =14.8; E_value=0.092; Accession=PF00515.18; Description =Tetratricopeptide repeat
  Pfam annotation: Domain name=TPR_1; Domain location=346-379; Score =35.9; E_value=1.4e-07; Accession=PF00515.18; Description =Tetratricopeptide repeat
  Pfam annotation: Domain name=TPR_1; Domain location=91-124; Score =24.0; E_value=0.00053; Accession=PF00515.18; Description =Tetratricopeptide repeat
  Pfam annotation: Domain name=TPR_2; Domain location=125-158; Score =17.5; E_value=0.049; Accession=PF07719.7; Description=Tetratricopepti de repeat
  Pfam annotation: Domain name=TPR_2; Domain location=159-193; Score =17.1; E_value=0.063; Accession=PF07719.7; Description=Tetratricopepti de repeat
  Pfam annotation: Domain name=TPR_2; Domain location=235-268; Score =3.8; E_value=12; Accession=PF07719.7; Description=Tetratricopeptide repeat
  Pfam annotation: Domain name=TPR_2; Domain location=312-345; Score =12.5; E_value=1.2; Accession=PF07719.7; Description=Tetratricopeptide repeat
  Pfam annotation: Domain name=TPR_2; Domain location=346-379; Score =23.2; E_value=0.00092; Accession=PF07719.7; Description =Tetratricopeptide repeat
  Pfam annotation: Domain name=TPR_2; Domain location=91-124; Score =29.2; E_value=1.5e-05; Accession=PF07719.7; Description =Tetratricopeptide repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2; Domain location=125-158::159-193::235-268::312-345::346-379::91-124::125 -158::159-193::...
  Pfam module annotation: Domain location=235-268::312-345::346-379::91- 124
  Subcellular localization annotation: CTP_CleavageSite=86; ConfidenceScore=5.22e-01
VPKEAIGISGELESMITDRQKGSSNLVRASSSNVMMFNNLGNLRQGGNTNTYSQNPVANGRYTNQTVENVSKGNKEQPGSLCRVVSTRMNPEQLKIMGNEDYKNGRFQEALALYDAAIAIDPNKASYRSNKSAALTALGRLLEAVFECREAIQIEPRYQRAHYRLGNLNMRLGEMDKALYHYKQAGPEIDPDENAKVKKIQVHLNKCTEARRLGDWNKLIKETNNAISSGADSAPQIFALQAEAFLKLRRHQHAEEAMSKGSNFDVDHCTKFFGPICHANTLVTQSRVHLAAGRLDPNNNEMKKVMRKARAAAAARSNGNELFMASKFSEASVAYGEGLEHDPYNSVLLCNRAACRSKLGQFEKAVEDCNASLSLRPSYSKARLRRADCNAKASTLIVNDQYSNPLKKKDKARCGGGTLRARCQGK

SEQ ID NO: 224119 - protein, 198 aa, Glycine max
  Coding DNA Sequence Number=SeqID_107341
  Pfam annotation: Domain name=zf-CCHC; Domain location=125-142; Score =22.8; E_value=0.00017; Accession=PF00098.13; Description=Zinc knuckle
MKEMKREKHAFYSSHNSCKCLTEELRDYYEGRHREKERKPQEANIKLSYFHGKDNVEANLDWEIRVEQQLKKKSTSKSYGSHSYPKKDQGQGILGVTPSKPKDDKGKTIEKQAPKASMQEKTSSIKCFKCLGRGHITSQCPTTKTMIMRGQDIYSSLDEATTSPSSSESEKAKGEESSEEIYPQEEGQPLVVKEKCKE

SEQ ID NO: 224120 - protein, 155 aa, Glycine max
  Coding DNA Sequence Number=SeqID_107342
MGSNQTPSLKKRFYQVKVKSLGITNLSELGQLMGQLQRQAFRKAYGKIWDLAMVDVSTEAIASLAQYYDQPLRKPYLFSRFYPSLARISKIVQISVQELDHKKQVENGVVGIPRKCLEAKARILAAIDAFLAYHDRKESPVVSILVDLYDTFDRR

SEQ ID NO: 224121 - protein, 313 aa, Glycine max
  Coding DNA Sequence Number=SeqID_107343
  Gene Ontology: Mol. function=heat shock protein binding; Biological process=protein folding
  Homolog annotation: Hit_ID=P93499; Match level="QueryCoverage=21%, HitCoverage=41%, E-value=2e-19, Identity=70%"; Hit description=DnaJ -like protein
  Pfam annotation: Domain name=DnaJ; Domain location=124-188; Score =93.8; E_value=5.3e-25; Accession=PF00226.21; Description=DnaJ domain
WNSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDASLYDVLGISVGASCIEIKAAYRKLARTYHPDVVAMNQKESSANQFMMIHSAYSTLSDPEKRAQYDRESSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 224122 - protein, 123 aa, Glycine max
  Coding DNA Sequence Number=SeqID_107344
MVPHLMRILKLAKYRLKAQMEKDEGPSGEGQSPRVEKDEGPEAETLSRLLIVAQENFWHLIKFGESFSLGSLLNQYQTYQGNPCGVYPDLSSFTGSDVYPDLSSFTGSGVIQFSVACIKRSAP

SEQ ID NO: 224123 - protein, 129 aa, Glycine max
  Coding DNA Sequence Number=SeqID_107345
MWECSLSGLLQLPASLAYLIAKGMIARRTCLSNEAIHSCLPPILFISLNLLGIQQKALGSPTVLRPPTFDDVLPQHKCLSRTSQRANAQPAHVSARVMEHGGMLGSNYKVWDLSLAFKVWDSSVGFIRH

SEQ ID NO: 224124 - protein, 197 aa, Glycine max
  Coding DNA Sequence Number=SeqID_107346
  Gene Ontology: Mol. function=DNA binding; Cellular component=nucleus; Biological process=regulation of transcription, DNA-dependent
  Homolog annotation: Hit_ID=Q84XV2; Match level="QueryCoverage=65%, HitCoverage=33%, E-value=3e-29, Identity=50%"; Hit description=IMB1
MGARAVELGGMLGSNCKVWDLSPTLEVWDSNEKRQLEEEAQAQLDIQLALETTYANKAKDISTELCEIDMHLKSLKEMVIQQCRKLSTQEKKMLMSALGKLSLENLYRALDIIAETNPMFQPSSTEDVVLDLDAQSDYTLWRLKAFVKDSLEEQVKVNAGAGINPNDNPDDKKNKKRRDSGDSSGKTNPKRKKLSTL

SEQ ID NO: 224125 - protein, 86 aa, Glycine max
  Coding DNA Sequence Number=SeqID_107347
MSYTYEKLIDEYLRKIKGYVDELAGIEVLVRHEEYVDTLLKGLSLDYVPVISIIKIKKHTPFITEIDALLYGHETCLTRYNRDAHR

SEQ ID NO: 224126 - protein, 47 aa, Glycine max
  Coding DNA Sequence Number=SeqID_107348
MPIQRLKNLPQARAFKIENADPDPDPGALRNGLGPVQTVAAVVPNGP

SEQ ID NO: 224127 - protein, 145 aa, Glycine max
  Coding DNA Sequence Number=SeqID_107349
  Subcellular localization annotation: CTP_CleavageSite=35; ConfidenceScore=5.08e-01
MFGSRNLIRIFILSLFSLLQQCNSFSRYVSFLLPRCCGFEYLSFPTQSICRYDLPFSTFIDLILILIICESVAEFSRSLNVRSCIWKHATTLRFVRGENADGTSDANGLAGQTVGRRGGGVGLSGRRRAVAVAGRLVEIVRHDEI

SEQ ID NO: 224128 - protein, 486 aa, Glycine max
  Coding DNA Sequence Number=SeqID_107350
  Gene Ontology: Mol. function=transporter activity; Cellular component= integral to membrane; Biological process=transport
  Homolog annotation: Hit_ID=Q9C9R9; Match level="QueryCoverage=97%, HitCoverage=97%, E-value=1e-178, Identity=67%"; Hit description =Putative transporter; 34935-36578
  Pfam annotation: Domain name=MFS_1; Domain location=13-389; Score =148.1; E_value=2.3e-41; Accession=PF07690.6; Description=Major Facilitator Superfamily
  Pfam annotation: Domain name=Sugar_tr; Domain location=9-452; Score= -96.6; E_value=0.00076; Accession=PF00083.14; Description=Sugar (and other) transporter
  Pfam module annotation: Pfam domain module=MFS_1::Sugar_tr; Domain location=13-389::9-452
MKMKAETLTLVLVNLAGIMERADESLLPGVYKEIGAALNADPTALGSLTFFRSIVQSLCYPLAAYLATRHNRAHVIALGAFLWAAATFFVAISSTFLQVAISRGLNGIGLALVTPAIQSLVADSTVDSNRGMAFGWLQLTGNFGSIIGGLFAVLIAPTSFKGIPGWRIAFHLVALISVIVGILVCLFANDPRFSKARERATTYEAPNKSFCSDMKDLMKEAKSVIGNPSFQIIVAQGVFGTFPGSSLSFATLWLELIGFPRVTTAFLWTLYVVATSFGGLFGGRMGDILSQRFPNSGRILLSQISSSSAIPLAAILLLGLPYDPSTAFKHGLLLFIMGLIRSWNAPATNNPIFAEIVPEKSRTTIYALDRSFETILSSFAPPIVGALAQHVYGYKPITKGSSDEIEKDRENAASLAKALYTAISIPSVLCVSIYSFLYCTYPRDRERARMEALVESEMQQLQVEDYNDVDYPREEDDNDEKVLLSR

SEQ ID NO: 224129 - protein, 117 aa, Glycine max
  Coding DNA Sequence Number=SeqID_107351
PNEKLAIQYQEGDVSLLLFDESKVAEGKFPTLEQGGGEASEVKLELTGSSGAFPRGMHGGDAAVDLKLEIKLAIRIRTAGLETWGMSSNVACQFKDHGMGLGYVSYCCSMANTALKP

SEQ ID NO: 224130 - protein, 248 aa, Glycine max
  Coding DNA Sequence Number=SeqID_107352
  Gene Ontology: Cellular component=nucleus; Biological process =regulation of progression through cell cycle
  Homolog annotation: Hit_ID=Q9XGI0; Match level="QueryCoverage=84%, HitCoverage=47%, E-value=6e-25, Identity=40%"; Hit description =Cyclin A2
MKKENSVTLKAGELPGRLTRARAAAALRASGQLPPLKERAQQNQNLLSKVNSKGAVSDNTCLQRKRKAVLQEVTNVCRENAYKGCFNSTKIQAKKSKLAKAGQINVSKVAPSVTVDSKAKETALQSEDTMCSINLENNEFLRLSANDCRLPESQMSGISAHPLISQKKDKKDNLPKLLTALKDPDITNIDDDDLEDPQSCSLYAADIYDTMRVAEVCAISIVPYGHIFSVSSASFKSMELANFFCHPL

SEQ ID NO: 224131 - protein, 197 aa, Glycine max
  Coding DNA Sequence Number=SeqID_107353
MSFQEFGQSDGWASLACLQWHFNLFLDQQLGSHFMGGWDNQKLHVSLLNDVWITISTLVPPVISNTSDMSAWKHKPDGTFSVSSTNISISSPPMANDPSFNLICRNEFIFSAKPSSITSLCVLNPNLFIFWEAPLTCLYKLNCDVVVALVAKLMYGRVLKDHFGTIVFAFSSKIGTCSINIAELWAIAIRIKIASLR

SEQ ID NO: 224132 - protein, 515 aa, Glycine max
  Coding DNA Sequence Number=SeqID_107354
  Gene Ontology: Mol. function=transporter activity; Cellular component= integral to membrane; Biological process=transport
  Homolog annotation: Hit_ID=Q9C9R9; Match level="QueryCoverage=91%, HitCoverage=95%, E-value=1e-178, Identity=68%"; Hit description =Putative transporter; 34935-36578
  Pfam annotation: Domain name=DUF112; Domain location=72-401; Score= -222.6; E_value=0.072; Accession=PF01970.7; Description=Integral membrane protein DUF112
  Pfam annotation: Domain name=MFS_1; Domain location=11-389; Score =142.2; E_value=1.4e-39; Accession=PF07690.6; Description=Major Facilitator Superfamily
  Pfam annotation: Domain name=Sugar_tr; Domain location=6-440; Score= -102.6; E_value=0.0012; Accession=PF00083.14; Description=Sugar (and other) transporter
  Pfam module annotation: Pfam domain module=DUF112::MFS_1::Sugar_tr; Domain location=72-401::11-389::6-440
MKSETLNLVLVNLASIMQRADESLLPGVYKEVGEDLKADPTALGSLTLFRSLVQSLCYPLAAYLATRHNRAHVIALGAFLWAAATFLVAISSTFLQVAISRGLNGIGLAIVIPAIQSLVADSTVDSNRGMAFGWLQLTGNLGSIIGGLFSVLIASTTVAGIPGWRIAFHLVALISVIVGILVRLFANDPHYSKSDDTATNQAQNKSFYSEMKDLMKEAKSVIRIPTFQIIVAQGVFGSFPWSGLSFATLWLELIGFSHVTTATLWTLFIVAASFGSLFGGWMGDFLSLRLPNAGRIILSQISAGSVIPLAAILLLGLPDDSSTAFMHGLVLVIMGFTSAWNAPATNNVDSPIFAEIVPEKSRTAIYALDCSFESILASFAPPIVGLLAQHVYGYRPIPSGSSDSVEIETDRENAASLAKALYTAIIIPMTICVSVYSLLYCTYPRDRERARMISLAESEMQQLEVEDGTKEEYCEIHEYLESNVVNDKESSKFDIDYPREESVDVDDDDKKVLLS

SEQ ID NO: 224133 - protein, 107 aa, Glycine max
  Coding DNA Sequence Number=SeqID_107355
  Gene Ontology: Mol. function=kinase activity; Cellular component =nucleus; Biological process=regulation of progression through cell cycle
  Homolog annotation: Hit_ID=Q9XGI0; Match level="QueryCoverage=93%, HitCoverage=20%, E-value=6e-38, Identity=77%"; Hit description =Cyclin A2
  Pfam annotation: Domain name=Cyclin_N; Domain location=1-105; Score =132.9; E_value=8.8e-37; Accession=PF00134.13; Description=Cyclin, N -terminal domain
LARRPHPNFMETVQRDITQSMRGILVDWLVEVSEEYKLVTDTLYLTVYLIDWFLSKNYIERQRLQLLGITCMLIASKYEEINAPRIEDFCFITDNTYTKAEFHTLKL

SEQ ID NO: 224134 - protein, 1089 aa, Glycine max
  Coding DNA Sequence Number=SeqID_107356
  Gene Ontology: Mol. function=ATPase activity, coupled to transmembrane movement of substances; Cellular component=integral to membrane; Biological process=transport
  Homolog annotation: Hit_ID=Q1T1V6; Match level="QueryCoverage=100%, HitCoverage=99%, E-value=0.0, Identity=60%"; Hit description=AAA ATPase
  Pfam annotation: Domain name=ABC_membrane_2; Domain location=1-169; Score=121.8; E_value=1.9e-33; Accession=PF06472.5; Description=ABC transporter transmembrane region
  Pfam annotation: Domain name=ABC_membrane_2; Domain location=512-793; Score=353.8; E_value=2.9e-103; Accession=PF06472.5; Description=ABC transporter transmembrane region
  Pfam annotation: Domain name=ABC_tran; Domain location=261-431; Score= 73.0; E_value=9.5e-19; Accession=PF00005.17; Description=ABC transporter
  Pfam annotation: Domain name=ABC_tran; Domain location=905-1089; Score=51.8; E_value=2.2e-12; Accession=PF00005.17; Description=ABC transporter
  Pfam module annotation: Pfam domain module=ABC_membrane_2::ABC _membrane_2::ABC_tran::ABC_tran; Domain location=1-169::512-793::261 -431::905-1089
MVYYKISHVDGRITNPEQRIASDVPRFCSELSEIVQDDLTAVTDGLLYTWRLCSYASPKYIFWILAYVLGAGAAIRNFSPAFGKLMSREQELEGGYRQLHSRLRTHSESIAFYGGEKREEAHIQQKFRTLVRHINRVLHDHWWFGMIQDFLLKYLGATVAVILIIEPFFSGHLRPDSSTLGRAEMLSNLRYHTSVIISLFQSLGTLSISARRLNRLSGYADRIHELMAISRELSLENGKSSLQRQGSRNCISEANYVGFYGVKASPNGSGKSSLFRVLGGLWPLVSGHIVKPGVGSDLNKEIFYVPQRPYTAVGTLRDQLIYPLTVDQEVEPLTDSRMVDLEYLLDRYPPEKEVNWGDELSLGEQQRLGMARLFYHKPKFAILDECTSAVTTDMEERFCANVLAMGTSCITISHRPALVAFHDVVLSLDGEGGWSVHHRREDSSTELGNDMMKASETKRQSDAKAVQRAFAMNKKDSAFLNSKAQSDISEVIIASSPSMKRNISPSAVPQLHGNTRALPMRVAAMCKVLVPTIFDKQGARLLAVVFLVVSRTWVSDRIASLNGTTVKLVLEQDKASFIRLIGLSVLQSAASSFIAPSIRHLTARLALGGRTHLTQHLLKNYLRNNAFYKVFHMASKNIDADQRITHDLEKLTTDLSGLVTGMVKPSVDILWFTWRMKMLTGRRGVAILYAYMLLGLGFLRTVTPDFGNLISQEQQLEGTFRFMHERLCTHAESVAFFGGGAREKAMVESRFRELLTHSEYLLKKKWLFGILDDFITKQLPHNVTWGLSLIYAMEHKGDRASVTTQGELAHALRFLASVVSQSFLAFGDILELNKKFVELSGGINRIFELEELLDAAQSENFTSVSAIPPMRDVHSSDVISFSKVDIITPAQKMLVRELICDIKRGGSLLVTGPNGSGKSSIFRVLRGLWPIASGRLSRPSEVVDEEDGSGCGIFYVPQRPYTCLGTLRDQIIYPLSREEAEVKALKMYGKGEKHADTRNLLDTRLKVILESVRLNYLLEREGSNWDANLKWEDILSLGEQQRLGMARLFFHEPKFGILDECTNATSVDVEEHLYGLAKDMGITVVTSSQ

SEQ ID NO: 224135 - protein, 630 aa, Glycine max
  Coding DNA Sequence Number=SeqID_107357
  Gene Ontology: Mol. function=binding
  Homolog annotation: Hit_ID=Q6L4Y6; Match level="QueryCoverage=91%, HitCoverage=96%, E-value=0.0, Identity=84%"; Hit description =Putative tetratricopeptide repeat (TPR)-containing protein
  Pfam annotation: Domain name=TPR_1; Domain location=405-438; Score =4.7; E_value=1.5; Accession=PF00515.18; Description=Tetratricopeptide repeat
  Pfam annotation: Domain name=TPR_1; Domain location=444-477; Score =10.9; E_value=0.27; Accession=PF00515.18; Description=Tetratricopepti de repeat
  Pfam annotation: Domain name=TPR_2; Domain location=405-438; Score =15.8; E_value=0.15; Accession=PF07719.7; Description=Tetratricopeptid e repeat
  Pfam annotation: Domain name=TPR_2; Domain location=444-477; Score =4.8; E_value=9.2; Accession=PF07719.7; Description=Tetratricopeptide repeat
  Pfam module annotation: Pfam domain module=TPR_1::TPR_1::TPR_2::TPR _2; Domain location=405-438::444-477::405-438::444-477
MDKVSSDCPYPGCFFCVMKEGNPSKRRASVLKFFRELPCQDEDGQVLPISGLWNTAMAHPNDPEFIELGIFECMSALIWKGLKNRRWLSHDQNIYIPYYAAHIIGSYTMNMEEFAESAVHAGVIPPLVELLRGRLTWVEQRVAVRALGHLATYASTFPAIASHGEILELSIQLAMSSLEIVYSHFYQYVDRRLSYHCDLLTRGMGGVEMESRKAEEWASQLQCWSLQLINCFAFKHEFLPTICKPEFLIKLPGMWGGLVNENSPAGIGLLRTICHQKLGRGPVASCPGIIDALCNIARSSDDWQYMAIDCLLWLLQDPNTCHKVIDKVVPVLVDLAEITTLGDHKKLGDSILNVFQECIQSQGSGRSSISSHTKEQIEDILDSKQRLKWEKNMPKEDLHIKQAAALVVKLEGNSLFSSGNIAGAASKYSEALALCPMRSRKERVVLYSNRAQCHLLLQQPLAAISDATRALCLHRPVNRHAKSLWRRAQAYDMLGLAKESLLDAILFINECSQSNDPDLSLRQNKVPDYAERLVKKQMRSAWLFREAAIKHGGVHSQGDGGDMYGPETDDSEWETASESDIGNDGRDDMGDDDDGDWNNDDQRKDYDKPSMKELANIPKSLHFKVKGKKE

SEQ ID NO: 224136 - protein, 118 aa, Glycine max
  Coding DNA Sequence Number=SeqID_107358
  Gene Ontology: Mol. function=kinase activity; Cellular component =nucleus; Biological process=regulation of progression through cell cycle
  Homolog annotation: Hit_ID=Q9XGI0; Match level="QueryCoverage=68%, HitCoverage=16%, E-value=4e-31, Identity=78%"; Hit description =Cyclin A2
  Pfam annotation: Domain name=Cyclin_C; Domain location=1-105; Score =113.2; E_value=7.7e-31; Accession=PF02984.9; Description=Cyclin, C -terminal domain
DQSLELEYLANYLAELTLMDYGFLNFLPSIIAASAVFLARWTLDQSNHPWNPTLQHYACYKASDLKTTVLALQDLQLNTDGCPLTAVRTKYRQDKRLCLHQNCLKLCSEDKDDLTSQC

SEQ ID NO: 224137 - protein, 194 aa, Glycine max
  Coding DNA Sequence Number=SeqID_107359
  Homolog annotation: Hit_ID=Q9SID9; Match level="QueryCoverage=97%, HitCoverage=58%, E-value=8e-31, Identity=46%"; Hit description =Expressed protein
MNGISQISFSTEGNISPKKPTSLPEIAKQRELSGTYRSESVMKINKQTSSAKTKELSGSDIFAPPPEIVPRSLAAAHTLESKESEDTRKPVPQKVSTSAQVSNRAGGQSNFSFSEEPVKKILRKKIHDQKFAEMTGNNIFKGDAPAGSPEKPSSRAKLREMAGNDIFADGKAENRDNIRGARRPPGGGSSIALV

SEQ ID NO: 224138 - protein, 43 aa, Glycine max
  Coding DNA Sequence Number=SeqID_107360
  Gene Ontology: Mol. function=protein dimerization activity; Cellular component=nucleus; Biological process=regulation of transcription, DNA-dependent
  Homolog annotation: Hit_ID=P13088; Match level="QueryCoverage=86%, HitCoverage=19%, E-value=2e-13, Identity=97%"; Hit description=Auxin- induced protein AUX22
MSHEMKMFMESCKRLRIMKKSDAKGFGLQPKGSLKGFIESAAK

SEQ ID NO: 224139 - protein, 44 aa, Glycine max
  Coding DNA Sequence Number=SeqID_107361
MELVFKKQSYSMLKSQIALEQGFPEYREEEKESNKKGRDYSDTM

SEQ ID NO: 224140 - protein, 47 aa, Glycine max
  Coding DNA Sequence Number=SeqID_107362
MLQQPGGWSDCDCGREGASATACYFVRQRWEVLFWCELLDVGGEIIA

SEQ ID NO: 224141 - protein, 115 aa, Glycine max
  Coding DNA Sequence Number=SeqID_107363
  Subcellular localization annotation: CTP_CleavageSite=49; ConfidenceScore=5.06e-01
MPSTICRDRAHKTPSGPGGVQQGPGVSSFGYGPLSVLQGARPPQQGIVPARHPVDPEKSNRVLGFPALITGLCQFYGVPVAPNKVIRPLTNRAFIKKYCTPRQAQGKTPQQPGDG

SEQ ID NO: 224142 - protein, 133 aa, Glycine max
  Coding DNA Sequence Number=SeqID_107364
MPTPPAKVSVGLCRPDIGITTTRHPVDPEEPNRALGFPALVMGLCQSYRAPVPTASSCHRDIGIMPVRHSVDPEKSNRVLGFPALITGLCQFYEVHVTPSKVIRPPTNRALIKKYCAPRKAQGETPQQPEDGR

SEQ ID NO: 224143 - protein, 133 aa, Glycine max
  Coding DNA Sequence Number=SeqID_107365
  Gene Ontology: Mol. function=transition metal ion binding
  Homolog annotation: Hit_ID=Q6Z6A4; Match level="QueryCoverage=90%, HitCoverage=36%, E-value=4e-41, Identity=60%"; Hit description =Oxidation protection protein-like
  Pfam annotation: Domain name=TLD; Domain location=4-111; Score=60.4; E_value=6e-15; Accession=PF07534.6; Description=TLD
MDWFSVSAILFQVVGDRKGAVFGGLVEAPLRPSNKRKYQLCGINRHIAGVNRYFTLCTTDFLAIGGGSHFALYLEGDLLNGSSSVSETYGNPCLAHSQEFEVKEVELWGFVFPSKYEEIVELSRTEAPGICRW

SEQ ID NO: 224144 - protein, 546 aa, Glycine max
  Coding DNA Sequence Number=SeqID_107366
  Gene Ontology: Mol. function=signal transducer activity; Cellular component=membrane; Biological process=response to light stimulus
  Homolog annotation: Hit_ID=Q9LFU0; Match level="QueryCoverage=94%, HitCoverage=82%, E-value=1e-151, Identity=52%"; Hit description=Non -phototropic hypocotyl 3-like protein
  Pfam annotation: Domain name=BTB; Domain location=44-144; Score=-9.4; E_value=0.029; Accession=PF00651.21; Description=BTBPOZ domain
  Pfam annotation: Domain name=NPH3; Domain location=209-485; Score =309.3; E_value=6.9e-90; Accession=PF03000.5; Description=NPH3 family
  Pfam module annotation: Pfam domain module=BTB::NPH3; Domain location= 44-144::209-485
MKSLQVGQAQQDSDGSDKVSDKSIVVPNKFIAIADSFKGEHSWFIAPQIPTDFSIQVQETTYNVHKYPLISKCGYIGRLEIQPLISNSGNVLNLENFPGGSETFETILKFCYGLPIDFSPDNIAALRCASEFLEMTEELEDGNLISKSEAFLTFVVLSSWKDTITVLKSSENLSPWAENLQIVRRCCDSIAWKASKDELTSEDAAPNQESWWFNDVAAFRIDHFMRIISAIRAKGTKPETIGKCIMQYAKRWLPGMEVELEGLRGYGHEKCNLQFSIFSGKKKESSGNSKEQRTIIESLISIIPPQQDAVSCKFMLQLLKMAMMYSVSPALTTDLEKRVSLVLEDAEVSDLLIPRYQNGDQGKTVICMTNSSEECTMLDIDVVQRIVEYFLMHEQQQIQQQQKTRKFNISRLLDNYLAEIARDPNLSITKFQVFAELLPENTRSYDDGLYRAIDTYLKTQPSLTEHDRKRLCKIMNCEKLSLDACLHAAQNERLPLRTVVQFFNVRRIIQILISRKMKTKEKHSPMPNPSLKPHAQGEARKTILTQ

SEQ ID NO: 224145 - protein, 246 aa, Glycine max
  Coding DNA Sequence Number=SeqID_107367
  Gene Ontology: Mol. function=sugar porter activity; Cellular component=integral to membrane; Biological process=carbohydrate transport
  Pfam annotation: Domain name=Nuc_sug_transp; Domain location=4-178; Score=-148.7; E_value=0.0011; Accession=PF04142.6; Description =Nucleotide-sugar transporter
MASDNGLYRQKQSIEQIGALFLLIVAAVLLSVGEGSTKGSAIGNADQILFYGIIPVLVASVLSGLASSLCQWASQVKKHSSYLMTIEMSIVGSLCLLASTLKSPDGEAMRQHGFFYGWTPLTLIPVIFNALGGILVGLVTSHAGGVRKKLLLHLIGGAVEAVTAQTYGTLSSLGVAGHDENSDFENSFIGNIRGFVIVSALLITALLQFIFDGKTPSLYCLLALPLVVTSISIYQKYPYQVKKKES

SEQ ID NO: 224146 - protein, 157 aa, Glycine max
  Coding DNA Sequence Number=SeqID_107368
  Gene Ontology: Mol. function=nucleotide binding; Cellular component =membrane; Biological process=small GTPase mediated signal transduction
  Homolog annotation: Hit_ID=Q9LFT9; Match level="QueryCoverage=99%, HitCoverage=75%, E-value=8e-75, Identity=88%"; Hit description=GTP -binding protein
  Pfam annotation: Domain name=Ras; Domain location=1-122; Score=135.9; E_value=1.1e-37; Accession=PF00071.12; Description=Ras family
MYLEDRTVRLQLWDTAGQERFRSLIPSYIRDSSVAVIVYDVANRQSFLNTNKWVEEVRTERGSDVIIVLVGNKTDLVEKRQVSIEEGDAKSREFGIMFIETSAKAGFNIKPLFRKIAAALPGMESLSSTKQEDMVDVNLKPTVNSSQTEQQGGGCSC

SEQ ID NO: 224147 - protein, 184 aa, Glycine max
  Coding DNA Sequence Number=SeqID_107369
  Gene Ontology: Mol. function=protein transporter activity; Cellular component=membrane; Biological process=intracellular protein transport
  Homolog annotation: Hit_ID=Q1PF48; Match level="QueryCoverage=94%, HitCoverage=66%, E-value=1e-17, Identity=33%"; Hit description =Syntaxin-like protein
  Pfam annotation: Domain name=SNARE; Domain location=101-157; Score =18.3; E_value=0.0074; Accession=PF05739.9; Description=SNARE domain
MVSDMVALFCKARIIKSRLEVIDQSNITNRTLSESYIEVTQIRMSVTNGLRAKLRVMLMHGFQSLRDKFLMEKMISRSLKVEFMVAAAGKTDIDNADLGVRHEEVIMDIQRSLNMLDQIFVDIAILVETQGENLDSIEDRVASVVNNANQMKRKNTNTEWLCWVLVVMLLTVFLYWGRNLEGVV

SEQ ID NO: 224148 - protein, 63 aa, Glycine max
  Coding DNA Sequence Number=SeqID_107370
MKIVMDKVSRVGYEYNIRIKDGFVFRQHQYLSSVDSGACCSADNNIVGASVYVAVYNINNNHT

SEQ ID NO: 224149 - protein, 113 aa, Glycine max
  Coding DNA Sequence Number=SeqID_107371
  Gene Ontology: Mol. function=binding; Cellular component =mitochondrial inner membrane; Biological process=transport
  Homolog annotation: Hit_ID=Q10QM8; Match level="QueryCoverage=76%, HitCoverage=20%, E-value=4e-26, Identity=59%"; Hit description =Mitochondrial carrier protein, expressed
  Pfam annotation: Domain name=Mito_carr; Domain location=2-52; Score =0.7; E_value=0.003; Accession=PF00153.17; Description=Mitochondrial carrier protein
KNLYELIQAIAASQGMRGFWKGNFVNILRTAPFKAINFYAYDTYRNKLTRMLGNEESTNFERFVAGAAAGITATLLCLPMDTVSGKLRIMLPVSVLSCVYILNCDALRSNTIG

SEQ ID NO: 224150 - protein, 167 aa, Glycine max
  Coding DNA Sequence Number=SeqID_107372
  Gene Ontology: Mol. function=binding; Cellular component =mitochondrial inner membrane; Biological process=transport
  Homolog annotation: Hit_ID=Q9LV81; Match level="QueryCoverage=91%, HitCoverage=35%, E-value=2e-72, Identity=85%"; Hit description =Mitochondrial carrier protein-like
  Pfam annotation: Domain name=Mito_carr; Domain location=4-61; Score =12.2; E_value=0.00027; Accession=PF00153.17; Description =Mitochondrial carrier protein
  Pfam annotation: Domain name=Mito_carr; Domain location=86-159; Score= 35.6; E_value=1.7e-07; Accession=PF00153.17; Description =Mitochondrial carrier protein
  Pfam module annotation: Pfam domain module=Mito_carr::Mito_carr; Domain location=4-61::86-159
MVAPGGEALGGVIGAFRHMIQTEGFFSLYKGLVPSIISMAPSGAVYYGIYDILKSAYLHSPEGMKRIQHMKEEGEELNALEQLELGPVRTLLYGAIAGCCSEAATYPFEVVRRQLQMQVRATRLNALATCVKIVEQGGVPALYVGLIPSLLQKLLYNHGCENNSTVK

SEQ ID NO: 224151 - protein, 84 aa, Glycine max
  Coding DNA Sequence Number=SeqID_107373
MSDSGRSYIDTLEFEHESSRQIQMAITFDSGLMRIMKLAKYRLKAQVEKDKAPEWRRMKAQVEKDEGPEAETLSRQLIVAEGPN

SEQ ID NO: 224152 - protein, 342 aa, Glycine max
  Coding DNA Sequence Number=SeqID_107374
  Gene Ontology: Mol. function=metal ion binding; Cellular component =nucleus; Biological process=regulation of transcription, DNA -dependent
  Homolog annotation: Hit_ID=Q6F2W0; Match level="QueryCoverage=25%, HitCoverage=21%, E-value=1e-31, Identity=71%"; Hit description =Putative Dof zinc finger protein
  Pfam annotation: Domain name=zf-Dof; Domain location=33-95; Score =140.5; E_value=4.7e-39; Accession=PF02701.6; Description=Dof domain, zinc finger
  Subcellular localization annotation: CTP_CleavageSite=42; ConfidenceScore=5.20e-01
MSPDDTPSKPATAKDQETQSSGGSGRKSSSTRPQEQGLNCPRCDSPNTKFCYYNNYSLTQPRHFCKTCRRYWTKGGALRNVPIGGGCRKNKKVKSSRLSCDSKDSGSSSSEVGGLKFLHSLSPSMDFHLGGLPFPRLHHHHHPPTTYNHFSSFENTSSTSSCFNLDPSPGTTTTLSSSFAALYNYPFSYNGAIQGMSSLNVHSGLASSIESLSSINQDLHWKLQQQRLAMLFGGDNNQKDHSGVNQIENQTQKPQTILFQNLEISKPGTFPVGDSRKEHGPSGDTHTPSTEWFFGNSYASVTPTPTSSGGGPGNNDNASNWSSGGGGVHAWGDVPQQYSSLP

SEQ ID NO: 224153 - protein, 122 aa, Glycine max
  Coding DNA Sequence Number=SeqID_107375
MAAQLIRDRVVMECLEGIWETLEGNERCQFRGTVRLTTTSLVHPEQPAQVSSSEEDPEGDPEELSPEPAMDAPDLPEDDEDPLPDVDSPEDIMPALEADSTEESGPGGMANSDDSSSQQTAP

SEQ ID NO: 224154 - protein, 1061 aa, Glycine max
  Coding DNA Sequence Number=SeqID_107376
  Gene Ontology: Mol. function=microtubule motor activity; Cellular component=microtubule associated complex; Biological process =microtubule-based movement
  Homolog annotation: Hit_ID=UPI000034ED67; Match level="QueryCoverage =97%, HitCoverage=96%, E-value=0.0, Identity=56%"; Hit description =ATP binding / microtubule motor
  Pfam annotation: Domain name=Kinesin; Domain location=399-716; Score =532.2; E_value=5.5e-157; Accession=PF00225.13; Description=Kinesin motor domain
MDPTQSNDVLQYPQTLISEPKDSPMQDANESLFDSMVCDSSSRLIPTGFTRSDNAAEEDCFMFVNAGGDAFSEEAGGITFLADTYFDGGNVMRTNEQIVEGGDYPFIYQSARLGSFCYRFDNLPPGDYIVDLHFVEIININGPKGMRVFNVLSELDIYAVVGANKPLQMVDLRVSVKDDGVILIRFESISGSPVVSGICIRRATKAPVPQVKSDYIKCSSCAVQIEIPSSQMKVMQAKSTAKYESKIKELTMQCDLKAKECYQAWMSLTATNEQLEEVQMELDKVTFNSLTTDQTVEKQAESLRNISNRYELDKKKWAEAINSLQEKIKLMKSDYSNLSFEAHECVDSIPELNKMVFAVQDLVKQCEDLKVKYNEEMAKRKKLFNEVQEAKGNIRVFCRCRPLNKAEISAGCNTIVDFDAAKDSCLGILTSGSTKKSFRFDRVYTPKDDQVDVFADASSMVISVLDGYNVCIFAYGQTGTGKTFTMEGTQQNRGVNYRTLEHLFKVSKERSETFSYDISVSVIEVYNEQIRDLLATGQTSKRLEIKQASEGFHHVPGVVEARIDNINEVWNVLQVGNNARAVGSNNVNEHSSRSHCLLCIAVKAKNLLNGESTKSKLWLVDLAGSERLAKTDVQGERLKEAQNINRSLSALGDVISALAAKSSHIPYRNSKLTHLLQDSLGGDSKTLMFVQISPSDQDVGETLSSLNFATRVRGVELGPVKKQIDTSEVQKMKAMLEKARSECRIKDESMRKLEENLQNLESKAKGKDQIYKNLQEKIKELEGQIELKKAMQNDSEKQISQLSDKLRGKEETCSTLQQKVKELEKKMKEQLQSESASFQQKVWDLEKKLKDQMQGSESESAILKDKIKELERKLKEQEQSSMSLLRQQMEQLEDRYREREQQWQQTDSFVDATVKAATPDVGKSCMSEECPSEIETGILRCSDSENRQISQGSSLFKGNGSTRKISQGSCLFKGNDSTHKIRSKREFRSNDENNFAMPSSLQHDRRVARKSDPPKIVRGLRPTPRPVTANLAPVSHKRASTSRDQVQGIKERDTKKKIWSR

SEQ ID NO: 224155 - protein, 994 aa, Glycine max
  Coding DNA Sequence Number=SeqID_107377
  Gene Ontology: Mol. function=transcription regulator activity; Cellular component=nucleus; Biological process=regulation of transcription, DNA-dependent
  Homolog annotation: Hit_ID=Q9FQ93; Match level="QueryCoverage=63%, HitCoverage=93%, E-value=0.0, Identity=63%"; Hit description=Anther ethylene-upregulated protein ER1
  Pfam annotation: Domain name=Ank; Domain location=646-678; Score =35.9; E_value=1.4e-07; Accession=PF00023.20; Description=Ankyrin repeat
  Pfam annotation: Domain name=Ank; Domain location=685-719; Score=6.8; E_value=3.2; Accession=PF00023.20; Description=Ankyrin repeat
  Pfam annotation: Domain name=IQ; Domain location=820-840; Score=22.2; E_value=0.0019; Accession=PF00612.17; Description=IQ calmodulin -binding motif
  Pfam annotation: Domain name=IQ; Domain location=843-863; Score=22.4; E_value=0.0016; Accession=PF00612.17; Description=IQ calmodulin -binding motif
  Pfam module annotation: Pfam domain module=Ank::Ank::IQ::IQ; Domain location=646-678::685-719::820-840::843-863
MAPLLTLFIQHCCRELSHIVLVHYRQVKGTKANFTSAKENEESLPYAQQTDKIMPQTEMDTSLSSTLHPHSYQVPSKTVDTSMNSAQTSEYEEAESAFNNHASSEFYSFLELQRPVEKISPQPADFYSPRPLINDQEKLPIIPGVNYISLTQDNKNKDILNAGLTYESPKPLGFSSWEGILENNAGSQHVHFQPLFPGTQPDNMGINSNFSQGEEIMVPYLTTSIAKQHENGSIIKAEGNWQVYDVDSLRMSSWPIDSAYSGSTCEVSCSNCEQEVNDVDFQKSLEQCLLHSHKQNKVLMQNDLQEKLLNEKEKIKSNLEAYGIEDTYLSFKRTLLDGPPAEEGLKKLDSFNQWMSKELGDVEESNKPSTSGGYWDTVETENEVGNTTIPSQGHLDTYVLDPSVSHDQLFSIIDYSPSWAFEGSEIKVIISGEFLRSQHEAEQCKWSCMFGEVEVPAVIIAKGVLCCHTPPHKAGRVPFYVTCSNRLACSEVREFDFQVHYTPEDTTGENRGSTFDTFSIRFGELLSLGHAFPQNSDSISVSEKSQLRSKINSLLREDDDDWDKLLKLTQEKDFSPENLREQLLQNLLKDKLHAWLLQKITEEGKGPNVLDEGGQGVLHFAAALGYDWALEPTIVAGVNVNFRDVNGWTSLHWAAFCGRERTVAFLISLGAAPGALTDPCPEHPSGRTPADLASANGHKGIAGYLAESSLSAHLTTLDLNRDAGENSGAKVVQRLQNIAQVNDLDGLSYELSLKDSLAAVCNATQAAARIHQVFRMQSFQRKQLKEYDDDKLGLSDERALSLIKMNVKSHKSGPRDEPVHAAAIRIQNKFRSWKGRREFLMIRQRIVKIQAHVRGHQVRKSCGKIIWSVGILEKVILRWRRKGSGLRGFKPEANSEGTMIQDVSSTDDDYDVLKEGRKQTEQRLQKALARVKSMVQYPEARDQYHRLLNVVTEIQENQVKHESSSNNSEEPREFGDLNDLEALLDEDIFMPTAT

SEQ ID NO: 224156 - protein, 585 aa, Glycine max
  Coding DNA Sequence Number=SeqID_107378
  Gene Ontology: Mol. function=protein serine/threonine kinase activity; Cellular component=integral to membrane; Biological process=protein amino acid phosphorylation
  Homolog annotation: Hit_ID=Q8RWK7; Match level="QueryCoverage=96%, HitCoverage=95%, E-value=0.0, Identity=71%"; Hit description=Protein serine/threonine kinase-like protein
  Pfam annotation: Domain name=LRRNT_2; Domain location=19-59; Score =44.8; E_value=3e-10; Accession=PF08263.3; Description=Leucine rich repeat N-terminal domain
  Pfam annotation: Domain name=LRR_1; Domain location=111-133; Score =19.5; E_value=0.012; Accession=PF00560.23; Description=Leucine Rich Repeat
  Pfam annotation: Domain name=LRR_1; Domain location=135-158; Score =9.4; E_value=5; Accession=PF00560.23; Description=Leucine Rich Repeat
  Pfam annotation: Domain name=LRR_1; Domain location=87-109; Score =16.0; E_value=0.14; Accession=PF00560.23; Description=Leucine Rich Repeat
  Pfam annotation: Domain name=Pkinase; Domain location=262-536; Score =126.7; E_value=6.3e-35; Accession=PF00069.15; Description=Protein kinase domain
  Pfam annotation: Domain name=Pkinase_Tyr; Domain location=262-536; Score=107.1; E_value=5.1e-29; Accession=PF07714.7; Description =Protein tyrosine kinase
  Pfam module annotation: Pfam domain module=LRRNT_2::LRR_1::LRR_1::LRR_ 1::Pkinase::Pkinase_Tyr; Domain location=19-59::111-133::135-158::87 -109::262-536::262-536
MDFIFVLLLLGCLCSFVLPDTQGDALFALKISLNASAHQLTDWNQNQVNPCTWSRVYCDSNNNVMQVSLAYMGFTGYLNPRIGVLKYLTALSLQGNGITGNIPKELGNLTSLSRLDLEGNKLTGEIPSSLGNLKKLQFFLLDSNNLSGQIPEQLFKVPKYKYGCFTGNNLSCGASYHQPCETDNADQGSSHKPKTGLIVGIVIGLVVILFLGGLMFFGCKGRHKGYRREVFVDVAGEVDRRIAFGQLRRFAWRELQIATDNFSEKNVLGQGGFGKVYKGVLADNTKVAVKRLTDYESPGGDAAFQREVEMISVAVHRNLLRLIGFCTTPTERLLVYPFMQNLSVAYRLREIKPGEPVLDWPTRKQVALGTARGLEYLHEHCNPKIIHRDVKAANVLLDEDFEAVVGDFGLAKLVDVRKTNVTTQVRGTMGHIAPEYLSTGKSSERTDVFGYGIMLLELVTGQRAIDFSRLEEEDDVLLLDHVKKLEREKRLDAIVDHNLNKNYNIQEVEMMIKVALLCTQATPEDRPPMSEVVRMLEGEGLAERWEEWQHVEVNRRQEYERLQRRFDWGEDSVYNQDAIELSGGR

SEQ ID NO: 224157 - protein, 345 aa, Glycine max
  Coding DNA Sequence Number=SeqID_107379
  Gene Ontology: Mol. function=transferase activity; Cellular component= membrane; Biological process=RNA-dependent DNA replication
  Homolog annotation: Hit_ID=Q6ZIF8; Match level="QueryCoverage=99%, HitCoverage=81%, E-value=1e-163, Identity=79%"; Hit description =Putative pectin-glucuronyltransferase
  Pfam annotation: Domain name=Exostosin; Domain location=7-310; Score =313.2; E_value=4.8e-91; Accession=PF03016.6; Description=Exostosin family
MEKKFKVYIYPDGDPNTFYQTPRKLTGKYASEGYFFQNIRDSRFRTENPDEAHLFFIPISCHKMRGKGTSYENMTIIVQNYVESLISKYPYWNRTLGADHFFVTCHDVGVRATEGLEFLVKNSIRAVCSPSYDVGFIPHKDVALPQVLQPFALPAGGNDIENRTTLGFWAGHRNSKIRVILARVWENDTELDISNNRISRATGHLVYQKRFYRSKFCICPGGSQVNSARIADSIHYGCIPGLILFCILSLLKLYTYVSSVILSNYYDLPFNDILDWNKFAVVLKESDVYQLKQILKNISDAEFVTLHNNLVKVQKHFQWNSPSIRFDAFHLVMYDLWLRHHTIKY

SEQ ID NO: 224158 - protein, 650 aa, Glycine max
  Coding DNA Sequence Number=SeqID_107380
  Gene Ontology: Mol. function=catalytic activity; Cellular component =intracellular; Biological process=metabolic process
  Homolog annotation: Hit_ID=Q9LHZ4; Match level="QueryCoverage=95%, HitCoverage=94%, E-value=1e-115, Identity=32%"; Hit description =Pentatricopeptide (PPR) repeat-containing protein-like
  Pfam annotation: Domain name=PPR; Domain location=148-182; Score =43.3; E_value=8e-10; Accession=PF01535.11; Description=PPR repeat
  Pfam annotation: Domain name=PPR; Domain location=249-283; Score =37.4; E_value=5e-08; Accession=PF01535.11; Description=PPR repeat
  Pfam annotation: Domain name=PPR; Domain location=350-384; Score =38.8; E_value=1.9e-08; Accession=PF01535.11; Description=PPR repeat
  Pfam annotation: Domain name=PPR; Domain location=421-455; Score =13.8; E_value=0.17; Accession=PF01535.11; Description=PPR repeat
  Pfam annotation: Domain name=PPR; Domain location=46-80; Score=42.3; E_value=1.6e-09; Accession=PF01535.11; Description=PPR repeat
  Pfam module annotation: Pfam domain module=PPR::PPR::PPR::PPR::PPR; Domain location=148-182::249-283::350-384::421-455::46-80
AVHTNVIKSGFSYSFLGHKLIDGYIKCGSLAEARKLFDELPSRHIVTWNSMISSHISHGKSKEAVEFYGNMLMEGVLPDAYTFSAISKAFSQLGLIRHGQRAHGLAVVLGLEVLDGFVASALVDMYAKFDKMRDAHLVFRRVLEKDVVLFTALIVGYAQHGLDGEALKIFEDMVNRGVKPNEYTLACILINCGNLGDLVNGQLIHGLVVKSGLESVVASQTSLLTMYSRCNMIEDSIKVFNQLDYANQVTWTSFVVGLVQNGREEVAVSIFREMIRCSISPNPFTLSSILQACSSLAMLEVGEQIHAITMKLGLDGNKYAGAALINLYGKCGNMDKARSVFDVLTELDVVAINSMIYAYAQNGFGHEALELFERLKNMGLVPNGVTFISILLACNNAGLVEEGCQIFASIRNNHNIELTIDHFTCMIDLLGRSRRLEEAAMLIEEVRNPDVVLWRTLLNSCKIHGEVEMAEKVMSKILELAPGDGGTHILLTNLYASAGKWNQVIEMKSTIRDLKLKKSPAMSWVDVDREVHTFMAGDLSHPRSLEIFEMLHGLMKKVKTLGYNPNTRFVLQDLDEEKKISSLYYHSEKLAIAYALWKTIGRTTTIRIFKNLREVYVPVKITGESYLLYAMPSLLDAHFPHRSVHTSMPP

SEQ ID NO: 224159 - protein, 712 aa, Glycine max
  Coding DNA Sequence Number=SeqID_107381
  Gene Ontology: Mol. function=1-deoxy-D-xylulose-5-phosphate synthase activity; Cellular component=nucleus; Biological process=terpenoid biosynthetic process
  Homolog annotation: Hit_ID=Q8L692; Match level="QueryCoverage=99%, HitCoverage=100%, E-value=0.0, Identity=83%"; Hit description=1 -deoxy-D-xylulose 5-phosphate synthase 2 precursor
  Pfam annotation: Domain name=TPP_enzyme_C; Domain location=160-353; Score=-50.3; E_value=0.078; Accession=PF02775.11; Description =Thiamine pyrophosphate enzyme, C-term
  Pfam annotation: Domain name=Transket_pyr; Domain location=390-556; Score=224.1; E_value=3.1e-64; Accession=PF02779.14; Description =Transketolase, pyrimidine binding dom
  Pfam annotation: Domain name=Transketolase_C; Domain location=571 -694; Score=148.5; E_value=1.7e-41; Accession=PF02780.10; Description= Transketolase, C-terminal domain
  Pfam annotation: Domain name=Transketolase_N; Domain location=86-363; Score=-203.4; E_value=0.018; Accession=PF00456.11; Description =Transketolase, thiamine diphosphate b
  Pfam module annotation: Pfam domain module=TPP_enzyme_C::Transket _pyr::Transketolase_C::Transketolase_N; Domain location=160-353::390 -556::571-694::86-363
MALSATFVKTNRSILPFHQNSSPNHGRIKQLCVRASASSLDDDEDRTVVRKEKDGWKIKFSSQKPATPLLDTINYPAHMKNLSLQDLEQLAAELRADVVHSVSNTGGHLSSSLGVVELTVALHHVFNTPEDKIIWDVGHQAYPHKILTGRRSRMHTIRKTSGLAGFPKREESVYDVFGTGHSSTSISAGLGMAVARDLLGKKNSIVSVIGDGAMTAGQAYEAMNNAGFLDSNMIIILNDNKQVSLPTATIDGPATPVGALSSALSKIQASTKFRKLREAAKGITKQIGGTTHQLAAKVDEYARGMISGSGSTLFEELGLYYIGPVDGHNIEDLVTILEKVKEMPAPGPTLIHVVTEKGKGYPPAEVAADKMHGVVKFVPTSGHQLKPKSSTLTYTQYFAESLIKEAEIDNKIVAIHAAMGGGTGLNYFHKRFPDRCFDVGIAEQHAVTFAAGLAAEGLKPFCAIYSSFLQRGYDQVVHDVDLQKLPVRFAMDRAGLVGADGPTHCGAFDITYMACLPNMVVMAPSDEAELMHMVATAAAIDDRPSCFRFPRGNGIGASLPLNNKGTPLEIGKGRILRQGSRVAILGYGSVVQQCLQAAQMLKPLDISVTVADARFCKPLDTDLIKLLGKEHEFLLTVEEGSIGGFGSHVSHFLSIVGLLDGPLKWRPMMLPDRYIEHGSPQDQTEEAGLSSKNIAATVLSLLERPKEALLFK

SEQ ID NO: 224160 - protein, 34 aa, Glycine max
  Coding DNA Sequence Number=SeqID_107382
MGNSSSAVTKIQYHGQGCIIQPQKLGNAFSPICL

SEQ ID NO: 224161 - protein, 41 aa, Glycine max
  Coding DNA Sequence Number=SeqID_107383
  Homolog annotation: Hit_ID=Q9SJZ7; Match level="QueryCoverage=88%, HitCoverage=8%, E-value=5e-10, Identity=86%"; Hit description =Putative DnaJ protein
MRGDQLVRVQVEIPKRLSNDERKLIEELADLSKGKTATGLD

SEQ ID NO: 224162 - protein, 73 aa, Glycine max
  Coding DNA Sequence Number=SeqID_107384
MPLPSAVHASSTNESGAPRSAVHVSSTYESGALRTDCLVHSQFSILAFFPEPHECHLPTAVHASSTYESGAPI

SEQ ID NO: 224163 - protein, 185 aa, Glycine max
  Coding DNA Sequence Number=SeqID_107385
MIYPPSPIRWHVKCKMTRTKKIDQMTIRWRSRCHRVVVHGRQDVLTATIGRPEHPSRVGAARAGVTIKQYFGPTRGVDHKKSDSITNGLALPPEPEVGPSAARVSTKESCIDHSGNDPDMCDSDKCGLYIDENPPCLVALGRVYEGSIIIHNIPLLHDQVKVGVEEVRDADALIPVPIEEVKLVG

SEQ ID NO: 224164 - protein, 98 aa, Glycine max
  Coding DNA Sequence Number=SeqID_107386
MSLSSAVHVSSTYEFGAMRSDSLVQFSNLAFFSEPHECHCLALFMHPPPTSLEPHEGIAYNCSPILHFHFFSEPHECHCLALFVCPPPMSLEPRKFIA

SEQ ID NO: 224165 - protein, 48 aa, Glycine max
  Coding DNA Sequence Number=SeqID_107387
MAFLGACFSVGRWWRGWGVRQSWWWCEWWRWWLNWRIGHYKNPNGACD

SEQ ID NO: 224166 - protein, 95 aa, Glycine max
  Coding DNA Sequence Number=SeqID_107388
  Homolog annotation: Hit_ID=Q1PFH7; Match level="QueryCoverage=58%, HitCoverage=28%, E-value=4e-16, Identity=76%"; Hit description =Pentatricopeptide repeat-containing protein
  Subcellular localization annotation: CTP_CleavageSite=7; ConfidenceScore=5.10e-01
MLVRVAVAAVVRAGTRNWARWASSGASSPSLSIWRRKKEMGKEGLVVAKELKRFRSDPVRLDRFIRSSVSRLLKSDLVAVLAEFQRQNQFFLCVK

SEQ ID NO: 224167 - protein, 156 aa, Glycine max
  Coding DNA Sequence Number=SeqID_107389
  Homolog annotation: Hit_ID=Q1PFH7; Match level="QueryCoverage=87%, HitCoverage=69%, E-value=1e-59, Identity=76%"; Hit description =Pentatricopeptide repeat-containing protein
  Pfam annotation: Domain name=PPR; Domain location=31-65; Score=15.4; E_value=0.11; Accession=PF01535.11; Description=PPR repeat
  Pfam annotation: Domain name=PPR; Domain location=66-100; Score=21.4; E_value=0.0033; Accession=PF01535.11; Description=PPR repeat
  Pfam module annotation: Pfam domain module=PPR::PPR; Domain location =31-65::66-100
MGYTKELSPFSLGKPLYDIVRKEIWYRPDMFFYRDMLMMLARNKRVEEAKKVWGDLKTEEVLFDQHTFGDIIRAFLDNGLPSEAMDIYEEMRQSPEPPLSLPFRVILKGLIPYPELREKVKDDFLEIFPGMIIYDPPEDLFEDNKQHNDRDNYRIA

SEQ ID NO: 224168 - protein, 67 aa, Glycine max
  Coding DNA Sequence Number=SeqID_107390
MGCYNCNKQKGSTECEYYVIHWMSTIILGGFKDNWEMYFTDSRPLELETMKEIHIRWARYYLKVSDN

SEQ ID NO: 224169 - protein, 628 aa, Glycine max
  Coding DNA Sequence Number=SeqID_107391
  Gene Ontology: Mol. function=binding; Cellular component =intracellular; Biological process=metabolic process
  Homolog annotation: Hit_ID=Q6ETD1; Match level="QueryCoverage=92%, HitCoverage=91%, E-value=1e-121, Identity=33%"; Hit description =Putative pentatricopeptide (PPR) repeat-containing protein-like protein
  Pfam annotation: Domain name=PPR; Domain location=115-149; Score =33.8; E_value=5.9e-07; Accession=PF01535.11; Description=PPR repeat
  Pfam annotation: Domain name=PPR; Domain location=150-184; Score=3.5; E_value=2.9; Accession=PF01535.11; Description=PPR repeat
  Pfam annotation: Domain name=PPR; Domain location=216-250; Score =31.0; E_value=4.2e-06; Accession=PF01535.11; Description=PPR repeat
  Pfam annotation: Domain name=PPR; Domain location=317-351; Score =40.5; E_value=5.8e-09; Accession=PF01535.11; Description=PPR repeat
  Pfam annotation: Domain name=PPR; Domain location=352-386; Score =10.6; E_value=0.41; Accession=PF01535.11; Description=PPR repeat
  Pfam annotation: Domain name=PPR; Domain location=388-422; Score=9.8; E_value=0.52; Accession=PF01535.11; Description=PPR repeat
  Pfam annotation: Domain name=PPR; Domain location=454-488; Score=4.1; E_value=2.5; Accession=PF01535.11; Description=PPR repeat
  Pfam annotation: Domain name=PPR; Domain location=53-87; Score=19.1; E_value=0.016; Accession=PF01535.11; Description=PPR repeat
  Pfam module annotation: Pfam domain module=PPR::PPR::PPR::PPR::PPR::PP R::PPR::PPR; Domain location=115-149::150-184::216-250::317-351::352 -386::388-422::454-488::53-87
HIREAFESFLSEIWAEPRLFSNLLQACIPLKSVSLGKQLHSLIFTSGCSSDKFISNHLLNLYSKFGELQAAVALFDRMPRRNIMSCNIMIKAYLGMGNLESAKNLFDEMPDRNVATWNAMVTGLTKFEMNEEALLLFSRMNELSFMPDEYSLGSVLRGCAHLGALLAGQQVHAYVMKCGFECNLVVGCSLAHMYMKAGSMHDGERVINWMPDCSLVAWNTLMSGKAQKGYFEGVLDQYCMMKMAGFRPDKITFVSVISSCSELAILCQGKQIHAEAVKAGASSEVSVVSSLVSMYSRCGCLQDSIKTFLECKERDVVLWSSMIAAYGFHGQGEEAIKLFNEMEQENLPGNEITFLSLLYACSHCGLKDKGLGLFDMMVKKYGLKARLQHYTCLVDLLGRSGCLEEAEAMIRSMPVKADAIIWKTLLSACKIHKNAEIARRVADEVLRIDPQDSASYVLLANIYSSANRWQNVSEVRRAMKDKMVKKEPGISWVEVKNQVHQFHMGDECHPKHVEINQYLEELTSEIKRQGYVPDTSSVLHDMDNEEKEQILRHHSEKLAIAFALMNTPEGVPIRVMKNLRVCSDCHVAIKYISEIKKLEIIVRDSSSHGSLIYAQLEQQRSSLQHAPP

SEQ ID NO: 224170 - protein, 78 aa, Glycine max
  Coding DNA Sequence Number=SeqID_107392
  Gene Ontology: Mol. function=zinc ion binding; Cellular component =intracellular
  Homolog annotation: Hit_ID=Q948W7; Match level="QueryCoverage=75%, HitCoverage=24%, E-value=1e-22, Identity=78%"; Hit description=Zinc -binding protein
  Pfam annotation: Domain name=PLATZ; Domain location=33-77; Score= -26.2; E_value=0.0013; Accession=PF04640.4; Description=PLATZ transcription factor
MKGSEASSGGDMSVKPASAWLERLMAETFFGGCGVHQNHKKNEKNIFCLHCCLSICPHCLPSHRSHSLLQITDMFGLD

SEQ ID NO: 224171 - protein, 74 aa, Glycine max
  Coding DNA Sequence Number=SeqID_107393
  Gene Ontology: Mol. function=structural constituent of ribosome; Cellular component=intracellular; Biological process=translation
  Homolog annotation: Hit_ID=Q1S5H1; Match level="QueryCoverage=54%, HitCoverage=28%, E-value=2e-17, Identity=95%"; Hit description =Ribosomal protein L35Ae, putative
  Pfam annotation: Domain name=Ribosomal_L35Ae; Domain location=10-57; Score=0.4; E_value=0.00053; Accession=PF01247.8; Description =Ribosomal protein L35Ae
  Subcellular localization annotation: CTP_CleavageSite=41; ConfidenceScore=5.08e-01
MVCWQENGPISNKAKVKKDGSHYRCIWGKVTRPHGNSGVVRAKFKSNLPPRSMINTLFANVASLVKLFLPLHAI

SEQ ID NO: 224172 - protein, 261 aa, Glycine max
  Coding DNA Sequence Number=SeqID_107394
  Gene Ontology: Mol. function=structural constituent of ribosome; Cellular component=ribonucleoprotein complex; Biological process =translation
  Homolog annotation: Hit_ID=Q05462; Match level="QueryCoverage=51%, HitCoverage=100%, E-value=7e-56, Identity=80%"; Hit description=60S ribosomal protein L27
  Pfam annotation: Domain name=KOW; Domain location=131-166; Score =31.5; E_value=2.9e-06; Accession=PF00467.19; Description=KOW motif
  Pfam annotation: Domain name=Ribosomal_L27e; Domain location=178-261; Score=189.9; E_value=6.1e-54; Accession=PF01777.8; Description =Ribosomal L27e protein family
  Pfam module annotation: Pfam domain module=KOW::Ribosomal_L27e; Domain location=131-166::178-261
DAQRLWIYAGCQVGCVRAMLEDNDNGGKTTTMVTRDEGVIQSFYFGWGFRDYVREKSEGKGRGCRDLVNGQKSDFTKLCSANSTVGDGNSRSIKRKRWPIVHSLETAHLAMCPNPEARKNLSVLKKMVKFLKPNKAVIVLQGRYAGRKAVIVRTFDEGTRERPYGHCLVAGIKKYPSKVIKKDSAKKTAKKSRVKAFVKLVNYQHLMPTRYTFDVDLKDAVTPDVLGTKDKKVTALKETKKRLEERFKTGKNRWFFTKLRF

SEQ ID NO: 224173 - protein, 48 aa, Glycine max
  Coding DNA Sequence Number=SeqID_107395
MAGGCAGQTTSKAVFGLELERFDVEWQDEFNKCNRTGWHGMAASGCGT

SEQ ID NO: 224174 - protein, 308 aa, Glycine max
  Coding DNA Sequence Number=SeqID_107396
  Pfam annotation: Domain name=Transposase_23; Domain location=234-305; Score=-12.4; E_value=0.026; Accession=PF03017.5; Description =TNP1ENSPM transposase
MSWELCILDVRKNAQVIQKQNIVPHVLSREVYLENKLMKEKKKKQLEEAAQFESTDIVIDPPSPIRQHLKWKMARTKKSGQMTSKTAKEITDKIVRFHGGVGLTEKLCCPWTSGCTNWGHWAIRTPWLCPCCWSWYHDLTILWIGFKDLLHIFVHGSQSPGAADEKYQGPTTGVDHRKVTQQLMLSFIQMQSQFQSQMQSQGLALPPEPEFGPSATRVCTKKSCVDPSGNDSDAGESKKCGLYVIENPPHLVVIGRLYEGSTTIHNIPLAFLYPLKVGVEEVQDADACILVPTQEVQLVGQTLNTFAA

SEQ ID NO: 224175 - protein, 106 aa, Glycine max
  Coding DNA Sequence Number=SeqID_107397
  Gene Ontology: Mol. function=riboflavin synthase activity; Cellular component=riboflavin synthase complex; Biological process=riboflavin biosynthetic process
  Homolog annotation: Hit_ID=O80575; Match level="QueryCoverage=86%, HitCoverage=40%, E-value=8e-40, Identity=84%"; Hit description=6,7 -dimethyl-8-ribityllumazine synthase, chloroplast precursor
  Pfam annotation: Domain name=DMRL_synthase; Domain location=1-104; Score=59.9; E_value=8.4e-15; Accession=PF00885.10; Description=6,7 -dimethyl-8-ribityllumazine synthase
MKQVVFKMSDIDKERLGKSGKYDAIVCIGAVVRGDTTHYDAVANSAASGVLSASLNSGGVPCIFGVLTCDDMDQALNRAGGKSGNKGAEAALTAIEMASLFEHHLK

SEQ ID NO: 224176 - protein, 771 aa, Glycine max
  Coding DNA Sequence Number=SeqID_107398
  Gene Ontology: Mol. function=ubiquitin-protein ligase activity; Cellular component=intracellular; Biological process=protein modification process
  Homolog annotation: Hit_ID=Q8GY23; Match level="QueryCoverage=99%, HitCoverage=20%, E-value=0.0, Identity=62%"; Hit description=E3 ubiquitin protein ligase UPL1
  Pfam annotation: Domain name=DUF908; Domain location=71-359; Score =346.3; E_value=5.2e-101; Accession=PF06012.3; Description=Domain of Unknown Function (DUF908)
  Pfam annotation: Domain name=DUF913; Domain location=406-771; Score =426.8; E_value=3e-125; Accession=PF06025.3; Description=Domain of Unknown Function (DUF913)
  Pfam module annotation: Pfam domain module=DUF908::DUF913; Domain location=71-359::406-771
MPPKIRCFIDHVTSVPLEKIEEPLKGFVWEFDKGDFHHWVDLFNHFDSFFEKYVKPRKDLQIDDDFLDLDPPFPRESVLQILRVIRIILDNCTNKHFYSSYEQHLSALLASTDPDVVEASLETLATFLKKTVGKYSIRETSLNSKLYALAQGWGGKEEGLGLIASAVPNGCDPIACELGCTLHFEFYAVNESESDVKVTEPLVQGLQIIHLCDVNKCVETDLELLHKLVTEYKVPASLRFSLLTRLRFARAFGSLASRQQYTCIRLYAFIVLIQACADADDLVWFFNAEPGFINELVSLLSYEDAVLEKIRILCLHSLAALCQDRSRQQSVQTAVTSGGHRGILSSLMQKAIDSVTSDTSKWSVHFAEALLSLVTVLVSTSSGCSAMREAGFIPTLLPLLKDTNPQHLHLVEKAVRILEAFMDYSNPAAALFRDLGGLDDTISRLKIEVSNVENGGKPPDDNSESSARSVNMVGSSSTGLDDTQPLYSEPLISYHRRLLMKALLRAISLGTYAPGNTARIYGSEENVLPHCLCIIFRRAKDFGGGVFSLAATVMSDLIQKDPTCFPVLDSAGLPSAFLDAIMDDVLNSADAITCIPQCLDALCLNSNGLQAVKDRNSLRCFVKVFTSRTYLRALAGDTPASLSSGLDELMRHASSLRGPGVEMLVEILETISKIGSAVDSSSLSPDPCSSTSVPMEMDGEDKSLILPNNKESSKADDTEQTTEPSPDVPIVNVEPFLPDCVNNIARLLETILQNADTCRIFVEKKGIEAIL

SEQ ID NO: 224177 - protein, 401 aa, Glycine max
  Coding DNA Sequence Number=SeqID_107399
  Gene Ontology: Mol. function=methyltransferase activity; Cellular component=cytosol
  Homolog annotation: Hit_ID=Q6YUR7; Match level="QueryCoverage=92%, HitCoverage=68%, E-value=7e-79, Identity=56%"; Hit description=SAM -dependent methyltransferase-like protein
  Pfam annotation: Domain name=Methyltransf_10; Domain location=24-380; Score=87.1; E_value=1.1e-23; Accession=PF05971.2; Description=Protein of unknown function (DUF890)
MGGSKKRKRKRNEEQRGGTVYSERENPPDFALLASLYPEFHPFVQFLHSHSRPTIDWTDFNATRQLTRVLLHHRHALNCPMGYEDSDTDTDTPIKHTKFNPDTGVGVGVGVGHRTRQGTRVSVLHSLWAHTRFRIATFYPIFLAKWIPDGNLCPTVPNRCNYIHWLQHLLSSDIIPNTISSDGKFRGFDIGTGASCIYPLLGASLHGWSFVGSDVTNVAIEWAERNVNSNPHISQLIEIRKVQDNASDPCVEVEESVNGDNIALCGSTDVEVAPLPLDLHACENRNYHGPPILVGVVRDDEKFDFCMCNPPFFESLEEAGLNPKTSCGGTSQEMVCPGGKKSNLKYLTSKLWEVGVAVVKTTEFVQGRTCRWGLAWSFLTPLQKTPVSLPDKKNTSFMLEV

SEQ ID NO: 224178 - protein, 2592 aa, Glycine max
  Coding DNA Sequence Number=SeqID_107400
  Gene Ontology: Mol. function=ubiquitin-protein ligase activity; Cellular component=intracellular; Biological process=protein modification process
  Homolog annotation: Hit_ID=Q8GY23; Match level="QueryCoverage=98%, HitCoverage=67%, E-value=0.0, Identity=54%"; Hit description=E3 ubiquitin protein ligase UPL1
  Pfam annotation: Domain name=HECT; Domain location=2225-2564; Score =541.9; E_value=6.7e-160; Accession=PF00632.15; Description=HECT -domain (ubiquitin-transferase)
  Pfam annotation: Domain name=UBA; Domain location=92-132; Score=50.9; E_value=4.2e-12; Accession=PF00627.21; Description=UBATS-N domain
  Pfam annotation: Domain name=UIM; Domain location=137-154; Score =20.9; E_value=0.0045; Accession=PF02809.10; Description=Ubiquitin interaction motif
  Pfam module annotation: Pfam domain module=HECT::UBA::UIM; Domain location=2225-2564::92-132::137-154
TELLVQPVAVGLSIGLFPVPRDPEVFVRMLQSQVLDVILPVWNHPMFCSCSPGFIASIISLVTHVYSGVGDVKRNHSNIVGSTNQRFMPPPPDEATIATIVEMGFSRARAEEALRRVETNSVEMAMEWLFSHADDPVQEDDELARALALSLGSSSESTKAESAEKTIDVLTEEGHVKKPPVDDILAASVKLFQSSDSVPFQLTDLLVTLCSQGKGDDRPKDNCALSVLAHILALLLFEDVSTREIAAQNGIISTIIDILTNFKGRQELGKEIPVPKCISALLLILDQMVQSRPKVENIEGTQTASLPDSSGEQFPDTVLPKENKSNGNEKEPAMAFENILGKSTGFATIDESRKLLDIACDLIKQHVPAVVMQAVLQLCARLTKTHALALQFLEKGSLVALFNLPRTCFFPGYDSVVSAIVRHLLEDPQTLQTAMELEIRQTLSGNRQSGRVSPRSFLTSLAPVISRDPMVFMKAAAAVCQIETSGGRTVVVLSKEKEKSKSSSVEVGLSSNECVRIPESKPHDGPGKCLKSHKKVPVNLTQVIDQLLEIVLKYPLVKGQEDSECDSTSMDIDEPTMKVKGKSKVEEAGILEPESERSTGLVKVTFVLKLLSDILLMYGHAVGVILRRDSEMCQFRGSNQPSGHSGIIHHVLHRLLPLSVDKSAGPDDWRGKLSEKASWFLVVLCGRSGEGRKRVTNELVKELMSFSNLESNSMKNSLLPDKRLFTFVDLVYSILSKNSSSGSLPGTGYSPDIAKSMIDGGIIQWLTSILQVVDLDHPDAPKIVNLILKGLEGLTRAANASEQIFKSDGTEKKRSAGLNDRSDDQITAPSAAEAVAHDQNVGSQEAIRDTMDNALDQGTSQGDDRADNPNQSMEQDMRVEERGVMAQNPSMELGMDFMREEMGEGGVLHNPDQIEMTFHVENRAHDDMGDEDDDMGDEGDEDEDDDEGEDEDEDIAEDGGGMMSLADTDVEDHDDVGFGDEYNDEMIDEDDDDFHENRVIEVRWREALDGLDHLQILGQPGFIDVAAEPFEGVNVDDLFRLQSFERRRQTGRSSFERSATEVNGFQHPLLVRPPPSGDFVSMWSSSGNSASRDSETLPSGNLDVAHFYMFDAPILPYDHVPSSLFGDRLGGAAPPPLTDYSVGMGSLHLPGRRVLGNGRWTDDGQPQGSAQAAAIAQAVEEQFLAQLCSVAPESSPVERQLQNSGEQENKSDALASHDDPILTAGTDSTSQQIDSQEQENGNGIRAQQINDGALCEEEINVDSGAQDTAEDLQANEPMLVQPVSLTIMPNGLDCTVIEENATHDENVEIAQAFVNSSINSDAAIQCESGADVPTSIHNVPVESMECNGSSNADGQPPNVELGDSGFETLNPGDSHASSIYASADVDMGGTDAEGNQSEQPTVSEDRRDEMLSTQNTEVAPDATQADQVSANNEASGANTIDPTFLEALPEDLRAEVLASQQAQSVQPPAYAPPSAEDIDPEFLAALPPDIQAEVLAQQRAQRVAQQAEGQPVDMDNASIIATFPADLREEVLLTSSEAVLSALPSPLLAEAQILRDRAMSHYQARSLFGSSHRLNNRRNGLGFDQRPVMDRGVGVTIGRRSVLTDSLKVKEIEGEPLLDGNALKALIRLLRLSQPLGKGLLQRLLLNLCAHSVTRATLIYLLLDMIKSEAEGSVGRPATLNSQRLFGCHSNTVYGRSQLLDGLPPLVFRRILEILTYLATNHSAVAKMLFHFDQSVIPDSSSPVKVHMNEKGKEKVIEGGPSPNSSGAQTGDVPLVLFLKLLNRPLFLRSNAHLEQVMGLIQVVVDTAASKLESQSQSEKGMADTQNLSTSEAPSNTEKDAALVESDSNQQDKHADVNPCPSEGKKNVDMYNIFLQLPQSDLRNLCSLLGREGLSDKMYMLAGEVVKKLAFIVPSHRKFFTLELSESAHALTGSAISELVTLQKTNMLGLSAGSMAGAAILRVLQALSSLTSLNTLGDMDMENDVDQHDDQATIWNLNTALEPLWQELSNCISAAEMQLGQSSFSSNMSNINVAENLQGSSTSPPLPPGTQRLLPFIEAFFVLCEKLQANESFMQQDHCNATAREVKESAGCSASTSVKIGGDPQRKYDGAITFTRFTEKHRRLSNAFIRQNPGLLEKSLSMMLKAPRLIDFDNKRAYFRSRIRQQHDQHLSGPLRISVRRAYILEDSYNQLRMRPTQDLKGRLNVQFQGEEGIDAGGLTREWYQLLSRVIFDKGALLFTTVGNNATFQPNPNSVYQTEHLSYFKFVGRVVGKALFDGQLLDVYFTRSFYKHILGVKVTYHDIEAVDPDYYKNLKWMLELGVQSHQWGERDESVGSERDRVTWRQHNDVSDIPDLTFSMDADEEKHILYEKNEVTDYELKPGGRNIRVTEETKHEYVDLVAEHLLTNAIRPQINSFLEGFNELVPRELISIFNDKELELLISGLPEIDLDDLKANTEYTGYTVASNVVQWFWEVVKAFNKEDMARLLQFVTGTSKVPLEGFKALQGISGPQRFQVHKAYGAPDRLPSAHTCFNQLDLPEYTSKEQLQERLLLAIHEASEGGSTICVSNLSFGEGVRAAILLWALLVSITMSQ

SEQ ID NO: 224179 - protein, 129 aa, Glycine max
  Coding DNA Sequence Number=SeqID_107401
  Gene Ontology: Mol. function=methyltransferase activity
  Homolog annotation: Hit_ID=Q6YUR7; Match level="QueryCoverage=99%, HitCoverage=25%, E-value=4e-12, Identity=35%"; Hit description=SAM -dependent methyltransferase-like protein
GLQRQYAAINVLEAVNSYFSSHGLSCTLNTSSFTVDVAAAKDDCDLILRNGLPIINKSIDCQPTREASSGSSLNLSSERLCFCISVFQQIPGTLLVKGSLQDRNSTLSGAFSMIFQKLEEALRDKFCTK

SEQ ID NO: 224180 - protein, 193 aa, Glycine max
  Coding DNA Sequence Number=SeqID_107402
  Homolog annotation: Hit_ID=Q2PES0; Match level="QueryCoverage=25%, HitCoverage=13%, E-value=4e-08, Identity=52%"; Hit description =Putative receptor-like GPI-anchored protein 2
  Subcellular localization annotation: CTP_CleavageSite=35; ConfidenceScore=5.20e-01
MGAGKGAVWFSNAVALVAIAVVACHAQPSATFKCSSANKPTCRPLISYSNPNTTTLGDIQKLFNVKHIMDIVGANNATKKIYGAATTRDIVTTTFADYNVSHPNSNQPTGLLGPLWSVQATSFPPQIPAIAQPAPIPLMICLVVSDCVQTVPPSGSGGSTGSDSGASRSTFQGLLLSNLLIVIHFVLFLVYVL

SEQ ID NO: 224181 - protein, 507 aa, Glycine max
  Coding DNA Sequence Number=SeqID_107403
  Gene Ontology: Mol. function=DNA-directed DNA polymerase activity; Cellular component=nucleoplasm; Biological process=DNA repair
  Homolog annotation: Hit_ID=O48586; Match level="QueryCoverage=89%, HitCoverage=66%, E-value=0.0, Identity=69%"; Hit description=Similar to DNA-damage-inducible protein P
  Pfam annotation: Domain name=IMS; Domain location=66-471; Score =336.1; E_value=5.9e-98; Accession=PF00817.11; Description =impBmucBsamB family
MTLNVVEKSSGRGGEELWSRWLVEEDAVMIPPKGKKGKNRFGGKRREEEMPVARRETCDGRVIAHVDMDCFYVQVEQRKQPNLRGLPSAVIQYNSYKGGALIAVSYEARRCGVKRLLSTLPHYHAVHFIDSMRGDEAKEACPQIQLVQVPVARGKADLNSYRNAGSEVVSVLSQKGRCERASIDEVYLDLTHAAETMLMETPLDSMQDFEDEVLKSHVLGLEIKDGSDAKDEVRKWLCRSDASYQDKLLACGALIVCDLRMKVLKETEFTCSAGIAHNKMLAKLASAMNKPAQQTVVPQSSVEGLLASLPIKKMKHLGGKLGSSLQSDLGVNTVGDLLQFSEEKLQQWYGINTGTWLWNIARGISGEEVEGRLLPKSHGSGKTFPGPQALKTVDSVQHWLNQLCEELNERLHSDLDQNKRIAQTLTLHARAYKTGDSDSHRKFPSKSCPLRYGTRKIQEDALILFQAGLRDFLGFYNCKAHGNENNNWGVTSLSVSASKLVSIPSVS

SEQ ID NO: 224182 - protein, 83 aa, Glycine max
  Coding DNA Sequence Number=SeqID_107404
MEEMGKCSVVYDILARLAFNDKGKWGVLESGEKGKTVLEVKKCDATQSEMDRTKDCCFVKAEVGRTQLQKSETDAIDESATPC

SEQ ID NO: 224183 - protein, 109 aa, Glycine max
  Coding DNA Sequence Number=SeqID_107405
  Subcellular localization annotation: CTP_CleavageSite=61; ConfidenceScore=5.29e-01
MRACPLRHPLFRSLTSPSTSFQRRTGSHGQQRTLSSSTIHLLHDTVEIGDRTTYQFRTLFRKEMYMSILKKNVKRQLQNWMLRRHRELLYQKDYQHFIWKIMDSNNINV

SEQ ID NO: 224184 - protein, 800 aa, Glycine max
  Coding DNA Sequence Number=SeqID_107406
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=97%, HitCoverage=95%, E-value=1e-106, Identity=40%"; Hit description =Homeodomain protein HOX3
  Pfam annotation: Domain name=Homeobox; Domain location=20-66; Score= -3.4; E_value=0.011; Accession=PF00046.19; Description=Homeobox domain
  Pfam annotation: Domain name=START; Domain location=314-537; Score =147.8; E_value=2.8e-41; Accession=PF01852.10; Description=START domain
  Pfam module annotation: Pfam domain module=Homeobox::START; Domain location=20-66::314-537
MSASKSGGGSGRGQQGDYHWRNRHGRDKVARLEEIFKECTHPNEVRRRQIGEELGLDPEQTINERLDTDALRLENERIQSENNKMRETLENLSCGSCGGRAMEPVKHQLSLQVLRGENILLTKECERITSLMANNGININPALLPVLPSSSSHDALGGSLLNQPVGIPAHNQFISNHDNHYIPAAIPTPFQDNPIVSPPSHNQDINPAPTIDQHIPTLDDPTLIGDNSPLISSFDYNIPALVTALDRNLPAMIHPHDQNNSIPSAEKEIHQVSNNSNNNLSALELDAVQILNNDMLPQPMKSLSKDMDSVQMLKIAEDAMEELMKLLSLNEPFWFRSLLDGKFNLRHDCYKRIFGRSNCLSGPHVRMESSKDSRVVKMSGAQLVEMFLNSDKWVDLFPTIVKKAQTIQVLESGSSGNRNGALQLVNAEMHILSHLVPSREFLFLRYCKQIEVGIWAIGDVSIDSSTYKTTVSHARRLPSGCLIQEKSSEGLCMVSWMEHVEVNEKMQTHNLFRDTICGNNAYGADRWVMTLERMCERFASYSAKTIPSCETGGVVRSPDVKRNIMHLTHRMVKMFCGNLDMQDNPNFPNLTRMNNNGVKLSIRVNHTGPNEPKGTIIGAAICFRVPLSPQIVFDNLIDNNKRAKWDTLCDGSAGHEIQRISTGSNPGNCISIMRPFIPKENNMVILQESYVDALGSMLVFAPFYMEGLDLIMKGEDSSLFPILPSGLTISWDYQSNKVPEGQSGQVGQSRGSLVTLMFQLLASSTSKIDNVDMKLIGSINTLVTSTVEKIKDALNCSNSK

SEQ ID NO: 224185 - protein, 136 aa, Glycine max
  Coding DNA Sequence Number=SeqID_107407
  Gene Ontology: Mol. function=chitin binding; Cellular component =extracellular region; Biological process=chitin metabolic process
  Homolog annotation: Hit_ID=UPI0000612705; Match level="QueryCoverage =93%, HitCoverage=92%, E-value=1e-09, Identity=29%"; Hit description =UPI0000612705 related cluster
GGLFGTSTLTFRGLHALPFRRLCILAFRGLHVLPIRGLHALTFKDYMSSPLVSCTPPPSEGYTSSSSEDYTSSPSKDYMFSPLDSCTPSPSEEYTSSPSEDYTPSEDYKSSHSEGYMPSPSENYTSSPSEGYMPSP

SEQ ID NO: 224186 - protein, 44 aa, Glycine max
  Coding DNA Sequence Number=SeqID_107408
PKSKAPARWIVIKYFNDPRPLEPERLKALQIQWAHYYLRVRDQT

SEQ ID NO: 224187 - protein, 216 aa, Glycine max
  Coding DNA Sequence Number=SeqID_107409
  Homolog annotation: Hit_ID=Q5W7C9; Match level="QueryCoverage=69%, HitCoverage=67%, E-value=8e-49, Identity=70%"; Hit description =Unknow protein
APLSFKRIRGMSSPGGILNALATALHGSIRTAPSIHRLRLGLLGYLIPFAPLAFVSQCQCRPSRVLSPLVFFPISTHFTAPPEIPSAPTVLQLDALRPIIPDNACILCLTAAAGTELADAYSPDTVIASSPGKEVHDPLSPIAENSPLLPPVGVWAVSQSQSADHPLGPATVDGIDKLLPHQLANQTRAPPRADSSFCSSAYGVLAAVSSRCSPPK

SEQ ID NO: 224188 - protein, 94 aa, Glycine max
  Coding DNA Sequence Number=SeqID_107410
MGAKYLEVVKRKLHATKQWSPDKIRLTKVAGDHKISLHATDSLSLDDKGAEFVYARLPPNLLLLNDKGKNAGPSGSRMSSGPLPLDDKRCRRLR

SEQ ID NO: 224189 - protein, 102 aa, Glycine max
  Coding DNA Sequence Number=SeqID_107411
MDKNALFRFLLVLLTLSCVVFVAAVPAIRSSMIGKIDPLVQDLLAKVLSLSLSLQEDPVMRLRNSEEEMKEGIVESRMLMDIVDYPGTRPNPAHDPKSPGKP

SEQ ID NO: 224190 - protein, 160 aa, Glycine max
  Coding DNA Sequence Number=SeqID_107412
MASRKRKASTSRPQPHYDTHRFTSVDAWNRYADNILGQNILLKRKVKLFVTEFDEFRTELVRRNWHRTLINLMEGSIDVALVKEFYANLYDPEDKSPKQVRVRGHLIKFDADSLNTFLETSVVLEPGETLPAYSRFYKLRPDPQELAARLCIPSGIYSEC

SEQ ID NO: 224191 - protein, 53 aa, Glycine max
  Coding DNA Sequence Number=SeqID_107413
MWKIPKGEDTSGDSPLWFLRHWGWDWECESLSGFYGESNRTEEWVREATTDNG

SEQ ID NO: 224192 - protein, 405 aa, Glycine max
  Coding DNA Sequence Number=SeqID_107414
  Gene Ontology: Biological process=cell wall catabolic process
  Homolog annotation: Hit_ID=Q2SCD0; Match level="QueryCoverage=81%, HitCoverage=61%, E-value=2e-52, Identity=37%"; Hit description =Protein containing LysM domain
MQGGHGERRRGLVAEFEIGAGVEAFHALRIHGAQQDAQLAGGQVTDRQPGVGSGGGKQQDFRRRCLHHFHTVARGAVDGVPGEQGRQGRQAHIVAAQLRRGKKGGDSVRCGIGADAAAGLSRLDHAFAVGVADLHLALQYLGGSDVAGVTGADPEYGTAHAAGRRRCIDDVARGRATGRCHPVARAALLQAQAGIDHAGVAVAAELVQAQPGILAQLQARGVGEFKRDAGVAFGLHGVTNAKLFPGEYRARGAAIGAGQFDLAAHRQHAGRCRFDAQPADREAQQLARRQLVGVVDAVVLLQLLPAHRGLEVQASQIPQGIAGTDPVVPVLGGGDGRQEEKSAEQRALEAHGERQRADEGHSLQSRQCGGAAARPHGPDLIPPNGSWRPYGRHPAHYCPRSVQGF

SEQ ID NO: 224193 - protein, 154 aa, Glycine max
  Coding DNA Sequence Number=SeqID_107415
MTSGGTRPPALTRMPSPNFCANRGRILPGPLQGDECGSCAPISVHVAQLIADAIYQFAGMTPTRHPVDPGKSNRALGFPTLITGLCQFYGVPVTPSKVIRSPVTRAFIEKYCMPRLAQGEVPQQLEDDLQQAAGAPPPPPESTSDHLWRLERYI

SEQ ID NO: 224194 - protein, 49 aa, Glycine max
  Coding DNA Sequence Number=SeqID_107416
MEFPQLMCAPRFNNHVGRIVIDNLPRQPVPADYLFLDEPNHLAPCHTSV

SEQ ID NO: 224195 - protein, 71 aa, Glycine max
  Coding DNA Sequence Number=SeqID_107417
MQNSSSATRVAPKNHQTTNSNHDTEVDEAATPPTRARYLSLPLTHLNFNCSSLLDLFYLCTRLQLNPLFRV

SEQ ID NO: 224196 - protein, 163 aa, Glycine max
  Coding DNA Sequence Number=SeqID_107418
MAVREEEAEAPEESEEPLPKPWSRKPRGPERKNTSETSFEELYGATTASLSSEETKGISRELKLSETEGKMLAIIDKYKEKLNLATAHEHRLVDEYTKVFAEKEAGGRVIDSLHGKAMIWMDRFASTLNRNQELPQLLARAKAMTGIYSASRRFTSSSTTVSK

SEQ ID NO: 224197 - protein, 64 aa, Glycine max
  Coding DNA Sequence Number=SeqID_107419
MASMMEAMLGMKRVASSTHRRCPHGPPRAHPRGRRLLPPIPAEEPAPNALPQPNITGISQPCPM

SEQ ID NO: 224198 - protein, 67 aa, Glycine max
  Coding DNA Sequence Number=SeqID_107420
MHDTNAFYGHERPKDYLFLLTTFAAHCPIDIIPFEVNVVAVRTTSDNISSKRKTLDEVSLSSSKSET

SEQ ID NO: 224199 - protein, 65 aa, Glycine max
  Coding DNA Sequence Number=SeqID_107421
MMLVSVVVVAVVIVTIVMVVIDNSGDNNDYDNGCNKGYSGNNEDDHDSGSWCADDGGGIGHYSSD

SEQ ID NO: 224200 - protein, 72 aa, Glycine max
  Coding DNA Sequence Number=SeqID_107422
MQNASVTGEMSVVQHVASGLATAAGGIAMQWWGRVQRAQVQRDQGSRLGRFATQASKIGVHFAKAIGDIHVL

SEQ ID NO: 224201 - protein, 96 aa, Glycine max
  Coding DNA Sequence Number=SeqID_107423
  Gene Ontology: Mol. function=transferase activity, transferring glycosyl groups
  Homolog annotation: Hit_ID=Q9LXU2; Match level="QueryCoverage=91%, HitCoverage=15%, E-value=3e-10, Identity=39%"; Hit description =Anthranilate phosphoribosyltransferase-like protein
MSIMSKRKMHKPAEALDFALKETSPNIGADVTGGVDPYVQEKLGTTRALPSTLRKVQSSLESGFCLLQRKDSSFCSGGGDQRQGCCCGRLCRESDV

SEQ ID NO: 224202 - protein, 93 aa, Glycine max
  Coding DNA Sequence Number=SeqID_107424
MPCKTPASLEKRPWCNTWRKRHCHWRNSQWSRHCSWRVKGTALGACRAAACRDRLLQRCRVVAIMTGEKHGAVGVAITTSEKLFKNARTSISL

SEQ ID NO: 224203 - protein, 103 aa, Glycine max
  Coding DNA Sequence Number=SeqID_107425
MGLIEANPKIGEKEWTVSFTLNKDVPTSSSSDNSTTVEPLQRETITVQDPPWTRYDYEHTPSEAFKAFPTNVVVHILLPQWTRPVQPQVIQMKSHWLAPSTQC

SEQ ID NO: 224204 - protein, 117 aa, Glycine max
  Coding DNA Sequence Number=SeqID_107426
MEENIWAIIDQYKEKLNLAAGHEQRLEDKYVKVSALQAKREARERVIDSLHGEAMMRMDRFTFTLNGSQELPRLLAKAKVMADVYLVPEEDHGLFDYCQHMIELMSHMIRKAFVFRL

SEQ ID NO: 224205 - protein, 110 aa, Glycine max
  Coding DNA Sequence Number=SeqID_107427
MEIEECREEEDKYKIYTGLETTRAYIQSPSNLRFLRFLSTLNRVVGIPKKHLEEWASFNDVLALLVFEVVLFPNVDGLADIVAIDTFLAYHHSKESLVVSILADAYDTFD

SEQ ID NO: 224206 - protein, 124 aa, Glycine max
  Coding DNA Sequence Number=SeqID_107428
MACKDRGGLSLSLSRDYQCPLSHPETNESDEPNIVVCFPRQKTKRLSVKAAEVSPAIPRQASGSYLARLGKLGGNHLPYFCYKMAFGAEGRGFSTLGIQNSLKINEKKKKKGENPSRGASVSPP

SEQ ID NO: 224207 - protein, 50 aa, Glycine max
  Coding DNA Sequence Number=SeqID_107429
MEVGWELCCKCKEQGALDGISLMASACKPAANHMPPRGGNRLNAVIDERV

SEQ ID NO: 224208 - protein, 386 aa, Glycine max
  Coding DNA Sequence Number=SeqID_107430
DAKLCNETTAQHAINTSELSPTMGLKRKEGEANDVGFQFGKAPEFGSGDQRFDPFLPSKTGVWIAQQALLWERLRCNIACIALQCCNALLPPRGLGGVAERLKACLIAPLYPDVPREQSVDAELRGKCNRKRGKAAQRDARGVYTQIDGSDHAPGFGVSMRGAKPSEYRQTGVVDISTPSWALLRTGCVALATSHRTPFKRQRTERIGEAMHQSRPPSWLRQRSSTETAALKERQPLSGVIGEDLSNLGCHLAKLVKTSLKGPPEGIHLDLESQHCQVLISLSPHLAFNAFKRLRAESSMGLVCIIHWCIETNKLPAPFLDKSIRNGAPPRNGASPATWLPPLPLPRNKSPHAHAHARAGQAQQGGCPSSAKTVLAERFVPQGLWP

SEQ ID NO: 224209 - protein, 173 aa, Glycine max
  Coding DNA Sequence Number=SeqID_107431
MRIDPQEFIAHLCIPGKGFVLNTEGHPWKLLRKDLTTLAQTWSVLSYSNLTPTSHTSNLNMERARLVYGLVIGMYMNIGAIISGVRKVRARPANVPSSSAPPAPPTSATPTPAAHDSQCFEAMLQSIHQGQILLLQSLQVVAPPGSILSVEQFIEKVSWPGTVDAILSPKGIG

SEQ ID NO: 224210 - protein, 227 aa, Glycine max
  Coding DNA Sequence Number=SeqID_107432
  Gene Ontology: Mol. function=hydrolase activity; Cellular component =intracellular; Biological process=response to DNA damage stimulus
  Homolog annotation: Hit_ID=P76213; Match level="QueryCoverage=93%, HitCoverage=83%, E-value=3e-47, Identity=46%"; Hit description =Excinuclease cho
  Subcellular localization annotation: CTP_CleavageSite=32; ConfidenceScore=5.10e-01
MAHCALGSVGGFALQLNQRINAGQQRSAENFVAVMVEAVTRTLQLTRFLLTADRSQPEPVIDDVNLRHLRPALHHTHRALPRPAYHAQLLQPCQQALLMRRQRRAPVAGALIPAGRDTGAAHRQGFLASLTRQSGCGIIRTGQAKRRNRDRARTPPAALIEQRLLRFDHLRFEQLCAHVPGGRDPADASRLAQHAGFICRAKVRHHPAAQVDTLTDVQRQVVVITVE

SEQ ID NO: 224211 - protein, 230 aa, Glycine max
  Coding DNA Sequence Number=SeqID_107433
  Gene Ontology: Mol. function=hydrolase activity; Cellular component =cytoplasm; Biological process=metabolic process
  Homolog annotation: Hit_ID=Q5PHA2; Match level="QueryCoverage=95%, HitCoverage=99%, E-value=1e-75, Identity=65%"; Hit description =Putative hydrolase
  Pfam annotation: Domain name=Hydrolase; Domain location=15-202; Score= 117.3; E_value=4.5e-32; Accession=PF00702.16; Description=haloacid dehalogenase-like hydrolase
ANCQWSCCMTYRRPVLAAIFDMDGLLIDSEPLWDRAELEVFASLNVDISRRHELPDTLGLRIDQTVRMWYEALPWNGPDQAEVTQRIIARALALVEETRPLLPGVEQALQLCQQQGLAIALASASPLAMLERVLEMFNLRHYFSALASAEALPYSKPHPQVYLDAAAKLGVDPLNCVALEDSFNGMIASKAARMRSIVVPAAEHRHDARWALANVQLENLTQLQAEHLFN

SEQ ID NO: 224212 - protein, 170 aa, Glycine max
  Coding DNA Sequence Number=SeqID_107434
  Gene Ontology: Mol. function=hydrolase activity; Cellular component =integral to membrane
  Homolog annotation: Hit_ID=P64481; Match level="QueryCoverage=96%, HitCoverage=82%, E-value=2e-64, Identity=67%"; Hit description=Inner membrane protein ydjM precursor
  Pfam annotation: Domain name=DUF457; Domain location=15-108; Score =126.9; E_value=5.6e-35; Accession=PF04307.5; Description=Predicted membrane-bound metal-dependent hydrolase (DUF457)
MASADWWHLVPAALLTCLLPDIDHPKSVLGQRLKWLSQPIARAFGHRGFTHSLLAVAVSLWLFQINVPADWFLPADVLQGMTLGYLSHIVADMLTPAGVPLLWPCRWRFRLPILNSQQGNQLERALCLALVGYALWFPPGMPSFGANGWPEQLFNNLQNGIGRLVNGSTR

SEQ ID NO: 224213 - protein, 96 aa, Glycine max
  Coding DNA Sequence Number=SeqID_107435
  Subcellular localization annotation: CTP_CleavageSite=33; ConfidenceScore=5.27e-01
MVVTVAKFVPTTMMTTIMVLNCSPQPQCQGSPQCDRNRNRSGGNSGNGDGYSDSAVNDNNSGDGNNGSDNNDHGGRSDGYNVGGVTARAALMEVAH

SEQ ID NO: 224214 - protein, 217 aa, Glycine max
  Coding DNA Sequence Number=SeqID_107436
  Gene Ontology: Mol. function=transferase activity; Cellular component= membrane
  Homolog annotation: Hit_ID=UPI0000DA49EA; Match level="QueryCoverage =42%, HitCoverage=1%, E-value=0.0, Identity=32%"; Hit description =PREDICTED: similar to mucin 19
  Pfam annotation: Domain name=Exostosin; Domain location=1-217; Score=- 17.4; E_value=3.2e-08; Accession=PF03016.6; Description=Exostosin family
MYDLSPGFHFGLLDWKGNVNQTWLNVNNPKHIPPYPGGLNLQHSVEYWLTLDLLSSNIAKKFWSCTAIRVQNSSHTDVVFVPFFSSLRHSKIHGKEKVSVNKMLQQRLVQFLMGREEWKRYGGMDHVIVEHHPNSILHARRKLGSAMLVLADFGRYPSQLANINKDIIAPYRHLVSTVPRAGSASYEERSTLLYFQGTISGKDASFSYSNIISSMHA

SEQ ID NO: 224215 - protein, 129 aa, Glycine max
  Coding DNA Sequence Number=SeqID_107437
  Gene Ontology: Mol. function=transferase activity; Cellular component= membrane; Biological process=metabolic process
  Homolog annotation: Hit_ID=Q6Z527; Match level="QueryCoverage=89%, HitCoverage=20%, E-value=3e-45, Identity=73%"; Hit description =Exostosin family-like protein
  Pfam annotation: Domain name=Exostosin; Domain location=1-84; Score= -101.1; E_value=0.013; Accession=PF03016.6; Description=Exostosin family
MALSKFCLNVAGDTPSSNRLFDAIVSHCVPVIISDEIELRFEDVLDYSEFGLFVHASDSVRKGYLLNLLRSIKPEKWTKMWARLKDITQHFEYQYPSQPGDAVNMIWEEVAQEKQIPETLASCYDPLKY

SEQ ID NO: 224216 - protein, 305 aa, Glycine max
  Coding DNA Sequence Number=SeqID_107438
  Gene Ontology: Biological process=regulation of transcription
  Homolog annotation: Hit_ID=Q6Z2T5; Match level="QueryCoverage=75%, HitCoverage=92%, E-value=6e-28, Identity=35%"; Hit description=RWP -RK domain-containing protein-like
  Pfam annotation: Domain name=RWP-RK; Domain location=141-192; Score =61.0; E_value=3.8e-15; Accession=PF02042.6; Description=RWP-RK domain
MESQPLMGWSSFYEIDEEPFPFTCQFSYSGNSEVYPSLDWPYDFPIQDYYIDAVPLMDYYPSDPLYETLTTEPTQSVQDYDFYDIKKGLPFWKEVDAVFDSQKVFLFGNNEESGTKKEMMEDGKVNDNRGIEERISGSSSSCRMLSRKTISQYFYMPITQAARELNVGITLLKKRCREVGIRRWPHRKLMSLQTLINNVQELGKEEGRESEEKLRSAIEILEREKKVLEEMPDTELEDTTKRLRQACFKANYKKRKLTVTGRGREPHSSSFSGFVARSIVNATGEYSNESEEERDIKYLLSQFLE

SEQ ID NO: 224217 - protein, 565 aa, Glycine max
  Coding DNA Sequence Number=SeqID_107439
  Gene Ontology: Mol. function=metal ion binding; Cellular component =intracellular; Biological process=thiamin biosynthetic process
  Homolog annotation: Hit_ID=Q6YWL6; Match level="QueryCoverage=96%, HitCoverage=90%, E-value=1e-159, Identity=54%"; Hit description =Pentatricopeptide (PPR) repeat-containing protein-like
  Pfam annotation: Domain name=PPR; Domain location=171-205; Score =30.6; E_value=5.5e-06; Accession=PF01535.11; Description=PPR repeat
  Pfam annotation: Domain name=PPR; Domain location=274-308; Score =46.6; E_value=8.5e-11; Accession=PF01535.11; Description=PPR repeat
  Pfam annotation: Domain name=PPR; Domain location=309-343; Score =12.4; E_value=0.25; Accession=PF01535.11; Description=PPR repeat
  Pfam annotation: Domain name=PPR; Domain location=345-379; Score=9.8; E_value=0.51; Accession=PF01535.11; Description=PPR repeat
  Pfam annotation: Domain name=PPR; Domain location=411-445; Score =10.3; E_value=0.45; Accession=PF01535.11; Description=PPR repeat
  Pfam annotation: Domain name=PPR; Domain location=70-104; Score=32.1; E_value=1.9e-06; Accession=PF01535.11; Description=PPR repeat
  Pfam module annotation: Pfam domain module=PPR::PPR::PPR::PPR::PPR::PP R; Domain location=171-205::274-308::309-343::345-379::411-445::70-104
MALETVISAIKSVSHKTRLLQIHAHIIRTTLIQYPTVSLQFLSRIALSGPLQDASYSQRFFGQLSHPLVSHYNTMIRACSMSDSPQKGLLLYRDMRRRGIAADPLSSSFAVKSCIRFLYLPGGVQVHCNIFKDGHQWDTLLLTAVMDLYSLCQRGGDACKVFDEMPHRDTVAWNVMISCCIRNNRTRDALSLFDVMQGSSYKCEPDDVTCLLLLQACAHLNALEFGERIHGYIMERGYRDALNLCNSLISMYSRCGCLDKAYEVFKGMGNKNVVSWSAMISGLAMNGYGREAIEAFEEMLRIGVLPDDQTFTGVLSACSYSGMVDEGMSFFHRMSREFGVTPNVHHYGCMVDLLGRAGLLDKAYQLIMSMVVKPDSTMWRTLLGACRIHGHVTLGERVIGHLIELKAQEAGDYVLLLNIYSSAGHWEKVAEVRKLMKNKSIQTTPGCSTIELKGAVHEFVVDDVSHSRNREIYETLDEINHQLRIAGYVVELSSELHKMDDKEKGYVLSHHSEKLAVAFGVLATPPGTILRVASNLRFLGTIIGFTTSGEGAAHVATIGRDIMSC

SEQ ID NO: 224218 - protein, 368 aa, Glycine max
  Coding DNA Sequence Number=SeqID_107440
  Gene Ontology: Mol. function=hydrolase activity, acting on ester bonds; Cellular component=cellulose and pectin-containing cell wall; Biological process=lipid metabolic process
  Homolog annotation: Hit_ID=Q9CA68; Match level="QueryCoverage=91%, HitCoverage=91%, E-value=1e-148, Identity=74%"; Hit description =Putative lipase/acylhydrolase; 46085-44470
  Pfam annotation: Domain name=Lipase_GDSL; Domain location=29-340; Score=161.5; E_value=2.2e-45; Accession=PF00657.12; Description=GDSL- like LipaseAcylhydrolase
MDFNLALVIVVTTILGIGLQGCDSKVVQFIFGDSLSDVGNNMHLSRSLAQASLPWYGIDMGNGLPNGRFTNGRTVSDIIGDNMDLPRPPAFLDPSVNEDIILENGVNYASGGGGILNETGAYFIQRFSLDKQIELFQGTQELIRAKIGKRAAYKFFKEASYVVALGSNDFINNYLMPVYTDSWTYNDETFMDYLIGTLERQLKLLHSLGARQLVVFGLGPMGCIPLQRVLTTTGNCREKANKLALSFNKAASKLIDDLAENFPDSSYKFGDAYDVVYDVISNPNNYGFQNADSPCCSFWNIRPALTCVPASSLCKDRSKYVFWDEYHPTDSANELIANELIKKFGLSNTNQGGAPSPAPAVAPSPEDR

SEQ ID NO: 224219 - protein, 473 aa, Glycine max
  Coding DNA Sequence Number=SeqID_107441
  Gene Ontology: Mol. function=zinc ion binding; Cellular component =nucleus; Biological process=regulation of transcription
  Homolog annotation: Hit_ID=Q0GLD2; Match level="QueryCoverage=61%, HitCoverage=97%, E-value=1e-138, Identity=81%"; Hit description=Dof20
  Pfam annotation: Domain name=zf-Dof; Domain location=120-182; Score =141.1; E_value=3.1e-39; Accession=PF02701.6; Description=Dof domain, zinc finger
MHEIRDPAIRLFGQKIPFPEDVVVDKEEKEIESGEEREQEMEKYEDQGHKDAGVENVTEEELEVDPPPNAEETKNSGSSPEAIVNPKTPSIEEETEKSKGDKTEKEQGDAANSQEKTLKKPDKVLPCPRCKSMDTKFCYYNNYNVNQPRYFCKACQRYWTAGGTMRNVPVGAGRRKNKNSTSHYRHITISEALQAARIDSHLPPLKGNGRVLSFGLDAHAPICDSMASVNNLGEKKPLNCTRNGFHHGFEDQRLPPVPCKSGENGDDSSTTSSITVSSSKGENNKNTFQQQSVPQNHGFLPQLPCIPGVSWPYTWNSPVPPPAMCPSGFPLPFYPATFWNCGMPGNWNVPLFSSHSSASNLESRSSSPNSPTLGKHSRDGDMIKQYSLPKEEASKPRNGGVLVPKTLRIDDPSEAAKSSIWATLGIKNESVSGGGMFKAFQSKKNEKNHVEASPLLMANPAALSRSLNFHENS

SEQ ID NO: 224220 - protein, 111 aa, Glycine max
  Coding DNA Sequence Number=SeqID_107442
  Subcellular localization annotation: CTP_CleavageSite=57; ConfidenceScore=5.53e-01
MVASPPSKAAAPAPMATPPITTPLAATPSKGHGVPPPQFCPRFCHQENPNRPPSLPRRTTPQENPPPPHPSNPHPYNHNIGKKRGISGFRNSYAERAEFCGGEVFVLARVC

SEQ ID NO: 224221 - protein, 336 aa, Glycine max
  Coding DNA Sequence Number=SeqID_107443
  Gene Ontology: Mol. function=sequence-specific DNA binding; Cellular component=nucleus; Biological process=regulation of transcription, DNA-dependent
  Homolog annotation: Hit_ID=Q2R053; Match level="QueryCoverage=97%, HitCoverage=92%, E-value=4e-67, Identity=43%"; Hit description=SRF -type transcription factor family protein
  Pfam annotation: Domain name=SRF-TF; Domain location=9-55; Score =73.9; E_value=4.9e-19; Accession=PF00319.9; Description=SRF-type transcription factor (DNA-binding and dimerisation domain)
MGRVKLKIKKLESISNRHVTYSKRKSGIIKKAKELSILCDIDVVLLMFSPTGKPTLLQGERSNIEEIIAKFAQLSPQERAKRKMESLEALKKTFRKLDHDVKIQDFLGSSSQTMEELSYQVKVLQAQITEVQQRLSYWNNLEKINNLEHLRQMEDSLRESINRVGLQKEGMALPSMIASLQDSQPLSWLLNDDNHHLMLPNEPKFQSFSDNTNRDVECSTDISLPNYSGYIGSNKFEVGSSPQVTTLGQGGGAMNELNGTTFLNVQCCDQFAYPPPPDIEEVKQFPTMDNKSNTVDYQVHNNFDLPRSLFENGHQFWNSASGSCGIAMFNENNYHK

SEQ ID NO: 224222 - protein, 65 aa, Glycine max
  Coding DNA Sequence Number=SeqID_107444
  Gene Ontology: Mol. function=endonuclease activity
  Homolog annotation: Hit_ID=Q8S7W2; Match level="QueryCoverage=86%, HitCoverage=30%, E-value=2e-20, Identity=82%"; Hit description =Putative endonuclease
MAYRQQLIVQRVIEQISPKLNLFRRVLIAGFQIVIWIFWNCRPMAMSGMDQILGGVESNEHLSPY

SEQ ID NO: 224223 - protein, 40 aa, Glycine max
  Coding DNA Sequence Number=SeqID_107445
MKQSQGCYANLQSGARKVNYELMWKAFQRSISIEWNESSA

SEQ ID NO: 224224 - protein, 559 aa, Glycine max
  Coding DNA Sequence Number=SeqID_107446
  Gene Ontology: Mol. function=oxidoreductase activity, acting on the CH-OH group of donors, NAD or NADP as acceptor; Cellular component =chloroplast; Biological process=L-serine biosynthetic process
  Homolog annotation: Hit_ID=Q1SGN7; Match level="QueryCoverage=99%, HitCoverage=95%, E-value=0.0, Identity=66%"; Hit description=D -isomer specific 2-hydroxyacid dehydrogenase, catalytic region
  Pfam annotation: Domain name=2-Hacid_dh; Domain location=43-353; Score=128.0; E_value=2.7e-35; Accession=PF00389.20; Description=D -isomer specific 2-hydroxyacid dehydr
  Pfam annotation: Domain name=2-Hacid_dh_C; Domain location=145-321; Score=279.9; E_value=5.1e-81; Accession=PF02826.9; Description=D -isomer specific 2-hydroxyacid dehyd
  Pfam annotation: Domain name=ACT; Domain location=486-550; Score =34.1; E_value=4.9e-07; Accession=PF01842.15; Description=ACT domain
  Pfam annotation: Domain name=IlvN; Domain location=176-346; Score= -92.6; E_value=0.1; Accession=PF07991.2; Description=Acetohydroxy acid isomeroreductase, ca
  Pfam module annotation: Pfam domain module=2-Hacid_dh::2-Hacid_dh _C::ACT::IlvN; Domain location=43-353::145-321::486-550::176-346
  Subcellular localization annotation: CTP_CleavageSite=45; ConfidenceScore=5.06e-01
SAVSFFNGNSVMRLSSHRGALLTNNVLETSKSKDKSSSNNNIILVSEKLGEAGLKVLREWGDVECAYDLSPEELCSKISCCDALIVRSATKVTREVFQASKGRLKVVGRAGVGIDNVDLQAATEFGCIVVNAPTSNTVAAAELAIAHLAAMARNVARADASMKASKWERNKYVGVSMVGKTVAIMGFGKVGYEVARRAKAALGMNVVAHDPYASADRASAIGVHLVSFDEAISNADFISLHMPLIPSTHKIFNHTSFAKMKRGARIINVARGGVIDEDDLVRALDDGTVAEAALDVFTEEPPAKDSKLVKHEKVTVTPHLGGSTKEAQEGVAIEIAEAVMGALKGELSARAVNAPAVPTELVAELAPYVVLAEKLGRVAVQLVSESRDVKVVYRSADLDTRLLRAMIIKGLIEPTSNSAINLVNADFIAKEKGVRISEEIIAGVELIDSIQLQISNVISIEGKVKYGSPHLTRVGSFDVDVSLEGNLILYRQVDQPGMIGRVGTILGQHNINVSFMSLGRTCRRKMAIVAIGVDEEPSKEALQHIGSLPAIQDLVFLKL

SEQ ID NO: 224225 - protein, 140 aa, Glycine max
  Coding DNA Sequence Number=SeqID_107447
  Gene Ontology: Mol. function=cation transporter activity; Cellular component=integral to membrane; Biological process=calcium ion transport
  Homolog annotation: Hit_ID=Q5KQN0; Match level="QueryCoverage=90%, HitCoverage=29%, E-value=6e-61, Identity=92%"; Hit description =Vacuolar cation/proton exchanger 2 (Ca(2+)/H(+) exchanger 2)
  Pfam annotation: Domain name=Na_Ca_ex; Domain location=2-120; Score =87.4; E_value=4.4e-23; Accession=PF01699.14; Description =Sodiumcalcium exchanger protein
MGASESLNMSVAFISVILLPIVGNAAEHASAIMFAVKDKLDITIGVAIGSSTQISMFVIPFCVVVGWCMGKEMDLNFQLFETATLFITVLVVAFMMQEGTSNYFKGLMLILCYLIVAASFFVHVDPKSGELPRIYCIDSR

SEQ ID NO: 224226 - protein, 67 aa, Glycine max
  Coding DNA Sequence Number=SeqID_107448
MVCTKKTGQMTSKAAKEIAEKIASQGSFVPHGHQDVLTAVIGRPEHPSRVCAVGASVTIKQYFRSAP

SEQ ID NO: 224227 - protein, 145 aa, Glycine max
  Coding DNA Sequence Number=SeqID_107449
MESIMGNIVPQGNIWCSRKKKIDPKTSRCFFIRYPDHAKGNKFFYLGKENKIAKSMNAKFLELDVIDLVVPSDDIDVELCETVSFPLPIPIVSVFNIVPIETVVQIILTETRVPIVPVETTIVIGDIVSSQANDMLNPPTMNENA

SEQ ID NO: 224228 - protein, 175 aa, Glycine max
  Coding DNA Sequence Number=SeqID_107450
MTRTEEETEKKIKVEKDTRSIGTSDNLHKNRNSPNKSEMHHHNEVSLLLLSWIETSRVSMPSTWMTPWLSPSSSPTSWCPRSSSTRVAPLTSYIGKHSKGSKSRPPLSTFMSTHSLTVKADQKQAPQCYAESLKVEPYPNTKEPTKASPHNLSPDCLPDCLPNKLGRPIRYRYAR

SEQ ID NO: 224229 - protein, 535 aa, Glycine max
  Coding DNA Sequence Number=SeqID_107451
  Homolog annotation: Hit_ID=Q1T192; Match level="QueryCoverage=44%, HitCoverage=52%, E-value=2e-15, Identity=25%"; Hit description =Polynucleotidyl transferase, Ribonuclease H fold
MASMPYTLRLVDSSTLGSKDDSIGCLCMSVGLRMFNRGAIVDDNGIREAIPTYEVSPGELFHLVGNNRLYFLKMGVWNVCKLLASSTSLCDVKGVFPECWPLVAIMHHLCCQHFNKGGHPVWFLLFSGHNFFSVYVGTLECFLDDSLEVPSLFNANHLGEQVYSSLSPWSSIYWQLVPGQAALKLSLRACFRVTLSRPSRMIPSPISFHARRTVNVEAPPIRVGLVVPSKFCQEVCHVLGYDLRFDDHIIDIDFDVKGYDPVEIVDIFSDECCFLLVWSVHPNLVVSGDINNVSVLMASEVLTELRTWPRFGSKLQLDELFDRLWASVRSVIAHIYIELVVQAYLVDNRAFRIALWCLLLICLDGQGDVSGATLVDEDLGHHEVGDDDGDNHGVIQVDGIDTLEVIARAYTPSVFFYLDLFLCLFFCSRHDSYVAPIGVLRYLVASKFDLGGFIRGNLMGTSKLKYSSRIILDWSLGASFSLVILLFGLSDFVPEFGHFFHLDVALGLFVQLVHATRRVFFIDCPQTCQAIERGA

SEQ ID NO: 224230 - protein, 81 aa, Glycine max
  Coding DNA Sequence Number=SeqID_107452
  Homolog annotation: Hit_ID=Q8L783; Match level="QueryCoverage=47%, HitCoverage=8%, E-value=2e-07, Identity=64%"; Hit description =H+/Ca2+ antiporter, putative
MTPVITKIRHYITQEGDNGENSDEEEEHELTQWEAIIWLAILTAWVSILSGYLVDAIQSRKYKTKLLIQESGGDNSRVINI

SEQ ID NO: 224231 - protein, 403 aa, Glycine max
  Coding DNA Sequence Number=SeqID_107453
  Homolog annotation: Hit_ID=Q3LHL2; Match level="QueryCoverage=43%, HitCoverage=33%, E-value=9e-34, Identity=38%"; Hit description =Hypothetical protein PPS5
  Pfam annotation: Domain name=DUF292; Domain location=24-145; Score =126.6; E_value=6.8e-35; Accession=PF03398.5; Description=Eukaryotic protein of unknown function, DUF292
MGKKLDALLGRTFKVSKFKAIVNLAISRLAVLKNQRQARLRHARSDVLELLQLGHQERASLRVEHVIKDQNMLDVYGRIEGYFNLLIERVHLIEQERECPEELKEAASGLLYAASRCGDFPEIQQIRVILTSRFGKEFAARSIELRNNCGVHPQMIQKLSTKMPSLESRMKVLKDIASENGIVLQLEETSVSVEEQSSVEKQNQHEPEKKEENVSILPSRGKDEKLIDSYKGRKTYKDVADAAQAAFESAEYAAAAARAALELSRSESHDPDDHDSTRLQPRKVEEGHDVRPQMEEKEILSETQREDELKKSKDIISCNSTDEVLKGATALVDGEIEADPLEKEVIFDDSDDENDNKQNINQSSKQTSSGYGAGIVVNTVPGSKMQNAPQLDLQKRPISVRTR

SEQ ID NO: 224232 - protein, 373 aa, Glycine max
  Coding DNA Sequence Number=SeqID_107454
  Gene Ontology: Mol. function=single-stranded DNA binding; Cellular component=nucleus; Biological process=response to DNA damage stimulus
  Homolog annotation: Hit_ID=Q84L33-2; Match level="QueryCoverage=99%, HitCoverage=99%, E-value=1e-124, Identity=64%"; Hit description =Isoform 2 of Q84L33
  Pfam annotation: Domain name=UBA; Domain location=149-191; Score =44.5; E_value=3.5e-10; Accession=PF00627.21; Description=UBATS-N domain
  Pfam annotation: Domain name=UBA; Domain location=328-367; Score =37.7; E_value=4e-08; Accession=PF00627.21; Description=UBATS-N domain
  Pfam annotation: Domain name=XPC-binding; Domain location=248-306; Score=122.3; E_value=1.3e-33; Accession=PF09280.1; Description=XPC -binding domain
  Pfam annotation: Domain name=ubiquitin; Domain location=6-78; Score =66.1; E_value=1.1e-16; Accession=PF00240.13; Description=Ubiquitin family
  Pfam module annotation: Pfam domain module=UBA::UBA::XPC -binding::ubiquitin; Domain location=149-191::328-367::248-306::6-78
MKLTVKTLKGSHFEIRVQPSDTIMAVKKNIEDVQGKDNYPCGQQLLIHNGKVLKDETTLSDNKVSEDGFLVVMLSKGKTLGSAGISSTQACCLLIFASNPPTTVSTPNSTPLVQPQSANNNASATDVTTTNVTTNTYGQAASNLVAGSNLEQTIQQLMDMGGGSWDRDTVTCALRAAYNNPERAVDYLYSGIPVAAEIAVPAASYPISQTTETGGASVGAVPGVPNSSPLNMFPQETISGAGAEIGSLDFLRNNPQFQALRSMVQSNPQILQPVLQELGKQNPSLLTLIQEHHAEFLQLINEPVEGSEGDIFDQPEQDMPHAINVTPAEQEAIGRLEAMGFDRASVIEAFLACDHDEQLAANYLLENAGDFEG

SEQ ID NO: 224233 - protein, 542 aa, Glycine max
  Coding DNA Sequence Number=SeqID_107455
  Gene Ontology: Mol. function=ATP binding; Cellular component =chloroplast thylakoid membrane; Biological process=carbon utilization by fixation of carbon dioxide
  Homolog annotation: Hit_ID=Q45YI8; Match level="QueryCoverage=89%, HitCoverage=81%, E-value=1e-155, Identity=59%"; Hit description =Rubisco activase 2
  Pfam annotation: Domain name=AAA; Domain location=162-418; Score=5.6; E_value=8e-05; Accession=PF00004.19; Description=ATPase family associated with various cellular activities (AAA)
MTKLLSPSAPPCPCLRVPIPNPTVKYRYAYSHRGQLRVRCSDNSDEEKEKEKKKKKEKRLSQQSSWEAQDAEGRDYLYRLGKEADNMNIAVGQRAGVIDSLFAGNFLGKDSDIVFDYRQKVTRSFQYLQGDYYIAPLFMDKVVCHIVKNYLARVLNTKVPLILGIWGGKGQGKSFQTELIFQAMGIEPVIMSAGELESERAGEPGKLIRERYRTASQVVQNQVRSFKVFNNIPCFMEIEPYNLLFFVRIGVKLDLKKPREKLHWNLCFSVESARIDFLMGKMSCLMINDIDAGLGRFGNTQMTVNNQIVVGTLMNLSDNPTRVSVGQDWRESDVTNRIPIIVTGNDFSTLYAPLIRDGRMDKFYWQPNQEDILNIVHRMYEKDSISRDEVERVVNTFPNQALDFYGALRSRTYDRSILKECFHGTRVRLMQMQLSSIYSTLLYFVPHCPEALRYAKVWGRDVVRSLTLAYAKRLFPWIDDIGGVENFGNKLLKRRKDQSLPVFIPPEQTVDALLESGYSLIKEQRLIMETKLSKEYMKNIDD

SEQ ID NO: 224234 - protein, 180 aa, Glycine max
  Coding DNA Sequence Number=SeqID_107456
  Gene Ontology: Mol. function=zinc ion binding; Biological process =transcription
  Homolog annotation: Hit_ID=Q1SW42; Match level="QueryCoverage=70%, HitCoverage=19%, E-value=5e-27, Identity=43%"; Hit description=Heavy metal transport/detoxification protein
  Pfam annotation: Domain name=SWIM; Domain location=45-81; Score=11.2; E_value=0.036; Accession=PF04434.8; Description=SWIM zinc finger
MFEREVKGMFSCFNSRQINADGPVVTYIVQEQVEVEGNQRDARDYEVCYNEAEMEVLCICGLFNFRGCLCRHALFILSQNEIKEIPAQYILLRWRKGMKRGNVDDHNGSGIDFSNPVHRYDHLYRTGCEGCRGRNKLRIGASQISPNRAIKENDTFTQTPLSTPARMEVKINFVQMRESP

SEQ ID NO: 224235 - protein, 634 aa, Glycine max
  Coding DNA Sequence Number=SeqID_107457
MAKRSEELGLSLMNTDSANHDRIPGGCHPNDTTAPLPLVSPSPFPHWNLHETSQHYNNEPAGVNSMIDSSQFRSYQNFQMDHNYSHRAEEHNFLPCRPDSRFPCPEGYIGWPYQYDRHNNLAIPSNVRNASFNLNNFEKPDNGGMCVTPIYGSASRLQMVNPTGTAMSANIGQPSLDMNSGMALCNPNQGCVEPLLTIGKHDERYMTMGSGSNNKESKSSAVTPKFNVTGNSERAFLPPINSYHNHLGSRSSLNPGFDMNDTFSAFQNDSGFISDLAPSGNHEALFDSIPGLRLGPSYAFQWPAAGEQNRYLGQFNRDLGLAGVKDTSMEFTDVGLTNGLERCMDLNSLPIVGSQTMPFESRQSWANRQLVPSSSGVVTDNLPTEMLPKNNDKFSSQFFSSPPLAVATRSTRGQDLSSNPGQSQAGGSIQQSNSLLRPQSTSGIQSGMGYMTAQVSRPSNMSSLKRAASQPLSSTVQNQHRKTLPTQFIHPSIPNWNRLAPSVPNTSRAMSPLIRPAQSLTAQAPPHSVVPPSFPTTWTKSVLQAPNTTRAIHPKMHTATFLAPNDKRISSFHHPSSHTSPRTNQSNHQMLAQALAHQRLKAPIIPSAPRIASNYIKFKEHDVVRFHIPVKLLN

SEQ ID NO: 224236 - protein, 1131 aa, Glycine max
  Coding DNA Sequence Number=SeqID_107458
  Gene Ontology: Mol. function=protein kinase activity; Cellular component=integral to membrane; Biological process=protein amino acid phosphorylation
  Homolog annotation: Hit_ID=Q1T089; Match level="QueryCoverage=81%, HitCoverage=95%, E-value=0.0, Identity=44%"; Hit description=Protein kinase
  Pfam annotation: Domain name=DUF1469; Domain location=660-804; Score=- 40.9; E_value=0.042; Accession=PF07332.2; Description=Protein of unknown function (DUF1469)
  Pfam annotation: Domain name=LRRNT_2; Domain location=181-221; Score =37.7; E_value=4.1e-08; Accession=PF08263.3; Description=Leucine rich repeat N-terminal domain
  Pfam annotation: Domain name=LRR_1; Domain location=250-272; Score =10.1; E_value=3.7; Accession=PF00560.23; Description=Leucine Rich Repeat
  Pfam annotation: Domain name=LRR_1; Domain location=274-296; Score =12.4; E_value=1.4; Accession=PF00560.23; Description=Leucine Rich Repeat
  Pfam annotation: Domain name=LRR_1; Domain location=298-321; Score =9.3; E_value=5.3; Accession=PF00560.23; Description=Leucine Rich Repeat
  Pfam annotation: Domain name=LRR_1; Domain location=323-345; Score =9.6; E_value=4.5; Accession=PF00560.23; Description=Leucine Rich Repeat
  Pfam annotation: Domain name=LRR_1; Domain location=347-369; Score =12.0; E_value=1.6; Accession=PF00560.23; Description=Leucine Rich Repeat
  Pfam annotation: Domain name=LRR_1; Domain location=370-392; Score =8.5; E_value=7.4; Accession=PF00560.23; Description=Leucine Rich Repeat
  Pfam annotation: Domain name=LRR_1; Domain location=395-422; Score =7.3; E_value=12; Accession=PF00560.23; Description=Leucine Rich Repeat
  Pfam annotation: Domain name=LRR_1; Domain location=427-450; Score =1.2; E_value=1.7e+02; Accession=PF00560.23; Description=Leucine Rich Repeat
  Pfam annotation: Domain name=LRR_1; Domain location=452-474; Score =14.5; E_value=0.39; Accession=PF00560.23; Description=Leucine Rich Repeat
  Pfam annotation: Domain name=LRR_1; Domain location=476-499; Score =8.1; E_value=8.9; Accession=PF00560.23; Description=Leucine Rich Repeat
  Pfam annotation: Domain name=LRR_1; Domain location=501-523; Score =11.5; E_value=2; Accession=PF00560.23; Description=Leucine Rich Repeat
  Pfam annotation: Domain name=LRR_1; Domain location=525-547; Score =14.1; E_value=0.52; Accession=PF00560.23; Description=Leucine Rich Repeat
  Pfam annotation: Domain name=LRR_1; Domain location=549-571; Score =12.0; E_value=1.6; Accession=PF00560.23; Description=Leucine Rich Repeat
  Pfam annotation: Domain name=LRR_1; Domain location=573-595; Score =19.6; E_value=0.012; Accession=PF00560.23; Description=Leucine Rich Repeat
  Pfam annotation: Domain name=LRR_1; Domain location=622-644; Score =9.9; E_value=4; Accession=PF00560.23; Description=Leucine Rich Repeat
  Pfam annotation: Domain name=LRR_1; Domain location=646-668; Score =9.0; E_value=6; Accession=PF00560.23; Description=Leucine Rich Repeat
  Pfam annotation: Domain name=LRR_1; Domain location=670-692; Score =12.6; E_value=1.3; Accession=PF00560.23; Description=Leucine Rich Repeat
  Pfam annotation: Domain name=LRR_1; Domain location=694-717; Score =16.2; E_value=0.12; Accession=PF00560.23; Description=Leucine Rich Repeat
  Pfam annotation: Domain name=Pkinase; Domain location=816-1102; Score= 137.2; E_value=4.6e-38; Accession=PF00069.15; Description=Protein kinase domain
  Pfam annotation: Domain name=Pkinase_Tyr; Domain location=816-1102; Score=97.0; E_value=5.8e-26; Accession=PF07714.7; Description =Protein tyrosine kinase
  Pfam module annotation: Pfam domain module=DUF1469::LRRNT_2::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain ...
  Pfam module annotation: Pfam domain module=location=660-804::181 -221::250-272::274-296::298-321::323-345::347-369::370-392::395 -422::427-450::452-474::476-499::501-523::525-547::549-571::573 -595::622-644::646-668::...
  Pfam module annotation: =670-692::694-717::816-1102::816-1102
MKAKDFNSSNAAEGPELLLAGTTILMKGLGVGGALLVRPGPGSGVGGGAECRRGCVGGLKLTFLRVAPGESGGRKKGFDRKVLSGVVIGVVMVFGGGGDDFGLEEEKEDGFVPVPRVNILAVQIGAIEPSATMNGSTAYDFSAGHLNLALANGPYDWGCCGFRGGDEEEEGGGRKGDGGIKQPHKAALLEFRKTIISDPHSSLANWDEAVHVCNFTGVVCDKFHNRVTRLILYDKGLVGLLSPVLSNLTGLHYLEIVRSHLFGIIPPEFSNLRRLHSITLEGNNLHGSIPESFSMLSKLYFFIIKENNISGSLPPSLFSNCTLLDVVDFSSNSLTGQIPEEIGNCKSLWSISLYDNQFTGQLPLSLTNLTLQNLDVEYNYLFGELPTKFVSSWPNLLYLHLSYNNMISHDNNTNLDPFFTALRNNSNLEELELAGMGLGGRFTYTVAGQLTSLRTLLLQENQIFGSIPRSLANLSRLFILNLTSNLLNGTISSDIFFSLPKLEQLSLSHNLFKTPIPEAIGKCLDLGLLDLSYNQFSGRIPDSLGNLVGLNSLFLNNNLLSGTIPPTLGRCTNLYRLDLSHNRLTGSIPLELAGLHEIRIFINVSHNHLEGPLPIELSKLAKVQEIDLSSNYLTGSIFPQMAGCIAVSMINFSNNFLQGELPQSLGDLKNLESFDVSRNQLSGLIPATLGKIDTLTFLNLSFNNLEGKIPSGGIFNSVSTLSFLGNPQLCGTIAGISLCSQRRKWFHTRSLLIIFILVIFISTLLSIICCVIGCKRLKVIISSQRTEASKNATRPELISNFPRITYKELSDATGGFDNQRLVGSGSYGHVYRGVLTDGTPIAVKVLHLQSGNSTKSFNRECQVLKRIRHRNLIRIITACSLPDFKALVLPYMANGSLESRLYPSCGSSDLSIVQRVNICSDVAEGMAYLHHHSPVRVIHCDLKPSNILLNDDMTALVSDFGVARLIMSVGGGAIDNMGNSSANLFCGSIGYIAPEYGFGSNTSTKGDVYSFGILVLEMVTRRRPTDDMFVGGLSLHQWVKIHFHGRVEKVIDSALVTASIDQSREVRKMWEAAIVELIELGLLCTQESPSTRPTMLDAADDLNRLKRYLNGDTTGTFASSLGISSSTVGGD

SEQ ID NO: 224237 - protein, 90 aa, Glycine max
  Coding DNA Sequence Number=SeqID_107459
MDKNEIGSQNPKLKKKLGAFASDLCCGIIMSDTLLKIDFHGDWGKQRGVEKVVILFHNSYSKIGFLDHSLFGGAGSEIGGAGSNIPAQPI

SEQ ID NO: 224238 - protein, 447 aa, Glycine max
  Coding DNA Sequence Number=SeqID_107460
  Gene Ontology: Mol. function=transferase activity; Cellular component= nucleus; Biological process=flavonoid biosynthetic process
  Homolog annotation: Hit_ID=Q05HB0; Match level="QueryCoverage=93%, HitCoverage=99%, E-value=0.0, Identity=72%"; Hit description =Hydroxycinnamoyl transferase
  Pfam annotation: Domain name=Transferase; Domain location=27-446; Score=371.2; E_value=1.6e-108; Accession=PF02458.6; Description =Transferase family
MGPNPNKRVEVEQENRWTGEVKMPAEMLINVKQSTMVRPAEETPRRALWNSNVDLVVPNFHTPSVYFYRPNGVSNFFDAKVMKEALSKVLVPFYPMAARLRRDDDGRVEIYCDAQGVLFVEAETTAAIEDFGDFSPTLELRQLIPSVDYSAGVSLGVGMQHHVADGASGLHFINAWSDVARGLDISLPPFIDRTLLRARDPPLPVFDHIEYKPPPATKKTTPLQPSKPLGSDSTAVAVSTFKLTRDQLSTLKGKSREDGNTISYSSYEMLAGHVWRSVCKARALPDDQETKLYIATDGRARLQPPLPHGYFGNVIFTTTRIAVAGDLMSKPTWYAASRIHDALIRMDNEYLRSALDYLELQPDLKSLVRGAHTFRCPNLGITSWARLPIHDADFGWGRPIFMGPGGIAYEGLSFIIPSSTNDGSLSLAIALPPEQMKVFQELFYDDI

SEQ ID NO: 224239 - protein, 322 aa, Glycine max
  Coding DNA Sequence Number=SeqID_107461
  Gene Ontology: Mol. function=metal ion transporter activity; Cellular component=membrane; Biological process=metal ion transport
  Homolog annotation: Hit_ID=Q67UQ7; Match level="QueryCoverage=99%, HitCoverage=65%, E-value=3e-90, Identity=60%"; Hit description =Magnesium transporter CorA-like
  Pfam annotation: Domain name=CorA; Domain location=47-306; Score =206.7; E_value=5.3e-59; Accession=PF01544.9; Description=CorA-like Mg2+ transporter protein
MADLKERLLPPKPASALNVREVANRPSASGRQAFQGVDVLGLKKRGQGLRSWIRVDTSGNSQAIEVDKFTMMRRCDLPARDLRLLDPLFVYPSTILGREKAIVVNLEQIRCIITADEVLLLNSLDSYVLHYVMELQRRLTTTGVGEVWQSDSSDMNRRRGSRNFENVFSNSSPDYLPFEFRALEVALEAACTFLDSQAAELEIEAYPLLDELTSKISTLNLERVRRLKSRLVALTRRVQKVRDEIEQLMDDDGDMAEMYLTEKKRRMELSFYGDQSMVGYKSVDGASISAPVSPVSSPLDSRKLEKCFSIARSRHESMRSSE

SEQ ID NO: 224240 - protein, 148 aa, Glycine max
  Coding DNA Sequence Number=SeqID_107462
  Gene Ontology: Mol. function=metal ion transporter activity; Cellular component=membrane; Biological process=metal ion transport
  Homolog annotation: Hit_ID=Q67UQ7; Match level="QueryCoverage=86%, HitCoverage=24%, E-value=3e-44, Identity=72%"; Hit description =Magnesium transporter CorA-like
  Pfam annotation: Domain name=CorA; Domain location=1-146; Score= -37.2; E_value=0.0002; Accession=PF01544.9; Description=CorA-like Mg2+ transporter protein
MRSSESTTESIEELEMLLEAYFVVIDSTLNKLTSLKEYIDDTEDFINIQLVYGTMTSYSHSERTADRIFFSQDNVRNQLIQFELLLTTATFVVAIFGVVAGIFGMNFEIELFDVPSAFQWVLIITGVCGVFIFSAFVWFFKYRRLMPL

SEQ ID NO: 224241 - protein, 130 aa, Glycine max
  Coding DNA Sequence Number=SeqID_107463
MSRPTSFNSTFTISFNILPRDAFKGVYLSYFDLTLNSYKVLGSIFEMDMKKGDPYLTPSLASINMTPTCRLSTTLTSLLNHEMYPLSGSSSPCQNNFKSVSFSLSLLVSKAGLNFSLKSSHELMDLDERD

SEQ ID NO: 224242 - protein, 117 aa, Glycine max
  Coding DNA Sequence Number=SeqID_107464
  Gene Ontology: Mol. function=RNA-directed DNA polymerase activity; Cellular component=intracellular; Biological process=RNA-dependent DNA replication
MEKCVEYIDLNKHCLKDSYLLPDIDKLVDGSSDYQYLSFMNAYSRYNQIRLHSNDQEKTTFMIEKANYCYKVMSFGLKNDDTTYQRMMNKVFEKQIGQNLEVYVDDMIVKSNTKNNT

SEQ ID NO: 224243 - protein, 65 aa, Glycine max
  Coding DNA Sequence Number=SeqID_107465
MGISMLRVIPKGHRAHVCASTSSKEYEAPKYKLRMNKVGSTLQVQPSASWSKFKSPKTGETKHTS

SEQ ID NO: 224244 - protein, 424 aa, Glycine max
  Coding DNA Sequence Number=SeqID_107466
TVSERWRQFKSDLTRKWALVAEKDSVDDTVCEKYGISKEKWTQFCQTRREPSWQDVQKKAQAIQKQNTTLHVLSRGGYEYLEHKLIVEKTKKKLEEATQSVSTNGMIDHPSPIRQHVKWKMTRTKKTGKMTSEAAKEIAEKIDSLEEQASPEHPSRVRANGAELEQLTQQIRDQLEESITEKVTWQLMLSFSQMQSQLQSQIQSQGLALHPKSEVGPSAARVSIKGSCVDPSVADPNTGRVYEGSTTIHNIPLLHGQVKVGVEEVKDAEAPIPVPTDEAAVSPAKPPDRLDHKVDDPLYLMTLTIPQLFLKSLQVMWDATVFGVFNEDFSLLLTETSIRAGNFDVYRFLEPQSIQRSGQSQFESESYMKSWMQSSKHDVYLGAYLNGALKGLDDTPQPKSKAGARWIVVKEALSAAITSCTGCP

SEQ ID NO: 224245 - protein, 152 aa, Glycine max
  Coding DNA Sequence Number=SeqID_107467
MAEEITSWLKEGIFIDMDMSIIPNHDGPLLVKGFINNKEESQNLTIGVASLKLGSHRFLWSPHNSIRIRELQSSYNAILGSPALNASRAVISMKISGKGNEHPGQNQEGFVRISKVRKREEQMLSIGANLDSETMETLSTFLNENAIIFARK

SEQ ID NO: 224246 - protein, 72 aa, Glycine max
  Coding DNA Sequence Number=SeqID_107468
MATRLAVRSVTMTQRHEAYLVSYNEDMKLRRNVPRYVGDGQQKASSHGRQRDGESLDAEHGEEESASNVGRV

SEQ ID NO: 224247 - protein, 559 aa, Glycine max
  Coding DNA Sequence Number=SeqID_107469
  Gene Ontology: Mol. function=transferase activity, transferring glycosyl groups; Cellular component=integral to membrane; Biological process=cell wall biogenesis
  Homolog annotation: Hit_ID=Q9M5Q1; Match level="QueryCoverage=84%, HitCoverage=83%, E-value=1e-136, Identity=50%"; Hit description =Galactoside 2-alpha-L-fucosyltransferase (EC 2.4.1.69) (Xyloglucan alpha-(1,2)-fucosyltransferase)
  Pfam annotation: Domain name=XG_FTase; Domain location=53-529; Score =717.4; E_value=1e-212; Accession=PF03254.4; Description=Xyloglucan fucosyltransferase
MDRAERSFKSFRTFLILTFITFPILVTFTVRHQNSIFDLIQGFNAKNATTDALKQGGKNSFNESTVGPKNNSVEDGKKNALSLSTTTNIANDKLLDGLLVSSFDEASCLSRYQSYLYRRASLHKPSKYLISKLRNYEHVHRSCGPSTKSYNKIMRKGAKFSINETSRECKYLVWTSANGLGNRMITLVAAFLYAILTDRVLLVRYGADMIGLFCEPFPDSSWLLPKNSPCWEDLKHFETHESLLMNNKVNNSQDELLPPFLALNLTHIHVGHTNLFHCDRSQDLLQKIPVLILWSNQYFVPSLFMISLFRQDLSKMFPDKDTVFHHLGRYLFHPSNEAWKLIQKSYEAHLAKANERIGLQIRVFNIHHPPHQTIFNEIIACTLQNKLLPELDMLNSSATSPLKKQTSKAVLVVSLYSEYGEKLRTMYQENTTVTGDVIRVYQPSHEEHQNSNDDMHNIKAWTEIYLLSLCNALVTSPRSTFGYVAHSLGGLKPWILQGVYGKTIPDPPCQRAKYMEPCFQYPPEYDCRANKTIDFPSIFNHIKHCDDVSSGLRLVNDYH

SEQ ID NO: 224248 - protein, 33 aa, Glycine max
  Coding DNA Sequence Number=SeqID_107470
MGIIRSGFSFIAGTTRVKRSDFRFQILSFLNLG

SEQ ID NO: 224249 - protein, 335 aa, Glycine max
  Coding DNA Sequence Number=SeqID_107471
  Gene Ontology: Mol. function=protein serine/threonine kinase activity; Cellular component=integral to membrane; Biological process=protein amino acid phosphorylation
  Homolog annotation: Hit_ID=Q9LXT2; Match level="QueryCoverage=74%, HitCoverage=65%, E-value=2e-37, Identity=34%"; Hit description =Serine/threonine-specific protein kinase-like protein
  Pfam annotation: Domain name=Pkinase; Domain location=76-304; Score =20.8; E_value=8.4e-10; Accession=PF00069.15; Description=Protein kinase domain
  Pfam annotation: Domain name=Pkinase_Tyr; Domain location=76-301; Score=-23.0; E_value=4.6e-11; Accession=PF07714.7; Description =Protein tyrosine kinase
  Pfam module annotation: Pfam domain module=Pkinase::Pkinase_Tyr; Domain location=76-304::76-301
MPSRPFPPTNPTKTKALFLALTISACVVIFCSILYFLYHLWHSLVHRAKTIPFDASAPLKLQRFSYKDLKQATNGFDTANVIGKGGSGTVFRGILKDGKLIAIKRLDTLSLQSEREFQNELQILGGLRSPFLVTLLGYCVEKNKRVLVYEYMPNRSLQESLFGDDGGGLSLSWGSRFCIMLDVARALEFLHLGCDPPVIHGDIKPSNVLIDSEWRGKISDFGLSRIKVEGEFGVDLFSQDLGRSQDLWKSQELSGNLTAETPPALGTPVENVSEVDFALALQASSSSKNSRTCFNVKALNLNSLNYNANIATETEIRSVNAKGKEVSALDRDDWN

SEQ ID NO: 224250 - protein, 78 aa, Glycine max
  Coding DNA Sequence Number=SeqID_107472
  Gene Ontology: Mol. function=protein serine/threonine kinase activity; Biological process=protein amino acid phosphorylation
  Homolog annotation: Hit_ID=Q9LID3; Match level="QueryCoverage=88%, HitCoverage=13%, E-value=5e-16, Identity=50%"; Hit description =Casein kinase-like protein
MDDECDTGDKAFTTEDEGSTGPISKRVKVGGSSLYKVDRKLALEVALKLEHRSSKVFIYGSPYEWQVYNALGISHGVP

SEQ ID NO: 224251 - protein, 238 aa, Glycine max
  Coding DNA Sequence Number=SeqID_107473
  Gene Ontology: Mol. function=ATPase activity, coupled to transmembrane movement of substances; Cellular component=integral to membrane; Biological process=transport
  Homolog annotation: Hit_ID=Q5SMN1; Match level="QueryCoverage=78%, HitCoverage=17%, E-value=4e-16, Identity=28%"; Hit description =Putative multidrug resistance-associated protein 7
  Subcellular localization annotation: CTP_CleavageSite=21; ConfidenceScore=5.09e-01
MKIHCTFFSSWFTVFAVNIVTVVMIVVLGFNQKIGRGFRLSDSQMTLPEKFVLNLIPAVGACLSIVDLIFLWKKDHNSHFVGYHKWFNSCSELILWVSVCIMESLVVLLNISFSIAINVIRIKIPSFKSSLLEDPLLSNGVDLEEGGYNDLGNNGNFWDLMTFKFITPVMNHGVIKQLDPEDLLPLPTDIGPSSCHDVILSCWQAQLSNNDSNPSLFRALCSAYGWPYLCLGLLKVFF

SEQ ID NO: 224252 - protein, 359 aa, Glycine max
  Coding DNA Sequence Number=SeqID_107474
  Gene Ontology: Mol. function=amino acid binding; Cellular component =chloroplast thylakoid membrane; Biological process=metabolic process
  Homolog annotation: Hit_ID=Q2QXL3; Match level="QueryCoverage=63%, HitCoverage=75%, E-value=3e-61, Identity=55%"; Hit description=ACT domain-containing protein, putative, expressed
  Pfam annotation: Domain name=ACT; Domain location=151-215; Score =14.1; E_value=0.061; Accession=PF01842.15; Description=ACT domain
  Pfam annotation: Domain name=ACT; Domain location=281-339; Score=1.9; E_value=2.5; Accession=PF01842.15; Description=ACT domain
  Pfam module annotation: Pfam domain module=ACT::ACT; Domain location =151-215::281-339
  Subcellular localization annotation: CTP_CleavageSite=25; ConfidenceScore=5.25e-01
MANASGSGFFTLSVVRVRPLTWKVSCFGSNAEGASRDSSLTSLARKALEMAKVIELIVFFLGILGLHLSADNTLRPFEKTTVLKALSISYVTKPCYISHKTRLSSPSSSGITMIARATAVTGTVEDGNQGEADTIPTPVVIIDQDSDPDATVVEITFGDRLGALLDTMNALRNLGLNVVKANVFLDSSGKHNKFSITKADSGRKVEDPELLEAIRLTILNNMIQYHPESSAQLALGAAFGLVTPKEQSLCFVLLPVARNAFAFSFCSFNGPVAFYIGGSRRLLYVETADRPGLLVDLVKIITDINIAVESGEFDTEGLLAKAKFHVNYKDKALIKPLQQVLVNSLRYFLRRPETEESSF

SEQ ID NO: 224253 - protein, 105 aa, Glycine max
  Coding DNA Sequence Number=SeqID_107475
  Gene Ontology: Mol. function=racemase and epimerase activity, acting on carbohydrates and derivatives; Biological process=carbohydrate metabolic process
  Homolog annotation: Hit_ID=Q1T6B0; Match level="QueryCoverage=59%, HitCoverage=14%, E-value=6e-19, Identity=68%"; Hit description=NAD -dependent epimerase/dehydratase; TonB box, N-terminal
MGEGDDIEELAEESGVVEVGVDDEDVGTVKEALAGALEGGVVVAVEVVEAEDVVAAMLEGEGDRESTKTAMSESQRELQQGEAVGDGDDKMKRMNARKKEDQIVS

SEQ ID NO: 224254 - protein, 1045 aa, Glycine max
  Coding DNA Sequence Number=SeqID_107476
  Gene Ontology: Mol. function=ATPase activity, coupled to transmembrane movement of substances; Cellular component=integral to membrane; Biological process=transport
  Homolog annotation: Hit_ID=Q9SKX0; Match level="QueryCoverage=99%, HitCoverage=79%, E-value=0.0, Identity=64%"; Hit description =Multidrug resistance-associated protein 11
  Pfam annotation: Domain name=ABC_membrane; Domain location=546-850; Score=73.4; E_value=7.4e-19; Accession=PF00664.13; Description=ABC transporter transmembrane region
  Pfam annotation: Domain name=ABC_tran; Domain location=282-454; Score= 115.8; E_value=1.2e-31; Accession=PF00005.17; Description=ABC transporter
  Pfam annotation: Domain name=SMC_N; Domain location=268-457; Score= -120.8; E_value=0.009; Accession=PF02463.9; Description=RecFRecNSMC N terminal domain
  Pfam module annotation: Pfam domain module=ABC_membrane::ABC _tran::SMC_N; Domain location=546-850::282-454::268-457
MTLIYEKCLRVNLAERSKFTNGEIQTFMSVDADRTVNLCNSFHDMWSLPLQIGVALYLLYTQVKFAFVSGLAITILLIPVNKWISQLIARATEQMMKEKDERIRRTGELLTYIRTLKMYGWELLFSSWLMDTRSLEVKHLATRKYLDAWCVFFWATTPTLFSLFTFGLFALMGHELDAAMVFTCLALFNTLISPLNSFPWVINGLIDAIISSRRLSRFLSCPERKFKVGDTNSSPSSFLSKQPDSVQGLGVFIQDACCTWSSSEEQALNLVLNHVTLSVSQGSFVAVIGEVGSGKSSLLYSILGEMQLARGSVYSNESIAYVPQVPWILSGTVRDNILFGKSYDPERYTDTLQACALDVDVSMMVRGDMAYIGEKGVNLSGGQRARLALARAMYHDSDVVMLDDVLSAVDVQVAQRILHNAILGPLMQRKTRLLCTHNIQAISSADMIVVMDKGRIKWMGNSADFPISSYTEFSPLNEIDSALHNHRQSCSTNLSSKSKEQSLPNSDIVHVLEGAEEIVEVELRKEGKVELGVYKSYAVFTGWFMTVIICLSAILMQASRNGNDLWLSFWVDTTTESSQTRYSVSFYLAILCLFCIMNSLFTLVRAFSFAFGGLQAATKVHNKLLNKLVNAPVQFFDQTPGGRILNRLSSDLYTIDDSLPFIMNILLANFVGLLGITIILCYVQVFFLLLLLPFWYIYSRLQWLQFFYRSTSRELRRLDSVSRSPIYTSFTETLDGSSTIRAFKAEEKVARDIDWHTQTASLKLSYGKGYMDSGRCSSIYPKHYQLNLPLNSEVLFICLALVACQICSDFYTSLDFFFAKFIEHITLYQKTSYTEIVASLWLSLRLQLLLIMTFFQLLGAFIVSFIAVMAVVGSHGSLPINFGTPGLVGLALSYAAPIVSLLGSFLSSFTETEKEMVSVERALQYMDIPQEEQTGCLYLSPDWPNQGVIEFQSVTLKYMPSLPAALCNLSFRIVGGTQVGIIGRTGAGKSSVLNALFRLTPICTGSITIDGVDIKNIPVRELRTHLAIVPQSPFLFEGSLRKKQD

SEQ ID NO: 224255 - protein, 65 aa, Glycine max
  Coding DNA Sequence Number=SeqID_107477
MVDCEGCQGMVEDLGVIAEDLERVINLRMVTEGTDLYDIMTRCLRRARGDAADGSLRPRQRRRID

SEQ ID NO: 224256 - protein, 192 aa, Glycine max
  Coding DNA Sequence Number=SeqID_107478
  Homolog annotation: Hit_ID=Q1SX88; Match level="QueryCoverage=68%, HitCoverage=60%, E-value=6e-07, Identity=26%"; Hit description=Heavy metal transport/detoxification protein; Harpin-induced 1
MVFNNDGFVETVLESNTFQNRHHLFQPPIENYIHIAVIDVPFEQGNDFCRAKLFMLDFKPGDGAVVNVDVAREDGYGGGVVGEEDLLVGGVGGEVQVVEFQRHDDEGGVVGTVEELEHLVGDVDLEEKDQHGDDQHGEDQPEEKGVAAPTLMVGLRAIGGVGGTVKLSLCCRERWVGGTAINHGGLGRWIHP

SEQ ID NO: 224257 - protein, 620 aa, Glycine max
  Coding DNA Sequence Number=SeqID_107479
  Gene Ontology: Mol. function=ATP binding; Cellular component =chloroplast; Biological process=response to heat
  Homolog annotation: Hit_ID=Q1SEZ3; Match level="QueryCoverage=98%, HitCoverage=98%, E-value=0.0, Identity=70%"; Hit description=Heat shock protein Hsp70
  Pfam annotation: Domain name=HSP70; Domain location=9-618; Score =1083.9; E_value=0; Accession=PF00012.10; Description=Hsp70 protein
  Pfam annotation: Domain name=MreB_Mbl; Domain location=7-393; Score= -237.6; E_value=0.0055; Accession=PF06723.3; Description=MreBMbl protein
  Pfam module annotation: Pfam domain module=HSP70::MreB_Mbl; Domain location=9-618::7-393
MAREYEGCAVGIDLGTTYSCVAVWLEQHCRVEIIHNDQGNNTTPSCVAFTDHQRLIGEAAKNQAATNPENTVFDAKRLIGRKFSDPVIQKDKMLWPFKIVAGINDKPMISLNYKGQEKHLLAEEVSSMVLTKMREIAEAYLETPVKNAVVTVPAYFNDSQRKATIDAGSIAGLNVMRIINEPTAAAIAYGLDKRTNCVGERSIFIFDLGGGTFDVSLLIIKDKVFRVKATAGNTHLGGEDFDNRMVNYFVQEFKRKNKVDISGNARALRRLRSACERAKRILSYAVTTNIEVDALFQGIDFCSSITRAKFEEINMELFEECMETVDRCLSDANMDKSSVHDVVLVGGSSRIPKVQELLQDFFNGKILCKSINPDEAVAYGAAVQAALLSKGIVNVPDLVLLDITPLSLGISLKGDLMSVVIPRNTTIPVKTTETYSTAVDNQSAVLIEVYEGERTRASDNNLLGFFRLSGIPPVPRNHLVYICFAIDENGILSVSAEEKSTGNKNEITITNDKERLSTKEIKRMIQEAEYYQAEDKKFLRKAKAMNDLDCYVYKIKNALKQKDISSKLCSKEKEDVSSAITRATDLLEGNNQQDDIAVFEDNLKELESIIERMKAMGKIV

SEQ ID NO: 224258 - protein, 251 aa, Glycine max
  Coding DNA Sequence Number=SeqID_107480
  Gene Ontology: Mol. function=zinc ion binding; Biological process =intracellular signaling cascade
  Homolog annotation: Hit_ID=Q2QMP6; Match level="QueryCoverage=93%, HitCoverage=93%, E-value=1e-24, Identity=29%"; Hit description=DC1 domain-containing protein, putative, expressed
  Pfam annotation: Domain name=C1_2; Domain location=26-55; Score=19.2; E_value=0.015; Accession=PF03107.7; Description=C1 domain
  Pfam annotation: Domain name=C1_2; Domain location=84-111; Score =29.5; E_value=1.2e-05; Accession=PF03107.7; Description=C1 domain
  Pfam annotation: Domain name=C1_3; Domain location=25-55; Score=26.4; E_value=0.0001; Accession=PF07649.3; Description=C1-like domain
  Pfam annotation: Domain name=C1_3; Domain location=83-111; Score =15.8; E_value=0.0071; Accession=PF07649.3; Description=C1-like domain
  Pfam module annotation: Pfam domain module=C1_2::C1_2::C1_3::C1_3; Domain location=26-55::84-111::25-55::83-111
MEMSTKKGCPSHAQPMQLKPPGAPFKCSGCKQMGLGCSYHCESSNCSYTLHEECAKAVSLAFHSFFPKSDFEFHEKAPGNRTRYCDGCGKDVLGFVYHCSTTGYDLHPCCLKLKHSLSDEEGRVTLELCQKVPSKCGKCKHRNVVEGVKGWSYVSSGGNYCYHVSCVKELIFENWKRGYFSQETNSTGMRSDSENTQIALRSMAMVQSGRRSRRIKKYTKIAVLVFKLVVSAIFGNPISAIAALVEALVSD

SEQ ID NO: 224259 - protein, 224 aa, Glycine max
  Coding DNA Sequence Number=SeqID_107481
MPVPSCGRTCRTFFRRLPLFLAEEPAKPSSAGYLSFSRKNLRNLLLWTVFCCILIIVRTRGLGHVLGTGRGRGISEDAHQADVPRRRRPTTSARRQWVRVHEDATQRPEDVSQLHKDVPHVSNATPEMTGAVDAVHIEGVATDGSLGSFARDEGFPCGLRDPSVLTGFAEHVAHSIWSGHEGPDLKLVSHGRKVDKIGRPAPEIERMIAATGLSPLNQVFCYHH

SEQ ID NO: 224260 - protein, 502 aa, Glycine max
  Coding DNA Sequence Number=SeqID_107482
  Gene Ontology: Mol. function=microtubule binding; Cellular component =cortical microtubule, transverse to long axis; Biological process =cytoskeleton organization and biogenesis
  Homolog annotation: Hit_ID=Q1SLE1; Match level="QueryCoverage=92%, HitCoverage=72%, E-value=1e-178, Identity=72%"; Hit description =Myosin II heavy chain-like
  Pfam annotation: Domain name=Myosin_HC-like; Domain location=81-433; Score=851.1; E_value=5.5e-253; Accession=PF07058.2; Description =Myosin II heavy chain-like
MAAQFAAEATLRRVHAAQKDDDMPPIEAILAPLEAELKLARQEIAKLQDDNKALDRLTKSKEAALLEAERTVQVALAKASMVDDLQNKNQELIKQIEICQEENKILDKMHRQKVAEVEKLTQTVRELEEAVLAGGAAANAVRDYQRKVQEMNEERKTLDRELARAKVTANRVAVVVANEWKDANDKVMPVKQWLEERRFLQGEMQQLRDKLAIVERAAKSEAQLKEKYHLRLKVLEESLRGNSNSSNRGTPEGRSMSNGPSRRQSLGGADNFSKLTSNGFLSKRSPSSQLRSSLSSSTVLKHAKGTSKSFDGGTRSLERSKMLLNGTPLSYSFNQSLEETKEREASDNWKGNSDDKPNDFPTVDLVDSVPGVLYDLLQKEVIALRKAGHEKDQSLKDKGDAIEMLAKKVDTLTKAMEVEAKKMRREVAAMEKEVAAMRVEKEQENRAKRFSNVKGPVNSAQQQLISGRLGILTIKWIYSVKRDPIVNSIPENLVFNQVHGIL

SEQ ID NO: 224261 - protein, 99 aa, Glycine max
  Coding DNA Sequence Number=SeqID_107483
MEIKTQKQLSIALSVSMAVDRATEVNQTSNEKYASVRGCPVPGRGGRHQDHGSIGVAANSKDQIIVNELNILVEGAEGEDVTFRERGGSKKGITAWSKA

SEQ ID NO: 224262 - protein, 61 aa, Glycine max
  Coding DNA Sequence Number=SeqID_107484
MKRKLREEEGQAGGVSLSKTYALSELHPLSETLSPLNAWGNPTRGSVTNARAQRAASSPSE

SEQ ID NO: 224263 - protein, 106 aa, Glycine max
  Coding DNA Sequence Number=SeqID_107485
  Gene Ontology: Mol. function=Rab GDP-dissociation inhibitor activity; Cellular component=cell surface; Biological process=regulation of GTPase activity
  Homolog annotation: Hit_ID=Q9LEG0; Match level="QueryCoverage=60%, HitCoverage=14%, E-value=2e-23, Identity=76%"; Hit description=GDP dissociation inhibitor
MTLLKALAGKLEQSLKVCISKEETTKCRKIVCDPSYMSDKVQKVGKVACAICIMSHPIPDTKDSYSTQVILPQKQLGRKSDIFMIIQLIQEQSETLHIRVVSWSII

SEQ ID NO: 224264 - protein, 99 aa, Glycine max
  Coding DNA Sequence Number=SeqID_107486
  Subcellular localization annotation: CTP_CleavageSite=41; ConfidenceScore=5.12e-01
MDSSGAFSGMIPHSANMHNSSFFQILPRAQPKEWCTQRMARQKHISCWVVEKKLSFKNYFDDAKEFKNYFDDVKEFQRSFKMNFKDDESKMSSKAKISR

SEQ ID NO: 224265 - protein, 209 aa, Glycine max
  Coding DNA Sequence Number=SeqID_107487
  Subcellular localization annotation: CTP_CleavageSite=39; ConfidenceScore=5.69e-01
MATPPSSPPLPPSGSATPFSPSTSKKTRKATRLISLTTRLAEVERPMVHVVPVTEKADGPHGNKLRTYLGIVARDKDKEKILRTIRERWRHFKSDLTSKWTVAHGKEGEDDKVSEKYEISKKKWTQFCHSRKDPSCETSYRYVLLSQHVQKKVQAIQKQNIVPHMLSRGGYDFIEKKLWRRSKRNDWRKKPNLGALAQSLIPHLPTDNT

SEQ ID NO: 224266 - protein, 99 aa, Glycine max
  Coding DNA Sequence Number=SeqID_107488
AKNKSLAKACKKGKLDETLERKEALELEEDALAFFKALSTEEHKKLVEDAKIVALTMYVEESQRKNAKKATMMNIDGETVPEAIIVDSIQAVTPSTPTY

SEQ ID NO: 224267 - protein, 140 aa, Glycine max
  Coding DNA Sequence Number=SeqID_107489
  Gene Ontology: Mol. function=pepsin A activity; Biological process =proteolysis
  Homolog annotation: Hit_ID=Q1S7J2; Match level="QueryCoverage=99%, HitCoverage=32%, E-value=3e-29, Identity=54%"; Hit description =Peptidase aspartic, catalytic
MNFLHKLKAEVSCEGRVILVLPRPIMSMTPVARPWSKKFEARENKKHENGGVLFRVEAIGGLEGDDVLLELVTGGGDGVVRRDAARVVVVTEFWGGEVVSVTVESGEGGIGRAAPCGPISEGDIVVAIIDPQELATDVKY

SEQ ID NO: 224268 - protein, 68 aa, Glycine max
  Coding DNA Sequence Number=SeqID_107490
MPNHNSLYCHYDNVPNDMRRNAVRRGKTERCSDNEGETKRIDLRTQGENGEEQSAVEMETGRKGSAKE

SEQ ID NO: 224269 - protein, 40 aa, Glycine max
  Coding DNA Sequence Number=SeqID_107491
MSMQEYKAYLSAAWAESEGATTHNGGTTVTAITTEAQRMH

SEQ ID NO: 224270 - protein, 475 aa, Glycine max
  Coding DNA Sequence Number=SeqID_107492
  Gene Ontology: Mol. function=transporter activity; Cellular component= membrane; Biological process=transport
  Homolog annotation: Hit_ID=Q2Z1Q0; Match level="QueryCoverage=99%, HitCoverage=91%, E-value=1e-171, Identity=63%"; Hit description =NRAMP family metal transporter
  Pfam annotation: Domain name=Nramp; Domain location=18-361; Score =418.0; E_value=1.4e-122; Accession=PF01566.9; Description=Natural resistance-associated macrophage protein
MGPGFLVSIAYIDPGNSLVIQSMAANLGVVTGKHLAEHCRAEYPRVPNFILWIIAEIAIVACDIPEVIGTAFALNMLFNIPVWIGVLLTGLSTLMLLALQQYGVRKLEFLIAFLVFTIAACFMVELGYAKPDAKEVLKGLFEPELKGSGATGLAISLLGAMEACRFYMIESAFALMVAFLINVCVISVSGAVCNSSNLNAEDQMSCQDLDLNKASFLLRVCENWRCLSYFGCYWYGAHKIIADISDMYHTQNVLGKWSSKLFGIALFASGQSSTITGTYAGQYVMQGFLDLRLEPWIRNMLTRCLAIVPSLIVAVIGGSAGAGKLIIVASMILSFELPFALVPLLKFTSSKTKMGTHVNSTMISAVTWIIGTLLMAINIYYLITGFIKLLLHSHLKIAAKVFLGILGFSGMAMYLAGITYLVLRKNKEATHLLALTATENQQMTNEQGNGSIYSLPREDIVSMQLPQRSTPADVD

SEQ ID NO: 224271 - protein, 199 aa, Glycine max
  Coding DNA Sequence Number=SeqID_107493
  Gene Ontology: Mol. function=transporter activity; Cellular component= integral to membrane; Biological process=transport
  Homolog annotation: Hit_ID=Q6J1S8; Match level="QueryCoverage=72%, HitCoverage=55%, E-value=4e-45, Identity=58%"; Hit description =Nodulin 26-like protein
  Pfam annotation: Domain name=MIP; Domain location=52-185; Score= -76.7; E_value=8.6e-05; Accession=PF00230.10; Description=Major intrinsic protein
MESRFTLLGFENRDRGGDMESWEWGVEEWSLEDGGLPAVSCSLALPPPPPGVPLARKVGAEFIGTFILMFTGTAAAIVNQKTNGSETLIGCAATTGLAHFPWKHVPMYIGAQVLASKYICAGFALKGVYHPFMRGGVTVPSGGYGQAFALEFIIAFNLMFVATDTRAVSIFSYTSFYVYFRTWVFGGDTKNSDTFQAFI

SEQ ID NO: 224272 - protein, 260 aa, Glycine max
  Coding DNA Sequence Number=SeqID_107494
  Gene Ontology: Mol. function=nucleic acid binding; Cellular component= intracellular; Biological process=regulation of transcription
  Homolog annotation: Hit_ID=Q42485; Match level="QueryCoverage=80%, HitCoverage=91%, E-value=2e-32, Identity=44%"; Hit description=Zinc finger protein 1
  Pfam annotation: Domain name=zf-C2H2; Domain location=104-126; Score =20.4; E_value=0.0063; Accession=PF00096.16; Description=Zinc finger, C2H2 type
MDLIWPESRPSENLKIPFLETPPPCSKPPVPSMDTQKEKKEDNEHPHESASDLVLDLSLPSKHSGGDGESKPELNLINCIDTNLSMNSSESSHGHGDELEPRIFSCNYCQRKFYSSQALGGHQNAHKRERTLVKRGHKAGAAVSIDFARRYSSMASLPLHGSYNRSSLGIQAHSMISKPSYQSPFFGLSRSHAQKRPMFSQPPIGTESESSLTGGIPVPRLGNFSPRLVPEGLGGYWLDSVNHLKTKQEELHKLDLSLKL

SEQ ID NO: 224273 - protein, 65 aa, Glycine max
  Coding DNA Sequence Number=SeqID_107495
MTHWASTSLVDPLLGFLITLSELSASLSGYGFEEMTSSPKPALGGGAHMGLLLVHLRDHLTEIRG

SEQ ID NO: 224274 - protein, 107 aa, Glycine max
  Coding DNA Sequence Number=SeqID_107496
MKDIKKSIDDLHELVLNLTTLVTIGTPLKTSNKQGRRLNLYGSGDGKCFEKKADRKKLFLPMKKNMKPLKVLQTTTSNVGYRINNRSAIELAQLASAIDVRQWMVHH

SEQ ID NO: 224275 - protein, 137 aa, Glycine max
  Coding DNA Sequence Number=SeqID_107497
MNLASILCGPWVPISLRGHEIHNIIIVCLEICSISSARGVTPPSGEGGNTGGEIGGGGTSGASGTARGLTFLGPGKAKLIMGLSDSKVRVSKVTPCALQKAMINAGKLSQEVLDWVICVICLDIMLPRSMSIYVTNP

SEQ ID NO: 224276 - protein, 648 aa, Glycine max
  Coding DNA Sequence Number=SeqID_107498
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q0KKZ5; Match level="QueryCoverage=99%, HitCoverage=69%, E-value=0.0, Identity=79%"; Hit description=P-type H+-ATPase
  Pfam annotation: Domain name=Cation_ATPase_N; Domain location=5-74; Score=60.4; E_value=6e-15; Accession=PF00690.16; Description=Cation transporterATPase, N-terminus
  Pfam annotation: Domain name=E1-E2_ATPase; Domain location=87-308; Score=292.5; E_value=7.7e-85; Accession=PF00122.10; Description=E1 -E2 ATPase
  Pfam annotation: Domain name=Hydrolase; Domain location=312-598; Score=73.1; E_value=8.8e-19; Accession=PF00702.16; Description =haloacid dehalogenase-like hydrolase
  Pfam module annotation: Pfam domain module=Cation_ATPase_N::E1-E2 _ATPase::Hydrolase; Domain location=5-74::87-308::312-598
MGSLENIKNETVDLERIPVDEVFRELNCSKEGLSNEEGQKRLQESKLLKFLGFMWNPLSWVMEAAAIMAIVLANGGGEPPDWQDFVGIMVLLVVNSTISFIEENNAGNAAAALMAGLAPKTKVLRDGRWSEEEASILVPGDIISIKLGDIIPADARLLEGDPLKIDQSALTGESLPTTKHPGDEIFSGSTVKQGEIEAVVIATGVHTFFGKAAHLVDSCNQVGHFQKVLTAIGNFCICSIAVGMIIEIVVMYPIQHRKYRSGINNLLVLLIGGIPIAMPTVLSVTMAIGSHRLSEQGAITKRMTAIEEMAGMDVLCSDKTGTLTLNKLTVDKNLIEVFARDADKDTVMLLGARASRVENQDAIDACIVGMLGDPKEARDGIKEVHFLPFNPVDKRTAITYIDTEGNWHRVSKGAPEQIIELCKLREDVKKKALSIIDKFADRGLRSLAVAKQEVPEKSKESAGGPWTFVGLLPLFDPPRHDSAETIRRALNLGVNVKMITGDQLAIGKETGRRLGMGSNMYPSSSLLGEHKDESIAGLPVDELIEKADGFAGVFPEHKYEIVKRLQDRKHICGMTGDGVNDAPALKRADIGIAVADATDAARGASDIVLTEPGLSSHLPENEELYHICCLYNNPNSVGLYAACSHLEV

SEQ ID NO: 224277 - protein, 112 aa, Glycine max
  Coding DNA Sequence Number=SeqID_107499
MAHTLPREKIDIALVKEFYANAYDPEDGTLKRCWIRGKVIRFDAETLNDFLETPLVIPKREEYPSYSQYLHTYPDHQAIAAKLFTPGGQFVLNANGAPWKLLRKDLTTLAQT

SEQ ID NO: 224278 - protein, 246 aa, Glycine max
  Coding DNA Sequence Number=SeqID_107500
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9SWH2; Match level="QueryCoverage=97%, HitCoverage=25%, E-value=1e-110, Identity=80%"; Hit description =Plasma membrane proton ATPase
MEAQRDFVTGIVLGTYLAVMTVVFFWAAHASDFFSDKFGVRSIRENYSELTAAVYLQVSIVSQALIFVTRSRSWSYVERPGMFLLVAFFIAQLIATVIAVYANWEFAKMKGIGWGWAGVIWLYSIIFYIPMDILKFIIRYALTGKAWNNITENRVAFTTKKDYGKGEREAQWAAAQRTLHGLNPPETEEMLNEKNNYRELSELAEQAKKRAEVARLRELHTLKGHVESVVKLKGLDIETMQQHYTV

SEQ ID NO: 224279 - protein, 316 aa, Glycine max
  Coding DNA Sequence Number=SeqID_107501
  Gene Ontology: Mol. function=protein-tyrosine kinase activity; Cellular component=membrane; Biological process=protein amino acid phosphorylation
  Homolog annotation: Hit_ID=UPI0000196CB7; Match level="QueryCoverage =61%, HitCoverage=53%, E-value=2e-58, Identity=54%"; Hit description =ATP binding / kinase/ protein kinase/ protein serine/threonine kinase/ protein-tyrosine kinase
  Pfam annotation: Domain name=Pkinase; Domain location=138-316; Score=- 1.2; E_value=1.7e-08; Accession=PF00069.15; Description=Protein kinase domain
  Pfam annotation: Domain name=Pkinase_Tyr; Domain location=138-310; Score=-17.1; E_value=2e-11; Accession=PF07714.7; Description=Protein tyrosine kinase
  Pfam module annotation: Pfam domain module=Pkinase::Pkinase_Tyr; Domain location=138-316::138-310
MNLLVLFLPVWVLSISFSSPILHAASSISLSQNAQAESPGIQEVRTVHHQNLNKRILIALVACSALLVGVFLFLLYVWFGRHKNLRCSKSKSQETIEAAKGETISSVNAKLNYSKMADKKSSVAIFDYQLLEAATNSFNTSNIMGESGSRIVYRAHFDEHFQAAVKKADSDADREFENEVSWLSKIQHQNIIKIMGYCIHGESRFLVYELMENGSLETQLHGPNRGSSLTWPLRLRIAVDVARALEYLHEHNNPPVVHRDLKSSNVFLDSNFNAKLSDFGFAMVLGMQHKNMKMSGTLGYLAPEYISHGIEEYLLS

SEQ ID NO: 224280 - protein, 250 aa, Glycine max
  Coding DNA Sequence Number=SeqID_107502
MTLSRWICANNSKTQLLQIVHAGGHVELHDRPVTAAEIMCRYPRCRVAYPYVFQQPWAVAEPETVLMLGQKYYVIPNSTIRKLQRLSPRSSPSPSSPAHEITISSSVDEIRNTKSSKEENDGVLSTCCVFRNKSSAKQSNIYKQYSKNKIKKSEIRADVRNLSLNINDKSGGLSHDSCFVSLFNGGRTKANASDVAKETRTPSSSAHLCDGNTLTRKRTKDFTGNGLRSSPKNVWSSEHWQPSLESITEE

SEQ ID NO: 224281 - protein, 356 aa, Glycine max
  Coding DNA Sequence Number=SeqID_107503
  Gene Ontology: Mol. function=cation transporter activity; Cellular component=integral to membrane; Biological process=potassium ion transport
  Homolog annotation: Hit_ID=Q83S20; Match level="QueryCoverage=94%, HitCoverage=68%, E-value=1e-152, Identity=73%"; Hit description =Putative transport protein ybjL
MAGAQAAQQHQRARTAETVLQAAAGAQADPGHKHHQAKLFHHGQCALRDVAERRVVGAQEAEHDAGKQQSGGVAQAKAEVAELESDHADHQADDKEGAERQQIGHLAVNSNEADAIGQAFHPTRFAAHLQHIAFVEHNAVVDRHLNLAANHPAFIHRVVVFHHDLFGDDAHVEQIAIEHLFTITETGVETRMGIRIADQRNFVAELQNCITVRTGQNAVTPQALNVAAGLTVNPQLTQVFAAAPLNQLRTNAVGANYRQEHFTLAVRIQTALARDLLGAGRQILMLQARQVACAKNQADQPNQIGEGVTQAEHAGGEADIPAKQFAERQRNQQGADHHDDRQKEIVLTVAEKDGEK

SEQ ID NO: 224282 - protein, 89 aa, Glycine max
  Coding DNA Sequence Number=SeqID_107504
MNHQPPEMSSNAHALEEKRPRSLNAQRRKACGARSCCKLMRVVAVTQGLLVMGGLIHDSRFHWVRVFIEILVQSISCMLSRQQFYKARE

SEQ ID NO: 224283 - protein, 57 aa, Glycine max
  Coding DNA Sequence Number=SeqID_107505
MWWSWYGCGNSYDGHGGDCGDGDARDSGGELMKEYVLQFLSQNEDEHGCTSSLRAIF

SEQ ID NO: 224284 - protein, 364 aa, Glycine max
  Coding DNA Sequence Number=SeqID_107506
  Gene Ontology: Mol. function=DNA binding; Cellular component=nuclear pore; Biological process=DNA integration
  Homolog annotation: Hit_ID=Q1RSI0; Match level="QueryCoverage=98%, HitCoverage=45%, E-value=1e-102, Identity=45%"; Hit description=IMP dehydrogenase/GMP reductase
MNRTWDVVHTPPHVRPIGCKWIYKIKRLPDDIVERYKARLVAKGFSQIEGADYFKTFSPVVKMSTICVVLALASINRWTLQQLDVSNAFLHGDLSVDVYMEIPPGLHGFSPSQSCKLHKSLYGGTFSSRDFSMPKPKEYCLDLLKDSGMLGCKPSSTPMYSTLRLHADSSGLLADPLPYRRLVGRLIYLTITRPDIAFATQQLSQFMSNPTKAHHNAAINVLRYLKSCPGKGLVFPRNCNTQIQALATATCELQWLTYLLRDLRVPRSIQSIIYCDNQSALHIAANPVFHELTKHLDIDCHLVREKSQAGLMRLLPVPSSNQLADIFTKGLPPCLFTVNSSKLKLADIYLPPACVGLTEEDHDS

SEQ ID NO: 224285 - protein, 136 aa, Glycine max
  Coding DNA Sequence Number=SeqID_107507
MTIIVVAATVAIMLVVTYNGHGDGGGLMIIMVMIVHPCQSRCFIFRNQHFHFYQPANGRFQRVPPRFGSASPTQPFPGNLRPNSGTHAHTLSLFRSTPSSLKPQLCLKHPLQPLPIAPCCSPNSPIAKSSPKIFNR

SEQ ID NO: 224286 - protein, 137 aa, Glycine max
  Coding DNA Sequence Number=SeqID_107508
  Gene Ontology: Mol. function=nucleic acid binding; Biological process= DNA integration
  Homolog annotation: Hit_ID=Q1RTN7; Match level="QueryCoverage=79%, HitCoverage=20%, E-value=2e-26, Identity=50%"; Hit description =Peptidase aspartic, catalytic
MSWILNSVSPSIAQSIIFFENAAAIWTDLKERFSQGDLLCVAELQEEIYYLKQDSASVTVYYTNLKSLWEELDNFRPLVPCTCSAKEFHQQDFIICFLKGLDERFAMLEQQHSATTSTSLDTNPFANTVSGRGHGTP

SEQ ID NO: 224287 - protein, 98 aa, Glycine max
  Coding DNA Sequence Number=SeqID_107509
  Subcellular localization annotation: CTP_CleavageSite=77; ConfidenceScore=5.10e-01
MTVGTTSDNISLKRKTLDEDHCHQASQRLSMATNSPPLPMFPWTQSPVESSTFATYPSPGGRRGAHGCVFQGRKACEVATNVYSRKTSEKPERVVYEL

SEQ ID NO: 224288 - protein, 167 aa, Glycine max
  Coding DNA Sequence Number=SeqID_107510
  Gene Ontology: Mol. function=nucleic acid binding
  Pfam annotation: Domain name=zf-CCHC; Domain location=104-121; Score =11.5; E_value=0.013; Accession=PF00098.13; Description=Zinc knuckle
MVGRILTNNNVNPMEFKTTMVQAWNVKKVYDLPLNRRTKSVVTLVGNSIGGFMEWDKGDKSRFGKVMRVRVSMDVGKPLKRGMFIKMGKGIQRKIFFKYKRLGNFCYTCGGLDHVLKECELIEEGNNEEGEVMMEGYRGSHVLKGNSSTTGPCEDTIDDMLKASTNY

SEQ ID NO: 224289 - protein, 318 aa, Glycine max
  Coding DNA Sequence Number=SeqID_107511
  Gene Ontology: Mol. function=chromatin binding; Cellular component =chromatin; Biological process=chromatin assembly or disassembly
  Homolog annotation: Hit_ID=Q1SAV4; Match level="QueryCoverage=90%, HitCoverage=88%, E-value=3e-81, Identity=46%"; Hit description =Integrase, catalytic region
  Pfam annotation: Domain name=Chromo; Domain location=235-285; Score =8.7; E_value=0.09; Accession=PF00385.14; Description='chromo' (CHRromatin Organisation MOdifier
  Pfam annotation: Domain name=rve; Domain location=1-158; Score=-10.1; E_value=0.042; Accession=PF00665.16; Description=Integrase core domain
  Pfam module annotation: Pfam domain module=Chromo::rve; Domain location=235-285::1-158
MDFITGLPPSHGLSVILVVVDRFTKGAHFGALPATYTAHKVNLLFIDIVCKLHGFSRNIVSDRDPIFISRFWCELFRISGTKLRMSTSYHPETDDQTEYLAGTSLIEAVDSLMMSRTQLHSSFQRRLAKAQVAMERTANSHRRDVHFDVGDWVFVRLRPYRQTSLQSAYSKLSKRFYGPFCILERIGPVAYRLQLPTSSKIHIVFHVSLLKPYRGDTPTTLDPLPPLQSDNHPVVEPLSILDWKWDTNYTPPVQKVLVQWTGLAPEDTTWEDWDSICTSYNLGDKVVLPEEGIGSKNNPTSSRPTRAHRKPTYLLDYE

SEQ ID NO: 224290 - protein, 89 aa, Glycine max
  Coding DNA Sequence Number=SeqID_107512
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O23708; Match level="QueryCoverage=44%, HitCoverage=17%, E-value=1e-14, Identity=100%"; Hit description =Proteasome subunit alpha type 2-A
MILVRFIMGDSQYSFSLTTFSPSGKLVQIEHALTAVGSGQTSLGIKAKTTQQAADPQEHIGNQHTCWTMSDCIPRGDLARQTLSFLSFC

SEQ ID NO: 224291 - protein, 177 aa, Glycine max
  Coding DNA Sequence Number=SeqID_107513
MLDSLLVANEVLDDARRRKKHSLIFKVDFGKAYNCVNCEFLFYMRRMIVRVIEKSTFRGITFNGIRANLSPSAVWFKDNPSKSCMKAAKKSTFRGITLGEGGLGLGEIEGYKVVEVGCRKRFGVEEGWDDIEGFNIGREVKGLMKVFSQIGRGGEEKMSMSGVVVEGCWGRRNVGSP

SEQ ID NO: 224292 - protein, 129 aa, Glycine max
  Coding DNA Sequence Number=SeqID_107514
MSGWETYKSITVAAGYGKKKGRMGMKTRQVAWLPWIMFHLVQNALKTCLFVTDTRMEVVLEMSTGAEGRELLEAEKGNGTAGKGEFQIQKSQTNHDGQGMEEGLKRILDLDVELLPEACRSQGEGGVYW

SEQ ID NO: 224293 - protein, 644 aa, Glycine max
  Coding DNA Sequence Number=SeqID_107515
  Gene Ontology: Mol. function=RNA-directed DNA polymerase activity; Cellular component=chromatin; Biological process=chromatin assembly or disassembly
MPKRNYLVACAESLQHLSDRPTGANSHRTLGYPARRVLIVRGIRNWPWIRQNVDFPRCGCVTRHQQPRYWSQTCTEWSNQNQEAWRGIPEKVVPPFADYRGNSMEFPYVSRGMLQSWTEYLAEEGNGMRVLLKHCSHGRTRSIGFEDEGQCNGGVMADETTIKTGVRQSSMALILEGSGATPAAETTWPKMSSKKTATDLQRNGLSNSFIVAWNVVGACRGRRALLCIRNVLDGGAKQFWACRRWPWGFDEIPDGGPIWKNRRHWLTHPRARQWWAWENDGRGKWVVTQLDEAGLQHIGYLTLKLSFLTVGVSVGSYVDGLGIRVIPGRGDCNGKGGVVGEGMYQGNWERDLVSRGRGGVEGNIGGELDWTAQQGAAHGAGVTLDRQWNIRADLLANEGATIANHNLERVDGGGVQGEKLGDPSLNKVVEPYMRKVVGASMPDRALRLSCGVSGSGGRGNSKIGPQSLREASSSGERRFTGSLGGGGEVVVVESGQGVAGGGAAENLGGRQRSGTRPETKQLKRIGWASPTARLANLSNSERKKGDRCGSSTGTSIESVLPCRRKPQSDAHWASSFMCGRGIGEEGCDGGGECLGEGGGRDCMVLDEGLLTLLKVEHSLFKSLCGRLPGIVLKHGGTIGQVGPS

SEQ ID NO: 224294 - protein, 137 aa, Glycine max
  Coding DNA Sequence Number=SeqID_107516
MSLEISENHLNCHPVRIKRFTAKLISGLEVEPESAGAVTGSAEPGSGECHEQVHPTPSSSTSSLPPASIPIVSPVQVNQTLSPQVTTPPSNTSTGSSKPSTVPHSPEVSATDARPLNSDRVSPSDTILRKLRWRERK

SEQ ID NO: 224295 - protein, 83 aa, Glycine max
  Coding DNA Sequence Number=SeqID_107517
MVGSIEVHYHSDWLPPILSLWLSLWWVLWWQHRRSKKNTVVKTGVLTTTARGETTKKMNHKFNNHRTVKMNGGERFTVQWGGR

SEQ ID NO: 224296 - protein, 94 aa, Glycine max
  Coding DNA Sequence Number=SeqID_107518
MPISPCKRIAPTKTPSGPGEVQQGPGVSSSGIPPIRQLVDLKKSNRVLELPALITGLCQFYGVPVTPSKVIRPPTNRAFIKKYCALRQAQGETP

SEQ ID NO: 224297 - protein, 67 aa, Glycine max
  Coding DNA Sequence Number=SeqID_107519
MVIVLDGAHFHTSYDTGNIPYAEEYLYKGVCHSVWNSLETQADHRGGGGELPCATGWPRHLLPSFPK

SEQ ID NO: 224298 - protein, 735 aa, Glycine max
  Coding DNA Sequence Number=SeqID_107520
  Gene Ontology: Mol. function=ubiquitin-protein ligase activity; Cellular component=ubiquitin ligase complex; Biological process =protein ubiquitination
  Homolog annotation: Hit_ID=Q93XR9; Match level="QueryCoverage=93%, HitCoverage=90%, E-value=1e-171, Identity=47%"; Hit description=Bg55 protein
  Pfam annotation: Domain name=U-box; Domain location=249-321; Score =69.0; E_value=1.5e-17; Accession=PF04564.6; Description=U-box domain
MCAELRKLVDRILRIIPQIEAARPSGMQALCLLNEAIDKAKQLLLYCSESSKLYLAITGDSILSKFQKARKSLTQSLVQILNMVPVMLAAEISRLIGDFECVTFVLNSAEQAAGKVMKQLLQQDPSTSDKDSMEESELKDFQFVAARLGITSPTAILIERRSIQKLLEKLKPNDQTKEIILKNLLFLLIKHRKSITGEQMEVYSQSEGPITTQNSDHESQKNLHVKSYLYLNHGQYRTHASELSRLTPPEEYTCPISLRLMYDPVVIASGKTYERMWIQKWFDEGNTICPKTKKELAHMALTPNVALKDLILNWCKTNGVSIPDPRRHVQDFHSWEASSNSIRSFGSSLYDLNFPMDFSNMSLGSLDTSYNSDSSHTKANHSLNLMLNKSSDNSRRHQSHVRIHDADRMHLSKLHERQWESQCQVIENMKIDFKCNYQAFCSVSSESFIDPLTRFLSTACERHDVKALRAGTKLLMEFMKCCRNGMTNLSEDTCIMLASLLDTEAIGEALTIMEELTGNWYEKANVAASSVLTSVSKILDSGNEEFQRKAIKIMYNFSSNGQICPYMVSLGCIPKLLPFFEDRTLLRDSIHILKNLCDTEEGRVTVVETKGCISSVVEILGTGSDEEKEPALIILLSLCSQRVEYCQLVVSEGIIPSLVNISNKGSDMAKAYALELLRLLKDDEFQYEDCCEPNLGASQEPNNHYQEKKSSKKPSILKKLSLFSKSSSVAPKTKR

SEQ ID NO: 224299 - protein, 123 aa, Glycine max
  Coding DNA Sequence Number=SeqID_107521
  Subcellular localization annotation: CTP_CleavageSite=51; ConfidenceScore=5.35e-01
MDFDAKLKKLSNIFFFTYFFFLKLGFLKAVLNFVPSEGRRFSSNGEERRVVGFGSNGGADSDNWNNKKSESNIGSSESVGVGGMPKLVLQPRTLSVSNEGDNVVKPKGVNLFGEVRPRDVEFS

SEQ ID NO: 224300 - protein, 69 aa, Glycine max
  Coding DNA Sequence Number=SeqID_107522
MEKIDIGKDQVDERVRKQRGNPSGVPSNKSKEQSSSLGYLPVRAVMDVNRPPGHTCGLCGSQAGGCDEK

SEQ ID NO: 224301 - protein, 338 aa, Glycine max
  Coding DNA Sequence Number=SeqID_107523
  Gene Ontology: Mol. function=histidine-tRNA ligase activity; Cellular component=cytoplasm; Biological process=tRNA aminoacylation for protein translation
  Homolog annotation: Hit_ID=Q9LZE8; Match level="QueryCoverage=78%, HitCoverage=68%, E-value=1e-76, Identity=59%"; Hit description =Histidyl-tRNA synthetase-like protein
  Pfam annotation: Domain name=tRNA-synt_2b; Domain location=100-282; Score=108.6; E_value=1.8e-29; Accession=PF00587.15; Description=tRNA synthetase class II core domain (G, H, P, S and T)
  Pfam annotation: Domain name=tRNA-synt_2d; Domain location=81-288; Score=-177.1; E_value=0.08; Accession=PF01409.10; Description=tRNA synthetases class II core domain (F)
  Pfam module annotation: Pfam domain module=tRNA-synt_2b::tRNA-synt _2d; Domain location=100-282::81-288
  Subcellular localization annotation: CTP_CleavageSite=75; ConfidenceScore=5.90e-01
MPATPFSCSFLTLQPRFNSYVNPIFRSLTFQLSSSPLPFNANFSSVRLHSSLSRAAETDSPTGGRSGALTPGPAVAGEVQKIDVNPPKGTRDFPPEDMRLRNWLFNHFKEVSRLYGFEEVDYPVLESEALFTRKAGEEIKDQPWRSSKVALWGLVGHEFESRNNLFAYARLYCFEDRGNRRVALRPELTPSLARLVIQKGKSVSLPIKWFTVGQCWRYERMTRGRRREHYQWNMDIIGVPGVMAEAELIASIVTLFKRIGITESDVGFKVSSRKNVSFEPNSTLQNQFNFQHTLLFRGDHNLGGFSYIPLKLKATFLERDRHMDSSRIGSDIMSECGF

SEQ ID NO: 224302 - protein, 93 aa, Glycine max
  Coding DNA Sequence Number=SeqID_107524
MKKVKKEEEQVPSKFQKSILIGCRKALRRDKTKKKNTWVSNLGVDQKSLEGGGIEVEGKEKVVKEEGKVMVEAVLGSDGVEDGRVKQKKKGIG

SEQ ID NO: 224303 - protein, 197 aa, Glycine max
  Coding DNA Sequence Number=SeqID_107525
  Gene Ontology: Mol. function=histidine-tRNA ligase activity; Cellular component=mitochondrion; Biological process=tRNA aminoacylation for protein translation
  Homolog annotation: Hit_ID=O82413; Match level="QueryCoverage=100%, HitCoverage=26%, E-value=5e-31, Identity=77%"; Hit description =Histidyl-tRNA synthetase
IEKIPADEIKKELKAVGLSQEAVQELLQVLSVKSLTELEERLGSSGEAVADLKQLFSLAEKIGYSKWLQFDASVVRGLAYYTGIVFEDVGSGNHPFSSPFTFTNPNNHPPSLASSSLCSLAATVIATSSSPLYPFDQFDLANPDPNNIEKENAHKDRLRGKLRAICGGGRYDHLFSTFGADDIAACGFGFGDAVIVE

SEQ ID NO: 224304 - protein, 256 aa, Glycine max
  Coding DNA Sequence Number=SeqID_107526
MISVLILLNIQSTLGTEPLRAFYSPYLFLTGYAKTIESDGMQRQIMVICPLLSKNSMSFDRDYYSLPSPTRDKDNRVRWHAETNYGHLSLFVEDFNVFRPKLLESPLCQPETSESVGIRRQIMVIRHLCYLETIESDSMQRQIMVIRHPYQPETSKYVGMQRQIMVTRFRCHPETIESDGTQRQIMVICSLLSKTLMSFDRDYYSLPFVNQRQQNGERYQPFNVKQSGVEAAKTQFLVGKRRIKSLQFKSSKQNSE

SEQ ID NO: 224305 - protein, 577 aa, Glycine max
  Coding DNA Sequence Number=SeqID_107527
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q6H7M3; Match level="QueryCoverage=99%, HitCoverage=58%, E-value=0.0, Identity=71%"; Hit description =Putative copper-transporting P-type ATPase
  Pfam annotation: Domain name=E1-E2_ATPase; Domain location=1-241; Score=270.9; E_value=2.5e-78; Accession=PF00122.10; Description=E1 -E2 ATPase
  Pfam annotation: Domain name=Hydrolase; Domain location=245-479; Score=128.3; E_value=2.1e-35; Accession=PF00702.16; Description =haloacid dehalogenase-like hydrolase
  Pfam module annotation: Pfam domain module=E1-E2_ATPase::Hydrolase; Domain location=1-241::245-479
MMISFILLGKYLEIVAKGKTSDALGKLTQLVPDKAYLVAIDTDGNIMTETEIDTQLIQKNDIIKIVYGSKIPVDSIVIKGQSYANESMITGEARPVDKSPGDKVISGTINENGCLLVKATHVGSDTALSQIVQLVEAAQLAKAPVQQLADHISRVFVPIVVVAALITWLGWFIPGEAGIYPKHWIPKAMDAFELALQFAISVLVVACPCALGLATPTAVMVASGMGASQGVLIKGGDALEKAHKVKIVVFDKTGTLTIGKPEVVSAVLFSEFSMEELCDMTIYVEASSEHPIAKAVVAHAKRLRQKFGSCIEEVPDVDDFEVHMGAGVSGKVGDRTVVVGNKRLMHACNVPICSEVEKYISENEILARTCILVSIDGKIAGAFSVTDPVKPEAKRVISFLHSMGISSIIVTGDNCATATAIANEVGIDEVFAETDPVGKADKVKDLQMKGMTVAMVGDGINDSPALVAADVGMAIGAGTDIAIEAADIVLVKSSFEDVITAIDLSRKTMSRIRLNYIWALGYNILGLPIAAGVLYPIAGIRLPPWLAGACMAASSLSVVSSSLLLQFYKKPLHIESS

SEQ ID NO: 224306 - protein, 604 aa, Glycine max
  Coding DNA Sequence Number=SeqID_107528
  Gene Ontology: Mol. function=peptidyl-prolyl cis-trans isomerase activity; Cellular component=nucleus; Biological process=protein folding
  Homolog annotation: Hit_ID=Q38931; Match level="QueryCoverage=86%, HitCoverage=92%, E-value=0.0, Identity=64%"; Hit description=70 kDa peptidyl-prolyl isomerase
  Pfam annotation: Domain name=FKBP_C; Domain location=165-260; Score =96.3; E_value=9e-26; Accession=PF00254.18; Description=FKBP-type peptidyl-prolyl cis-trans i
  Pfam annotation: Domain name=FKBP_C; Domain location=282-381; Score =113.6; E_value=5.8e-31; Accession=PF00254.18; Description=FKBP-type peptidyl-prolyl cis-trans i
  Pfam annotation: Domain name=FKBP_C; Domain location=49-143; Score =200.3; E_value=4.5e-57; Accession=PF00254.18; Description=FKBP-type peptidyl-prolyl cis-trans i
  Pfam annotation: Domain name=TPR_1; Domain location=423-456; Score =5.5; E_value=1.2; Accession=PF00515.18; Description=Tetratricopeptide repeat
  Pfam annotation: Domain name=TPR_1; Domain location=472-505; Score =19.1; E_value=0.015; Accession=PF00515.18; Description =Tetratricopeptide repeat
  Pfam annotation: Domain name=TPR_1; Domain location=506-539; Score =27.9; E_value=3.7e-05; Accession=PF00515.18; Description =Tetratricopeptide repeat
  Pfam annotation: Domain name=TPR_2; Domain location=423-456; Score =15.3; E_value=0.23; Accession=PF07719.7; Description=Tetratricopeptid e repeat
  Pfam annotation: Domain name=TPR_2; Domain location=472-505; Score =15.4; E_value=0.2; Accession=PF07719.7; Description=Tetratricopeptide repeat
  Pfam annotation: Domain name=TPR_2; Domain location=506-539; Score =23.1; E_value=0.00097; Accession=PF07719.7; Description =Tetratricopeptide repeat
  Pfam module annotation: Pfam domain module=FKBP_C::FKBP_C::FKBP _C::TPR_1::TPR_1::TPR_1::TPR_2::TPR_2::TPR_2; Domain location=165 -260::282-381::49-143::423-456::472-505::506-539::423-456::472 -505::506-539
MDEDFDMAAAEPMGEDFDFAGSGSNPVLKVGEEKEIGKEGLKKKLLKEGEGWDTPEAGDEVQVHYTGTLLDGTKFDSSRDRGTPFSFTLGQGQVIKGWDQGIITMKKGENALFTIPAELAYGESGSPPTIPPNATLQFDVELLSWTSVKDICKDGGLFKKILTEGEKWENPKDPDEVLVKYEAHLEDGTLVAKSDGVEFTVNDGHFCPAFSKAVKTMKKGEKVLLTVKPQYGFGEKGKPAHGDEGAVPPNATLQITLELVSWKTVSEVTDDKKVIKKILKEGEGYEHPNEGAIVKLKVIGKLQDGTLFLKKGHDDEGGLFEFKTDEEQVIDGLDRAVLTMKKGEVALLTIAPEYAFGSSESQQELAVVPPNSTLYYEIELVSFEKKLLLERNANHHAVLIKQNSFEKEKESWDMDTPEKIEAAGKKKEEGNALFKAGKYARASKRYEKAVKFIEYDTAFSEEEKKSSKSLKVACNLNNAACKLKLKDYKQAEKLCTKVLDLESTNVKALYRRTQAYIQLADLDLAEFDIKKALELEPNNRDVKLEYVTLKEKMKEYNKKEAKFYGNMFNKLHKLDSLDNSGMLGKFNFVSQGLVVPSSMERKKK

SEQ ID NO: 224307 - protein, 103 aa, Glycine max
  Coding DNA Sequence Number=SeqID_107529
MTSENVDWKLRVGLEFENIEVWEFWTGYSRKVGYGVRRHFQNKPKKMIIGVFCNWVPRRRSSPIKFEISGGYFVVVAAKGITGLSSTHLQLWRIVKQSKKRWF

SEQ ID NO: 224308 - protein, 297 aa, Glycine max
  Coding DNA Sequence Number=SeqID_107530
MVFMPYSREQQEEGLMFDKDWEKDITQETMDVMLYGKPCPNTTNRKAFVSLLRTTNLMYICRLIHSFLFNIVMPRLGSRDYVCDRDKLCMYKVMVSEKVNLPEIIRNDRVDVFVLEPPVDITQLKGVTFVKMGIANNFPEYAQNKKEDVAFAKAKKKSLAESRKKDKIGKTLEMKDAIEEEDGIITFVEALSIKEHKKKLVKDARIVTEEATMVDVDGDPVPVEVIVESIQTQFKLKVEVAIIPEDLDPKEKEALEKAMVQSILEVSLNEYEDNIIETDPGAAAIVTTCLIATISLL

SEQ ID NO: 224309 - protein, 330 aa, Glycine max
  Coding DNA Sequence Number=SeqID_107531
  Homolog annotation: Hit_ID=Q41649; Match level="QueryCoverage=27%, HitCoverage=60%, E-value=6e-41, Identity=88%"; Hit description=FK506- binding protein 2 precursor
  Pfam annotation: Domain name=FKBP_C; Domain location=232-314; Score =134.4; E_value=3e-37; Accession=PF00254.18; Description=FKBP-type peptidyl-prolyl cis-trans i
MGVKFLEAVKRRFHSIKQWSPDEIREKPKGGHFHHLLIASLSWLRRNPYTCKFGVAWWDPVPSVGEVNGGCISFGMDGQVTLHLRPRLLQILCCSKPLPTCFDPDWTTILLHRLVIRDGSNSFWHMLVLLPDWGVVDFTMIKGLSSLITRPYESPWSSHCIVNKKGPDARLRSRLRIVIGLAVGIVGRHNCNPCCCGCGQQNDDGVEGVWFTKAIEEKNDTKPWSGERRRTWSKYTKGKLTDGTVFDSSFERNNPIEFELGTGQVIKGWDQGLLGMCLGEKRKLKIPSKLGYGEQGSPPTIPGGATLIFDAELVGVNDKSLGEGKGNNEL

SEQ ID NO: 224310 - protein, 406 aa, Glycine max
  Coding DNA Sequence Number=SeqID_107532
SQMSNSGVEGEIEKKALWFRGAVLVAKEGASNRMAFRISIDSFAYALGAALPLLIAIFFSVFFAGYKPACERKRLSSVEEAPKYEQVLSGVESDNLDKCESCRSVKLIKPPSLDKVHVASIKLAGVDTFLVLQARYDVSGVCGACIVLLHTCHSWSGDILELWCVGVRFKNPRWTRRLFPLAVPPRRILIMGPLTVNPLPQKGGFVLYWWRHLSPLWEARRCGGDVRVSPRGRCNHSVGLPSPLRSDDFPFLRVTLGSLPFFFMYKCLFEVLGLILLLTAFQCALLEHLNVAPSQLHPNSWAMPRAFKILCPFLNIRPNVSVFLFFLQMKLNGKIGWASLNSVSNKLFKFDSNIFRRFKDYFVRVLATDVVANGSIDSCEEGQQIYFGTTSGLARRAGHHVSSLDE

SEQ ID NO: 224311 - protein, 495 aa, Glycine max
  Coding DNA Sequence Number=SeqID_107533
  Gene Ontology: Mol. function=transferase activity; Cellular component= membrane; Biological process=protein metabolic process
  Homolog annotation: Hit_ID=Q6UDF0; Match level="QueryCoverage=95%, HitCoverage=90%, E-value=0.0, Identity=89%"; Hit description=Beta-1 ,4-mannan synthase
  Pfam annotation: Domain name=Glycos_transf_2; Domain location=95-274; Score=20.2; E_value=2.6e-05; Accession=PF00535.16; Description =Glycosyl transferase
MRNLIFEEPEVRVPGDTSSSLRYAWESIRAPVIIPLLKLAVILCSIMSIMLFVERVAMAIVILVVKVLGKKRYTKYNLEAMKQKLERNKRFPMVLIQIPMYNEKEVYKLSIGAVCGLSWPADRFIVQVLDDSTNQSLRECVQMECQRWIQKGVNVKYETRTNRNGYKAGAMKEGLEKEYVEDCEYVAIFDADFQPDADFLWNTIPYLLENPKLGLVQARWKFVNSKECMMTKLQEMSLDYHFSVEQEVGSSTYSFFGFNGTAGIWRIQAIKDAGGWKDRTTVEDMDLAVRASLQGWEFVFVGDIKVKNELPSTFKAYRYQQHRWSCGPANLFKKMTMEILYCHRVPLLKRLHLVYAFFFVRKIVAHWVTFFFYCIVIPACVIVPEVSLKKQIAIYIPATITILNAVSTPRSMHLLVLWILFENVMSLHRTKAAIIGLLEANRVNEWVVTEKLGNAMKQRKNAKPSRTSWFRIIDRQELSLQWDLGKWEQLYPTKA

SEQ ID NO: 224312 - protein, 338 aa, Glycine max
  Coding DNA Sequence Number=SeqID_107534
MGVGDILRSSSSMVFGWCRRKTLAPMHHSRSSQLRLHISGSDIRRCNNCLRVCIESNITKKIWTWCRLGWLHIPISFSQWKLGIRRLRRILGVISMECKDYYFQCQRVAGWLKRSRLRSFLVSNKVDMCMIQETKVGVMKEMVVREIWGKKGYHWVAAPSIGMSGEYKWGAKPFKFFNFWSQHPSLKKVDLESWSQPCGVQWKLYAFKEKLKALKLSLKAWCKQEFQKVDSQIETIERDLNDLDAKLIAGKEIFGGFYRSKLHNESRLIQRIFYDNKGDEKKLKESRNEFKMFKIESRTLQGSRGNLISRIKNQDSRFKLPRIKIKIQDSRFKNQEKN

SEQ ID NO: 224313 - protein, 1370 aa, Glycine max
  Coding DNA Sequence Number=SeqID_107535
  Gene Ontology: Mol. function=ATPase activity, coupled to transmembrane movement of substances; Cellular component=integral to membrane; Biological process=auxin mediated signaling pathway
  Homolog annotation: Hit_ID=Q9ZR72; Match level="QueryCoverage=94%, HitCoverage=98%, E-value=0.0, Identity=79%"; Hit description =Multidrug resistance protein 1
  Pfam annotation: Domain name=ABC_membrane; Domain location=778-1057; Score=161.5; E_value=2.2e-45; Accession=PF00664.13; Description=ABC transporter transmembrane region
  Pfam annotation: Domain name=ABC_membrane; Domain location=97-374; Score=137.5; E_value=3.6e-38; Accession=PF00664.13; Description=ABC transporter transmembrane region
  Pfam annotation: Domain name=ABC_tran; Domain location=1132-1316; Score=237.9; E_value=2.2e-68; Accession=PF00005.17; Description=ABC transporter
  Pfam annotation: Domain name=ABC_tran; Domain location=449-661; Score= 209.3; E_value=8.7e-60; Accession=PF00005.17; Description=ABC transporter
  Pfam annotation: Domain name=SMC_N; Domain location=1125-1320; Score=- 125.6; E_value=0.02; Accession=PF02463.9; Description=RecFRecNSMC N terminal domain
  Pfam module annotation: Pfam domain module=ABC_membrane::ABC _membrane::ABC_tran::ABC_tran::SMC_N; Domain location=778-1057::97 -374::1132-1316::449-661::1125-1320
MSKDSEEIKTIEQWKWTEMQGLELVPEEGAAAAPSQHHQLPMEMNTSEPPNKDVVGASSSSAAVTNGEKKEKEKESVPSVGFGELFRFADGLDYVLMGIGTVGAVVHGCSLPLFLRFFADLVNSFGSNANDVDKMTQEVVKYAFYFLVVGAAIWASSWAEISCWMWSGERQSTTMRIKYLEAALNQDIQFFDTEVRTSDVVFAINTDAVMVQDAISEKLGNFIHYMATFVSGFVVGFTAVWQLALVTLAVVPMIAVIGGIHTATLAKLSGKSQEALSQAGNIVEQTVAQIRVVLAFVGESRALQSYSSALRIAQKIGYKTGFAKGMGLGATYFVVFCCYALLLWYGGYLVRHHATNGGLAIATMFAVMIGGLGLGQSAPSMAAFTKARVAAAKIFRIIDHKPNIDRNSESGIELDTVTGLVELKNVDFSYPSRPEVQILNDFSLNVPAGKTIALVGSSGSGKSTVVSLIERFYDPTSGQVLLDGHDIKTLKLRWLRQQIGLVSQEPALFATTIRENILLGRPDADQVEIEEAARVANAHSFIIKLPDGYETQMRFVQKSKPGNACLCIASAKDQEEVDEMVGERGLQLSGGQKQRIAIARAMLKNPAILLLDEATSALDSESEKLVQEALDRFMIGRTTLVIAHRLSTIRKADLVAVLQLGSVSEIGTHDELFSKGENGVYAKLIKMQEMAHETAVNNARKSSARPSSARNSVSSPIIARNSSYGRSPYSRRLSDFSTSDFSLSLDASHPSYRLEKLAFKEQASSFWRLAKMNSPEWLYALIGSIGSVVCGSLSAFFAYVLSAVLSVYYNPDHRYMIREIEKYCYLLIGLSSTALLFNTLQHFFWDIVGENLTKRVREKMLMAVLKNEMAWFDQEENESARIAARLALDANNVRSAIGDRISVIVQNTALMLVACTAGFVLQWRLALVLVAVFPVVVAATVLQKMFMTGFSGDLEAAHAKATQLAGEAIANVRTVAAFNSETKIVGLFTTNLQAPLQRCFWKGQISGSGYGVAQFALYASYALGLWYASWLVKHGISDFSKTIRVFMVLMVSANGAAETLTLAPDFIKGGQAMRSVFELLDRRTEIEPDDQDATLVPDRLRGEVELKHVDFSYPTRPDMPVFRDLSLRARAGKTLALVGPSGCGKSSIIALIQRFYDPTSGRVMIDGKDIRKYNLKSLRRHISVVPQEPCLFATTIYENIAYGHESATEAEIIEAATLANAHKFISGLPDGYKTFVGERGVQLSGGQKQRIAVARAFLRKAELMLLDEATSALDAESERSVQEALDRASSGKTTIIVAHRLSTVRNANLIAVIDDGKVAEQGSHSQLLKNHPDGIYARMIQLQRFTHSQVIGMASGSSSSTRPKDDEREG

SEQ ID NO: 224314 - protein, 106 aa, Glycine max
  Coding DNA Sequence Number=SeqID_107536
  Gene Ontology: Mol. function=DNA binding; Cellular component=nucleus; Biological process=regulation of transcription
  Homolog annotation: Hit_ID=Q0PJF9; Match level="QueryCoverage=62%, HitCoverage=68%, E-value=1e-17, Identity=61%"; Hit description=MYB transcription factor MYB164
  Pfam annotation: Domain name=Myb_DNA-binding; Domain location=2-50; Score=29.6; E_value=1.1e-05; Accession=PF00249.21; Description=Myb -like DNA-binding domain
MASSWTPRQNKQFERALAKYDRETPDRWQNVANEVGKSVEEVKRHYEILKEDIRRIERGQVAFPYRTNNSNRRWNLEAMAGKSGAPYLKKSESMGTDKFILEGNKW

SEQ ID NO: 224315 - protein, 96 aa, Glycine max
  Coding DNA Sequence Number=SeqID_107537
  Gene Ontology: Mol. function=DNA binding; Cellular component=nucleus; Biological process=regulation of transcription, DNA-dependent
  Homolog annotation: Hit_ID=Q8GW75; Match level="QueryCoverage=63%, HitCoverage=63%, E-value=4e-19, Identity=69%"; Hit description =Putative myb-related protein
  Pfam annotation: Domain name=Myb_DNA-binding; Domain location=2-50; Score=24.8; E_value=0.0003; Accession=PF00249.21; Description=Myb -like DNA-binding domain
MESSWTPRQNKIFEHALAIYDRETPDRWQNIAKMVGKSIEEVKMHYEILKEDIKRIEQDQVPFPYAGYVQVAHSANLNSLFHAWQAHDTYISRTPN

SEQ ID NO: 224316 - protein, 100 aa, Glycine max
  Coding DNA Sequence Number=SeqID_107538
MILEEREKLIKVINEKNLLLTKKIEIVDDLANYEKMMQQVFMMGHENGFQKALHQVALFASMIILKNFDVLKDVKNKEIARESQMESFEDAYGNGANSKE

SEQ ID NO: 224317 - protein, 110 aa, Glycine max
  Coding DNA Sequence Number=SeqID_107539
MASNLQIRGTKNFCNSSELNTWCPQLSIPRPMGMLKQQTRLTYATNAMIQVEIGEPLARKAHFEEALNDEGLTFKLHMIEEMREHAQIQEKACKRRETRKHQSKLKRRKF

SEQ ID NO: 224318 - protein, 106 aa, Glycine max
  Coding DNA Sequence Number=SeqID_107540
  Homolog annotation: Hit_ID=Q1RV13; Match level="QueryCoverage=71%, HitCoverage=18%, E-value=4e-08, Identity=38%"; Hit description=IMP dehydrogenase/GMP reductase
MVDGINALDVKDESEGLQKIPFSMDPSPFNVLCIKALLRYFELVLGLKVNFRESCLANVGVEESCISRYPRWLNYCVMDIPFVYLGIFIGVNLRNEMAWVPIIKKL

SEQ ID NO: 224319 - protein, 314 aa, Glycine max
  Coding DNA Sequence Number=SeqID_107541
  Gene Ontology: Mol. function=DNA binding; Cellular component=nucleus; Biological process=regulation of transcription
  Homolog annotation: Hit_ID=Q9ZPW7; Match level="QueryCoverage=65%, HitCoverage=68%, E-value=3e-45, Identity=48%"; Hit description =Expressed protein
  Pfam annotation: Domain name=Homeobox; Domain location=252-312; Score= -5.3; E_value=0.018; Accession=PF00046.19; Description=Homeobox domain
  Pfam annotation: Domain name=ZF-HD_dimer; Domain location=104-163; Score=130.5; E_value=4.6e-36; Accession=PF04770.3; Description=ZF-HD protein dimerisation region
  Pfam module annotation: Pfam domain module=Homeobox::ZF-HD_dimer; Domain location=252-312::104-163
MREQDKVIEMPSTLDYNNSSSSPKLSSPIGERCDQLPPHQSHTLVFTDPPQTSSHHHNLYPPSLPPNPLQLPQPHHRPRRDPDPSPIISPPRTTPPQPQPHTTTTLFRYRECLKNHAASMGGHVTDGCGEFMPNGEEGTPESFKCAACECHRNFHRKEPHQGVVLESQLLQHVLNKNSRNINILHSPHSHHVLHGVVGGPVQPVMLGFGGSGPAESSSEDLNMFQTLDHRGGGNLLSSSVQQPPLSSSSSKKRFRTKFTQQQKDRMMEFAEKLGWKIQKQDEQELHQFCSQVGVRRQVFKVWMHNSKQAMKKKQ

SEQ ID NO: 224320 - protein, 106 aa, Glycine max
  Coding DNA Sequence Number=SeqID_107542
MTHHNDFQDYFDDAKESRVKQVPKNQASGIKSQIIKIQEQLSFKIQDSRTIKIKIQEQSKSRLKTQDSREIDFKIQERKSRSNNQDFTREVITLPMLFLTRHEEFM

SEQ ID NO: 224321 - protein, 98 aa, Glycine max
  Coding DNA Sequence Number=SeqID_107543
MLQHFDARISSPWVVPWELAMVAKLAMVAEVDVVAATLHEGCQNQLQWRRRSKSNMYMNKVNNTNIEIHKWPQDSNNIDNMVESTTNSFQHKKEWNHQ

SEQ ID NO: 224322 - protein, 382 aa, Glycine max
  Coding DNA Sequence Number=SeqID_107544
  Gene Ontology: Mol. function=RNA-directed DNA polymerase activity; Cellular component=intracellular; Biological process=RNA-dependent DNA replication
MRRRKTKNEEFLKHLKTLKEVPSEEEVENDGNKPVIISGSIFPMEEEKLIDVLKANKESITQPQRQLNPIMKKEVRKEVLKILEVNMIYPILDNLWVSSVQVVPKKGGMMIVCNTKNELIPTRIITGWRMCIDYCKLNQATRKDHFPFPFMNQMLERLASQAFYCFLDGYNQIAVDPKDQEKISFTSPFVVFAYKRMSFGLCNALTTFQRGNCLGHKISSKGIKVDKAKLMLLRNYLILSMLRVFEAFSSMWGSIDEFDLEIKEKKGCENVVADHLSRLVNEEVTLIEKDFLDKFPDGFLLVVHERPCFSNMENFKVTGVIPKDFNWHQRKMFFHDAHQYVWDDLHLFKIGANNLLRRCVSKVDYVFKWVEAIRAPKSYAKR

SEQ ID NO: 224323 - protein, 82 aa, Glycine max
  Coding DNA Sequence Number=SeqID_107545
  Gene Ontology: Mol. function=DNA binding; Biological process=DNA integration
  Homolog annotation: Hit_ID=Q1SKC8; Match level="QueryCoverage=71%, HitCoverage=14%, E-value=2e-15, Identity=64%"; Hit description =Integrase, catalytic region
MTLNSYESSKHYKPKVKTYHDKKILHKEFRPGQQVLLCNSNLKVFPEKLKSKWYGPFIVKELKELPPLCFSITLEVFGTSSS

SEQ ID NO: 224324 - protein, 114 aa, Glycine max
  Coding DNA Sequence Number=SeqID_107546
MAFKFKKDALRTITQIWMSFALSNVAPTLHTFNLNRQHASLIYCILANILINIGKVISDKIHSLPSSKNFGEEDSTDKPLVFPALIIALCAYQRAKMFVRSLKSLKKLITKEED

SEQ ID NO: 224325 - protein, 388 aa, Glycine max
  Coding DNA Sequence Number=SeqID_107547
  Gene Ontology: Mol. function=RNA-directed DNA polymerase activity; Cellular component=nucleus; Biological process=RNA-dependent DNA replication
MARRALWINLYNISAAMSYPWLLIGNFNSILSPFDRFNGAEASAYELKDFAECYADLGPGGNNSHGPGHQMNGSGIFKVCKRLKSLKAPLKLLYKQEFSHISNRVELAEANYSSLLCSLRQNPHDSSLLAQANRARGQLIMLRKAKTMKIAQLITNKYLLQADKCSKFFHALIKRNRHHHFIAAIRLDNEHLQPASMSICKLGPKVSPECFAALLRPITKQDVWDVIFVMDNNKSSGPNGYNVFFFKKAWNIIGDDIFAAINEFFIIGKILKQINHAIIALILKTDHASQVNHFRPISCCNLLYKIVSKILANRIAPVLENIIGESQSAFLKNRKMMDNIFHIQELLRKYTRKRISPKCLLKIDLHKAYDSISWEFLDWMLKSVGFPA

SEQ ID NO: 224326 - protein, 193 aa, Glycine max
  Coding DNA Sequence Number=SeqID_107548
  Gene Ontology: Mol. function=RNA-directed DNA polymerase activity; Biological process=RNA-dependent DNA replication
  Subcellular localization annotation: CTP_CleavageSite=72; ConfidenceScore=5.15e-01
MSQGYQLAPVNLPSTQLEWVQKCFLISSSFSLANFPFRYLGVPFLSSRLNVCHYAPLLSHITCLIQGWSRKSLSYAGKVELIRAVIQGIANFWMSIFPLPQSVLDTIIATCRNFLWGKADGGKIKPLVAWSEVCTPKKEGGRLRGRCMITSEGPDLLSTGVLLFGIQSFRQRCPLFCGLLPRTVCSLLTELPS

SEQ ID NO: 224327 - protein, 109 aa, Glycine max
  Coding DNA Sequence Number=SeqID_107549
MASANAIDLNLLKFETEEDLNQVLSEGPYFIFQRPLLLKVMHAFFDFGNEELSKIPVWVKLRNFPLELWNPQALGKILSKIGPPPPPHSHRPLDNIQGIYLICPCSGGN

SEQ ID NO: 224328 - protein, 58 aa, Glycine max
  Coding DNA Sequence Number=SeqID_107550
MAQEEETSTDQMPEPSPASVPEETQPSAPVMEPEQPIQDSSAALTLDLNEDQSPDEHD

SEQ ID NO: 224329 - protein, 256 aa, Glycine max
  Coding DNA Sequence Number=SeqID_107551
  Gene Ontology: Mol. function=acetylesterase activity; Biological process=xylan catabolic process
  Homolog annotation: Hit_ID=Q83V97; Match level="QueryCoverage=98%, HitCoverage=77%, E-value=5e-46, Identity=39%"; Hit description =Pectin acetylesterase precursor
  Pfam annotation: Domain name=Abhydrolase_3; Domain location=15-222; Score=-25.8; E_value=5.2e-06; Accession=PF07859.3; Description =alphabeta hydrolase fold
  Pfam annotation: Domain name=Peptidase_S15; Domain location=2-214; Score=-107.9; E_value=0.029; Accession=PF02129.9; Description=X-Pro dipeptidyl-peptidase (S15 family)
  Pfam annotation: Domain name=Peptidase_S9; Domain location=31-245; Score=-11.2; E_value=1e-06; Accession=PF00326.11; Description=Prolyl oligopeptidase family
  Pfam module annotation: Pfam domain module=Abhydrolase_3::Peptidase _S15::Peptidase_S9; Domain location=15-222::2-214::31-245
MIYVPATGKNNHAAVLIIPGGGFSYIMKDLEGLDVANVLSKQGYASFVLIYRLPHDGSAQYRQQAFADTQRALRLIRANAQQYRVAPDRIGVMGFSAGAFLAANLSNTPDEANYQAVDAQDKVSARPDFSALIYPVLSLKQGVTHPGTRAALYGKDLSAQQMAQLSQEDRVSAHTPPTFLVQALNDGTASPQNTLGMFSALRQNKVNVELHLFQQGGHGFGTGQKQHLPVQNWLTLFHAWQSSLVKRTPSVSLPRI

SEQ ID NO: 224330 - protein, 216 aa, Glycine max
  Coding DNA Sequence Number=SeqID_107552
MVIDQSLFFELTQLSSDGVPFKGTLDDEWKFDFSVSDARQMVCTNQADMIGRLLAGSLAFECRIMHYLIVRILLPRSSNLAQVSEEDLIIMWVFLTGRQIDWAHLPFVKVKRSFSISANVVSSFGYRKKRDGSWVKKGAQPNDDEGHLPVEGNSSLLQSILDRFDGLQTYVGERFDSLERQVDTQFEEINSRIAKVEEYVTIIHDCLDLPPPPPSS

SEQ ID NO: 224331 - protein, 114 aa, Glycine max
  Coding DNA Sequence Number=SeqID_107553
MTYSSWQNKLNKYFMFKTLVMKGGLWQMTTPPSFPLPHPNDAALHSPYTLKRTRPIRAERPLVHVDLAMGKADGPHRKKLRTYLGIVARDKVDVTYKNWKQVPAAQKDLIWEDI

SEQ ID NO: 224332 - protein, 278 aa, Glycine max
  Coding DNA Sequence Number=SeqID_107554
  Homolog annotation: Hit_ID=Q47AJ0; Match level="QueryCoverage=87%, HitCoverage=71%, E-value=7e-18, Identity=29%"; Hit description =Hypothetical protein precursor
MMHTSIWQRGVAVWVVLLLLSGAGGWILYTASNTLSARHLMMQKTITSLALAQQALLAYAQQPLGVTQCESNCPRPGDLPCPDRNNDGIAETSCSNTARLGRLPWKTLGIGDVRDGSGERLWYAVSERYKNNPRILPLNLDTSGTWSMLSAEGVLWDATQGDGLVAVLIAPMQPLVREDGWVQQREEASSEIAKHYLDIHGLDNANPVEKTVNGFVMAVSSPHFNDVVWPITTGHMHQQMQKQVLSELKRSLRCAVAPCTAYPSPAATEDDRCLGFQS

SEQ ID NO: 224333 - protein, 48 aa, Glycine max
  Coding DNA Sequence Number=SeqID_107555
MGLNQFRFSTWSMTSLSRGKRKDRSGVKYFEVVKRRSHPTKQMVPGRN

SEQ ID NO: 224334 - protein, 70 aa, Glycine max
  Coding DNA Sequence Number=SeqID_107556
MLLLRVVHVSSTIKCEASGDWEARYSVVFQIGSFAKRKKEEVEMRVIITERAGLTKSVSYLCFPLISDER

SEQ ID NO: 224335 - protein, 114 aa, Glycine max
  Coding DNA Sequence Number=SeqID_107557
MSHAVKDHRGKWAPNYEGPFVVKRAFSGGALVLTNMDGEELPSPGQDHLGLPSGGETKHERQKPIKVLRDERKRGWGHDRPIVAFLCAKRAENVAARQPRILCILQLSFTICLF

SEQ ID NO: 224336 - protein, 37 aa, Glycine max
  Coding DNA Sequence Number=SeqID_107558
MSAEGWKEPDIYRSGMKLQIMCSLENNEKMLEIDGLL

SEQ ID NO: 224337 - protein, 233 aa, Glycine max
  Coding DNA Sequence Number=SeqID_107559
  Homolog annotation: Hit_ID=Q8H6Q8; Match level="QueryCoverage=69%, HitCoverage=5%, E-value=3e-31, Identity=41%"; Hit description=CTV.20
  Subcellular localization annotation: CTP_CleavageSite=58; ConfidenceScore=5.14e-01
MASESDDDFETDMQKQIQKAKQTKTVYNQRPSQSLTQQESTSQPSNSYISKNKFFNVLQMEPEYWDKNPFKATAKVFPPGFHYRPIATNKTRKFYEFILIDTNSVSIKHFKDPKDPNLNTHSTIQILKVMQPRHYGSNLNQPKKFSAPFDPAGYNYWDYIDAWTNVFWHQNSKFKHSWLIYFKNNTVYNFPNWFLQWWNYFGPIPQIFPEEVQQGSNNSTSSIIARNHVFQQI

SEQ ID NO: 224338 - protein, 292 aa, Glycine max
  Coding DNA Sequence Number=SeqID_107560
  Gene Ontology: Cellular component=membrane
  Homolog annotation: Hit_ID=Q3BYI7; Match level="QueryCoverage=99%, HitCoverage=37%, E-value=1e-28, Identity=31%"; Hit description=Small- conductance mechanosensitive channel
MAAVEPGRHRRAEAAQVRVGRGGTGLAEYGAGRPRSGHAYQRRHHGGAGWPDCPDLPRPDHGHAGDPGTPASPADRRGRGQAGGTGRWRGRGHAGAPQQLAGIGTRGGQRRGGGRHRRDVAGLPEFRQVREPAVDWRQHRGAGGDPAVQQGGPDHPAQHRPERVAPGAGRRAAVGGAAYRGCAAHAACTGGTVRQHRRSGGSIHFSVHDRLRYRWYQAGTGRDRDGGTGAAGRPGDHPAGAALADRHLPAQDRTGSGRTQFGQHRRPLRRHHHRGDLGPERDGTAAEQAGTA

SEQ ID NO: 224339 - protein, 134 aa, Glycine max
  Coding DNA Sequence Number=SeqID_107561
  Homolog annotation: Hit_ID=Q64EX4; Match level="QueryCoverage=92%, HitCoverage=37%, E-value=2e-26, Identity=48%"; Hit description=MtN19- like protein
MDMRRNGCSTSWSLIHVVHKIRKPALNDNLQCKQIEGFQGSRRMVSLRYKISWVDWNIYQIPVKVYILDSTDKVRSNGSKILHDCLAEYTIPAGGGGDSPHVQKANIPMENGGYLIYGTAHMHSGDEQYFSPFL

SEQ ID NO: 224340 - protein, 58 aa, Glycine max
  Coding DNA Sequence Number=SeqID_107562
MVCNLTSAILNRLARISEFWLSAAFLAQQMDCNGGLSGMDFHSTNMHSSSFFQILPRT

SEQ ID NO: 224341 - protein, 280 aa, Glycine max
  Coding DNA Sequence Number=SeqID_107563
  Gene Ontology: Mol. function=DNA binding
  Homolog annotation: Hit_ID=Q1SFS3; Match level="QueryCoverage=80%, HitCoverage=43%, E-value=7e-28, Identity=34%"; Hit description =Lambda repressor-like, DNA-binding
MRPLQRQAFHKVYGKILDLATAEVFTEAVVSLAQYYDQPLRCFTFGDFQMVPTIEEFEEILGCPLGGRKPYLYSGFLPSLSKIAAVVGDSAKELDRTKQTRNDVVGLPRKYLEGKARDMPSQEKWGPFADILALLIFGVVLFPNVDGLVDLAAIDAFLAYHHSKESPVVAILADLFDTFDWRCEKNSARIVCCLPALCVWLISHLFQQDTRHPCHHSNIEYLRRLAVLAPSSHFWLPFAFIFGVIVHSNNNGACHIAPILLQFMSKRAPTKCSVKCPNDI

SEQ ID NO: 224342 - protein, 152 aa, Glycine max
  Coding DNA Sequence Number=SeqID_107564
MWFDLISFRWHQRRAWHLPHLPKSDMTDQVVPRKILQERNMVIYHTEFDDFKEELERRNWHEELTNFAQGSIDVAIVKEFYANLYDLEDKSPKQVRVRGHLVKFDEDALNIFLKTPMITEEGETLSAYSIFALLRPDPQELAANVPSFSYIS

SEQ ID NO: 224343 - protein, 103 aa, Glycine max
  Coding DNA Sequence Number=SeqID_107565
MPRIHDAILYYNGKWNMPPQNKFVGCAFTGKNPKKFQIPSTCTIDELKNLIKQVAPKGIPPLGIHESQTVRRLFFCQPAQFEYSDTVIKYEINELITNEELLK

SEQ ID NO: 224344 - protein, 147 aa, Glycine max
  Coding DNA Sequence Number=SeqID_107566
MATAEALERETKKARKEEHDELKAYLRSKRNLSQQLSETEGNMWAVIDECKEKLNLAATHEQRLEDEYAKISAESEARERVIDSWHQEATMWTDRFALTLNRSQELPRLLAKAKAMADTYSAPKKIHRLLSYCQQMIDLMDHMIRNR

SEQ ID NO: 224345 - protein, 93 aa, Glycine max
  Coding DNA Sequence Number=SeqID_107567
MKDKWDFQARPAWATRAPKTVQYLISILVPRIALYRAKHFVSIYIWSSLSFKLGISHPDLFFRLSSFQSSSGSCSCLSILCPLLVPFSFTMEM

SEQ ID NO: 224346 - protein, 136 aa, Glycine max
  Coding DNA Sequence Number=SeqID_107568
  Gene Ontology: Mol. function=transition metal ion binding; Biological process=cytoskeleton organization and biogenesis
  Pfam annotation: Domain name=Transposase_21; Domain location=19-136; Score=-43.9; E_value=7.3e-11; Accession=PF02992.5; Description =Transposase family tnp2
MQRESQCEPVDVQMGDCLEEMKVKDDDKWSNDEITMKGPPAKIEDLIKLWNEVVVVFDGYPNETFKLCAMLFCTINDFPAYGNLSGYNFKGHRACPIYEEDTSYMQLKHGRKIVCTRHRRFLKAYHPYWQLKKSFN

SEQ ID NO: 224347 - protein, 78 aa, Glycine max
  Coding DNA Sequence Number=SeqID_107569
  Homolog annotation: Hit_ID=Q9M9M5; Match level="QueryCoverage=60%, HitCoverage=7%, E-value=2e-16, Identity=83%"; Hit description =Putative 26S proteosome regulatory subunit
MTNVGWGCMEVATVTEGAMVCLKWRFAEALAEVEGRAHEAKLAEDVNMRILVDRANAEQEKWVAAINTTFEHIGGTFC

SEQ ID NO: 224348 - protein, 209 aa, Glycine max
  Coding DNA Sequence Number=SeqID_107570
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=1e-28, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTSPLNESISCFHIRVDHWVLVPSPSEDYTSSLSEDYTSSPSVGCTPSPSEGYTSLPSTDYIHSPLEDYTGLHALAFRGLHALTFKGLHVLTFKGLHVLTFRGLHALAFRGLDILAYRGLHALAFRGLHALAFRGLYVLAFRGQHVLTFRGLHALTFRGLHVLAFRGLHTLAFRGLHSLAFRGLHVLTCRGLHILTCRGLHVLTCRGLH

SEQ ID NO: 224349 - protein, 85 aa, Glycine max
  Coding DNA Sequence Number=SeqID_107571
  Gene Ontology: Mol. function=DNA binding; Biological process=DNA integration
  Homolog annotation: Hit_ID=Q0ZCD3; Match level="QueryCoverage=68%, HitCoverage=4%, E-value=3e-10, Identity=51%"; Hit description =Integrase
GTSSRFKENKEGYIPCGYFLFLFYSSYKGQLARCLTVVSIDPPSSRMHGESVALVSLVREQAAHFHGDSKCLNKPYYSVRCLMSG

SEQ ID NO: 224350 - protein, 92 aa, Glycine max
  Coding DNA Sequence Number=SeqID_107572
FTSDSPQISASPHQLDLAPYASGPYNAQWNAPGLLHDKHMLCSSRILEEMEVEEPWLGLWLPLNYRVDMGASFVVDLGMAFVDDWVRGTVIG

SEQ ID NO: 224351 - protein, 66 aa, Glycine max
  Coding DNA Sequence Number=SeqID_107573
MVSGKRALHPGPWEHRKWRCRNLPFGGRAMRDSRVRLPRKENARSCHQRLFEENVGKTGKGVVYEL

SEQ ID NO: 224352 - protein, 183 aa, Glycine max
  Coding DNA Sequence Number=SeqID_107574
  Pfam annotation: Domain name=zf-CCHC; Domain location=10-27; Score =21.6; E_value=0.00027; Accession=PF00098.13; Description=Zinc knuckle
ASMQEKTSSMKCFKCLGRGHITSQCPTKKTMIMRGQDIYSSQDEATTSPSSSKSEEAKWEESSEEICPQEEGQPLMVKEECKETLVSIATSLRLEFIPQVKELLDEGVPMNPKRIKVIPEWLAPPSVLRKKAQSFKNLGIRGQILFKGEGMMQSYPARALDRKLQVDWARDAREGPRVLMSLR

SEQ ID NO: 224353 - protein, 63 aa, Glycine max
  Coding DNA Sequence Number=SeqID_107575
MGPDGCRETRRIGTEEAARKPRQDFSIQKGVYLYLVGPSISDRELVERMGRVSLELNVTMVVL

SEQ ID NO: 224354 - protein, 153 aa, Glycine max
  Coding DNA Sequence Number=SeqID_107576
  Gene Ontology: Mol. function=DNA binding; Cellular component=nucleus; Biological process=regulation of transcription
  Homolog annotation: Hit_ID=Q6R0D2; Match level="QueryCoverage=82%, HitCoverage=19%, E-value=9e-12, Identity=38%"; Hit description=MYB transcription factor
  Subcellular localization annotation: CTP_CleavageSite=68; ConfidenceScore=5.73e-01
MTSFKLNESTPTSSVIQAPLTINVPVFRSSRIANMESSQSSSSGMQETNIVFPVTVKRQALPNVPSTRAVETRGSGSGYTSMKKKREPWSEEEDLQLRAAVRRWGEGNWATMAKSDDFPIQRSTTQLSKVKMLVNHPLFPNLNFLGKYCHRDV

SEQ ID NO: 224355 - protein, 88 aa, Glycine max
  Coding DNA Sequence Number=SeqID_107577
EASSNFLVCGLNPSMNIFSWIGSENPWVGVLLMVLDSGKYLSQPTLQREGDAGAHGEVVAAQLAQASWVASTKRHHLLLEPPGSPKWA

SEQ ID NO: 224356 - protein, 344 aa, Glycine max
  Coding DNA Sequence Number=SeqID_107578
  Gene Ontology: Mol. function=kinase activity
  Homolog annotation: Hit_ID=Q94CG5; Match level="QueryCoverage=67%, HitCoverage=22%, E-value=5e-49, Identity=44%"; Hit description =Kinase interacting protein 1
DKEIQVLHQKLDNPDANPDESPYTITTEYKYTPQEALLRKAGQGANVLDSENSPSNLDANAAASPLAEQVETESTGKNAFSSVRMTLEKLMAHQDKCQDLSNLEQKFRSDIDNLLEENLEFWLRFSTSVHQIQKFQNSIQDLKAELKTIRDKNKKSEGYSHSKQQPIQSQLRPIFRHLREIRTELSLWVEHNAVLHDELQGRYASLSNIQDEIARAGNTESGADTAELISKYQVAKFQGEILNMKQENSKVASELQAGLTLVKGMKTDVEKTLDELDEAIGVNSGVPKNNGEMNHSTSRARIPLRSFLFGVKLKKQKHHPSLFACVNPALQRQYSVNDEAPAPI

SEQ ID NO: 224357 - protein, 72 aa, Glycine max
  Coding DNA Sequence Number=SeqID_107579
MIGNHVNVVPNAWLTTKVMVPRASHVNLVIAFVVHSIRKVHQVKVKYGSIQLAKIGAEEESSYIASLSTANI

SEQ ID NO: 224358 - protein, 387 aa, Glycine max
  Coding DNA Sequence Number=SeqID_107580
  Gene Ontology: Mol. function=kinase activity
  Homolog annotation: Hit_ID=Q94CG5; Match level="QueryCoverage=74%, HitCoverage=28%, E-value=9e-39, Identity=34%"; Hit description =Kinase interacting protein 1
LQDEFGVGTVIEDNDARALMAATALKSCQETLNKLKEIQAQSSNDAKEEYQRVKKAHEKFETLRDQFISKYMNQQNQDDVDKSENVGTDKKCIDEDMEQEEHDVGMLREKIKQKLEEDSSNSLTVTEMAECIDELVNKVCTLETAVSSQTGMVKRLKSETDGLHTNIKKLEEDREMLIEGSEVTNKKLMELEEELRRVKMLNQSVRTQDNTLQTHFTEASCNLEHLSGKLNNMKPDEEEENLVLYKKKRTASDDKSGKKSEKHHDNLSVDNTDVKTIKEDDGENVDTNKSNLNDGSFMNERIQKLVQQDKDDLSDTVSNLDTESQDLDISEEDQPNWRQMFISGLDDREKILLEEYTSVLVNYKDVRLKLNDVEKKNRDSIFELTLQ

SEQ ID NO: 224359 - protein, 112 aa, Glycine max
  Coding DNA Sequence Number=SeqID_107581
MDPDFAGAPPDTAFHQIKEKRRHRNSYTVAACGPVVSRGKRAMDSEELAELARVDPKRLALQQFHNPPSHDQQHLDPQQAQLSMPNPLPSSSTQSFGGEYGLNNFSNFSQLN

SEQ ID NO: 224360 - protein, 70 aa, Glycine max
  Coding DNA Sequence Number=SeqID_107582
MGCGLDCEGGGGKEGGGGGNTVGGDGHGGEWRHLKENSVTTMAMQMNMSDDGGGTQTKTKELWQHGGIWT

SEQ ID NO: 224361 - protein, 287 aa, Glycine max
  Coding DNA Sequence Number=SeqID_107583
  Gene Ontology: Mol. function=pyridoxal phosphate binding; Biological process=carboxylic acid metabolic process
  Homolog annotation: Hit_ID=Q1SBV6; Match level="QueryCoverage=57%, HitCoverage=40%, E-value=9e-47, Identity=56%"; Hit description =Probable histidine decarboxylase [imported]-Arabidopsis thaliana
MAFISAVHATELLPNVVRGAKVTTRREKYENNNSHMNLAITQCSGDTQANLASATAYCVETLNQYSLCNLGTIDVDTDIGHGHVDTSHFEKVNEMLIYLSVSVSDTDTCRTPGHGKGMECPYFIGTTMKGAIDDLDLVIQTLEGCGFTRDRFYIHCDGALFGMMLPFVKQTLRITFKKPIGSVTISGHKFLGCPIPCGVVITHLEYTSMHCLKMLKLLLQEIPQSQVAVVSMLQYFFGDAGIGTILNKFSNIVIFERPLDHDFTRTMLEFGMQWEYCTCDGDATHYR

SEQ ID NO: 224362 - protein, 219 aa, Glycine max
  Coding DNA Sequence Number=SeqID_107584
  Gene Ontology: Mol. function=transition metal ion binding; Cellular component=integral to membrane; Biological process=nitrogen fixation
  Homolog annotation: Hit_ID=Q9M2C0; Match level="QueryCoverage=92%, HitCoverage=97%, E-value=1e-67, Identity=66%"; Hit description =Nodulin-like protein
  Pfam annotation: Domain name=DUF125; Domain location=41-213; Score =236.7; E_value=5e-68; Accession=PF01988.9; Description=Integral membrane protein DUF125
MASDHSSVNQPKFVYPNNELEQQEALEVETKDFDYSKRSQWLRAAVLGANDGLVSTASLMMGVGAVKQDIKVMILTGFAGLVAGACSMAIGEFVSVYSQLDIEVAQMKREKERDNIDQEEDGYEKEKLPNPIHAAAASALAFSVGALVPLLAASFIRDYKVRLGVILGAVSLALVVFGWLGAVLGKAPTFRSCVRVLLGGWLAMAITFGLTKLIGSSGL

SEQ ID NO: 224363 - protein, 105 aa, Glycine max
  Coding DNA Sequence Number=SeqID_107585
MATTTMKVGEDTTNYNGEDEQGRRKGDRDATKGMRRETRDEGDRKKILPNYQVAYNNEMFDPNPYYWSQLHSLLTPTNICECMTPHRPSQHHMSSPSCPNTTMLP

SEQ ID NO: 224364 - protein, 84 aa, Glycine max
  Coding DNA Sequence Number=SeqID_107586
  Gene Ontology: Mol. function=kinase activity
  Homolog annotation: Hit_ID=Q94CG5; Match level="QueryCoverage=97%, HitCoverage=8%, E-value=6e-26, Identity=63%"; Hit description=Kinase interacting protein 1
  Pfam annotation: Domain name=KIP1; Domain location=1-52; Score=69.1; E_value=1.5e-17; Accession=PF07765.3; Description=KIP1-like protein
MEEKVAETLNILCDEGDSFAKRAEMYYKKRPELVDFVEEAFRAYRALAEKYDHLSKELQSANRTIASVFPDQVPCHIEEDDEEE

SEQ ID NO: 224365 - protein, 447 aa, Glycine max
  Coding DNA Sequence Number=SeqID_107587
  Gene Ontology: Mol. function=protein serine/threonine kinase activity; Cellular component=membrane; Biological process=protein amino acid phosphorylation
  Homolog annotation: Hit_ID=Q2QXA8; Match level="QueryCoverage=97%, HitCoverage=78%, E-value=1e-128, Identity=54%"; Hit description =Protein kinase family protein, putative, expressed
  Pfam annotation: Domain name=ACT; Domain location=186-314; Score =22.9; E_value=0.0012; Accession=PF01842.15; Description=ACT domain
  Pfam annotation: Domain name=Pkinase; Domain location=271-447; Score =100.9; E_value=3.8e-27; Accession=PF00069.15; Description=Protein kinase domain
  Pfam annotation: Domain name=Pkinase_Tyr; Domain location=271-445; Score=86.4; E_value=8.7e-23; Accession=PF07714.7; Description =Protein tyrosine kinase
  Pfam module annotation: Pfam domain module=ACT::Pkinase::Pkinase_Tyr; Domain location=186-314::271-447::271-445
MDLVEGVGESSSPPRAFSGCSNYDVHNNVYNRLVETGHDQAVSNPNFREHLEAHFNRLPPSYGLDVNIDRAEDVLLHQTLLALAKDPHKRPVYHIRFLENISTRTDGEDEQILSTHYSPGSTSHATNGGAVSPGKSKMRDIANEFEPCSKLEDLNLDVRKNSKVTEEKFLTDNFFQRHEHSSVPVHEIIFSTVDKPKLLSQLSALLSDIGLNIREAHVFSTTDGYSLDVFVVDGWPVEGSWSRSSNSHSAVEKALATEGKSGDWEIDRRLLKLGEKIASGSSGDLYRGVYLGEDVAVKVLRSEQLNDALEDEFAQEVAILRQVHHKNVVRFIGACTKCPHLCIITEYMPGGSLYDYMHRNHNVLELSQLLNFAIDVCKGMKYLHQNNIIHRDLKTANLLMDTHNVVKVADFGVARFLNQGGVMTAETGTYRWMAPENIGMFTYLLPF

SEQ ID NO: 224366 - protein, 155 aa, Glycine max
  Coding DNA Sequence Number=SeqID_107588
  Gene Ontology: Mol. function=protein serine/threonine kinase activity; Cellular component=membrane; Biological process=protein amino acid phosphorylation
  Homolog annotation: Hit_ID=Q2QXA8; Match level="QueryCoverage=68%, HitCoverage=20%, E-value=5e-35, Identity=62%"; Hit description =Protein kinase family protein, putative, expressed
  Pfam annotation: Domain name=Pkinase_Tyr; Domain location=3-132; Score=-103.8; E_value=4.2e-06; Accession=PF07714.7; Description =Protein tyrosine kinase
MDLVLCYSCKLFLKLIRSCSKLPHPGFSNRPKSLFLIAISELTNGFSHKVINHQPYDQKADVFSFSIVLWELVTAKVPYDTMTPLQAALGVRQGLRPELPKDGHPKLLELMQRCWEAIPSHRPSFNEITIELENLLQEMEFITCKLQKDSEANGA

SEQ ID NO: 224367 - protein, 341 aa, Glycine max
  Coding DNA Sequence Number=SeqID_107589
  Gene Ontology: Mol. function=hydrolase activity; Cellular component =cytosol; Biological process=metabolic process
  Homolog annotation: Hit_ID=Q8RWN4; Match level="QueryCoverage=95%, HitCoverage=52%, E-value=1e-134, Identity=67%"; Hit description =Cytosolic IMP-GMP specific 5-nucleotidase, putative
  Pfam annotation: Domain name=5_nucleotid; Domain location=1-336; Score=355.3; E_value=9.9e-104; Accession=PF05761.4; Description=5' nucleotidase family
MAKAYIYARMYKDVRAAVDLCHRDGTLKQMVAIEPKRYINEDSSIVPMLEMLRDSGQATFLVTNSLWDYTNIVMNFLCGSSMADVSNNFGWLQYFDVVITGSAKPGFFHEENRATLFEVVPETGMLLNTDNGSPIPQVGNTSARLFTEAKNHACPVFQGGNVSHLHKLLSIESSSQVLYVGDHIYGDILRSKKVLGWRTMLVIPELEKEVKLLWESRDSRKGDFYMNSLVQELQFLRSERDCIEDEIHHLKWSLKFKNPDADSKQKLSSELDKLKFHEPWGQLMKTGYQNSRFAHQVERFACLYTSQVSNLGLYSPDKYYRPSEDFMQHEFGIMACETPDI

SEQ ID NO: 224368 - protein, 507 aa, Glycine max
  Coding DNA Sequence Number=SeqID_107590
  Gene Ontology: Mol. function=microtubule motor activity; Cellular component=microtubule associated complex; Biological process =microtubule-based movement
  Homolog annotation: Hit_ID=Q9FME7; Match level="QueryCoverage=99%, HitCoverage=39%, E-value=1e-56, Identity=31%"; Hit description =Kinesin-like protein
MANEIARLKEEADMMKLNNSSAGLASMSPGARNSRIFALEKMIATSSTTLLSMASHLSEAEERERVFSGKGRWNQVRSLPEAKNLMNHLFNLASSSRCSLRDKEVTCREKDMEIRDLKEKVVRLSCSLRQLEMQKSELIHQLKLLSAKRYSESVGDSVYADINGGHKYDLRKMENRRSTILLEDMDLSVSDTETDDYVADATDDEWVASEKIHVRKRKSRSRHVSMENNQSNISSEDVKDNSTEGVGGASGETASDICCSCSKSSSCKTNKCKCRTLGGTCGSSCGCLASKCANRSSVSNEAQVEGAGNDSSIDEADKDRLLVAQGAELLQGALVEGPAEVHSDHGPRKPLSDIGNTLAKSNAQNANQRRKWAKKRNKSTVPVPVLTTNVVVPDTPPFSQSDNSEVPKKENNSISEANVSMNIPQKIQSSRPENAPLAPKVEKSVIETDRWMKLPRAMRKSPNGGGLPLGDMNASKPDEPVNKESEVIEARTPVKQKRTLEKENNGR

SEQ ID NO: 224369 - protein, 342 aa, Glycine max
  Coding DNA Sequence Number=SeqID_107591
  Gene Ontology: Mol. function=microtubule motor activity; Cellular component=microtubule associated complex; Biological process =microtubule-based movement
  Homolog annotation: Hit_ID=Q9FME7; Match level="QueryCoverage=96%, HitCoverage=24%, E-value=1e-103, Identity=63%"; Hit description =Kinesin-like protein
MDYDLVKSYVSKIQDLEGELQRLKNLNAKSRHVDWVDSDDSGFRSKNVLFASGNEYSSDCDAKSVDITDDMEDHAKEIEHSSLQEKLDRELKELDKKLEQKEAEMKMFNNADTSVLKHHYEKKVLELEQEKKFLQKEIEELKYNLANISSTSDDGAQKLKEEYLQKLNALEAQVSVLKKKQESQAQLLRQKHKSDEAAKRLQDEIQRIKSHKVQLQHKIKQESEQFRLWKASREKEVLQLKKEGRRNEYEMHKLLALNQRQKMVLQRKTEEATLATKRLKELLESRKTSRESAAGGNGPGIQALMQAIEHELEVTVRVHEVRSAHERQMEEYVPLFTFRFFI

SEQ ID NO: 224370 - protein, 391 aa, Glycine max
  Coding DNA Sequence Number=SeqID_107592
  Gene Ontology: Mol. function=microtubule motor activity; Cellular component=microtubule associated complex; Biological process =microtubule-based movement
  Homolog annotation: Hit_ID=Q9FME7; Match level="QueryCoverage=98%, HitCoverage=30%, E-value=1e-170, Identity=77%"; Hit description =Kinesin-like protein
  Pfam annotation: Domain name=Kinesin; Domain location=15-348; Score =517.1; E_value=1.9e-152; Accession=PF00225.13; Description=Kinesin motor domain
MENSDSAQCVRVAVNVRPLITSELMLGCTDCISVVPGEPQVQIGSHAFTYDYVYSSGSPSSAIYDDCVAPLVDALFHGYNATVLAYGQTGSGKTYTMGTNYTGEDNAGGIIPKVMETIFKRVQTMKESSEFLIRVSFIEIFKEEVFDLLDPNSARGDMASTAKPAAPSRVPIQIRETVNGGITLAGVTEAEVKTKEEMSSYLSRGSLSRATGSTNMNSQSSRSHAIFTITMEQKNGDDVLCAKLHLVDLAGSERAKRTGADGMRLKEGIHINKGLLALGNVISALGDERKRKEGGHVPYRDSKLTRLLQDSLGGNSKTVMIACVSPADTNAEETLNTLKYANRARNIQNKAVINRDPVGAQMQRMRSQIEQLQSELLLYRGDAGGAFEELQ

SEQ ID NO: 224371 - protein, 223 aa, Glycine max
  Coding DNA Sequence Number=SeqID_107593
  Homolog annotation: Hit_ID=Q5EAE9; Match level="QueryCoverage=24%, HitCoverage=18%, E-value=8e-15, Identity=54%"; Hit description=RING -H2 finger protein ATL5C precursor
MTYYYMGDATSFNPFQALTFLILITTPFILGDDGTAATSSSPVISTGPYSYSDPFNLSMGVILAVLITTFCLTFLFLIYIKHCYDTNTNTLKLTTNSRPSHVRKNSGIDRDVLESLPVFRFGSLRGQKNGLDCAVCVASTRSTWLDAYSTCPLCRYKVEPDDVVVFVKDDDARAKSPEGELDVDRKRPKRRRHGSNGLDDFVGRCGTLFLLQHVQNTKFLVLG

SEQ ID NO: 224372 - protein, 321 aa, Glycine max
  Coding DNA Sequence Number=SeqID_107594
  Homolog annotation: Hit_ID=Q1S0U5; Match level="QueryCoverage=27%, HitCoverage=30%, E-value=2e-21, Identity=49%"; Hit description =Transposase, IS4
MLGTSVQRSMSRLFGKEIGLRWDNAKSSADASDEWWVKKQLENPLYGKFKNKGLSFTHKLTELFENVVANREFQWAPLSRIFPAGVEVDMNDVYRSSLDGIGVDVEESSRESEDTSVNATNTSVSATDAFGKINLNDSQGIVNQEIGCQKNASKSCNEVVASASIQEVMNELKALPELQNDCVFHIQCCNLMLFKPAKKMFIAMRGLDEQRMHWLKDAFKTPLLFKVKMNDLLEQFESNNNEDDELMEHASYVGVLVDEYAIKHLCKKPCRTCEQTCHIWVQKLYSELVDHGLKPTNYIGVEEMVALFLNMVGHARGNRNL

SEQ ID NO: 224373 - protein, 215 aa, Glycine max
  Coding DNA Sequence Number=SeqID_107595
DKDSANRIKRRRGSHSQSTEESVRNEQDIDVVDDGVSKIRSANYMTLSFASDHNHHWSFMPVKPLPFKITDEMIDRSNSPGGHSVEPASPSSSNVSLRKKMKEIEVVSKTSKSSSSDLEIEIAKLLYGLKTSKSHESSKKFEASVYPSDDGEAPKEDIGEDRMNSSAGFGDASADGRLGVEEIGAFVASRGGFSFWDLLDLEKIPGKGWDCGKFL

SEQ ID NO: 224374 - protein, 69 aa, Glycine max
  Coding DNA Sequence Number=SeqID_107596
  Homolog annotation: Hit_ID=Q1RV39; Match level="QueryCoverage=92%, HitCoverage=6%, E-value=6e-16, Identity=69%"; Hit description =Calponin-like actin-binding; Kinesin, motor region
MKIKISRGVVSQGNGFASKFVMADKKMDNKIPMVTKKEGFLHKNHVDDVESKRQLLKQQMLFNQQRDIQ

SEQ ID NO: 224375 - protein, 73 aa, Glycine max
  Coding DNA Sequence Number=SeqID_107597
MTVTSPRKDDRRGSKKEASSDAADRTFPNRHHANFVHGMNENSIADIGREIAGATDIFQPTLRNFYLKTLAGR

SEQ ID NO: 224376 - protein, 152 aa, Glycine max
  Coding DNA Sequence Number=SeqID_107598
  Homolog annotation: Hit_ID=Q10E11; Match level="QueryCoverage=77%, HitCoverage=46%, E-value=2e-20, Identity=54%"; Hit description =Expressed protein
MCTRYSYIILCVIIAVFAKTLIPYIVAQQDRRIGLKTKKRRPPSTYWPLSMPPVKSFALPISRSVSFAAETDAAYTDEDLEKIQQLFISAARDCVPQDRNSFVTFQANTGVEVCTFRLIVKNAASLLGNKDPVKLKAEALLDNLIRTKACPV

SEQ ID NO: 224377 - protein, 35 aa, Glycine max
  Coding DNA Sequence Number=SeqID_107599
MARNQGFFTEDGARESSSEHIKVAYELAQKEYEKA

SEQ ID NO: 224378 - protein, 64 aa, Glycine max
  Coding DNA Sequence Number=SeqID_107600
MESPMLIVSSMTGRDKKFQESYRKDPTITLLIDVDDASNSPLGGKRWCLGASGYGVEKEKEGGL

SEQ ID NO: 224379 - protein, 41 aa, Glycine max
  Coding DNA Sequence Number=SeqID_107601
MNNLSQYKLPRDAAGYASADDAAPIDSGKNRDRKRDLSSYY

SEQ ID NO: 224380 - protein, 90 aa, Glycine max
  Coding DNA Sequence Number=SeqID_107602
MGSKCGGSQQVTDLVRWCNELAVGDVRTSVKMKRKEERDHEDEEKGAANVGGLRLSLVLGGEAEGEEDGIGGDALHEGSVLLTHGSRGTP

SEQ ID NO: 224381 - protein, 311 aa, Glycine max
  Coding DNA Sequence Number=SeqID_107603
  Gene Ontology: Mol. function=protein kinase CK2 regulator activity; Cellular component=protein kinase CK2 complex; Biological process =Wnt receptor signaling pathway
  Homolog annotation: Hit_ID=Q8LPD2; Match level="QueryCoverage=51%, HitCoverage=66%, E-value=6e-83, Identity=90%"; Hit description =Protein kinase Ck2 regulatory subunit 2
  Pfam annotation: Domain name=CK_II_beta; Domain location=75-251; Score=349.9; E_value=4.1e-102; Accession=PF01214.9; Description =Casein kinase II regulatory subunit
MYKERERVGVSVSASKSEDRKRINDVLDKHLERSSPSTSRPITSASKNSNLQVEESETESEESDVSGSDGDDTSWISWFCNLRGNEFFCEVDDDYIQDDFNLCGLSSQVPYYDYALDLILDVESSHGDMFTEEQNELIESAAEMLYGLIHARYVLTSKGMAAMLDKYKNYDFGRCPRVYCSGQPCLPVGQSDIPRSSTVKIYCPRCEDLYYPRSNHRNQHKAMFQEFLGSKFTSHKAEVEAFMKELVVKKYADMRSKCLVSASDSMRKCLAFEFVDLLPMDSYITNFQVHLLGCYTQLSNIIGYLECECTI

SEQ ID NO: 224382 - protein, 189 aa, Glycine max
  Coding DNA Sequence Number=SeqID_107604
  Homolog annotation: Hit_ID=Q0PJI2; Match level="QueryCoverage=38%, HitCoverage=26%, E-value=2e-08, Identity=58%"; Hit description=MYB transcription factor MYB183
MGNNMFTMVFLILMLISSATPTEIDAKNPELVAATKEMQRANYSTFVMLINMSPLDTIKGNVTFLMPNDRMLDNMALVEPRLRSRFLPESIGAASSAEAYPAASRGSLYCERLFILTLPHGVYHDSDAEQHDLAGDDGVGGSSNRSSGEYRKIFLRCCDSSQREGRERGREREEKKAERGKAEARKGKR

SEQ ID NO: 224383 - protein, 57 aa, Glycine max
  Coding DNA Sequence Number=SeqID_107605
MKERLSHHLIGMLKIRFNSGESTPVDTKQLAYTHSKRDKGKCRADYRPTTHEDVASS

SEQ ID NO: 224384 - protein, 111 aa, Glycine max
  Coding DNA Sequence Number=SeqID_107606
  Gene Ontology: Mol. function=peptidase activity; Biological process =proteolysis
  Homolog annotation: Hit_ID=Q108Y0; Match level="QueryCoverage=58%, HitCoverage=12%, E-value=1e-11, Identity=63%"; Hit description=ICE -like protease p20 domain containing protein, expressed
MGTYMLVNILQTRCMVLECINFRMNGILEDPKRHNSPTGSPCAVDHTKVSNAVQDAHSAAEKAYNMAKVDGGVNKVVAVANKAANTARVAALRGVSLEPLSVIELDGRLWN

SEQ ID NO: 224385 - protein, 126 aa, Glycine max
  Coding DNA Sequence Number=SeqID_107607
  Gene Ontology: Mol. function=transporter activity; Cellular component= intracellular; Biological process=transport
  Homolog annotation: Hit_ID=Q2PYY3; Match level="QueryCoverage=98%, HitCoverage=41%, E-value=8e-38, Identity=65%"; Hit description =Transporter-like protein
MLEDTLKWRSTYKPEDIRWKKFQDEIVVEGETGKLYRASVHDREGRIVLVLRPGMQWLLLNTSSKENQMRHLVYMLENAMLNLPHGQEQMSWLIDFTEWSFRNSVPIKSAKETINTYRITTLRDLP

SEQ ID NO: 224386 - protein, 1806 aa, Glycine max
  Coding DNA Sequence Number=SeqID_107608
  Pfam annotation: Domain name=GYF; Domain location=521-576; Score =47.6; E_value=4.1e-11; Accession=PF02213.6; Description=GYF domain
MADRASATTRLHISAAPPFPISKDFHGPDNPIPLSPQWLLPKPGESKPAIGTVENHVISTPPNGNRSETVKTSGDGEDANDGHKRKDVFRPSMLDSESGRRDRWRDEERDTKSSIHKDRWRNGDKNLSDTQRMDRWTENVSMRHFGEARRATSDRWNGSSNRDTNFEQRRESKWNTRWGPDDKAPEGLCEKWNDPGKDSDLHVDKGLSNISNLVKDEKEGDHYRPWRPNSSQSRGRVEPTHHQNVMPNKQVSALSYRRGRGEDTTPGIAFGRARLSSGGSSINSTYMHSQYPGTLLDKVESEQGEAHPFRYSRANLLDDEPLEPLALGAPNSEELMPLSSLVVYYIVFPFEQSVLKDIDKGEIISSSAPQVPKDGLNSTEFTHSRQMKLVKASFQDRVEDNDSYRMADEVPSNRESTFEESHSVHHGATWLGTPLGEHAGTLMHDSRDVSSDIKSRNSDMSWSHQPKDTHAQWERNLDYLSETRDVAKWHDGGDPIKRQLSGTLDSEFESRKVQQICPEELSLLYKDPQGRIQGPFKGIDIISWFEAGYFGIDLPVRLENAAFDSPWLQLGDAMPHLRAKARPPPGFSAAKLDSTETPGRQYSSTFGNMHSGLSEIEMMRNDSMHRSSSTEAENRFLESLMSGTKSSSPLDSLTLSEGLQGFLGNNYGNLGPSGVDSGNNLHLLAKRMALERQRSLPNAYPYWPGRDAGSLPPKSDIFPDASPHSNILSSLSDNSRQLQSQNSELMSIIQGLSDRSSTGLNSGIAGWLNFPLQGGLDPLQNKTDLHHDQNYVQMPFGIQQQRFQTPNQLPLNNLIAQTSDIPSSILTAEKLLSSGLSQDPQMLNMLQQQHLLQLHSQAAAAPSQPMPLIDKLLLLKQQQQQEEQQLLLRQQQQQEEQQLLLRQQQQLLSQVLQEHQSHQRFGNLSHQQLQGGGIPLGNLHVNLSQIQQPKEIFPMSSQTPIPTVQGELTTNSLDLPLQVSQDTSYNISSESSAQMSDQLFENISHQKSWSATLPEQINDNYQKEALPVSASVEGSLLLEQNRAKEEPAIAQKLLPFSNYTAKTLEQMPDNTCRDDDTLVSATSESGENSQPIQCVAPVVAMSSAGSCGTELPLVSQLSEDLEINSDSLEEQQGGRPSVVDVRSVEVHEPKKTTEKKSKKQKSSKSQSSDKVKGLLKNVILQQSKKSESWESNYSEANKGEPAHETCLQQTMDKGKQSATATAETDDHQEGSGLPTNIQGSNTETVIENELKAVSSVATQNTELPSVRAWKPAPGFKAKSLLEIQLEEQKKVQTEKLVSEVATPVNSMSSTPWVGVVANPDSMKVSSDSNREAENTEYLAKAEKSQNSKSKKSPLHDLLAEDLVPKSSERDDKVPDSMLPPQNIAVHSEPVDDGDFIEAKDTKRSRKKSAKLKSSGAKVSMPVASNEVPISSSHIEKVKSSRSVQQEKELLPSVPSGPSLGDFVLWKGETTSPSPPPAWTTDSARIPKPTSLRDILKEQEKKSYAVLPNQLPTPQKSQPAQAARNSGSSRPISASSPSKTAPSSQINSQASLSKYRGDDDLFWGPVEQSKQENKQYEFCLFIVPMILLYILARLILLPKLKLSGFPQLASLGSWGSKSVPMNGNSPGSLSQQKSGSGKPTEQSLSSSPASSQKLLKLKKNAMTKNSEAMDFRVWCENECVRLVGTKDTSFLEFCLKQTRSEAEMFLTENLGSYDPDREFIDKFLNYMDLLPSDVLEIAFQTGNDQKAAGGMISANTDVQELGYTDGSFSKVGKKKGGKKGKKVSSSVLGFNVVSNRIMMGEIQTVED

SEQ ID NO: 224387 - protein, 81 aa, Glycine max
  Coding DNA Sequence Number=SeqID_107609
  Subcellular localization annotation: CTP_CleavageSite=51; ConfidenceScore=5.04e-01
MGELWFIKELKSPLGMATSSSNRQCYWLLPTAAQIASSTGAFHCKKVVPPSCNAAARSLRTTIPYPQLASQTGVSKPAKCH

SEQ ID NO: 224388 - protein, 114 aa, Glycine max
  Coding DNA Sequence Number=SeqID_107610
  Homolog annotation: Hit_ID=Q852F8; Match level="QueryCoverage=70%, HitCoverage=44%, E-value=8e-15, Identity=55%"; Hit description =Expressed protein
  Pfam annotation: Domain name=DUF1195; Domain location=1-88; Score =16.4; E_value=8.5e-05; Accession=PF06708.2; Description=Protein of unknown function (DUF1195)
MTWILPFLKTSMCWYEVEEREKVVRHMWDLYSHTNTKSVGLPKFWWEAFEAAYQQLVSDVPAVRDAAVSEIAKMSLRSLPIQIQSHSVFSFHDEHVQSITASRKIKQAKSRTGQ

SEQ ID NO: 224389 - protein, 815 aa, Glycine max
  Coding DNA Sequence Number=SeqID_107611
  Homolog annotation: Hit_ID=Q67VX6; Match level="QueryCoverage=29%, HitCoverage=51%, E-value=2e-23, Identity=30%"; Hit description=Ulp1 protease-like
  Pfam annotation: Domain name=Peptidase_C48; Domain location=161-354; Score=96.0; E_value=1.1e-25; Accession=PF02902.9; Description=Ulp1 protease family, C-terminal catalytic domain
MEVVLHPDYVVYQDNYYTGTKLCFSQCYIQISDSTACAKQGEGTFEWAVDDLIHIDCLLFPKSGMVVMKLCAVSSNAGPSIHISCTSDIEELKIVFVDDNWSLRQEQITSLNGKYLAIWNTVSDMDVEDGKKIPLGPRCYFSNFQESFEKVDYPKGDLNSVCITKSDFDLLKPDTFINDTIIDFYIQNPSSASDGKAAFQRVRRWTRKVNLFEKDYIFIPVNFKLHWSLIVICHPGEVVKFNDKEPDKALKVPCVLHMDSMRGYHSDLKNIFQSYLWEEWKERQKDTCGEDLSSRFLNMHFLSVPSPQQDNMFDCGLFLLHCIELFLDEAPFNFNPFKLTKFSNFLNLDWFHPVEVSLKRPFIQRLIFELAENENHSLHEGFPSDYNEDHRYSENNKNRTNSLRPEVNGDSSLSHSVQGKQFTLLSAPSPLDPQSFNPSDMVLKEHFKPGTMAGTSRGHCQSLDQQSSDHYLNGSIFSTKDGTDLNEELMHIMANPNFQQVSPQSFSLTYLTGGCETEISHGPRIGIQSEHDKIESFIATPSCASGDSDIEIIENFPTRNETRSSYEDERGENNNTAIENYIEQVSDIPGSLMENSQWPNTNCVGHNNGDQHLSYIQSEHSKTKPSQATSTCAYASDDIAMIGNFPIINETRSPYEDEQGEKNNTAIEDYFEHFPEIPDSHMEFSQWPNTSTYASANPDNIAITESFPIRNETGLSYDDQRAEYNNAAMENFFEHLPEIPDSLVEFSQRSNPMCVSDNNGDQGLYCQETPAMQMDQVSNALDDKFTCDDDDLVIIDSMEPDHWKNQPIKKRRMLR

SEQ ID NO: 224390 - protein, 143 aa, Glycine max
  Coding DNA Sequence Number=SeqID_107612
MVPPLEAPHEGSALEPTIEGGGLVIAIVILRPQMCCLAALSRRRDLRQRKLLVQVLEVLRRVNAGVVGARCQRAATAGGEYIATVEEDRGVGGGFGVTAITQHGGGEVNQGASDEGRREYFQFHTIVLRRERVEASCSNEIDG

SEQ ID NO: 224391 - protein, 115 aa, Glycine max
  Coding DNA Sequence Number=SeqID_107613
MEELEEQAISVVACAVDILFGVMTFGCKNRDKKRIIFLMKEVTKSLKEFVQEEMEIEDAQEVVHEVLNELKNILNLHSANRYKVIDWLTENPDKLVILKALPLKEKEDYILAFMS

SEQ ID NO: 224392 - protein, 207 aa, Glycine max
  Coding DNA Sequence Number=SeqID_107614
  Gene Ontology: Mol. function=carbohydrate binding
  Homolog annotation: Hit_ID=Q10NJ9; Match level="QueryCoverage=70%, HitCoverage=46%, E-value=2e-33, Identity=40%"; Hit description =Lipase, putative, expressed
  Pfam annotation: Domain name=DUF620; Domain location=11-185; Score =179.2; E_value=1e-50; Accession=PF04788.3; Description=Protein of unknown function (DUF620)
MGRHAERFYCKVHSSAVRGGDGRSSCIEFTGKHKNPDLWCLELVVSGFKVGAGINGKLAWNHSSSQPFHANKGPSRPLRRFFQGLDSSYKRLQAQSTSNTEIAFKGKGSVFWETSIESMIDDYRYIDGINIAHGGRTIATLYRYGVAHNHKHMIEETWTIEEVDFNIVGLSMDCFLPPSGGEREHEGAEQAWDRILLRFSLFCSPQP

SEQ ID NO: 224393 - protein, 166 aa, Glycine max
  Coding DNA Sequence Number=SeqID_107615
MQIAEVIGEFGQALTRGTGTRQFDWRVEVGEFRGLQAVAGRNRVAAEESTAHWTRQFDWRVEPGDLVSENCRESSRFQLKLLLGESLHAETGESLHFETDRQTGESLHVEIVNNTGETNATYPVISTTVEANDNGSRNRIDVVHNFTDTLNSFWLCIANPEFGKKL

SEQ ID NO: 224394 - protein, 259 aa, Glycine max
  Coding DNA Sequence Number=SeqID_107616
  Gene Ontology: Mol. function=protein binding; Cellular component =cytoskeleton
  Homolog annotation: Hit_ID=Q8GSM4; Match level="QueryCoverage=68%, HitCoverage=58%, E-value=8e-20, Identity=35%"; Hit description=Ovate protein
  Pfam annotation: Domain name=DUF623; Domain location=186-245; Score =94.1; E_value=4.1e-25; Accession=PF04844.4; Description=Protein of unknown function, DUF623
  Subcellular localization annotation: CTP_CleavageSite=18; ConfidenceScore=5.29e-01
MAKRFKLKFNIPSFQMCRSKDPSSFPGNPVPAIYRLSPVNHNARHTRHPSIPSPSPSKITSIAQGCKMCHDKQSLKKLKSIRGRKSTSSVPSRRSDFRIDNIEEEESETLISCMTSFSDEFCLGEEKELSTGSSSQRRKMSSVKKVRSVRFQSSEKRRGAEVKKTTVTRKSVEGKVRESFAVVKKSKDPYEDFKKSMMEMITEMEMSEAEDLEQLLQCFLALNSRSHHAVIVRAFMEIWQQMFFWNPTSMKNLQTDLEK

SEQ ID NO: 224395 - protein, 186 aa, Glycine max
  Coding DNA Sequence Number=SeqID_107617
  Gene Ontology: Mol. function=RNA-directed DNA polymerase activity; Biological process=RNA-dependent DNA replication
FQSPRLGVTYGNQESSKRVGKTLKRVVGISNCCGVDCFRHEGVEVEVISASRNHIYVKVSFLHQAHSFYLSLIYGFSEASNKILTWDLIHTLCPGPGLFWMCVRDFKEILCPDDKNGGNEANINLIAWFRMVLEQCSEPKGLGQLGLIMETKTQNSSIIWLDKGGRGIQLTGSRMIREYASRKRKI

SEQ ID NO: 224396 - protein, 90 aa, Glycine max
  Coding DNA Sequence Number=SeqID_107618
MGERMNGNGESSSSSSSLGMVKCKCEESSSCRFFQWIDGIEAGNNVSAEGSELVRYVQENEELKLKLVSLMEEAKAYAEEITYLRKKFIA

SEQ ID NO: 224397 - protein, 178 aa, Glycine max
  Coding DNA Sequence Number=SeqID_107619
  Gene Ontology: Mol. function=phosphogluconate dehydrogenase (decarboxylating) activity; Cellular component=mitochondrion; Biological process=pentose-phosphate shunt
  Homolog annotation: Hit_ID=O22111; Match level="QueryCoverage=32%, HitCoverage=11%, E-value=3e-19, Identity=87%"; Hit description=6 -phosphogluconate dehydrogenase
MEADVPNSHWEAMRNQCLDEAADSASTTAVSHRHMSFELDYSDLEDANVVSFEVMRKNPFWVYDREALRLFSKFNKGRLQLGHILLGNVDVLMAAHLGVVFMPQGLRHFHRIDTFDPGGYLRDGGKWTVQQAAELSIVAPTIEASLDARFLSGLKEERVEAAKVSKSGGIGVIVTDQP

SEQ ID NO: 224398 - protein, 370 aa, Glycine max
  Coding DNA Sequence Number=SeqID_107620
  Homolog annotation: Hit_ID=Q9LTB9; Match level="QueryCoverage=99%, HitCoverage=100%, E-value=3e-72, Identity=66%"; Hit description =Arabidopsis thaliana genomic DNA, chromosome 5, TAC clone:K14A3
MEQKKETVTTTMSDEAKERISERLSCLENLYFPRALESTVTLPSQRKAIFRDLLSRDVALFLERYGSKLTCSELSEFDSMKDDYEINWHIKRLRSIMSPTSEELRMRSVTVKNRRRAYLDKLVCQGHYFSEEAMREREPYLHHEYVGRFQDQSGRRMARPGERWSETLMRRCEEAALVAKIRGEQQRMGVPERDWVGNERFQEEEEEEEEEEEEEEEEKEEEVVLDEERRRISSNGQPVENWSLWAFGALVIAKEQPELEVLGGLRQVVKYSSIVFGSNAPHSFGLGDFSAIMRHLNEADPTKVSEEPTLSAEELEDRMNQFTYIMQQKFLLGEDHEHQDYSKIDNDETLDDHWQREANIDAEERYFADD

SEQ ID NO: 224399 - protein, 591 aa, Glycine max
  Coding DNA Sequence Number=SeqID_107621
MTSGVLQFNWSMQLAGNPQDVVVPPVEGVAGGGTAYGWNDGGTHGLNVKGPIDPTEIPTKDLVHVWCMPNTANVGPQDMPRHLEPINLLAARNERESVQIAIRPKVSWGGSSVAGTVQIQCSDLCSTSGDRLIVGQSLLLRRVVPILGVPDALVPVDLPVSQINLFPGETTALWISIDVPSSQPPGQYEGEIVITAIKSDAESPVQSISKVEKHQLYRDLKGCLDIVEPIDGKPLDEVVERVKSTTTSLRRILLSPSFSEFFSDNGPVDVMDEDAISSLSLRMKLNLTVWEFVLPETPSLPAVFGVSSSHTLNVKQISDTVIEDRFGVQQGTAEWYEALDQHFKWLLQYRISPYFCKWADGMRVLTYTSPWPADHPKSDEYFSDPRLAAYAVPYKQVVSGNNSAEDYLQKQVEILRTKNHWRKAYFYLWDEPLNLEQYDSVRNMASEIHAYAPDARILTTYYCGPNDAPLAPTPFDAFVKVPSFLRPHNQIYCTSEWVLGNQEDLVKDIIAELQPENGERGELTGRRKNEEWWTYVCMGPSDPHPNWHLGMRGTQHRAVMWRVWKEGGTGFLYWGANCYEKATVASAEVIV

SEQ ID NO: 224400 - protein, 348 aa, Glycine max
  Coding DNA Sequence Number=SeqID_107622
  Gene Ontology: Mol. function=heat shock protein binding; Cellular component=integral to membrane; Biological process=protein folding
  Homolog annotation: Hit_ID=Q9ZU99; Match level="QueryCoverage=73%, HitCoverage=72%, E-value=1e-75, Identity=55%"; Hit description =Expressed protein
  Pfam annotation: Domain name=AT_hook; Domain location=335-347; Score =16.3; E_value=0.035; Accession=PF02178.9; Description=AT hook motif
  Pfam annotation: Domain name=DnaJ; Domain location=67-129; Score =80.2; E_value=6.7e-21; Accession=PF00226.21; Description=DnaJ domain
  Pfam module annotation: Pfam domain module=AT_hook::DnaJ; Domain location=335-347::67-129
MQSATRAEAERLLGIAEKLLQNRDLVGSREFAFLAQETEPLLEGSDQILAIVDVLLAADKRVNNHPDWYAVLQVDRRSDDLDLIKKQYRRLALLLHPDKSRFHFADHAFQLVADAWALLSDPIKKSVYDKELSFFSRVDLSVPGWVQQQEKLPVRRTGPGPGPGPGPTAGRNSAASAREDIHADENSRRRRSSTFWTACPYCYRLYEYPRVYEGCCLRCQNCDRSFHGVTVPSLPPLVPGQDAYYCCWGFFPMGFVVGSFGSPPQPEEEAAPSAAEAPPSPPPPPQQPASSLPNWMPVAAENGVGSVTPVAAATRLTRSGAAVPNGVGSGNGTGKKKRGRPRKYPLPS

SEQ ID NO: 224401 - protein, 157 aa, Glycine max
  Coding DNA Sequence Number=SeqID_107623
  Homolog annotation: Hit_ID=O22111; Match level="QueryCoverage=41%, HitCoverage=20%, E-value=1e-16, Identity=50%"; Hit description=6 -phosphogluconate dehydrogenase
EGFHAAKICSYAQGMNLICAKSIEKGWDLKLEFAKEIIDHQSAWKIVVCLAINSGISTPETNLKLKQAPKATSKLQEDSNFQNFRAVIKCEDPNAGIAYGRGVTEVERALSRRHESHPGQELKKISESKSSIKGFNFMDERVVVATYPSARGRRVTR

SEQ ID NO: 224402 - protein, 251 aa, Glycine max
  Coding DNA Sequence Number=SeqID_107624
  Gene Ontology: Mol. function=nucleic acid binding; Cellular component= intracellular; Biological process=chromatin modification
  Homolog annotation: Hit_ID=Q10QG1; Match level="QueryCoverage=59%, HitCoverage=27%, E-value=1e-81, Identity=90%"; Hit description=Zinc finger, C2H2 type family protein, expressed
  Pfam annotation: Domain name=RS4NT; Domain location=117-154; Score =13.5; E_value=0.049; Accession=PF08071.2; Description=RS4NT (NUC023) domain
  Pfam annotation: Domain name=zf-C2H2; Domain location=132-154; Score =22.2; E_value=0.0018; Accession=PF00096.16; Description=Zinc finger, C2H2 type
  Pfam annotation: Domain name=zf-C2H2; Domain location=159-180; Score =15.8; E_value=0.16; Accession=PF00096.16; Description=Zinc finger, C2H2 type
  Pfam annotation: Domain name=zf-C2H2; Domain location=56-78; Score =26.4; E_value=0.0001; Accession=PF00096.16; Description=Zinc finger, C2H2 type
  Pfam module annotation: Pfam domain module=RS4NT::zf-C2H2::zf -C2H2::zf-C2H2; Domain location=117-154::132-154::159-180::56-78
MTEPQNPSPLTHSPALEITPQPLLPPKRKRSLPGMPDPDAEVIALSPKTLLATNRFVCEICNKGFQRDQNLQLHRRGHNLPWKLRQRGSTEPRKKAYVCPEPSCVHHNPARALGDLTGIKKHFCRKHGEKKWQCERCSKKYAVHSDWKAHMKTCGSREYRCDCGTLFSRRDSFITHRAFCDVLAQESARAQAQAQGQGGSNSKVVEASSPPTPPLTPSASVVPPTLSIQSSGSSCVNFSDTFSTFVNFLII

SEQ ID NO: 224403 - protein, 152 aa, Glycine max
  Coding DNA Sequence Number=SeqID_107625
  Gene Ontology: Mol. function=carbonate dehydratase activity; Cellular component=chloroplast; Biological process=carbon utilization
  Homolog annotation: Hit_ID=Q9C6F5; Match level="QueryCoverage=80%, HitCoverage=43%, E-value=2e-39, Identity=62%"; Hit description =Carbonic anhydrase, putative
  Pfam annotation: Domain name=Pro_CA; Domain location=1-144; Score =70.6; E_value=4.9e-18; Accession=PF00484.9; Description=Carbonic anhydrase
MVIACADSRVCPSNILGFQPGEVFMIRNIANLVPVMKNGPSECNAALQFAVTTLQVENILVIGHSSCAGIEALMNMQEDAESRNFIHKWVANGKLAKQRTKAATAHLSFDQQCKFCEKKEAVMLSKNKNSGADCCYTRKLETTFMTMKSNSI

SEQ ID NO: 224404 - protein, 595 aa, Glycine max
  Coding DNA Sequence Number=SeqID_107626
  Gene Ontology: Mol. function=metal ion binding; Cellular component =nucleus; Biological process=regulation of transcription, DNA -dependent
  Homolog annotation: Hit_ID=Q6Z2D6; Match level="QueryCoverage=99%, HitCoverage=96%, E-value=1e-122, Identity=41%"; Hit description =Putative coiled-coil protein
  Pfam annotation: Domain name=fn3; Domain location=308-396; Score=2.3; E_value=0.092; Accession=PF00041.11; Description=Fibronectin type III domain
MLSLPDKQRLVHEIARQSKDASSMLQSFTRRELLEIICAELGKERKYTGYTKSQMIEHLLKIISKNSNLHINGNTPPQSPAKSCIGTKRKKKPATQDLHHAPLGNSKETVKTFLCQNVACKAKLNPEDSFCKRCSCCICHHYDDNKDPSLWLTCSSDLPNEESCGMSCHLQCALSNQMSGILKGSCGGVKLDGTFCCVSCGKINELMKTWRKQLLVAKEARRTDILSLRLSLAHRILLGTEVYKEVQKIVETALKLLENEVGSLYASMTRGIVSRLSCGAEVQRLCTTALECFDSKFSVLFSICLENKDAPTCSIRFEECLPTSVVIVLEYKDKLLQNFLGCRLWHRLSTMDYPEQPTFIVLRPEKRFKLENLHPSTEYFCKASLFSSTGILGAAEATWVTPCEPTNPSKVINCGGNRFRWSPQRPSGTGVNMCAQNRITAEIHPTESANSEMKLSSGEHPGKKHIILNIRSRFEEFLSKPQPVEPFSYKNLAAVSPSTPSKSYEMRQIPGLNSRKFSKENDYEYSVRVVKWLEHQGHIDEIFRVRFLTWFSLKATQQERRVVSAFVDALIDDPASLADQLIHTFSDEICCEPKS

SEQ ID NO: 224405 - protein, 89 aa, Glycine max
  Coding DNA Sequence Number=SeqID_107627
MYMVSFHVSEELVVESSIFEILKIKTAFYITVQRNSIVCDGCGISSNITTQRFTNPQKQNRPNVKLEVEEHGSRVDERKKEVQDGFYQE

SEQ ID NO: 224406 - protein, 563 aa, Glycine max
  Coding DNA Sequence Number=SeqID_107628
  Gene Ontology: Mol. function=transmembrane receptor activity; Cellular component=exocyst; Biological process=exocytosis
  Homolog annotation: Hit_ID=Q1SHQ5; Match level="QueryCoverage=91%, HitCoverage=85%, E-value=1e-119, Identity=46%"; Hit description =Exo70 exocyst complex subunit
  Pfam annotation: Domain name=Exo70; Domain location=37-563; Score =565.8; E_value=4.3e-167; Accession=PF03081.6; Description=Exo70 exocyst complex subunit
  Subcellular localization annotation: CTP_CleavageSite=17; ConfidenceScore=5.35e-01
MRKLCFNPKTESFALARSSPSSPLSLTSSPTLPRLSFSEPSSFHEDIFIEEAEALILKWNPDSSAYAKVTSLFYQDRNEAKQYISCVNQLQKTMHSLLSQNLSSDKLILAHNLMQIAMKRLTKEFYQILSMNRAHLDPESVSARSSRTSANSSASDYDDDFAAEDDDIRAAGDSISEVEQVSSGAMADLKLIADCMISSGYAKECVSVYILIRKSIIDEGIYRLGVEKLSSSRANKMDWEVLDLKIKSWLEATRISVRTLFNGERILCDHVFSYSDSVRESCFAEISRDGAALLFGFPELVAKTKKSSPEKLFRVLDMHAVASELLPEIESIFSSDYNSGVRSQFLVSLQRLTESAQILLAEFESTIQKGTSKPAVNGGGVHSLTIQTMNYLSVLADYLNVLSDIFPRDWLPPQKSSSLPESYLYSPESDYSASTPALTARFAWLILVLLCKLDGKAKHCKDVSLSYLFLANNLWYVVARVRSSNLQYVLGDDWILKHEAKAKRFVSNYEKVAWGEVVSSLAENPAAAEARAVFENFNRKFEEAYRKQNSFVVADRELRDEIK

SEQ ID NO: 224407 - protein, 125 aa, Glycine max
  Coding DNA Sequence Number=SeqID_107629
  Homolog annotation: Hit_ID=O65047; Match level="QueryCoverage=69%, HitCoverage=51%, E-value=3e-09, Identity=40%"; Hit description =Hypothetical protein Sb07
MELIGTSSDAVPHQNHSSRGSSNAGNKNLTEKEVYVNHAELAWHQMRTEWVGDQSKKLRRSPKGSTLSVTRTYEEVLASREPFKRPILLSEMITDSTGRLHSSLCLQHLGFFGQIVAAAAKHSSD

SEQ ID NO: 224408 - protein, 569 aa, Glycine max
  Coding DNA Sequence Number=SeqID_107630
  Gene Ontology: Mol. function=RNA-directed DNA polymerase activity; Cellular component=chromatin; Biological process=chromatin assembly or disassembly
  Homolog annotation: Hit_ID=Q1RVR4; Match level="QueryCoverage=32%, HitCoverage=53%, E-value=3e-32, Identity=39%"; Hit description =Peptidase aspartic, active site; Aldehyde dehydrogenase
  Pfam annotation: Domain name=RVP_2; Domain location=393-524; Score= -39.8; E_value=0.0013; Accession=PF08284.2; Description=Retroviral aspartyl protease
  Pfam annotation: Domain name=zf-CCHC; Domain location=341-358; Score =12.6; E_value=0.0081; Accession=PF00098.13; Description=Zinc knuckle
  Pfam module annotation: Pfam domain module=RVP_2::Retrotrans_gag::zf -CCHC; Domain location=393-524::137-227::341-358
MPPVKKTTIKQMEAKVEALESEISEVRTTLANVQNAVRENHANLLAMLEKCLGKTMFEEEGPGGSVKGTPANTPLLETKESKRVHTNRIREESLAEFRHAVKKIELPSFTGEDPTGWISRAEIYFRVQDTTPEIKVRLAQLCMEGPTIHFFNSLIGENEDLSWENLKDELLGRYGGHGEGDVYEQLTELKQEGTVDEYITEFEYLTAQIPRLPDKQFLGYFLHGLKTEIRGKVRSLAAMGEMSRTKLLQVTRAVEKEIKGTGSGFYRGSKSGNGSHRPSSHGSGKGSTDWVMVKGQEEEKRSGVGPKGDKMAHNHKRRNGPRERGFTHLSYQEMMERKQKGLCFKCGGAFHPMHKCPEKHLKILVLEDDDDEEAEAKVIAVEVEESDEDDKAEMCVLNLNHIAYENHKTVKLQGRICGVPVLILVDSGATHNFVSQKLVHKMEWSIEETPSMSIKLGDGSRSQSQGVVKGLELNIGEFKLSPEMHLFELGGIDVVLGMEWLKTLGDMIVNWRQQTMSFWSNKKWCILSKPKFNKPKELWGMEKRGVEGGTMLTAHQQKELGLLLEQYAQ

SEQ ID NO: 224409 - protein, 532 aa, Glycine max
  Coding DNA Sequence Number=SeqID_107631
  Gene Ontology: Mol. function=transferase activity; Biological process= Mo-molybdopterin cofactor biosynthetic process
  Homolog annotation: Hit_ID=O74841; Match level="QueryCoverage=40%, HitCoverage=79%, E-value=1e-37, Identity=41%"; Hit description =Probable FAD synthetase
  Pfam annotation: Domain name=MoCF_biosynth; Domain location=263-396; Score=73.7; E_value=5.7e-19; Accession=PF00994.14; Description =Probable molybdopterin binding domain
  Pfam annotation: Domain name=PAPS_reduct; Domain location=37-201; Score=70.0; E_value=7.6e-18; Accession=PF01507.9; Description =Phosphoadenosine phosphosulfate reductase family
  Pfam module annotation: Pfam domain module=MoCF_biosynth::PAPS _reduct; Domain location=263-396::37-201
MEIDKAIRECDDRRLQTKYNNATYVVQRALALYSIEEVAFSFNGGKDSTVLLHILRAGYFLHKKGQNSVNGDLKDFPIRTIYFESPCAFPEINSFTYDTAAIYGLQIDTISLDFKSGLEALLKEKPIRAIFLGVRIGDPTAVGQEQFSPSSPGWPPFMRLNPILDWSYRDVWAFLLTCKVNYCSLYDQGYTSIGSIYDTVPNSLLCISNSSNKFKPAYLLADGRLERAGRAKRPSTSTGGQIPAESNGLTSQDSYKNSMLTASIIAVGDEILFGNLEDLLGPYLCRKLHSIGWSVLQHSAVHNNIDSVAEEVERQKSKSDMVFIYGGVGPLHSDVTIAGIAKAFGVRLAPDEEFEEYLRHIIGDQCTGDRNEMAQLPEGITELWHHDKLSVPLIKCENVIILSATNVPEMEKQWDCWIELAKSSDLLALLEPYVSKHVTTSLSDALSMVEIAQPLSKLCLEFPDLYIGCYRNARYGSLIVSFKGKNENLSWLGHIILILPTNIRCIGIKMEREENQGAAVLVEERTMAQGGG

SEQ ID NO: 224410 - protein, 162 aa, Glycine max
  Coding DNA Sequence Number=SeqID_107632
  Gene Ontology: Mol. function=transferase activity; Biological process= paclitaxel biosynthetic process
  Homolog annotation: Hit_ID=Q94CD1; Match level="QueryCoverage=86%, HitCoverage=30%, E-value=1e-52, Identity=72%"; Hit description =Putative N-hydroxycinnamoyl/benzoyltransferase
MANENGFQLSVKLSEPTLVPPAEETKKGLYFLSNLDQNIAVIVRTVYCFKTAERGNEKAGEVIKNALKKVLVYYYPLAGRLTISSEGKLIVDCTGEGALLVEAEANCSMEEIGDITKPDPGTLGKLVYDIPGAKHILQMPPLVAQYNFFNAKDSQFMHFAST

SEQ ID NO: 224411 - protein, 119 aa, Glycine max
  Coding DNA Sequence Number=SeqID_107633
  Gene Ontology: Mol. function=protein binding; Cellular component =cytoskeleton
  Homolog annotation: Hit_ID=Q6Z256; Match level="QueryCoverage=50%, HitCoverage=15%, E-value=1e-25, Identity=93%"; Hit description =Putative actin related protein 2
MYPGLPSRLEKEILDRYLDVVLKGNRDGLKKLRLRIEDPPRRKHMVYLGGAVLAGIMKVWPGMTLRSMIALKMGYQFWEAKAHQRLSDEYSKLLKLPPPKIACINCCWPCIAVPMATRG

SEQ ID NO: 224412 - protein, 579 aa, Glycine max
  Coding DNA Sequence Number=SeqID_107634
  Gene Ontology: Mol. function=transferase activity; Cellular component= nucleus; Biological process=mRNA editing
  Homolog annotation: Hit_ID=Q1RZ85; Match level="QueryCoverage=91%, HitCoverage=73%, E-value=1e-111, Identity=39%"; Hit description =Asp/Glu racemase; Polynucleotidyl transferase, Ribonuclease H fold
  Pfam annotation: Domain name=PPR; Domain location=107-141; Score =28.8; E_value=1.9e-05; Accession=PF01535.11; Description=PPR repeat
  Pfam annotation: Domain name=PPR; Domain location=142-176; Score=2.5; E_value=3.8; Accession=PF01535.11; Description=PPR repeat
  Pfam annotation: Domain name=PPR; Domain location=177-211; Score =13.3; E_value=0.2; Accession=PF01535.11; Description=PPR repeat
  Pfam annotation: Domain name=PPR; Domain location=239-273; Score =27.5; E_value=4.8e-05; Accession=PF01535.11; Description=PPR repeat
  Pfam annotation: Domain name=PPR; Domain location=301-335; Score =45.8; E_value=1.4e-10; Accession=PF01535.11; Description=PPR repeat
  Pfam annotation: Domain name=PPR; Domain location=403-437; Score =43.0; E_value=1e-09; Accession=PF01535.11; Description=PPR repeat
  Pfam annotation: Domain name=PPR; Domain location=438-472; Score =23.0; E_value=0.0011; Accession=PF01535.11; Description=PPR repeat
  Pfam module annotation: Pfam domain module=PPR::PPR::PPR::PPR::PPR::PP R::PPR; Domain location=107-141::142-176::177-211::239-273::301 -335::403-437::438-472
  Subcellular localization annotation: CTP_CleavageSite=50; ConfidenceScore=5.40e-01
MSILVSKATAGMQMQAFPVIPIPTSTSMRSISHSSPFRLHSAASITTLLKACKKREHLEQVHACIIHRGLEQDHFLVFLFISRAHTLLSTLSYASSVFHRVLAPSTVLWNTLIKSHCQKNLFSHTLSAFARMKAHGALPDSFTYPSVIKACSGTCKAREGKSLHGSAFRCGVDQDLYVGTSLIDMYGKCGEIADARKVFDGMSDRNVVSWTAMLVGYVAVGDVVEARKLFDEMPHRNVASWNSMLQGFVKMGDLSGARGVFDAMPEKNVVSFTTMIDGYAKAGDMAAARFLFDCSLEKDVVAWSALISGYVQNGLPNQALRVFLEMELMNVKPDEFILVSLMSASAQLGHLELAQWVDSYVSKICIDLQQDHVIAALLDMNAKCGNMERALKLFDEKPRRDVVLYCSMIQGLSIHGRGEEAVNLFNRMLMEGLTPDEVAFTVILTACSRAGLVDEGRNYFQSMKQKYCISPLPDHYACMVDLLSRSGHIRDAYELIKLIPWEPHAGAWGALLGACKLYGDSELGEIVANRLFELEPLNAANYVLLSDIYAAAERWIDVSLVRSKMRERRVRKIPGSSKI

SEQ ID NO: 224413 - protein, 439 aa, Glycine max
  Coding DNA Sequence Number=SeqID_107635
  Gene Ontology: Mol. function=transferase activity; Cellular component= nucleus; Biological process=paclitaxel biosynthetic process
  Homolog annotation: Hit_ID=Q94CD1; Match level="QueryCoverage=64%, HitCoverage=62%, E-value=1e-124, Identity=75%"; Hit description =Putative N-hydroxycinnamoyl/benzoyltransferase
  Pfam annotation: Domain name=Transferase; Domain location=1-308; Score=40.4; E_value=6.6e-13; Accession=PF02458.6; Description =Transferase family
MAPHFELVSIAVLKESVNSIFQVTKFKCGGFALGLCMNHCMFDGIGAMEFVNSWGEAARDLPLSIPPVIDRSILKARSPPKIEHLHQEFADIEDKSNTNSLYEDEMVYRSFCIEPERLKQLKMKAMEDGALEKCTTFEVLSAFVWIARTKALKMLPDQQTKLLFAVDGRAKFNPTLPKGYFGNGIVLTNSVCQAGELTEKPFSFGVRLIQDAIKMVTDSYMRSAIDYFEVTRARPSLACTLLITTWSRLSFHTTDFGWGEPALSGPVSLPEKEVILFLSHGQERRNINVLLGLPAPVMKIFQDLMQIYMQCNGDKDAVFSSSSFLFFKYYIIYAEGAAPNSIVVTEDVSPKGNATKDIVAPNNVVIVEDEEASNDIVVTLKSAEKEEEAKEKEGAQEEEAEEKERGDGEEDMAYVGFAEKRTRTDNFVIRENKNHNSLT

SEQ ID NO: 224414 - protein, 295 aa, Glycine max
  Coding DNA Sequence Number=SeqID_107636
  Homolog annotation: Hit_ID=Q9LKZ5; Match level="QueryCoverage=30%, HitCoverage=8%, E-value=6e-28, Identity=70%"; Hit description =Receptor-like protein kinase 2
MGTPARWHSPFMVLHGEEDGIGIAGGGLGDVVNLLDTADQDGDIGFILWGRIGDNDIVGEVEVAEAGEGGESRRNGAEEFVCGEGEVEEEWEVGNVGGERGGEVHFGEVEGGDVVVVVADDVELGAIRDGGIPRRQNGLMVASLRSRLIKRSLGSIVGSKIRVGWIFGKRDVVRTDSCPLCASTSENIFHIIRDCPFARQIWERLGILECDSRVAVYLVLHLDNTQHRFWNSVSNIRDWLSRDWTVRIHVYGERSESVNDDAVEAENPGGAAYEGRKSWQRHIWRSEMRRQRFTE

SEQ ID NO: 224415 - protein, 120 aa, Glycine max
  Coding DNA Sequence Number=SeqID_107637
  Gene Ontology: Mol. function=RNA-directed DNA polymerase activity; Biological process=RNA-dependent DNA replication
MVSGHAVAPFLEIDLYHFILDNAKKRLGSWRARSLSFASRATLIQVVMSALPTYTMQTLLLPIHICKELEKMMRCFLWGMKMWFMNASVSWKDIGNSKDFGGMGFKDIYLFNKAMVMKLG

SEQ ID NO: 224416 - protein, 37 aa, Glycine max
  Coding DNA Sequence Number=SeqID_107638
VNLLKITEELLQKSFGFNRSIEISGRWIAHVLDTGWS

SEQ ID NO: 224417 - protein, 57 aa, Glycine max
  Coding DNA Sequence Number=SeqID_107639
MEEDRSCINENSEPEEMQDESRRQVISFTYIKKAIDNCYTCFRDPSNLPKEIDESER

SEQ ID NO: 224418 - protein, 420 aa, Glycine max
  Coding DNA Sequence Number=SeqID_107640
  Homolog annotation: Hit_ID=Q1STP5; Match level="QueryCoverage=29%, HitCoverage=22%, E-value=7e-11, Identity=35%"; Hit description=IMP dehydrogenase/GMP reductase
  Subcellular localization annotation: CTP_CleavageSite=31; ConfidenceScore=5.43e-01
SFLPPIRTTPLLYASFFLDRFVFSTAPLSPKASIAVVQAVFAIVVLFPPSRQREAAPIAEDVQHVDHSTNEVHEQPEEAAVDDVVPDAEGFPRGPRDTSVLIGYVDYVAVIVWNGEERPELKLSSHGRKVHKFGRPTPEIEGLVVAIGLSPLTSCSLDTGDWELISAYMERWHKETSSFHLPIGVPITGAFHSFEALHMDEAVLVLIELLEVSADEARAETVQCHWTYVQLSWLRDIYHSKCDVAQWTVAARAYLLHLGTSFVVQEEGTSTWLVVTENKKGYISYGSVQVEGTSTWLFKVNKEGYIPCGSLLLFEYLAPVGQICVVPGQCAADYMEWFYMIFQPFMSPTQLGDPPRHPSVMHNDTFVELDIPQHPVVATTMDTAPVDAPGHAEQPRHVLEACQEIVERLERLFNLRIVTK

SEQ ID NO: 224419 - protein, 194 aa, Glycine max
  Coding DNA Sequence Number=SeqID_107641
  Gene Ontology: Mol. function=catalytic activity; Biological process =metabolic process
  Homolog annotation: Hit_ID=Q9LW70; Match level="QueryCoverage=58%, HitCoverage=24%, E-value=1e-22, Identity=41%"; Hit description=Long -chain-fatty-acid-CoA ligase-like protein
MQSIANKSSSQFFHLPLVLNKSSEKSRDDHSQNGGIHTDKILLDNFGRSSEDPALILYTSGTTGKPKGVVHTHKSIISQVEFLPKFSVRGVWQRWRESYPTDGSKAEDAITVFTGVSVILISIVLVSDMVHSHGTLVCVYNLSLAENNYVYCYNHTKTAFIVHMMAIKLIEASGITTKISTTHTNCSEEFRSHF

SEQ ID NO: 224420 - protein, 112 aa, Glycine max
  Coding DNA Sequence Number=SeqID_107642
MVYSRNRKQKGEIGPLKSGGGIGRENNIVTRKENWANSEDPVASKENGSPILKVGMGLKRWSRGTEITEKRMLEATNTWTIAKDMGSVMKQRKENGVQDCYLRRKKQRSNGK

SEQ ID NO: 224421 - protein, 128 aa, Glycine max
  Coding DNA Sequence Number=SeqID_107643
MPPTVPVNHYSDPEGQHNRIRILWCYPMLMYTERRLALSTLISSKSASPAEGTSRPVHTGGGPIDPTQAGITAAAGTRLALQWILVKGFRLYSFQLPDSMSPDWVICAPAAFLGCGSRFSGSLSGIEP

SEQ ID NO: 224422 - protein, 101 aa, Glycine max
  Coding DNA Sequence Number=SeqID_107644
MEFDLNKTESDNEEQFKFDERKDGSNLKINSSKLQQRINRNITTMFNCSELFYLIHKKRKFTTIPIPCKPTKIDLPVDNWSEFLLSIRTQVLVRKTESKRV

SEQ ID NO: 224423 - protein, 1528 aa, Glycine max
  Coding DNA Sequence Number=SeqID_107645
  Homolog annotation: Hit_ID=Q5JJP6; Match level="QueryCoverage=23%, HitCoverage=44%, E-value=5e-12, Identity=25%"; Hit description =Adenylyl cyclase-like
  Pfam annotation: Domain name=GYF; Domain location=486-541; Score =50.7; E_value=4.9e-12; Accession=PF02213.6; Description=GYF domain
MIGYYPSTWLFTQVNSTDPILKDSWRLEGSQDKKDWRRTAPDVDISRRWREEERETSLLGRRDRRKEDRQNTSTSENRSLPSDRWHESRGSGHDSRRENKWSSRWGPEDKEKDSRSEKRHDVEKEDGHTEKPSPGVGNRMGPDRDTDSRDKWRPRHRLEAQAAGVATYRAAPGFGLEKGRTEGSNVRFSPGRGRANINGNLQIVRPPIGSGSGSALVDRNKTILGKSSLGADSYYYPRGKLLDLYRKRKVDPSFDSLPSEMEHTSPITQQGSVEPLAFVAPAAEEEAVLKEIWKGKITSSEVSGYSFRGKDGGSNDDISGPGIISEGKQPSIGSGAKVISGSDVSDDSDQILIGSASIAGGLLRNIVEEVATFQEGKQQHMETIGVHGRAESSVNSIGEGSIPGNKVAESANFDYHQGQTSGFRDHANRNGVDSIAASELSSNLPNDSRSLFDFSSLQQTSSINQQDLKINEKSYPSESVIALEELSLCYLDPQGEIQGPFLGIDIILWFEQGFFGMDLPVRLSDAPEGSPFHELGDIMPHLKVKSGLGSGSNRVIQSEPSDAIGRNLKVDVHNFDYDGSSVSDDQPWSSSRPDTSSSVGITSQLPNQSYHSEVKFSDDQCFSNIVAHDEDVTLSKLAGSINEKPMMRPMDVSASYPHSTGKPVANEVAVNDTHNNEADKLHPFGLLMSELRDGSHLRRAQSSNSSMRLGDQSHFLDPLIDRDAAFADQSSIGGMVNQPPFRETWADEYGLNRHFNGNPHVGSLEDQFLSHMGPKFNNFDVAEQLMLQKLQKERLQQQSNISNHFPAHLGGSDLERFPGFALAQNKSSNIQQMMQNPGSDFERILELQIQQRQLELQQQQDMHHQQLLHQQMKLQPQQQSQVQQLLLEQFMHQQIPDPNFGQSKHDISRDNLLDQVQMRRYVHDLQQNPHSSRHLDPSVEQIIQANMGLNAAQGRQADLSDLLLQARHGNVLPSEQQLHFQQDQLQAQQLSLALRQQLGLDGERHFGRSWPMNETGQLVRNPATHPLGHSAGFNVSDIHKQQQRLGTQEEQLNYLGRNLPEQNQRGFYDNPMMFERSAPISQGRELHDRHRYLHPGDQMSSLSSHHLRSSDDLFGHHPDAFKSSLHGNNGHVENSWIDPRVQIQQHLEAVRQRRELGDTVTSADLNLSASAGAHEESSARGFMDLLHQKLGVQSTQPSTVDKWHPLSSRSDKSWHVPEATSMMHSFEHPSDQQVHLNDPFLERTQSANSNALIHDHLNSMHITDQYNNLGNTERMPLRSRSGSLLEEQSLLSANKDTLHPNYRIPFQIGKSSMEKDLLELEANQRHDYMGTMNNLVPGMSDMSEQVESITNSMELPAIAHSRHSSLSSAGGDGGSFGREMGLNNPRGDEVSGDRIPSSTKGFDNAFHKRPHVSRVLSSPDVQSDQPSIPHVNQNNLINLASSEGSMVGRREMTGNSSISSITDAQTSGKKEVRFRSSSFSEGAVSETSFIDMLKKPVLPEVVADSHAASGIGTESLDAAQAGRSGKKK

SEQ ID NO: 224424 - protein, 339 aa, Glycine max
  Coding DNA Sequence Number=SeqID_107646
MATKKVSSVHVDEDYIDIEPIFSSPNIFSSYSLDIPQQNNNNNREFEFQNKEESITSPADELFYKGKLLPLHLPPRLEMVEKLLENAGSTFGFSRSQSSLEDSRFRMLQSTPLESCNISPSESRRVCSCESLPSEYQFEWCSKIEGLVSDLHHHHHQQQHVPKKQTKQKQFWLAQGLKASKSYLKSLFSKSGCSDKSCASDAATSKVGESSIEHRRQRSCAVKNSDMLEDGFLNSSSRRSFSGVIQRHYASKASSLSTSSSGSSSSSSSFSLSSAGSYELQLFNRSISAELENSIESAIAHCKKSQQKGGLNKVCSQSAVCGKKGIMEKTLVRKDEFLI

SEQ ID NO: 224425 - protein, 207 aa, Glycine max
  Coding DNA Sequence Number=SeqID_107647
  Gene Ontology: Cellular component=integral to membrane
  Homolog annotation: Hit_ID=Q9C7A2; Match level="QueryCoverage=53%, HitCoverage=19%, E-value=5e-39, Identity=71%"; Hit description =Ankyrin-like protein; 93648-91299
MTFASGNVQGVKAGAVFRGKRVVAGVREELLYDVEVALFSCGEEGGFSQLIHLIKDGGPDTGNLGVELEAPHHDGVDLGEDLADGGRVAALRGEVELGVVMAAGDLLDIFFPRGVEAFAGVGEEEGFVGVGEEEGLAGGGEEEGGARGGGGGGLGERGGVMRVTMMIHDRPHQRPRWWGWGGVPTPFHNLLNTTTPQHCVVLVCFAP

SEQ ID NO: 224426 - protein, 169 aa, Glycine max
  Coding DNA Sequence Number=SeqID_107648
MVEKLIENADATTPLQAWTISPSESRKTKRFRLAQRLKASKTYVKTLFNKYGCYDNSCANDAATSHKKNVKDDARKNKNPFEFFGHNKHQRQRSCVVKNNDDMLEDGFINSNKRSCELQLLNKSTRAEQENSINSAISNCKKSQQQGSSNKVCSQSLVCGNKEITGLIH

SEQ ID NO: 224427 - protein, 107 aa, Glycine max
  Coding DNA Sequence Number=SeqID_107649
MGDGKVNLPDDLFSGKLSDSLRVWLAERWPFIRPCLDGLGGVQFAVVVNLNLELSYEASGGHGGEKGIVALLDDSKDQLLSDNSIPLSPQWLYSKPVDAKTTANPVG

SEQ ID NO: 224428 - protein, 444 aa, Glycine max
  Coding DNA Sequence Number=SeqID_107650
  Gene Ontology: Mol. function=receptor activity; Cellular component =integral to membrane; Biological process=ion transport
  Homolog annotation: Hit_ID=Q8S1S0; Match level="QueryCoverage=90%, HitCoverage=90%, E-value=1e-126, Identity=54%"; Hit description =Putative lung seven transmembrane receptor 1
  Pfam annotation: Domain name=Lung_7-TM_R; Domain location=139-421; Score=119.6; E_value=9.1e-33; Accession=PF06814.3; Description=Lung seven transmembrane receptor
MAMAKMRPALSLLLLLLLLLFLLSPSAAEIKSLKINSDTRPMILFEKFGFTHKGHVSIAVSSVSVGVLSSAVQPESSRLGFFLLNEESLLQVLMEIQQNPSFCVLDSHYILLLFTFRDLSPPPVASFNRSYPVTSPNEYSLFFANCAPETSVTMSVHTEAYNLDADGSRDYLSAGQTLLPSLYFLFFLTYLSFFSFWLYICYTNKLSVHRIHLLMSLLLLMKALNLICAAEDKHYVKATGLPHGWDVLFYIFQFIRVVLLFTVIVLIGTGWSFLKPFLQDREKKVLMIVIPLQVLANLASVVIGETGPFIKDWVTWNQVFLLVDIICCCAIIFPIVWSIRSLRETSKTDGKASRNLAKLTLFRQFYIVVIGYLYFTRIVVFALRTIAAYKYQWVSNAAEETASLAFYVVMFYMFRPLEKNEYFVLDEEEEEAAEMALKDEDFEL

SEQ ID NO: 224429 - protein, 150 aa, Glycine max
  Coding DNA Sequence Number=SeqID_107651
VPLTIRQSRVSPDFTGNPACHLTSRVRTTEGAGDDVVCAEDNVNLRVSTGLLAAIDKGCRRRQVVCAEDDVNLRVSTGLLTANDKGCCRNVPSSGRARARLTGALSKGGKMRGVATNEGISTSYVDKSGTLAPTYPPSKRKSDLRSSFLR

SEQ ID NO: 224430 - protein, 284 aa, Glycine max
  Coding DNA Sequence Number=SeqID_107652
  Subcellular localization annotation: CTP_CleavageSite=26; ConfidenceScore=5.09e-01
MSFSLFYALELFLLFFFHLCLPFSTLALEIPENPSTKLSPTSPNATACFVTSSSSTPSNSTTCTTVFASVLAPSPTTPSTPQSPSNSTSSFTNLISNLARSQNPNTIMRESTSLSLSTPLYLSNNDPLHYTASPQPALSATALLQKAAQMGASNASLLRGLGLATTTSSSSSFGKDEGFNINATTTLQWNGQVKQENHPVVDNLGLGLLCGSGSVPDVMMAPSTPFVGQPMTRDLLGLSIGGGGSRGGLSALLTSFGGNFDSPGEGGVHRCFQCSAQTDKQTRP

SEQ ID NO: 224431 - protein, 64 aa, Glycine max
  Coding DNA Sequence Number=SeqID_107653
  Subcellular localization annotation: CTP_CleavageSite=14; ConfidenceScore=5.36e-01
MATPSSSPPPKSVPSSSTSKRTRKVTLLRSLDARSVEVERPVAHVDPMPEKVDEVGIVGARYAG

SEQ ID NO: 224432 - protein, 158 aa, Glycine max
  Coding DNA Sequence Number=SeqID_107654
  Gene Ontology: Mol. function=heat shock protein binding; Cellular component=integral to membrane; Biological process=chloroplast accumulation movement
MERFYSSQRESILLGYSNDNNNSLIQGSNLEVDFTDVFGGPPRRSSVNEVRQSVGEFSEEERGWCRWPPEREKPVFGEDSGNRRRNHSDFFDDIFGGEESASVCSTPKKRVGDAFALSRVSSPLPPAADPVFGSLPATFRFSSFPPNYLALGSLCFNF

SEQ ID NO: 224433 - protein, 502 aa, Glycine max
  Coding DNA Sequence Number=SeqID_107655
  Gene Ontology: Mol. function=heat shock protein binding; Cellular component=integral to membrane; Biological process=chloroplast accumulation movement
  Homolog annotation: Hit_ID=Q10QF7; Match level="QueryCoverage=88%, HitCoverage=69%, E-value=6e-41, Identity=30%"; Hit description =Expressed protein
  Subcellular localization annotation: CTP_CleavageSite=32; ConfidenceScore=5.00e-01
LPAKLTNGADLPTFGSPTRSRNLLNNINDGIVASNGLKPYRQSLLSQEFSNSSTFDKTDKGSIMKQDISISEVLPSASNGQFHFSIYKWASKGVPMVMPLRTERNSRNKDKAKLERCSGAKEWIVSEITTQNPIEYNRKQDSNQIVEQIVSAKTQLDTSTSPQTVSKDVPASSISRDTREVESSIRSTSDKKLEPKPLQFLFKESDKKQDNDEMITREREENRMMKSTKKSSAVFDVTVNPMKQEEKAVPLRDVGRSKATSQGSVSLGENLGKGLVKGKVKEFARIFNQEAVNKPKVDSKSQPQGSTYKKRDALRTKNEVEAGPEQPKKDNSVTETTNISANNLFHQDDISEPEIPDISFTVIGDKDESFPGSFMIQVLAQDEGEVLQTQKNQEIQTIDNKIKQWSKGKEGNIRSLLSTLQYVLWPECGWKPVPLVDIIEGNAVKRSYQRALLCLHPDKLQQKGASSDQKYIAEKVFDILQDLCLDSIKLVTRIPLHHVLQF

SEQ ID NO: 224434 - protein, 395 aa, Glycine max
  Coding DNA Sequence Number=SeqID_107656
  Gene Ontology: Mol. function=RNA-directed DNA polymerase activity; Biological process=RNA-dependent DNA replication
MLWWTSKVSLGGGFMGFYGFPECRRKIDSWDLLHNLAKDNSLLWCMIGHFSDMLTIEDKYRGQKQPQWLISGFREVVKDCKLVDLPLEGYQYTWIQKRGTMDVTKERLEKPLANQALIYSFPQCRLTNIMMDRSELEKYRGRRHVEGIRKYVEVREIMGSWLAKEDGFWRQREKTHWFRDECVNPRLSEDSNHEITRPFLIDEFREALFNMNSDKASCPDKFNPTFYKRFWSTSGTGLPPNLNDTSIVLIPKKENPKSMKDLYPILLCNVVYKVLAKEIHHIKLKLKGKVGEVNRHGVGLVVPHRGLKQGDPLSPYPFILDCEDLTSIIKKAEAKRICKKLKVDYKENIYMKILSLYEKAYGQAISLAKSKVFFSRNTPPNIKDEVTSILGVLRY

SEQ ID NO: 224435 - protein, 190 aa, Glycine max
  Coding DNA Sequence Number=SeqID_107657
  Gene Ontology: Mol. function=protein binding; Cellular component =coated vesicle membrane; Biological process=intracellular protein transport
  Homolog annotation: Hit_ID=Q9SB50; Match level="QueryCoverage=95%, HitCoverage=38%, E-value=4e-74, Identity=75%"; Hit description =Clathrin coat assembly like protein
  Pfam annotation: Domain name=Adap_comp_sub; Domain location=2-190; Score=148.9; E_value=1.3e-41; Accession=PF00928.11; Description =Adaptor complexes medium subunit family
MVHCQLQVPPDGEFPVMNYRLTQEFSPPFRINALIEEAGSLKSPTLLKLLLQAEVILKVSAEFPSSVTANTIKVQMPLPKCTSRVSFELEPGAVGQTTDFKEANKRLEWSLRKIVGGSEHTLHAKLTFSQESHVNITKESGPVSMTFTIPMHNVSRLQVKYLQIAKKSATHEPYRWVRYVTQANSYVARI

SEQ ID NO: 224436 - protein, 256 aa, Glycine max
  Coding DNA Sequence Number=SeqID_107658
  Gene Ontology: Mol. function=acyltransferase activity; Cellular component=integral to membrane; Biological process=metabolic process
  Homolog annotation: Hit_ID=Q1S6K6; Match level="QueryCoverage=88%, HitCoverage=64%, E-value=3e-88, Identity=60%"; Hit description =Phospholipid/glycerol acyltransferase
  Pfam annotation: Domain name=Acyltransferase; Domain location=154 -236; Score=-11.6; E_value=0.028; Accession=PF01553.11; Description =Acyltransferase
MESELKDLNSKPPNGNGNSVRDDRPLLKPEPPVSADSIADMEKKFAAYVRRDVYGTMGRGELPTKEKLLLGFALVTLLPIRVVLAVTILLFYYLICRVCTLFSAPTGEEEQEDYAHMSGWRRTIIVSCGRALSRLMLFIFGFYWIPESNSASQEDKSRQPEELRRPGVIISNHVSYLDILYHMSSSFPSFVAKRSVAKLPLVGLISKCLGCVYVQRESRSSDFKGVSGGTMVEWCGQFFCQPPLANFEGSPPMAAP

SEQ ID NO: 224437 - protein, 161 aa, Glycine max
  Coding DNA Sequence Number=SeqID_107659
  Subcellular localization annotation: CTP_CleavageSite=66; ConfidenceScore=5.68e-01
MDMDARARGPSNTPAFSTSTSAPASTSTPPTPTPPPSSGTSAQRIDVLSIHDLAQHRPIISMEDFMAQVVWLGVQPSPVGEGEAPIAQEPQPEPEATTEETPEVTPTATPMDVVEDTDYAADMAAAQSTWDPWPTPAQDIHLLAQDAPSLPQDDPTPAQEG

SEQ ID NO: 224438 - protein, 127 aa, Glycine max
  Coding DNA Sequence Number=SeqID_107660
  Gene Ontology: Mol. function=transcription regulator activity; Cellular component=nucleus; Biological process=regulation of transcription, DNA-dependent
  Homolog annotation: Hit_ID=Q9LN63; Match level="QueryCoverage=62%, HitCoverage=26%, E-value=2e-25, Identity=65%"; Hit description =BRASSINAZOLE-RESISTANT 2 protein
  Pfam annotation: Domain name=DUF822; Domain location=57-127; Score =66.5; E_value=8.3e-17; Accession=PF05687.4; Description=Plant protein of unknown function (DUF822)
  Subcellular localization annotation: CTP_CleavageSite=55; ConfidenceScore=5.33e-01
AVHMLCKASNHARSSFNGADHASPSGDCVRVRRGVESGGGVAVAEVRMTSDGATSAATNRRKPSWRERENNRRRERRRRAISAKIYSGLRAQGNYNLPKHCDNNEVLKALCAEAGWAVEEDGTTYRK

SEQ ID NO: 224439 - protein, 83 aa, Glycine max
  Coding DNA Sequence Number=SeqID_107661
  Gene Ontology: Mol. function=zinc ion binding; Cellular component =intracellular
  Homolog annotation: Hit_ID=Q308N9; Match level="QueryCoverage=97%, HitCoverage=31%, E-value=8e-10, Identity=46%"; Hit description=Salt -tolerance protein
MKEAPQFAELEWLTDVGIFGEQFAQEALAAAEVPQLLVTHNNSSVASNRTSKSYISHKKPRIEVLNDQDDDDEFSIFIVPDLG

SEQ ID NO: 224440 - protein, 163 aa, Glycine max
  Coding DNA Sequence Number=SeqID_107662
  Gene Ontology: Mol. function=nucleic acid binding; Biological process= DNA integration
  Homolog annotation: Hit_ID=Q1SAJ1; Match level="QueryCoverage=36%, HitCoverage=31%, E-value=7e-07, Identity=57%"; Hit description=Zinc finger, CCHC-type
MASAKFDVEKFTSKNNCNLWRVKMLALLTQQAYELALEGEVMKFWEKSLEKRLSTCFGQSLKVGEDLMVRGRMEERKKISKEEVEGGKVLVGNDGACSIVGKGTMQIKMVDGTVRTLTDVRVPKGDLTIMKGKLNNELYILQVDVEWMSLAREAYLIDNGLES

SEQ ID NO: 224441 - protein, 85 aa, Glycine max
  Coding DNA Sequence Number=SeqID_107663
MENDGVERLGHGVEMRTKEEEEHKTIEDKKGSDWMRIESRWGCEDKELDVAYQLTVRTIKTTRISGVNLSNMCVAVEASTSTNHV

SEQ ID NO: 224442 - protein, 803 aa, Glycine max
  Coding DNA Sequence Number=SeqID_107664
  Gene Ontology: Mol. function=protein binding; Cellular component =membrane; Biological process=defense response
  Homolog annotation: Hit_ID=Q1T0H1; Match level="QueryCoverage=83%, HitCoverage=66%, E-value=1e-156, Identity=44%"; Hit description =Disease resistance protein
  Pfam annotation: Domain name=LRR_1; Domain location=546-567; Score =6.1; E_value=21; Accession=PF00560.23; Description=Leucine Rich Repeat
  Pfam annotation: Domain name=LRR_1; Domain location=569-591; Score =14.5; E_value=0.39; Accession=PF00560.23; Description=Leucine Rich Repeat
  Pfam annotation: Domain name=LRR_1; Domain location=593-612; Score =8.6; E_value=6.9; Accession=PF00560.23; Description=Leucine Rich Repeat
  Pfam annotation: Domain name=LRR_1; Domain location=615-637; Score =10.7; E_value=2.9; Accession=PF00560.23; Description=Leucine Rich Repeat
  Pfam annotation: Domain name=NACHT; Domain location=169-315; Score= -37.6; E_value=0.05; Accession=PF05729.3; Description=NACHT domain
  Pfam annotation: Domain name=NB-ARC; Domain location=127-428; Score =249.8; E_value=5.8e-72; Accession=PF00931.13; Description=NB-ARC domain
  Pfam module annotation: Pfam domain module=LRR_1::LRR_1::LRR_1::LRR _1::NACHT::NB-ARC; Domain location=546-567::569-591::593-612::615 -637::169-315::127-428
EFGIIWNLKDDIQRMKRTVSAIKAVCQDAGAKANNLQVSNWLEELKDVLYDADDLLEDISIKVLERKAMGGNSLLREVKIFFSHSNKIVYGFKLGHEMKEIRKRLEDIAKNKTTLQLTDCPRETPIGCTEQRQTYSFVRKDEVIGREEEKKLLTSYLLHPDASVADNVCVVPIVGIGGLGKTTLAQLVYNDNAVQRYFEEKLWVCVSDEFDIKKIAQKMIGDDKNSEIEQVQQDLRNKIQGRKYLLVLDDVWNEDRELWLKLKSLVMEGGKGSIIIVTTRSRTVAKIMATHPPIFLKGLDLERSLKLFSHVAFDGGKEPNDRELLAIGRDIVKKCAGVPLAIRTIGSLLYSRNLGRSDWLYFKEVEFSQIDLQKDKIFAILKLSYDHLPSFLKQCFAYCSLFPKGFEFDKKTLIQLWLAEGFIRPSNDNRCEEDVGHEYFMNLLLMSLFQEVTTDDYGDISTCKMHDLIHDLAQLVVGKEYAIFEGKKENLGNRTRYLSSRTSLHFAKTSSSYKLRTVIVLQQPLYGSKNLDPLHVHFPFLLSLKCLRVLTICGSDIIKIPKSIRELKHLRYLDLSRNHFLVNLPPDVTSLHNLQTLKLSRCLKLKELPSDINKSLRHLELNECEELTCMPCGLGQLTHLQTLTHFLLGHKNENGDISELSGLNSLKGKLVIKWLDSLRDNAEEVESAKVLLEKKHLQELELWWWHDENVEPPLQWEDPIAEGRILFQKNWVGNLSSLLSLEISNCSDWPKIAHIPKVMVSAYTPSALKELKNSPPSFDLLALIQPHSVSILLLPQASLPYSA

SEQ ID NO: 224443 - protein, 36 aa, Glycine max
  Coding DNA Sequence Number=SeqID_107665
MVWTCGVKRWRFAWSGPTSSKASAFASMTCDVLHFE

SEQ ID NO: 224444 - protein, 71 aa, Glycine max
  Coding DNA Sequence Number=SeqID_107666
MALVEEIKARYEKTAVKVVDLKVFQTSDSWNYSIETPKGAPSIIADAPCILSEWAKMSFTQVDPYDSYGST

SEQ ID NO: 224445 - protein, 109 aa, Glycine max
  Coding DNA Sequence Number=SeqID_107667
  Gene Ontology: Mol. function=electron carrier activity; Cellular component=endoplasmic reticulum; Biological process=electron transport
  Homolog annotation: Hit_ID=Q8GUS1; Match level="QueryCoverage=95%, HitCoverage=15%, E-value=7e-38, Identity=76%"; Hit description =NADPH:P450 reductase
  Pfam annotation: Domain name=FAD_binding_1; Domain location=3-108; Score=-43.9; E_value=4e-05; Accession=PF00667.10; Description=FAD binding domain
MMWLYLYETADNVGVFAENDDEAVEEAGKLLGQDLDLVFSLLTDNEDGTPLGGSLPPPFLGPCTLGFVLAHYADLLNPPRKAALVALAAHTSEPSEADRLTFLSSPQGK

SEQ ID NO: 224446 - protein, 88 aa, Glycine max
  Coding DNA Sequence Number=SeqID_107668
  Gene Ontology: Mol. function=DNA binding; Cellular component=nucleus; Biological process=regulation of transcription, DNA-dependent
  Homolog annotation: Hit_ID=Q8GZ96; Match level="QueryCoverage=87%, HitCoverage=10%, E-value=5e-17, Identity=51%"; Hit description =Putative MYB-family transcription factor
MKKTSNVFFSEDEAAVLLQRYNAQTILTLLQELANYPDSKFDWDDLVAKTSTGISNAREYQMLWRHLAYGHSFDENSDLDNQPLISRI

SEQ ID NO: 224447 - protein, 108 aa, Glycine max
  Coding DNA Sequence Number=SeqID_107669
  Gene Ontology: Mol. function=electron carrier activity; Cellular component=endoplasmic reticulum; Biological process=electron transport
  Homolog annotation: Hit_ID=Q8GUS1; Match level="QueryCoverage=77%, HitCoverage=15%, E-value=4e-35, Identity=75%"; Hit description =NADPH:P450 reductase
  Pfam annotation: Domain name=NAD_binding_1; Domain location=1-76; Score=4.3; E_value=0.00082; Accession=PF00175.11; Description =Oxidoreductase NAD-binding domain
MERLVLKEDGVQLGPALLFFGCRNRQMDFIYEDELKNFVEQGALSELIVAFSREGPEKEYVQHKMMDKGMARDVHRTLLTIVQQQREREKESRYSKSNFKRITLHPHH

SEQ ID NO: 224448 - protein, 1060 aa, Glycine max
  Coding DNA Sequence Number=SeqID_107670
  Gene Ontology: Mol. function=hydrolase activity, acting on acid anhydrides, catalyzing transmembrane movement of substances; Cellular component=integral to endoplasmic reticulum membrane; Biological process=calcium ion transport
  Homolog annotation: Hit_ID=P92939; Match level="QueryCoverage=98%, HitCoverage=98%, E-value=0.0, Identity=78%"; Hit description=Calcium- transporting ATPase 1, endoplasmic reticulum-type
  Pfam annotation: Domain name=Cation_ATPase_C; Domain location=850 -1045; Score=249.5; E_value=7.2e-72; Accession=PF00689.11; Description=Cation transporting ATPase, C-terminus
  Pfam annotation: Domain name=Cation_ATPase_N; Domain location=19-99; Score=104.3; E_value=3.6e-28; Accession=PF00690.16; Description =Cation transporterATPase, N-terminus
  Pfam annotation: Domain name=E1-E2_ATPase; Domain location=118-373; Score=367.9; E_value=1.6e-107; Accession=PF00122.10; Description=E1 -E2 ATPase
  Pfam annotation: Domain name=Hydrolase; Domain location=377-754; Score=93.3; E_value=7.4e-25; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=850-1045::19 -99::118-373::377-754
MGKGGQDYGKRENTSTAPSDREIFKAWAKDVRECEEQFKVNVKVGLNPDEVENRRKIHGLNELEKHDGQSIWSLVLEQFNDTLVRILLVAAIISFVLAWYDGDEGGEMEITAFVEPLVIFLILIVNAIVGVWQESNAEKALDALKEIQSEHAVVIREGAKIPNLPAKELVPGDIVELKVGDKVPADMRVVELISSTLRLEQGSLTGESEAVNKTNKRVDEDADIQGKRCMVFAGTTVVNGNSICLVTQTGMDTEIGKVHMQIHVASQSEEDTPLKKKLNEFGEKLTLIIGLICILVWLINVKYFLSWEYVDGWPRNFKFSFEKCTYYFEIAVALAVAAIPEGLPAVITTCLALGTRKMAQKNALVRKLPSVETLGCTTVICSDKTGTLTTNQMAVAKLVAVGHNVDTLRAFKVEGTTYNPADGQIENWPTGGLDANLQMIAKIAAVCNDAGVAQSEHKFVAHGMPTEAALKVLVEKMGLPEGSKVAPSASTRTLLRCCEWWSEHDRRLATLEFDRDRKSMGVIVDSGLGKRSLLVKGAVENVLDRSSKIQLRDGSIVNLDDNARNLVLQALHEMSTSALRCLGFAYKDELPKFENYSGNDDHPAHQLMLNPSNYSSIESELIFVGLVGLRDPPREEVYQAIEDCRDAGIRVMVITGDNKNTAEAICREIGVFSPDEDISSKSLTGRDFMELHDKKAYLRQHGGLLFSRAEPRHKQEIVRLLKEEGEVVAMTGDGVNDAPALKLADIGIAMGIAGTEVAKEASDMVLADDNFSSIVAAVGEGRSIYNNMKAFIRYMISSNIGEVASIFLTAALGIPEGLIPVQLLWVNLVTDGPPATALGFNPPDKDIMKKPPRHSDDSLINLWILFRYLVIGIYVGLATVGIFIIWYTHGSFFGIDLSGDGHTLVTYTQLANWGQCSSWQNFTASPFTAGAKTITFDNSCDYFSTGKVKAMTLSLSVLVAIEMFNSLNALSEDGSLLTMPPWVNPWLLLAMSVSFGLHFLILYVPFLAQVFGIVPLSFNEWLLVLVVALPVILIDEILKFVGRCTSSRASSARKSKQKSE

SEQ ID NO: 224449 - protein, 335 aa, Glycine max
  Coding DNA Sequence Number=SeqID_107671
  Homolog annotation: Hit_ID=Q6Z256; Match level="QueryCoverage=23%, HitCoverage=26%, E-value=3e-33, Identity=73%"; Hit description =Putative actin related protein 2
  Pfam annotation: Domain name=Actin; Domain location=83-303; Score= -203.2; E_value=0.0012; Accession=PF00022.9; Description=Actin
MVVFGDDDGYCSPVKKQKGCWKETKHDSSVAGLWISQTTTKQRQITAKWAQTKAKQVRQRRRRMVRRSSEKGLCKNNATCQKGDRGNAVAKRGKIVGKRDVSREVHWNAETVTARRRQAENHWGPSGNRSSEGEQSREVPVVDGYSFPHLTKRMNVAGRHITSYLVDLLSRRGYDYKREYQLGLETTILVKNYTLPDGRVIKVGTERFQAPEALFTPVGVENPAYEAWEQQDQVLLAWLQSTLSTSFLSRIIGCVHSYEVWEWIHDYFHKQMQARARQLRTELLAMILEDKSMCEFLLRIKAISDALVLRTRNRELNVTVKKKEDHRALLIVIKR

SEQ ID NO: 224450 - protein, 84 aa, Glycine max
  Coding DNA Sequence Number=SeqID_107672
  Subcellular localization annotation: CTP_CleavageSite=57; ConfidenceScore=5.08e-01
MASAGVPYKCGKGSVKYFRKLFGTSFSGKFPEKDFFRKKNLGIPEVVTNFVRKIVIRKFPEEGSSGNFRKKVLPETSGRTFFRN

SEQ ID NO: 224451 - protein, 260 aa, Glycine max
  Coding DNA Sequence Number=SeqID_107673
  Gene Ontology: Mol. function=RNA-directed DNA polymerase activity; Cellular component=chromatin; Biological process=chromatin assembly or disassembly
  Pfam annotation: Domain name=Chromo; Domain location=117-171; Score =46.2; E_value=1.1e-10; Accession=PF00385.14; Description='chromo' (CHRromatin Organisation MOdifier
SETIENQLLKAQERMKNQADKKRLDKSFAVGEWVFVKLRAHRQKSVVTRINAKLSARYYGPYPILERIGAVAYKLKLPVGSRVHPVFHVSLLKKAVGNYQEEEELPELLEEDQMEEYEPAAVLATRKVRQQGEESKQVLIQWKGKTAEEATWEEAIMMKSQFPKFNLEDKIAAEEGSIDRSQAALPREQLIHNETNKPRIWQCIGNCFDPEQKLAHGLIFKDHCKQLSSKLPCSGLHLFVEIIMDPFPNLIGMDASNDPR

SEQ ID NO: 224452 - protein, 137 aa, Glycine max
  Coding DNA Sequence Number=SeqID_107674
  Gene Ontology: Mol. function=nucleoside-triphosphatase activity; Cellular component=integral to membrane; Biological process=transport
  Homolog annotation: Hit_ID=Q9LFG8; Match level="QueryCoverage=89%, HitCoverage=15%, E-value=2e-38, Identity=65%"; Hit description =Probable white-brown complex homolog protein 20
MREPAHNATVARPTCRARNHFLLPAFSLPSIRGHTFWARVLHQQGQDPSVLDMVPLPFAGEVSVRGSAAERVRCEVSEVLRKRDSDVRQHAAGDGAGGVEGGAAEEYERDAGNEHLEVDVRSYWRGCAEAAGDYAAE

SEQ ID NO: 224453 - protein, 501 aa, Glycine max
  Coding DNA Sequence Number=SeqID_107675
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=31%, E-value=1e-151, Identity=53%"; Hit description =Chromo
  Pfam annotation: Domain name=RnaseH; Domain location=171-291; Score= -20.0; E_value=0.0042; Accession=PF00075.14; Description=RNase H
  Pfam annotation: Domain name=zf-H2C2; Domain location=367-408; Score =16.6; E_value=0.0023; Accession=PF09337.1; Description=His(2)-Cys(2) zinc finger
  Pfam module annotation: Pfam domain module=RnaseH::zf-H2C2; Domain location=171-291::367-408
MPFGLMNAPSTFQSLMNDVFRPLLRKCVLVFFDDILIYSRGWEAHAKHLKEVLQLLAQHSLVANKKKCYFAQKTVEYLGHMITEEGVAVDPNKVKSVMAWPTPKNVKGVRGFLGLTGYYRKFIRDYGKIAKPLTELTKKDNFKWGAEAQKAFDELKERLTTSPVLSLPDFSKGFVIECDASGGGIGAILMQDKKPVAYFSKALGARNLTKSAYEKELMAVVLAIQHWRPYLLGRKFIVSTDQKSLKQLMQQRIVTAEQQNWAAKLLGYDFEIVYKQGKLNKGADALSRMHEGTELNQITSCAQWDQEQQVKEEINQDPKLQDIIRQLQQDSGAKPGYEYKQGVLFYDGRLVISSKSQLIPTLLREFHATPQGGHSGFYKTYRRIAANVYWIGMKGAVQEYVRSCDVCQRQKYLATSPGGLLQPLPVPEQVWEDISMDFISGLPKSKGFEAILVVVDRLSKYSHFVPLKHPYTARSIAEIFCKEVVKLHGIPLSIVSGIPCS

SEQ ID NO: 224454 - protein, 119 aa, Glycine max
  Coding DNA Sequence Number=SeqID_107676
  Gene Ontology: Mol. function=nucleic acid binding
  Homolog annotation: Hit_ID=Q2QKC1; Match level="QueryCoverage=99%, HitCoverage=24%, E-value=4e-23, Identity=51%"; Hit description =Alternative splicing regulator
MPRYDDKYGNTRLYVGHLSSRTRSRDLERAFSRYGRFLGFWLNLERSVVGGLPWWNWWKFLSSVDFGDSFCNVIACFYGNGINHKLDFSDPRDADDARYNLDGRDVDGSRIIVEFAKGV

SEQ ID NO: 224455 - protein, 168 aa, Glycine max
  Coding DNA Sequence Number=SeqID_107677
MESLSSKLTMLICLIQAQGEDGVIHGHQSGHIHLVVAEAVIAVTAEIAATVLGAFGLASRSRSPVRREESPVREDRSQSPQHKNSPQPSKTRKHSPSPDRSPQRRGDTSPDNDRLSRSPARDREDRGYDSPKVNGRSGSPSRSPRDDDRSPIDDEDNHRHSPRGSESP

SEQ ID NO: 224456 - protein, 161 aa, Glycine max
  Coding DNA Sequence Number=SeqID_107678
  Homolog annotation: Hit_ID=Q10N48; Match level="QueryCoverage=77%, HitCoverage=54%, E-value=2e-25, Identity=46%"; Hit description =Expressed protein
  Pfam annotation: Domain name=zf-FPG_IleRS; Domain location=26-57; Score=14.3; E_value=0.1; Accession=PF06827.4; Description=Zinc finger found in FPG and IleRS
MSLVQYLVKRDYCNMQFPEPLTNFSGKKCKRCGIYEEDIFSDDVFDEWELCPSDFTTPDGRYAHFKEKEFNASFLCPECLSFSGVSVSAPPAENDNPNKKGMNVAVIILLSILGSTILILGMLGTYKYWQKRKREQDQARFLKLFEEGDDIEDELGLGTII

SEQ ID NO: 224457 - protein, 257 aa, Glycine max
  Coding DNA Sequence Number=SeqID_107679
  Gene Ontology: Mol. function=ATP binding; Cellular component=integral to membrane
  Homolog annotation: Hit_ID=Q5W7C1; Match level="QueryCoverage=99%, HitCoverage=89%, E-value=1e-101, Identity=71%"; Hit description =Unknow protein
  Pfam annotation: Domain name=UPF0014; Domain location=3-246; Score =192.6; E_value=9.2e-55; Accession=PF03649.4; Description =Uncharacterised protein family (UPF0014)
MEFLKGMVKPVAATAVVCLAVALSFYQKLGLELEMVVAIVRAFIQLSIIGFVLEFIFRQDNAGWILLAYLFMVSIAGYTAGQRAKHVPRGKYVAGASILTGTAVTMLVLVALSVFPFTPRYIIPVAGMMVGNSMTVTGVTMKRLRDDIKTQMNLVETALSLGATPRQATHEQVKRALILALSPVVDNTKTVGLISLPGAMTGLIMGGASPLEAIQLQIVVMNMMIGAATVSSIMATYLCWPAFFTKAYQLETKVFSS

SEQ ID NO: 224458 - protein, 318 aa, Glycine max
  Coding DNA Sequence Number=SeqID_107680
  Gene Ontology: Mol. function=DNA binding; Biological process=DNA integration
  Homolog annotation: Hit_ID=Q1S5L0; Match level="QueryCoverage=64%, HitCoverage=39%, E-value=6e-27, Identity=34%"; Hit description =Integrase, catalytic region
MQRVLNGKNQFRFVDGSIDVSLELGNLIHISEIQQQINGLKQGSMSVTKIFTELKVLQKELESQRPVPTCSSLDLSSCVSMRNAHMFQLQDQVIQFLTGFSDQFSVLKSRVIGGSISTTPWCCNKKGKEILLILMIQRFWSVQLRLLDTRKPQGQGRRANSNNYIGRNSNWGCIYCRKTGHTSETCYRKHGFPPNYGKGVQLVANATQQLQKTESKDEVMPRLHCHTPAGTLVTLENVLNKQFSFVVPFAQKIDSWSGFKQLVGCEDLNRAQRHVRRYNQSCATNMENWKITWEIGEEEYEGEKKEKRIARHGHGNTG

SEQ ID NO: 224459 - protein, 320 aa, Glycine max
  Coding DNA Sequence Number=SeqID_107681
  Gene Ontology: Mol. function=nucleic acid binding; Cellular component= nucleus; Biological process=mRNA processing
  Homolog annotation: Hit_ID=Q2QKC1; Match level="QueryCoverage=90%, HitCoverage=80%, E-value=2e-62, Identity=45%"; Hit description =Alternative splicing regulator
  Pfam annotation: Domain name=RRM_1; Domain location=46-115; Score =16.1; E_value=0.0047; Accession=PF00076.12; Description=RNA recognition motif. (a.k.a. RRM, R
  Pfam annotation: Domain name=zf-CCHC; Domain location=140-157; Score =31.6; E_value=2.7e-06; Accession=PF00098.13; Description=Zinc knuckle
  Pfam annotation: Domain name=zf-CCHC; Domain location=162-179; Score =6.0; E_value=0.099; Accession=PF00098.13; Description=Zinc knuckle
  Pfam module annotation: Pfam domain module=RRM_1::zf-CCHC::zf-CCHC; Domain location=46-115::140-157::162-179
MPRYDDKYGNTRLYVGRLSSRTRSRDLERVFSRYGRFLRFSLNLEVFVGRLALVEFVEIPVDNDGLIVSGNHFRRVRGVDMKNDFAFVEFSDPRDADDARYNLDGRDVEGSRIIVEFAKGGPRGSRDREYMGRGPPPGSGRCFNCGIDGHWARDCKAGDWKNKCYRCGERGHVLLVVEEAGIEATAETTATVLVTLVLASRSRSPVRRERSPVSEDRSQSREPSKIRKHSASPDQSSPRKRGDTSPGNDRLATHQDGSDYSDGPRGKSRSPASPARDRDEGGYDSPKANGHSRSPSRSPRDDDRSPIDEDDDNHRRSQSP

SEQ ID NO: 224460 - protein, 223 aa, Glycine max
  Coding DNA Sequence Number=SeqID_107682
  Homolog annotation: Hit_ID=Q1RXD8; Match level="QueryCoverage=27%, HitCoverage=7%, E-value=4e-09, Identity=45%"; Hit description=RNA -directed DNA polymerase
MKVGAYEGERMKVYGVVCWDHYEGWRGLEKEEISKSFSIWWRDLCKTCGGLNESKWFDDMVVRKVGKGDKTQFWKDIWVGNQSLASEYPRLFLNSLQKDEYGANSIWGSEMRESGGGIVLGGESGLWEGDMVENSYGGGGVVLVEGAEDSWLWPHEQSGLSLHIRLCAKGSRIQILMHTLVDMWKVKLAPKETKFWYCRNSTTCKRSNRGCRVVKLEKLKVQQ

SEQ ID NO: 224461 - protein, 127 aa, Glycine max
  Coding DNA Sequence Number=SeqID_107683
  Subcellular localization annotation: CTP_CleavageSite=41; ConfidenceScore=5.55e-01
MNEHLRTFALQLSYSTTTPKSSSTPHTASSVLSSCRKWWVSEARVIGEFDSMSANCFGEDLRWWQDDFKLGLTVEHNSGFGRADGGGAPAETMMPKSQDRGKTDILLSSMWQVGHSYMWWRGNEISG

SEQ ID NO: 224462 - protein, 207 aa, Glycine max
  Coding DNA Sequence Number=SeqID_107684
MATCCGLRSDNKPITAATIKQNHAWSGKNMEGHNGLDTLECLRGRLLAERHASRVAKEEAESLGNKFVELEKKLKEEIKLRDKAERKLKLLKKKLECFNNVTTPSWQKSPSSEICEDSCGSSLCSAVSRDSEANETKLVHTVNPALLENEVHNHYVAEECVLVQTHNSPLTTKDCNSDQSNFLPQILGNNPNQSSDNLKNDGNRCPR

SEQ ID NO: 224463 - protein, 159 aa, Glycine max
  Coding DNA Sequence Number=SeqID_107685
TNIVICTLCQPGASEPVDTQRLMSSFAPLSSRDGESNDMQRYPSVFPYKTISVNPDPRSQVAETNVIICTLCQPGASEPIDTQRLTSSSTPLSSRDGGRRRYPSGYPYKMISVNPDLRSQTNIVIYTLCQPGASKPVDKPRLMSSSAPLSSRGSESDDK

SEQ ID NO: 224464 - protein, 49 aa, Glycine max
  Coding DNA Sequence Number=SeqID_107686
MMETWMAQDLDSIGIITEDRDLGGRDENGEEVRLHGDRKGEMMLKATRR

SEQ ID NO: 224465 - protein, 75 aa, Glycine max
  Coding DNA Sequence Number=SeqID_107687
MAINPREERRKDNESGSDGEEESVALLRDCDLIGRERTCKKKEKCCLSYPNFVRGPLLDDMRPFFGPCEVLGTHH

SEQ ID NO: 224466 - protein, 159 aa, Glycine max
  Coding DNA Sequence Number=SeqID_107688
  Gene Ontology: Mol. function=inorganic diphosphatase activity; Cellular component=cytoplasm; Biological process=phosphate metabolic process
  Homolog annotation: Hit_ID=Q2HTA8; Match level="QueryCoverage=78%, HitCoverage=58%, E-value=2e-53, Identity=86%"; Hit description =Inorganic pyrophosphatase
  Pfam annotation: Domain name=Pyrophosphatase; Domain location=38-153; Score=151.1; E_value=3e-42; Accession=PF00719.9; Description =Inorganic pyrophosphatase
MENSDARCVRVAVNVRPLITLELMLGCTNCIFVLPGEPLVVQITKGSKVKYELDKKTGLIKVDRVLYSSFVYPYNYGFIPRTLCEDNDPIDVLVLMQEPVLPGCFLRARAIVLMPMIDGGEKDDKIIAVCADDLEYKHFTNYKELVPHASPRSDISLKI

SEQ ID NO: 224467 - protein, 67 aa, Glycine max
  Coding DNA Sequence Number=SeqID_107689
MESSVNGGFSHLQSCGDSSEEELSVLPRHTKVVVTGNNRTKSVLVGLQGVVKKAVGLGGWHWLGEQF

SEQ ID NO: 224468 - protein, 97 aa, Glycine max
  Coding DNA Sequence Number=SeqID_107690
MNVDMEALKDQTASMMEAMLSMKRMMDPGLSSNALLKMKCECPKSHFVVMRNSISMPSFSKTIMVICHFSKTSMSFDQDYYSLFFLPETIKSVDMRR

SEQ ID NO: 224469 - protein, 77 aa, Glycine max
  Coding DNA Sequence Number=SeqID_107691
  Homolog annotation: Hit_ID=Q9XFS0; Match level="QueryCoverage=64%, HitCoverage=5%, E-value=3e-15, Identity=78%"; Hit description=Gamma -adaptin 2
MTETHLRWFGLMRRKSTEAPMRKMDQMEDGSIVLCKNHKESSRLGRKFCQSCYCLTKGEAPWSYDYWGSALYRAVQN

SEQ ID NO: 224470 - protein, 71 aa, Glycine max
  Coding DNA Sequence Number=SeqID_107692
  Gene Ontology: Mol. function=binding; Cellular component=clathrin coat of trans-Golgi network vesicle; Biological process =intracellular protein transport
  Homolog annotation: Hit_ID=Q9XFS0; Match level="QueryCoverage=98%, HitCoverage=8%, E-value=8e-29, Identity=87%"; Hit description=Gamma -adaptin 2
MIQAIRACKTAAEERAVVRKECATIHAAIDENDPDYRHWNLAKLMFIHMLGYPTHFGQMECLKLIASPGFP

SEQ ID NO: 224471 - protein, 199 aa, Glycine max
  Coding DNA Sequence Number=SeqID_107693
MGPVGYYNAHTCTYSHFYFAAKSLAPDSSLLSGCLLYLWWIFSFLILWVLTNGIEVKLQRNALSVIEAPTGNEEDDDLEFENMPWNGSDMASDDTHKFHKSRHRMHRTLGSSHKTTSRSFSADSQSKGSVSMPLHGSTKVDLSKLEMAALWRYWRHFNLVDAFPNPSKEQLVDVVQRHFMSQVIVGFVQAAKRLKTVWK

SEQ ID NO: 224472 - protein, 71 aa, Glycine max
  Coding DNA Sequence Number=SeqID_107694
MELQHLRSERDRIENEVHHLSESLREIIENNTSNSWGRNEMKTLNDEGMKLGVTRGGVDWGWCHFVHSKFY

SEQ ID NO: 224473 - protein, 341 aa, Glycine max
  Coding DNA Sequence Number=SeqID_107695
  Gene Ontology: Mol. function=RNA binding; Biological process =regulation of transcription, DNA-dependent
MRNQKLNSEEELWRQNLSENFEPKFEIRSSVDGTLVLDLNTDGNHHYPVFDLNLNYLQLDANDDSNIEDTDSILNEGEDADSVLDTVDDTNSFLNEGDDTDSFLNDGNVNASHEDATVRKKKFLSNEQRWAIYTALLKKNVNDKLKRTTTNEVATLFLVSLRTVRKRAKDTPHGTNVNVSHKKTKNYGRKRDQVDLNKIIDVPLHKRTTLRSLASALNMNHNTLFKLLKEGLIRRYSNAIKPHLKNHHKRAQLQFCLSVIDHTSLPDETKFIDMYNIVHINEKWFYMSINTEKYYLLPVEEDPLIQCQSSHYIGKVMFLVVMGCPKFDNERNEIFSGKIGV

SEQ ID NO: 224474 - protein, 149 aa, Glycine max
  Coding DNA Sequence Number=SeqID_107696
MVVSHRGFDQPLFDLGIDDDDNEEVDDAVVVEESQENNNDEPEYNYNHVVYQDSQGYNSENLSLEDLFDNDGLTQDSCFEFSFKENREVMANRTKPLSEVENGAFGESQNEEAMKSRVNEIQNERVEDVKTEDLKCVFDLNEVPIEGCK

SEQ ID NO: 224475 - protein, 92 aa, Glycine max
  Coding DNA Sequence Number=SeqID_107697
MMLNILETRRIRPLPLPRRSVVTQTKKLIEIWIQEWCCSSSSGSWLSGISRDGSRAWARRLQYRHDIRGGGCRGVVEGTIRVLHDPLNSVEG

SEQ ID NO: 224476 - protein, 59 aa, Glycine max
  Coding DNA Sequence Number=SeqID_107698
MIIGGKEVVTTRMIVMGKCGDSHAGKKTLKGRGDKIRVPNFWEPNANGTCDRGWYHSNT

SEQ ID NO: 224477 - protein, 186 aa, Glycine max
  Coding DNA Sequence Number=SeqID_107699
  Gene Ontology: Mol. function=binding; Cellular component=clathrin coat of trans-Golgi network vesicle; Biological process =intracellular protein transport
  Homolog annotation: Hit_ID=Q9XFS0; Match level="QueryCoverage=62%, HitCoverage=13%, E-value=7e-34, Identity=65%"; Hit description=Gamma- adaptin 2
MALVALLKLSSRFPSCSERIREIIVQCKGNLVLELQQRSIEFNLIIAKHQNIRHTLVERMPVLDEATFLARRAGSLPDVALTSTGPSVGLPNGAGKPVAPIVDLLDINSDDAPVPTSSGGDLLQDLLGVDLSLASQQSGCANLFACLTKKRDHEQHIIGKIKIPIPNVLYIRALSENLSFTKAKRN

SEQ ID NO: 224478 - protein, 740 aa, Glycine max
  Coding DNA Sequence Number=SeqID_107700
  Homolog annotation: Hit_ID=Q6K884; Match level="QueryCoverage=88%, HitCoverage=80%, E-value=1e-161, Identity=49%"; Hit description =Transducin-like
MVQVRFHPLHPHILASGSLDQEVRLWDANTSECIISHHFYRPIASIAFHAKGEIIAVASGHKLYIWFHNKKGEASSPIFVLKTKRSLRAVHFHPHAAPYLLTAEVNDLESSDSSMTEATSLGYLQYPPPAVFVTNIHPTEHISLSSELPYVSLPFYVMPAYTVDESRAELQHASHDVGSGSMQIESAAMVQLHADPSAAAHYETTVSPMDTFSEMPSSSQTGAEYPAHTAFSNGMGIGLSNLTMDGMETDETRPAEGSQHGNLTNTYSLNGMLHGLSRQTANRGVLSEFGQFHQFFPSRDPSGWEIPFLHGWIMGQSQVGVPSMLPHMGASRDNLSQHIGSSSIKASNPSTSNVDAAMPSSAIPGSISIPGSSMRSGLRNHFSQSRVPVSESGNLAASINAPHDGFDIQTIVSRIQSELATSVAATAAELPCTVKLRVWSHDIKNPCAPLNADRCRLTIPHAVLCSEMGAHFSPCGRFLAACVACVLPHIEADPGLQTPVHQDPGVATSPTRHPISAHQVMYELRIYSLEEATFGSVLASRAIRAAHCLTSIQFSPTSEHILLAYGRRHGSLLKSIVIDGETTLPIYTVLEVYKVSDMELVRVLPSAEDEVNVACFHPFAGGGLVYGTKEGKLRVLQYDGAHAVNGTGPSYFPEETIVGVSHGLSMKVGGPVLDVKRRGWGRWSLWKSCVNLVGVYQKDNYRERWTSQAVELSHHKRFSHLDFLMNNTTSEVIEKPIQLI

SEQ ID NO: 224479 - protein, 469 aa, Glycine max
  Coding DNA Sequence Number=SeqID_107701
  Gene Ontology: Mol. function=nucleic acid binding; Cellular component= chromatin; Biological process=DNA integration
  Homolog annotation: Hit_ID=Q1T010; Match level="QueryCoverage=80%, HitCoverage=28%, E-value=1e-106, Identity=46%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=322-469; Score =112.6; E_value=1.2e-30; Accession=PF00665.16; Description=Integrase core domain
MTMEENEKIADFFARVKVVINQMATQVTRILATVTEEEVVVGTIEEEVAMFLVVEEARIMLKINLISRREAGAEATIEVVAMVEEEVVGKDECYAKKDSQGDEANLAKGDDEENELVMLMVATADEMCTIDEWYLDTGCSTHMTGHKEWLVNFDASKKNRIKFADGRAMLAEGVGNVMIKMSNGTQYCISGVFYVPGLESNLLSLGQLVEKGHKVIMEDKKLKLFDSGDKKNLIFDVSMSRNRTFRANLEALCHKCLATVVSEDDWVWHHRYGHLNFRDLHDLNTHNMVRGLPLINVPKELCKNCVESKQHRESFKNFVETKAREKLEVIYSDVCGPMQCESLGESRYFVSFLDDFTRKMWVYILKRKSEVLGVFKKFKRMVVRQTGFLIKKTIVTDGGGEYTSNEFDEFCELEGIVHDVTPPYTPQHNGAADRRNRTMMNMVRCMLNGKKLPKFLWAEAVSTAVYVLN

SEQ ID NO: 224480 - protein, 85 aa, Glycine max
  Coding DNA Sequence Number=SeqID_107702
MVEALLLGLHPDGKERNDWRGVSNGLCEGNTEHCRGHERGGGCRSASPISLRFQIDLHLRFLPQFPDLHYMNIPWALMALHIKDD

SEQ ID NO: 224481 - protein, 207 aa, Glycine max
  Coding DNA Sequence Number=SeqID_107703
WHLRKGKLLLHRPRPYLIDPGLHPKRLRRELKHRNWHKELTNFVDGSIDVAIIKEFYAILYDPEDKPPKQVRVRGHLIKFDADTLNAFLKTPVILEEGENFPVYSRFCRSKSELQELATRLCIPGRGFELNANGLSLKIFQKNLTTLAYTWSVLSFSNLVPTSHTSDITLDRARLIYGIIQKMDMNLGYIISAQISMIANQGRTRTK

SEQ ID NO: 224482 - protein, 860 aa, Glycine max
  Coding DNA Sequence Number=SeqID_107704
  Homolog annotation: Hit_ID=Q1S805; Match level="QueryCoverage=95%, HitCoverage=99%, E-value=0.0, Identity=57%"; Hit description=DENN; dDENN; uDENN
MDSKEEAEHHEDRPTSPMRVLQQLSEGAFRVAGEAFHNMYSGGGSSMPQMGPGAHRRCQSELVTREGVQRNNSFQKLRSHVHKAWRWGGRFREEVSPASFNPEVMANQKRQWYRLHPKNLEPESLFEHFVIVGLHPDANLEAVEHAFARRKKWEKEKPASLDYKMLQQQRPPEPTLEPQAWLLERTPSLSELNELVYGQEHLGKDDLSFVFTIKAADNATLYGVCLHVPEIVQRPPGILGISSPFSHPSGACSRFLVSAPRCYCLLTKVPFFELHFEMLNSRTYYALLGCSLIAQERLNRITQFINEVTLTGSTPSTPKLDDQMSSNANSPDRESFSDWMDCAIPLDAAAVITAAAAGIISDDEIIQLSPKRWDSRCQSPVSVTASDASDHWQVRDIDKDGRKNLQDHDNCTFGAPETLGSIERMHGNYKNDQVSPKVGTPFSAQNRVLERLGSSESLFSPVRSMASEDEDDFFSNNERDYGDELLIEWAMENKNDLLQIVCRYHAEPIPPRGSEFVFHPLEHLQAIQYIRHSVASLGFGDDCSNCSEPALDNAKLAAAEEALSLSVWTMATTCRVLSLDSMLYCIFFASCGLLPMAPAFPLPIEDFDSFHLSTMFLVGDGINYRSVVGKTGGNNVSKSGDYNPTFILANFDIMQGVLSATVLSLIPMIRPFQWQSLLLPVGIQHKPDDLNMKTKNLVLVNMPKDQVTMCHLPRLPRHRELLSQLTPIHARLSNERSIARKHPVHRCNEVQAEASTQFLNIMWHYLESLCSDLKSHTITSVQSNNDRVSLLLKDSFIDSFPARDQPFIKTLVCQALRVVSHSPIMSHYFRPNGAIHLLYMFDGTEEDIVVDFIGEDLQSR

SEQ ID NO: 224483 - protein, 633 aa, Glycine max
  Coding DNA Sequence Number=SeqID_107705
  Gene Ontology: Mol. function=nucleotide binding; Cellular component =nucleus; Biological process=regulation of transcription, DNA -dependent
  Homolog annotation: Hit_ID=Q1S808; Match level="QueryCoverage=100%, HitCoverage=98%, E-value=1e-174, Identity=55%"; Hit description=Plus- 3
  Pfam annotation: Domain name=Plus-3; Domain location=263-372; Score =152.2; E_value=1.4e-42; Accession=PF03126.8; Description=Plus-3 domain
  Pfam annotation: Domain name=TolA; Domain location=269-630; Score= -156.2; E_value=0.098; Accession=PF06519.2; Description=TolA protein
  Pfam module annotation: Pfam domain module=Plus-3::TolA; Domain location=263-372::269-630
MADLENLLLEAAGRTRHSCQPSRRGHGGGGGSDSREDDSEDEHDYSGRKPSSLQVPLKKRFDPIERDDGERSKDEGDDDVGGRCCHEGDSSDESDFGDDLYKNEDDRLNLSEMTELQREMILSERATKKHDKYFLGKIASKREKGKKTVAGKQTSPLPPSRVRSSARSADRSTAKDGALNELRAKRLKQQDSEANRRPSEASRSSGPGHFSPKHKPFPNLSSSSDSETESKSLSDNEGLSDDDRIIDSDDDRIMLGSEGLSFEDIKEITIRRSKLAKWFMEPFFEELIADCFVRVGIGRPKSGPIYRLCMVKNVDATDRARQYKLENKTTHKYLNLVWGNETSAARWQMAMISNSPPKEEEFIQWVKEVERRGGRMPTKQEVAEKKEAILKTNLFVYSAATVKQMLQEKKSAKTRPLNIAAEKDRLRTELEIAHSKNSKAEVKRIMTRLEELEESRKAKRMDARALKLAEMNRKNRFENFKNASELKPVNKELKAGEAGYDPFSRRWTRSRNYYSGKPAEEGAAENNSAGGDTGSYHTGAAETVMAGTAATTAALKAAAGAGKLVDTSAPVDQATESNVLHNFELPISLATLQNFGGAKGVQAGYMAKKQRIEATAGFKVLENDRQKHALTLT

SEQ ID NO: 224484 - protein, 639 aa, Glycine max
  Coding DNA Sequence Number=SeqID_107706
  Homolog annotation: Hit_ID=Q10RZ4; Match level="QueryCoverage=44%, HitCoverage=50%, E-value=3e-20, Identity=28%"; Hit description =Expressed protein
MEPVPVVLYVSSDEEEEVPCLEENGGRNRIIDFDWVKEFLDISDEESNEVSKHEHKSKSNSSLISTPSVEDDDDCVVLDVDPESRVSTVDGDSPTESDELVVVGEKGQFDLDVLVTGKYRNVLSIFLVFNSLSLNCLAEILMVLTEHIACRDYPHPRHLCVIFPYSSTPHEKHCYQCYCYVCDSVAPCPKWVTGLLGMDHCHATDESETWRTRRKIFKLGKTAPLPSSTNYSTLSDVTNAQQNNILPFCVMSPYSMLPNQTSMSTATHTCSPVNSIPQNQSSSPITMRTCSSIHSSFQNQVSWPNNVPSIATNFTIPSGTNRGRYPESGSTLARNRYQSQSIPQHSLGNRAIQRVRQHGVSTLVPQFHSHTLFNGLGSVGVGSTMPMNHSTHDASGGFSNHVNLAQQFAGYHAATGFSNDNRTSYGQNAYVPQNLWYPNPCSQPNNLSSVSNYATAHETQVSYQSNGSQNFYAVQGNNAPSSNNVAGLSRNENVCGNVTQSGTTRQYSCQQKPHDASLIESALKADRIEHSKQSIPYQQSSGSTNTCLGSVDDIKRWLFGDENSFLVGADDALASSSAPSGLGSVDDIKRWLFSDENTVPVGADDALASELNTPSPDLSTFDGGSFFDFESSWECRARV

SEQ ID NO: 224485 - protein, 167 aa, Glycine max
  Coding DNA Sequence Number=SeqID_107707
  Homolog annotation: Hit_ID=Q1S7Z5; Match level="QueryCoverage=25%, HitCoverage=8%, E-value=1e-16, Identity=86%"; Hit description=Rh -like protein/ammonium transporter
MKLCSLKRVIVLQLLRQQVAPSDHPSSHEPTYDCSPRIHNRTPVEIKVFSFPKLAGLSGGLGMKKFSMIMLNRCGTLLNQIHTLDNIIFKDVTQSLQQPSPMQVCWIAPPGDVMKLNTDGSAFGNPGQAGFAGITMDSLGNCVTQVSWDPVALQLQFMQSYSPSIMV

SEQ ID NO: 224486 - protein, 870 aa, Glycine max
  Coding DNA Sequence Number=SeqID_107708
  Gene Ontology: Mol. function=protein binding; Cellular component =exocyst; Biological process=protein transport
  Homolog annotation: Hit_ID=Q5YLM3; Match level="QueryCoverage=96%, HitCoverage=99%, E-value=0.0, Identity=61%"; Hit description =Roothairless 1
MAKSSADDAELRRACEHAIEGTKHKVVLSIRTVKTHGTWGKTAKLGRQMAKPRVLALCTKAKVQRTKAFLRVLKYSNGGVLEPAKLYKLKHLSKMEVATNDPSGCTFTLGFDNLRSQSVAPPQWTMRNVDDSLAHCIVYYFSCRNRLLFGILNICKDILGRLPKVVGIDVVEMALWAKENTPAVSTQNNQQDGTSVESTAAETELKVYVEKELVSQAEEEDMEALLGTYIMGIGEAEAFSERLKRELQALEAANVHAILESEPLIDEVLQGLEAASNCVEDMDEWLGMFNVKLRHMREDIESVSACRVQIETRNNKLEMQNVNNRTLIQELDKLLEQLSIPSEYSACLTGDSFDEAQMLQNMEACEWLTTAMRGLEVPNIDPTYAKMRAVKEKRGELQIIKSVFVGKASEYLRSYFASFVDFMLNDKNYFSQRGQLKRPDHADLRYKCRTYARLLKHLKILDKNCLGPLRKAYCSSLNLLLRREAREFANELRASAKTSKTPTVWEGFMGSGQNVNSADTAAVSEAYAKILTIFIPLLVDEVKVLDILSPGTFPSLVDGNKTGHNDQKNDDDLGIMDIDENDSKSGKNSVDFAALNESLQDLLDGIQEDFAAVVDWAHKIDPLCCISMHGTTERYLSGQKADAAGFVRILLGDLESRISMQFSRFVDEACHQIERSERNARQTGVLPYIPSLYDLANVVPTLAKFYHQASEAYEQACTRHISVIIYYQFERLFQFARKIEDLILNNVAPEEIPFQVGLSKADLRKTLKSSLSGVDKSIAAMYKKLHKNLTSEELLPSLWNKCKNDFLDKYETFVQLVARIYPAESVPSVAELRDLLASMREALQSVATTTRIEGSMESVCRDEPRINSIA

SEQ ID NO: 224487 - protein, 283 aa, Glycine max
  Coding DNA Sequence Number=SeqID_107709
  Gene Ontology: Cellular component=integral to membrane
  Homolog annotation: Hit_ID=Q1S566; Match level="QueryCoverage=92%, HitCoverage=83%, E-value=4e-68, Identity=52%"; Hit description =GNS1/SUR4 membrane protein
MESMKYWLIEHPAMVSFRWSPTQSYGGTWWFLISATSFYVAAAVTLHLLLKFFRRRRAVPLGPIPALHSLAMSLISAAIFTGMFFSAEAEARDTRWLWRRSRTTSFEWLLCFPLGTRPSGRVFFWSYVFYLSRFLHLLRTFFVVLRHRRLSFFRLFNNSVLLIMSFLWLEFSQSLQVLAILFYTAVYSVVYAFRFWTEIGLPTKTPLALSFTANFQIVLLGFNLMCHVGVLSLHYLRGGCNGIGAWVFNSVLNAAFLVQFLKSYVKTHCHSQSIVACSSSKRE

SEQ ID NO: 224488 - protein, 353 aa, Glycine max
  Coding DNA Sequence Number=SeqID_107710
  Gene Ontology: Mol. function=transferase activity, transferring hexosyl groups; Cellular component=integral to membrane; Biological process=carbohydrate biosynthetic process
  Homolog annotation: Hit_ID=Q8LF94; Match level="QueryCoverage=95%, HitCoverage=98%, E-value=1e-140, Identity=70%"; Hit description =Avr9/Cf-9 rapidly elicited protein 231
  Pfam annotation: Domain name=Glyco_transf_8; Domain location=70-328; Score=303.5; E_value=3.9e-88; Accession=PF01501.10; Description =Glycosyl transferase family 8
MKFKSRRLEAEAGALVLFFLILSSSSSSNYAKPSTIIHQFKEAPEFYNSPECASLTHSSDSYICSEEAVHVAMTLDTTYIRGSMAAILSVIQHSSCPQNTFFHFVCSSSASLLRAAISHSFPYLNFHLYTFDDSQVSGLISTSIRSALDCPLNYARSYLPSLLPLCVRRVVYLDSDLILVDDIAKLAATPLGENTVLAAPEYCNANFTSYFTPTFWSNPSLSLTFADRRPCYFNTGVMVIDLERWREGDYTTKIQEWMELQKRMRIYDLGSLPPFLLVFAGNIASVDHRWNQHGLGGDNFRGLCRDLHPGPVSLLHWSGKGKPWVRLDANRPCPLDALWAPYDLLNTPFSLDS

SEQ ID NO: 224489 - protein, 101 aa, Glycine max
  Coding DNA Sequence Number=SeqID_107711
  Gene Ontology: Mol. function=ubiquitin-protein ligase activity; Cellular component=ubiquitin ligase complex; Biological process =protein ubiquitination
  Homolog annotation: Hit_ID=Q3HLY8; Match level="QueryCoverage=95%, HitCoverage=24%, E-value=6e-21, Identity=48%"; Hit description=U-box protein
AKFLSHEGSIAVVTERILKVSASVDDRAVFVLSQVSKFSGTTMVLQEMLRVGTVAKLCMVLQADRAKYLKDKAMEILKGHSEVWANSPCIPNTSFGGYVKY

SEQ ID NO: 224490 - protein, 264 aa, Glycine max
  Coding DNA Sequence Number=SeqID_107712
  Gene Ontology: Mol. function=transferase activity; Cellular component= cytoplasm; Biological process=lipoate biosynthetic process
  Homolog annotation: Hit_ID=Q948J9; Match level="QueryCoverage=91%, HitCoverage=83%, E-value=3e-92, Identity=66%"; Hit description =Lipoyltransferase
  Pfam annotation: Domain name=BPL_LipA_LipB; Domain location=59-146; Score=78.4; E_value=2.2e-20; Accession=PF03099.9; Description =Biotinlipoate AB protein ligase family
MVQCSRRCELFDLHQELIPYDVAWSWQKDIVREKKSQIENEGDCSDTLIILQHPSVYTLGTASTHHNLNFDIENPPFPIYRTERGGEVTFHGPGQLIMYPIINLRRHKMDLHWYLRTLEEVVIRALSSTFSIQASRVEGLTGVWVGNQKLAALGIRVAHWITYHGLALNVTTDLSPFKWVIPCGIRDRQVGSIKGLLKEAQSCIAHGTSVLHDLDDTSLIHITYRSLIEEFSRAFQLEYHYKTISVPVLCKRKPSCFSKETQQS

SEQ ID NO: 224491 - protein, 519 aa, Glycine max
  Coding DNA Sequence Number=SeqID_107713
  Gene Ontology: Mol. function=nucleic acid binding; Cellular component= chromatin; Biological process=DNA integration
  Homolog annotation: Hit_ID=Q1SRN1; Match level="QueryCoverage=99%, HitCoverage=54%, E-value=2e-67, Identity=44%"; Hit description =Integrase, catalytic region
  Pfam annotation: Domain name=rve; Domain location=2-103; Score=12.3; E_value=0.00056; Accession=PF00665.16; Description=Integrase core domain
  Pfam module annotation: Pfam domain module=RVT_2::rve; Domain location=216-350::2-103
MVELQLNTKIKALQTDGAKEYLVLTKYLADHGIQHCISCPHTHEQNGALERKHRHLTETGLTLLAASSLPSKFWVEAFSTATFIINRIPSSMIKYKSSFEVLFHKTPDYSIFKPFGCLCDPYLRPYTKTKLDFRSTPCIFLGCNTKYKGYKCITNSGKEYTVINTTICPNQTPTELTTPLTNPIPTSSPIHDPLPPNINPTIHDPVNSAPKQPPHPTPTTMKAIGSKWIYRLNYNFDGSVAKHKARLVAQGCDTSLFVHATPKFITYILVYVDDIIITGSSNSAIQSVISKLHSLYPFKDLATLRFFLGIEAKHTTTGALLLSQSKYITNLLSKVNMHNAKPIKTPLAPGSKLQMDVTDSFSDPTLYKSVVGALQYATITRPDIAYAFNKLCQFMHSPLESHWKATKRVLRYLNGTIDHGFCVYLGNNLVSWPTKKQHSVSRSSTQAEFRSLAALVAEIKWIKSLLTELHVIQTKPPLLWCDNQGAAVNGEIVVKHIPSQFQVADLLTKDPSSSTFLSP

SEQ ID NO: 224492 - protein, 62 aa, Glycine max
  Coding DNA Sequence Number=SeqID_107714
MDDQTTINNNKVLCCDHALRGATFGLCEYGGDHALNAGFALSTPLGFFVSLLRTKLELTAKR

SEQ ID NO: 224493 - protein, 102 aa, Glycine max
  Coding DNA Sequence Number=SeqID_107715
MQSLQELAHQRPIMSVEQFIKQAAYPEPIPVPADPPSPMVDPSSPAPEAALPSTPIIISDDPTVQAPGLAPTLPATPELKFSDKEGGRITTPPGTPMLHFDD

SEQ ID NO: 224494 - protein, 114 aa, Glycine max
  Coding DNA Sequence Number=SeqID_107716
  Homolog annotation: Hit_ID=Q1S7Z2; Match level="QueryCoverage=52%, HitCoverage=9%, E-value=7e-12, Identity=59%"; Hit description=WD40 -like
MAAYQAKLTLMTGTEDFQVLDYMLPEEGDIYDGAPAQFPISFGKQSKPQTPLEAIHTATRRSNSNPKTANDLPSISSSSRECLLVDHDFKFLVNVFQLKRYTLILPNELDAKFT

SEQ ID NO: 224495 - protein, 98 aa, Glycine max
  Coding DNA Sequence Number=SeqID_107717
  Homolog annotation: Hit_ID=Q1M2R7; Match level="QueryCoverage=70%, HitCoverage=7%, E-value=6e-08, Identity=35%"; Hit description=PDR -like ABC-transporter
MASFSDWMDGVRVAIAIPTIEVRFENMNIGAEVHVGSRALPIFTNYMVNKIEVRVPRTNLVWLLDQFTGKVTYNGHGMNEFGYALPASLELPFILFER

SEQ ID NO: 224496 - protein, 50 aa, Glycine max
  Coding DNA Sequence Number=SeqID_107718
MGVAYRSEIRICYAPSKPLEVGETHECMTNKRPYGQDLIIHPEPDCLTIA

SEQ ID NO: 224497 - protein, 323 aa, Glycine max
  Coding DNA Sequence Number=SeqID_107719
  Gene Ontology: Mol. function=DNA binding; Biological process =regulation of transcription
  Homolog annotation: Hit_ID=Q10EL0; Match level="QueryCoverage=59%, HitCoverage=44%, E-value=5e-31, Identity=47%"; Hit description=Myb -like DNA-binding domain, SHAQKYF class family protein, expressed
  Pfam annotation: Domain name=Myb_DNA-binding; Domain location=141 -192; Score=41.5; E_value=2.9e-09; Accession=PF00249.21; Description =Myb-like DNA-binding domain
MPTFAPLPEPDLSLNISPPFTSDSDAKKVEISCNGLLTLTTKTLYNDMCSTSDSGSSGSDLSHENGFFGHTDTAYNLGHHEPTLSLGIETTNSNPYPVQQGALSRNNFSHFHNYQPHSNTLDFKRNARVIHGVKRNARAPRMRWTTTLHAHFVHAVQLLGGHERATPKSVLELMNVKDLTLSHVKSHLQMYRTVKSSDKGSAGYGQTGIGLSQKPGIVDLYGVLACERANLPQPLLKSQRASWQSSIETNSINYTQNPIINSMYSHLKGNQTMVGGQHYECLSNCMKEKLDSCSLSRSDMTLDLEFTLGRSTSCKQTTLNQEN

SEQ ID NO: 224498 - protein, 768 aa, Glycine max
  Coding DNA Sequence Number=SeqID_107720
  Gene Ontology: Mol. function=protein serine/threonine kinase activity; Cellular component=integral to membrane; Biological process=protein amino acid phosphorylation
  Homolog annotation: Hit_ID=Q6QLL5; Match level="QueryCoverage=78%, HitCoverage=85%, E-value=0.0, Identity=59%"; Hit description=WAK -like kinase
  Pfam annotation: Domain name=Pkinase; Domain location=395-669; Score =141.6; E_value=2.2e-39; Accession=PF00069.15; Description=Protein kinase domain
  Pfam annotation: Domain name=Pkinase_Tyr; Domain location=395-669; Score=77.6; E_value=4e-20; Accession=PF07714.7; Description=Protein tyrosine kinase
  Pfam module annotation: Pfam domain module=Pkinase::Pkinase_Tyr; Domain location=395-669::395-669
MMLWSMWKRRNIKLLDAIEEAPEALARANSVLQDWISAQNTRPRDYQGNFRQIFTGWVDSFMEVQEGEAYAILSALRWMEDKPYQAVISSQAAKCRQTCGSSKPVPYPFGFSSGCAIRLNCTAGVASVGEFPVKVNTDSLIVSIEAQCNRSFDSFHHLFSHKYAPTSRNVILLDNCTATPLPCSIPETLVRTHFESVGCGNASGTGELSCYFEKITNGFMDQRMLDEIRCKYFMSSLSVPDIKNISGTAPLSLGVNVIELGWWLQGDRCLCSDHANCTTLQSPVDRKPGFRCRCRDGFVGDGFLVGTGCQKASSCNPAKYMSGRCGGTTRFIVLIGGFVIGVSLMVTLGSLCCFYRRRSKLRVTKSTKRRLTEATGNNSVPIYPYKDIEKATNSFSEKQRLGTGAYGTVYAGKLYNDEWVAIKRIKHRDTDSIEQVMNEIKLLSSVSHTNLVRLLGCSIEYGEQILVYEFMPNGTRSQHLQKERGSGLPWPVRLTIATETAQAIAHLHSAICPPIYHRDIKSSNILLDYNFRSKVADFGLSRLGMTEISHISTAPQGTPGYVDPQYHQDFHLSDKSDVYSLGVVLVEIITGQKVVDFSRPHNEVNLASLAADRIGKGLLNEIIDPFLEAEARSDAWTLSSIHKVAELAFRCLAFHRDMRPSMTEVASELEQLSLSRWTTMGDNNCATSTELSSCSSSSNESEKPLSTGMKNAGGAKGKGHLKLQTGPVHLMSLQRPNSNSPVSVQDQELWLSEQSSPSSNSFPSKSFD

SEQ ID NO: 224499 - protein, 521 aa, Glycine max
  Coding DNA Sequence Number=SeqID_107721
  Gene Ontology: Mol. function=monooxygenase activity; Cellular component=membrane; Biological process=fatty acid biosynthetic process
  Homolog annotation: Hit_ID=Q4ZJ74; Match level="QueryCoverage=89%, HitCoverage=88%, E-value=0.0, Identity=68%"; Hit description=Allene oxide synthase
  Pfam annotation: Domain name=p450; Domain location=61-521; Score= -158.5; E_value=0.00093; Accession=PF00067.12; Description=Cytochrome P450
  Subcellular localization annotation: CTP_CleavageSite=45; ConfidenceScore=5.67e-01
MTSITSASLPLLQLQSSLKRKPCNLKSSTTMRRFTTKASASETTSAAAPAPEPSKLPMRKIPGDYGLPFIGPIKDRLDFFYNQGRDKFFQSRAQKYNSTVFRANMPPGPFIASNPNVIVLLDAKSFPVLFDVSKVEKRDVFTGTFMPSTQLTGGYRILSYLDPSEPRHEQLKRLLFFLLKSRSSHVIPEFHSSYTTLFETLENELAKEGKASFQTANDQAAFNFLARALYGTNPSDTNLGRDGPSIIQTWLLFQLGPIMTLGLPKFLEDPTLHTFRIPPFLIKKDYKRLYDFFYESSGFALDEAVRLGVPREEACHNLLFATCFNSFGGMKIFFPTILKWVGRAGVKLHARLAEEVRAAVKSNGGKVTMASMEEMPLMKSVVYEAFRIEPPVPLQYGRAKKELVIESHENAFVVKEGEMLFGFQPFATKDPKIFENAEEFVADRFVGEGEKLLKHVLWSNGPETEGPTLGNKQCAGKDFVVLFSRLLVVEFFLHYDSFDVQVGNSSLGSSLTFTSLKKASY

SEQ ID NO: 224500 - protein, 181 aa, Glycine max
  Coding DNA Sequence Number=SeqID_107722
MTRRLLAGSLAFESRILHYLIVCILLPRSSNLAQVSEEDLIVMWAFHKGLQIDWAHLVRYRMHKALRLNAPLPYPHLITLFLQHFNIPLDSEPYVPIKRSFLIGVVVIASFGYQKEHDGSWVKKGARPVDEEGHLHGGEDSSLLQKILDRFDGLQSFVGERVVIIKKGEIVEASFMMLNQD

SEQ ID NO: 224501 - protein, 404 aa, Glycine max
  Coding DNA Sequence Number=SeqID_107723
  Subcellular localization annotation: CTP_CleavageSite=50; ConfidenceScore=5.27e-01
MELQTLCCALPSQPLHSSNHRILSSPAFGIRAPFTNQRQRFHFGNASKCMGAAFSGLKWVIKEPSLLGLSKFQRLLVHSSDSNLNGGLEVHPKQSSSVPVTTFNGAEPFHGKSGSVSFCGLTHQSVEEGKLESSPFEGKGGSFLWVLAPAAFIASLILPQFFVDNVVEAFLNNVILIVFVCLCTGKIENLTLTDYPTNLKPNIRGRTMSKNSDILCEKKFLDKSTKDVEKMTMSHAIAFPLHFAVFLEVIGGVDVLFYIGLATFLHVTDCVQRPYLQYSSKRWGLITGLRGYLFSAFFTMGLKIIAPLILLFVTWSAIRIAAFVAITPFLVGCVAQIAFEKALDNRGSSCWPLVPVIFEVYRLYQLTKAANFAEKLLFSMKGLPAGPELVERSGALFAMLITFQ

SEQ ID NO: 224502 - protein, 44 aa, Glycine max
  Coding DNA Sequence Number=SeqID_107724
MCRDRERGKQVRAMQVLSGMIGIGEEQNEYYSREDIGMGIGVSL

SEQ ID NO: 224503 - protein, 526 aa, Glycine max
  Coding DNA Sequence Number=SeqID_107725
  Gene Ontology: Mol. function=oxidoreductase activity; Cellular component=membrane; Biological process=electron transport
  Homolog annotation: Hit_ID=Q9SZ46; Match level="QueryCoverage=99%, HitCoverage=99%, E-value=0.0, Identity=64%"; Hit description =Cytochrome P450-like protein
  Pfam annotation: Domain name=p450; Domain location=38-513; Score =300.6; E_value=2.9e-87; Accession=PF00067.12; Description=Cytochrome P450
MDSSLQLTIIAILVSLLVFLWHTKRNRGGSKNKSKEAPIPAGAWPLIGHLHLLGGDDQLLYRTLGTMADQYGPAFNIWLGTRRAFVVSSWEVAKECFTSNDKALASRPTTVAAKHMGYNYAVFGFAPYSPFWREMRKIATLELLSNRRLEMLKHVMVSELNMVMRDLYNSWVQNRSRPVLVELNRWLEDLTLNMVVRMVAGKRYFGASASCDNDDEARRCQKAINQFFHLIGIFVVSDALPFLRWFDVQGHERAMKKTAKELDAILEGWLKEHREQRVDGEIKAEGEQDFIDIMLSLQKGGHLSNFQYDSDTSIKSTCLALILGGSDTTAGTVTWAISLLLNNRQALKKAQEELDLNVGMERQVEESDIRNLAYVQAIIKETLRLYPAGPLLGPREAQEDCNVAGYHVPAGTRLVVNLWKIHRDPRVWQEPSAFRPERFLTSDAVDVRGQNFELIPFGSGRRSCPGMSFALQVLHLTLARLLHAFEFATPSDQPVDMTESPGLTIPKATPLEVLLTPRLPAKLYAC

SEQ ID NO: 224504 - protein, 526 aa, Glycine max
  Coding DNA Sequence Number=SeqID_107726
  Gene Ontology: Mol. function=oxidoreductase activity; Cellular component=membrane; Biological process=electron transport
  Homolog annotation: Hit_ID=Q43068; Match level="QueryCoverage=97%, HitCoverage=98%, E-value=1e-146, Identity=49%"; Hit description =Cytochrome P450 82A1
  Pfam annotation: Domain name=p450; Domain location=37-512; Score =295.7; E_value=8.8e-86; Accession=PF00067.12; Description=Cytochrome P450
MGLTIQYLEASVAAIIGIILVSYFIKRATAGSARKPPAAGGGWPLIGHLHLLGGSTQPPYITLGSLADKYGPIFSMRIGVHHAVVVSSWELAKECFTTLDVVISSRPKFTAAKILGYNYANFGFTPYGDFWRVMRKIAASELLSTARFELLQRIRDSEMQISLKELYRTWVDKRGVSDDLLVEMKQWFGDVNLNVILRMISGKRYSAKSEDDLQQVRRIRRVFREFFRLTGLFVVGDAIPFLGWLDLGGEVKEMKKTAIEMDNIVSEWLEEHKQQITDSGDTKTEQDFIDVLLFVLKGVDLAGYDFDTVIKATCTMLIAGATDTTAVTMTWALSLLLNNHHALKKVKDELDEHVGKERLVNESDINKLVYLQAVVKETLRLYPAGPFSGPREFTENCTLGGYKIEAGTRFMLNIWKLHRDPRVWSNPLEFQPERFLNTHKNVDVKGQHFELLPFGGGRRSCPGISFGLQMSHLALASFLQAFEITTPSNAQVDMSATFGLTNMKTTPLEVLVRPVLSHQLLFVDEA

SEQ ID NO: 224505 - protein, 219 aa, Glycine max
  Coding DNA Sequence Number=SeqID_107727
  Gene Ontology: Mol. function=monooxygenase activity; Cellular component=membrane; Biological process=electron transport
  Homolog annotation: Hit_ID=Q1SJP3; Match level="QueryCoverage=87%, HitCoverage=39%, E-value=3e-55, Identity=53%"; Hit description=E -class P450, group I
MDSIVSEWLEQHRHKRDSGDTETEQDFIDVLLSVLNGVELAGYDVDTVIKGTCTTLIAGAIDTTTVTMTWALSLLLNNGDALKKVQDELDEHVGRERLVNELDINKLVYLQAVVKETLRLYPTRPVSGPREFTKELYIRWLQYPSRDPRIWSNPLEFQPERFLSTHKDMDVKGQDFELLSFGGGRSYSLWMKFRKIHCINQCLPYLSNEQGLCAFTFPA

SEQ ID NO: 224506 - protein, 98 aa, Glycine max
  Coding DNA Sequence Number=SeqID_107728
  Gene Ontology: Mol. function=isomerase activity; Cellular component =endoplasmic reticulum; Biological process=cell redox homeostasis
  Homolog annotation: Hit_ID=Q8LAM5; Match level="QueryCoverage=84%, HitCoverage=16%, E-value=6e-16, Identity=46%"; Hit description =Protein disulfide isomerase-like
  Subcellular localization annotation: CTP_CleavageSite=90; ConfidenceScore=5.89e-01
MMLPPLLATIIFQILTSSTRTTSVTLLASTTRQRRCSRSSRWTTRTPSSRTTASSWSRSRRLGAATTRPLCQSTLSPPPSSSLTALFLPRSMPPSKTN

SEQ ID NO: 224507 - protein, 1553 aa, Glycine max
  Coding DNA Sequence Number=SeqID_107729
  Gene Ontology: Mol. function=ATPase activity, coupled to transmembrane movement of substances; Cellular component=integral to membrane; Biological process=transport
  Homolog annotation: Hit_ID=Q7GB25; Match level="QueryCoverage=98%, HitCoverage=99%, E-value=0.0, Identity=73%"; Hit description =Multidrug resistance-associated protein 5
  Pfam annotation: Domain name=ABC_membrane; Domain location=328-600; Score=101.9; E_value=1.8e-27; Accession=PF00664.13; Description=ABC transporter transmembrane region
  Pfam annotation: Domain name=ABC_membrane; Domain location=978-1258; Score=85.6; E_value=1.5e-22; Accession=PF00664.13; Description=ABC transporter transmembrane region
  Pfam annotation: Domain name=ABC_tran; Domain location=1334-1517; Score=161.3; E_value=2.5e-45; Accession=PF00005.17; Description=ABC transporter
  Pfam annotation: Domain name=ABC_tran; Domain location=675-846; Score= 117.7; E_value=3.4e-32; Accession=PF00005.17; Description=ABC transporter
  Pfam annotation: Domain name=MMR_HSR1; Domain location=1335-1434; Score=-12.7; E_value=0.014; Accession=PF01926.13; Description=GTPase of unknown function
  Pfam annotation: Domain name=SMC_N; Domain location=1322-1521; Score=- 131.5; E_value=0.056; Accession=PF02463.9; Description=RecFRecNSMC N terminal domain
  Pfam module annotation: Pfam domain module=ABC_membrane::ABC _membrane::ABC_tran::ABC_tran::MMR_HSR1::SMC_N; Domain location=328 -600::978-1258::1334-1517::675-846::1335-1434::1322-1521
MAVDEIEILSPTFSSSGSFETLWSAILGLPLLELVAICANLTLSLLFLFVVSARKVLVCVGRGVRFGKENITGNASPGCVSVDLETRDVVRIETWFKLSVLSCLYVLLVQVLLLGFDGVALIRGRDLDVDLDLGLALLSVPLVQGLAWVVLSFSALQCKFKASERFPILLRLWWVMLFGICLCGLYVDGKGVWMEGSKHLRSHVVANFTITPALAFLCIVAIRGVTGIKVFRNSEEHQPLLVEEEPGCLKVTPYTDAGLFSLATLSWLNPLLSIGAKRPLELKDIPLVAAKDRSKTNYKVLNSNWERLKAENQSEQPSLAWALLKSFWKEAACNAVFAGVTTLVSYVGPYMISYFVDYLVGKEIFPHEGYVLAGVFFVAKLVETFTTRQWYLGVDILGMHVRSALTAMVYRKGLRISSLAKQSHTSGEVVNYMAIDVQRVGDYSWYLHDMWMLPLQIVLALAILYKNVGIAAIATLIATIISIVVTVPIARVQENYQDKLMAAKDERMRKTSECLRNMRILKLQAWEDRYRVKLEEMRGVEFKWLRKALYSQAFITFIFWSSPIFVSAVTFATSILLGGQLTAGGVLSALATFRILQEPLRNFPDLVSTMAQTKVSLDRLSGFLLEEELQEDATIVLPQGITNIAIEIKDGIFCWDPSSSFRPTLSGISMKVERRMRVAVCGMVGSGKSSFLSCILGEIPKLSGEVRVCGSSAYVSQSAWIQSGTIEENILFGSPMDKAKYKNVLHACSLKKDLELFSHGDQTIIGDRGINLSGGQKQRVQLARALYQDADIYLLDDPFSAVDAHTGSDLFREYILTALADKTVIFVTHQVEFLPAADLILVWLYGFSSTFKHNAVLKEGCIIQSGKYDDLLQAGTDFNTLVSAHHEAIEAMDIPTHSSEESDENLSLEASVMTSKKSICSANDIDSLAKEVQEGSSISDQKAIKEKKKKAKRSRKKQLVQEEERIRGRVSMKVYLSYMAAAYKGLLIPLIIIAQTLFQFLQIASNWWMAWANPQTEGDLPKVTPSVLLLVYMALAFGSSWFIFVRAVLVATFGLAAAQKLFLKMLRSVFHAPMSFFDSTPAGRILNRVSIDQSVVDLDIPFRLGGFASTTIQLIGIVGVMTEVTWQVLLLVVPMAVACLWMQKYYMASSRELVRIVSIQKSPIIHLFGESIAGASTIRGFGQEKRFMKRNLYLLDCFARPFFCSLSAIEWLCLRMELLSTFVFAFCMVLLVSFPRGSIDPSMAGLAVTYGLNLNARLSRWILSFCKLENKIISIERIYQYSQIPSEAPTIIEDSRPPFSWPENGTIEIIDLKVRYKENLPMVLHGVTCTFPGGKKIGIVGRTGSGKSTLIQALFRLIEPASGSILIDNINISEIGLHDLRSHLSIIPQDPTLFEGTIRGNLDPLDEHSDKEIWEALDKSQLGEVIREKGQQLDTPVLENGDNWSVGQRQLVALGRALLQQSRILVLDEATASVDTATDNLIQKIIRSEFKDCTVCTIAHRIPTVIDSDLVLVLSDGLVAEFDTPSRLLEDKSSVFLKLVTEYSSRSSGIPDF

SEQ ID NO: 224508 - protein, 365 aa, Glycine max
  Coding DNA Sequence Number=SeqID_107730
  Gene Ontology: Mol. function=tyrosine decarboxylase activity; Cellular component=cellular_component; Biological process=amino acid and derivative metabolic process
  Homolog annotation: Hit_ID=Q8RY79; Match level="QueryCoverage=97%, HitCoverage=72%, E-value=1e-164, Identity=78%"; Hit description =Tyrosine decarboxylase 1
  Pfam annotation: Domain name=Pyridoxal_deC; Domain location=44-365; Score=452.2; E_value=6.6e-133; Accession=PF00282.9; Description =Pyridoxal-dependent decarboxylase con
MEEESALRPMDAEQLREQAHKMVDFIADYYKTIEDFPVLSQVQPGYLGKLLPDSAPDSPESLQNVLDDVQEKILPGVTHWQSPNYFAYFPSNSSIAGFLGEMLSAGLNIVGFSWITSPAATELETIVLDWLAKAFQLPDYFYSSGKGGGVIQGTASEAVLVVLLAARDKILRRVGRNALPKLVMYASDQTHSALLKACQIAGINPELCRLLKTDSSTNYALSPDVLSEAISNDIAGGLVPFFLCATVGTTSSTAVDPLPALGKIAKTNKLWFHVDAAYAGSACVCPEYRHCIDGVEEADSFNMNAHKWFLTNFDCSLLWVKDRSSLIQSLSTNPEFLKNKASQGNMVIDYKDWQIPLGRRFRWFF

SEQ ID NO: 224509 - protein, 307 aa, Glycine max
  Coding DNA Sequence Number=SeqID_107731
  Gene Ontology: Mol. function=protein serine/threonine kinase activity; Cellular component=integral to membrane; Biological process=protein amino acid phosphorylation
  Homolog annotation: Hit_ID=Q1S227; Match level="QueryCoverage=90%, HitCoverage=55%, E-value=1e-114, Identity=39%"; Hit description =Protein kinase; Actin-binding, actinin-type
  Pfam annotation: Domain name=LRRNT_2; Domain location=31-77; Score =43.5; E_value=7.3e-10; Accession=PF08263.3; Description=Leucine rich repeat N-terminal domain
  Pfam annotation: Domain name=LRR_1; Domain location=105-127; Score =12.2; E_value=1.5; Accession=PF00560.23; Description=Leucine Rich Repeat
  Pfam annotation: Domain name=LRR_1; Domain location=129-151; Score =5.8; E_value=23; Accession=PF00560.23; Description=Leucine Rich Repeat
  Pfam annotation: Domain name=LRR_1; Domain location=153-175; Score =10.1; E_value=3.7; Accession=PF00560.23; Description=Leucine Rich Repeat
  Pfam annotation: Domain name=LRR_1; Domain location=177-199; Score =16.3; E_value=0.11; Accession=PF00560.23; Description=Leucine Rich Repeat
  Pfam annotation: Domain name=LRR_1; Domain location=201-223; Score =16.7; E_value=0.084; Accession=PF00560.23; Description=Leucine Rich Repeat
  Pfam annotation: Domain name=LRR_1; Domain location=225-247; Score =12.9; E_value=1.1; Accession=PF00560.23; Description=Leucine Rich Repeat
  Pfam annotation: Domain name=LRR_1; Domain location=249-271; Score =7.9; E_value=9.4; Accession=PF00560.23; Description=Leucine Rich Repeat
  Pfam annotation: Domain name=LRR_1; Domain location=273-295; Score =8.1; E_value=8.7; Accession=PF00560.23; Description=Leucine Rich Repeat
  Pfam annotation: Domain name=LRR_1; Domain location=81-103; Score =5.1; E_value=32; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=31 -77::105-127::129-151::153-175::177-199::201-223::225-247::249 -271::273-295::81-103
MKKSKMKMKIQIFIFFCFISCFSYGFAAASTNDEVSALLSIKEGLVDPLNALQDWKLHGKAPGTDAAHCNWTGIKCNSDGAVEILDLSHKNLSGRVSNDIQRLKSLTSLNLCCNAFSTPLPKSIANLTTLNSLDVSQNFFIGNFPLALGRAWRLVALNASSNEFSGSLPEDLANASSLEVLDLRGSFFVGSVPKSFSNLHKLKFLGLSGNNLTGKIPGELGQLSSLEYMILGYNEFEGGIPEEFGNLTNLKYLDLAVANLGGEIPGGLGELKLLNTVFLYNNNFEGRIPPAISNMTSLQLLDLSDNM

SEQ ID NO: 224510 - protein, 151 aa, Glycine max
  Coding DNA Sequence Number=SeqID_107732
  Gene Ontology: Mol. function=prephenate dehydratase activity; Biological process=L-phenylalanine biosynthetic process
  Homolog annotation: Hit_ID=Q6JJ29; Match level="QueryCoverage=61%, HitCoverage=27%, E-value=6e-29, Identity=59%"; Hit description =Prephenate dehydratase
MKKPKKKREREFALPYGTEQNRSKTELKRRHHDTAAIATPHVTELYGLNMMADGIQDDPSNVTRFVKLVREIIIPRTNHPFKTSIIFAHDKGTSVLFKVLFTFAFRNINLTKFSVDFEASMAEVRAMEKCEMKRVVGREKGKMLGGELERL

SEQ ID NO: 224511 - protein, 809 aa, Glycine max
  Coding DNA Sequence Number=SeqID_107733
  Gene Ontology: Mol. function=identical protein binding; Cellular component=cellulose and pectin-containing cell wall; Biological process=negative regulation of enzyme activity
  Homolog annotation: Hit_ID=Q1S230; Match level="QueryCoverage=91%, HitCoverage=94%, E-value=0.0, Identity=80%"; Hit description =Protease-associated PA; Proteinase inhibitor I9, subtilisin propeptide
  Pfam annotation: Domain name=PA; Domain location=407-504; Score=91.7; E_value=2.2e-24; Accession=PF02225.12; Description=PA domain
  Pfam annotation: Domain name=Peptidase_S8; Domain location=153-643; Score=51.8; E_value=2.3e-12; Accession=PF00082.12; Description =Subtilase family
  Pfam annotation: Domain name=Subtilisin_N; Domain location=65-150; Score=46.2; E_value=1.1e-10; Accession=PF05922.7; Description =Subtilisin N-terminal Region
  Pfam module annotation: Pfam domain module=PA::Peptidase _S8::Subtilisin_N; Domain location=407-504::153-643::65-150
MGDYFHKLFNDGQGSGCIEDEEGKVLVTNKDIKERWEIIFRSFSMMDKVQAMEGLEIQEGGNLDYYYIICIGELHPHGITSTSFSSKLKWHLSFIQQTISSDEDPSSRLLYSYRSAMDGFAAQLTETELEYLKNLPDVISIRPDSKLQIQTTYSYKFLGLNPARENGWYQSGFGRGTIIGVLDTGVWPESPSFNDQGMPPIPQKWKGICQAGKAFNSTNCNRKLIGARYFTKGHFSVSPFRDPEYLSPRDSSGHGTHTASTAGGVPVPLASVFGYASGVARGMAPGAHIAVYKVCWFNGCYNSDIMAAMDVAIRDGVDILSLSLGGYSLPLYDDSIAIGSYRAMEHGISVICAAGNNGPTEMSVANEAPWISTIGASTLDRKFPATVHIGNGQMLYGESMYPLNHHPMSNGKEIELVYLSEGDTESQFCLRGSLPKDKVRGKMVVCDRGINGRAEKGQVVKEAGGVAMILTNTEINLGEDSVDVHVLPATLVGFDEAVTLKAYINSTKRPLARIEFGGTVIGKSRAPSVARFSARGPSYTNPSILKPDVIAPGVNIIAAWPQNLGPTGLPEDTRRVNFSVMSGTSMACPHVSGIAALIRSVHPRWSPAAIKSAIMTTAEVTDHTGRPILDEDQPAGVFDMGAGHVNPQRALNPGLVYDIRPDDYITHLCSLGYTKSEIFSITHRNVSCNAIMKMNRGFSLNYPSFSVIFKGGVRRKMFSRRLTNVGSANSIYSMEVKAPEGVKVIVKPKRLVFKQVNQSLSYRVWFISRKRVKRGDDLVNYAEGSLTWVHSQNGSYRVRSPVAVTWKSK

SEQ ID NO: 224512 - protein, 97 aa, Glycine max
  Coding DNA Sequence Number=SeqID_107734
  Gene Ontology: Cellular component=mitochondrion
  Homolog annotation: Hit_ID=Q2QMA7; Match level="QueryCoverage=61%, HitCoverage=35%, E-value=7e-14, Identity=63%"; Hit description =Expressed protein
MARILGYRSLPPKAKNLVVGGLIAFVFGAYFYTMRVVGGTNELQVAIDKFEVDKNKNAGDANMPSKILPPVDGVDSTKQKHDEKELSSPLLNSFSIS

SEQ ID NO: 224513 - protein, 517 aa, Glycine max
  Coding DNA Sequence Number=SeqID_107735
  Gene Ontology: Mol. function=nucleic acid binding; Cellular component= plastid chromosome; Biological process=positive regulation of transcription, DNA-dependent
  Homolog annotation: Hit_ID=Q10N26; Match level="QueryCoverage=99%, HitCoverage=60%, E-value=1e-115, Identity=45%"; Hit description =Pentatricopeptide, putative, expressed
  Pfam annotation: Domain name=PPR; Domain location=111-145; Score=6.1; E_value=1.4; Accession=PF01535.11; Description=PPR repeat
  Pfam annotation: Domain name=PPR; Domain location=2-36; Score=12.2; E_ value=0.27; Accession=PF01535.11; Description=PPR repeat
  Pfam annotation: Domain name=PPR; Domain location=220-254; Score =26.6; E_value=8.8e-05; Accession=PF01535.11; Description=PPR repeat
  Pfam annotation: Domain name=PPR; Domain location=255-289; Score =23.7; E_value=0.00066; Accession=PF01535.11; Description=PPR repeat
  Pfam annotation: Domain name=PPR; Domain location=41-75; Score=25.4; E_value=0.00021; Accession=PF01535.11; Description=PPR repeat
  Pfam annotation: Domain name=PPR; Domain location=76-110; Score=42.5; E_value=1.4e-09; Accession=PF01535.11; Description=PPR repeat
  Pfam module annotation: Pfam domain module=PPR::PPR::PPR::PPR::PPR::PP R; Domain location=111-145::2-36::220-254::255-289::41-75::76-110
MTSYNILLKACCVAGRVDLTQGIYRELKHLESVGQLKLDVLTYSTIIKVFADVKLWQMALKIKQDMLSAGVSLNIVAWSSLSNACAHAGLVEQAIQLFEEMLLAGCEPNTQCFNIILNACVEAYQYDRGFRFFHSWKGKKMLGSSGEGYNSNLGQGHMHNVTSMPNGISNSHILSFSERFPFTPTTTTYYILLKPCGTDYYHAKALIKEMETVGLSPNQISWSILIDICGASANVEGAIEILKTMGDAGIKPGVIAYTTAMKVCVESKNFMQALTLYEEMKCYEIRPSWVTYNTLLKARSKYGSLHEVQQCLAIYQDMRKAGYKPNDYYLEELIEEWCEGVIQDNREKQGEFSSSNKSESERPHSLLLEKIAAHLLKRVADILAIDVQGLTKVEAHLVVLAVLRMIKENYSLGHSVNDDILIIIGATKVDENPSKHILEVQEAIIKLLRNELELEVFPARTRLALCDTAKLEYPNRSNLNIEALPGENALGFQTRRPGVLVRLKVTKKSLYSWLHRK

SEQ ID NO: 224514 - protein, 379 aa, Glycine max
  Coding DNA Sequence Number=SeqID_107736
  Gene Ontology: Mol. function=protein serine/threonine kinase activity; Cellular component=membrane; Biological process=protein amino acid phosphorylation
  Homolog annotation: Hit_ID=Q6TKQ5; Match level="QueryCoverage=99%, HitCoverage=99%, E-value=1e-170, Identity=80%"; Hit description =Protein kinase-like protein
  Pfam annotation: Domain name=APH; Domain location=76-254; Score= -13.5; E_value=0.052; Accession=PF01636.13; Description =Phosphotransferase enzyme family
  Pfam annotation: Domain name=Pkinase; Domain location=73-347; Score =142.8; E_value=9.5e-40; Accession=PF00069.15; Description=Protein kinase domain
  Pfam annotation: Domain name=Pkinase_Tyr; Domain location=73-347; Score=145.8; E_value=1.2e-40; Accession=PF07714.7; Description =Protein tyrosine kinase
  Pfam module annotation: Pfam domain module=APH::Pkinase::Pkinase_Tyr; Domain location=76-254::73-347::73-347
MGWIPCSGYSGTKNKVEKMEVQDSLVGQIKATPGKLKRNSSTKSKDTSKNGNPDHIAAQTFAFRELATATRNFRNDCLLGEGGFGRVYKGRLESINQVVAIKQLDRNGLQGNREFLVEVLMLSLLHHPNLVNLIGYCADGDQRLLVYEYMPLGCLEDHLHDIPPGKKRLDWNTRMKIAAGAAKGLEYLHDKANPPVIYRDLKCSNILLGEGYHPKLSDFGLAKLGPVGENTHVSTRVMGTYGYCAPEYAMTGQLTLKSDVYSFGVVLLEIITGRKAIDNSKSAGEQNLVAWARPLFKDRRKFSQMADPTLHGQYPPRGLYQALAVAAMCVQEQANLRPVIADVVTALSYLASQKYDPNTHTVQSSRHAPSTPPRTRRGI

SEQ ID NO: 224515 - protein, 366 aa, Glycine max
  Coding DNA Sequence Number=SeqID_107737
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9LHJ9; Match level="QueryCoverage=98%, HitCoverage=92%, E-value=1e-125, Identity=62%"; Hit description =Protein phosphatase 2C
  Pfam annotation: Domain name=PP2C; Domain location=35-326; Score =87.5; E_value=4.1e-23; Accession=PF00481.12; Description=Protein phosphatase 2C
MVRFCWRPAAVGDDGDVNGRVEGLLWYKDLGNHLYGDFSMAVIQANSSLEDRSQLESGPLTSDYLGPQGTFVGVYDGHGGTAASQFVSDNLFCNFKDLAGEHQGISENVIQSAFSATEEGFLSVVRKQWLSKPQIASAGTCCLAGIICNGMLYVANAGDSRAVLGRVERATRETTAIQLSAEHNVNIQTERDDVRTKHPHDPQIVVMKHNVWRVKGIIQVSRSIGDAYLKKDEFNREPLPNKFRLPEPFFKPILSYEPAISVHKLRPEDQFIIFASDGLWEQLSNQEVVNIVSNSPRNVRFLYLSIKGIARRLVKAALRVAARKREMRVSDLQKIEQGVRRHFHDDITVIVVFLNHKLIDNSSLFN

SEQ ID NO: 224516 - protein, 217 aa, Glycine max
  Coding DNA Sequence Number=SeqID_107738
  Gene Ontology: Mol. function=protein binding; Cellular component =integral to membrane; Biological process=vesicle-mediated transport
  Homolog annotation: Hit_ID=Q9LTJ4; Match level="QueryCoverage=78%, HitCoverage=80%, E-value=2e-44, Identity=54%"; Hit description =Arabidopsis thaliana genomic DNA, chromosome 5, BAC clone:F17P19
MVKVTIVGRVSDGLPLAQGLRYMNEENGYLSCYRQQAEFILQEFSRGALTASKMTIHIDNFCFNYLVENGVVFIVLCEFTYPRKLAFHYLQDIQKEFEKFDKTLIGKITRPYSFVKFDGIIANISRQYIDTRTQANLSKLNANRKQDLDIATEDIYNILERKRNSETMRSSPVTLLPESTIWCSPRLEVIALKWTPVMIIVITSMALLWASLADFIV

SEQ ID NO: 224517 - protein, 456 aa, Glycine max
  Coding DNA Sequence Number=SeqID_107739
  Gene Ontology: Mol. function=mismatched DNA binding; Cellular component=integral to membrane; Biological process=mismatch repair
  Homolog annotation: Hit_ID=Q6DQL5; Match level="QueryCoverage=72%, HitCoverage=43%, E-value=1e-113, Identity=62%"; Hit description=DNA mismatch repair protein
  Pfam annotation: Domain name=MutS_V; Domain location=190-416; Score =303.6; E_value=3.7e-88; Accession=PF00488.12; Description=MutS domain V
  Subcellular localization annotation: CTP_CleavageSite=17; ConfidenceScore=5.15e-01
MIWTCTQKALVRRVDCRVFNPMKRRRGVPRTTLKNVVKRDLMNGLFNNVVVKPNLPHCVVQRVTKEEKGYELDFHASETIRDGGILLHLGLLRAERVAGQRLSTDVKVPSNWIKVNSTKKTIRYHPPKVVTALDKLSLAEEELTVACRAAWNSFLRDFSKHYAEFQAAVQALAALDCLHSFAILSRNKGYVRPVFVDDHEPVQIQICSGRHLVLKTTLQDNFVPNDTNMHADGENCQIVTGPNMGGKSCYIRQVALIAIMAQVGSFVPASSAKLHVLDRIYTRMGASDSIQQGRSTFLEELSETSHILHSCTEHSLVVIDELGRGTSTHDGMAIAHATLLPVWQLNFLALAAYHVSHLTSHDASKNSNLDHDITYLYKLVPGVSERSFGFKVAQLAQLPSHCISRAIVMASKLEALVNSRIHGRSRKELLLDTLVIDQEKEQLMAQPHDHPHKEKV

SEQ ID NO: 224518 - protein, 448 aa, Glycine max
  Coding DNA Sequence Number=SeqID_107740
  Gene Ontology: Mol. function=sequence-specific DNA binding; Cellular component=nucleus; Biological process=regulation of transcription, DNA-dependent
  Homolog annotation: Hit_ID=Q9ZUU0; Match level="QueryCoverage=95%, HitCoverage=95%, E-value=4e-87, Identity=44%"; Hit description=WRKY transcription factor 44
  Pfam annotation: Domain name=WRKY; Domain location=170-228; Score =146.1; E_value=9.5e-41; Accession=PF03106.6; Description=WRKY DNA -binding domain
  Pfam annotation: Domain name=WRKY; Domain location=366-425; Score =145.7; E_value=1.2e-40; Accession=PF03106.6; Description=WRKY DNA -binding domain
  Pfam module annotation: Pfam domain module=WRKY::WRKY; Domain location=170-228::366-425
  Subcellular localization annotation: CTP_CleavageSite=90; ConfidenceScore=5.21e-01
MDIKEAQRVVISKPVASRPTCSTFKSFSELLAGAINVSPAIESSPTTVSAIRPKTVRFKPAMNQPPAGFVSSQADTFGAALDNSSDMSPKLDTKQSLIYKPTAKLVSKTTVSLLANMGNCSTNTSSNLDQSITPQTETNYQSSEPSKMVQQNIEEDQKALTSSVNCDRPSYDGYNWRKYGQKQVKGSEYPRSYYKCTHPNCPVKKKVERSFDGNIAEIVYKGEHNHSKPQLHKRNSAAGTQGSGVMSDGMVQDMWSNSHSERNEGNEVRIENTGLSMHSDYYVKVPQPNDSSLNIGATNAGGGSMENSCGLSGEYEEGSKGFEAQEDEHRSKRRKNENQSNEAALSEEGLVEPRIVMQSFTDSEVLGDGFRWRKYGQKVVKGNPYPRSYFRCTNIMCNVRKHVERAIDDPRSFVTTYEGKHNHEMPLKNTGTVASERDSQASLSKDKP

SEQ ID NO: 224519 - protein, 63 aa, Glycine max
  Coding DNA Sequence Number=SeqID_107741
MGWGFAASQLAELVGSSVCKPEYMEFVMGWGFATSQLAELVGLSVCEPGTVPALDCSSFCGAR

SEQ ID NO: 224520 - protein, 98 aa, Glycine max
  Coding DNA Sequence Number=SeqID_107742
  Gene Ontology: Mol. function=nucleic acid binding
MPPKQQSKADLAKKQKIVEDKTFGLKNKNKSKNVQKYVQNLKQSVQPNPDSSKLAAKKKKEEEKAKDKELNDLFKIAVSQPKVPVGNIISVSLWGTDM

SEQ ID NO: 224521 - protein, 97 aa, Glycine max
  Coding DNA Sequence Number=SeqID_107743
  Gene Ontology: Mol. function=oxidoreductase activity; Cellular component=chloroplast
  Homolog annotation: Hit_ID=Q9ZUU2; Match level="QueryCoverage=98%, HitCoverage=51%, E-value=3e-31, Identity=55%"; Hit description =UPF0308 protein At2g37240, chloroplast precursor
MDASGVALVLIGPGSIDQAKSFSEKSKFEGAVTPQAGLKIIQLYLEGYRQHWKLSFEKDTVSRGGWKQGGTIVAGPEQDKEAGDDPEIEDIFKACCS

SEQ ID NO: 224522 - protein, 198 aa, Glycine max
  Coding DNA Sequence Number=SeqID_107744
  Gene Ontology: Mol. function=phosphotransferase activity, phosphate group as acceptor; Cellular component=chloroplast; Biological process=nucleobase, nucleoside, nucleotide and nucleic acid metabolic process
  Homolog annotation: Hit_ID=Q9ZUU1; Match level="QueryCoverage=92%, HitCoverage=65%, E-value=7e-78, Identity=76%"; Hit description =Probable adenylate kinase 1, chloroplast precursor
  Pfam annotation: Domain name=ADK; Domain location=5-164; Score=50.4; E_value=5.9e-12; Accession=PF00406.12; Description=Adenylate kinase
MVYLNFVSVYRKLLSEIVNQGKLVSDEIIISLLSKRLADGEAKGESGFILDGFPRTIKQAEILEGVTDIDLVVNLKLQEEALLAKCLGRRICNQCGGNFNIASISVKGENGRPGMVMAPLLPPAHCMSKLIARSDDTESVVKERLRIYNEKSQPVEGFYRSRGKLLEFELPGGIPESWPKLLQALNLDDYEEKQSAAA

SEQ ID NO: 224523 - protein, 549 aa, Glycine max
  Coding DNA Sequence Number=SeqID_107745
  Gene Ontology: Mol. function=structural constituent of ribosome; Cellular component=intracellular; Biological process=translation
  Homolog annotation: Hit_ID=Q1SEG3; Match level="QueryCoverage=68%, HitCoverage=93%, E-value=1e-172, Identity=79%"; Hit description =Ribosomal protein L4/L1e
  Pfam annotation: Domain name=Ribosomal_L4; Domain location=21-265; Score=432.3; E_value=6.4e-127; Accession=PF00573.12; Description =Ribosomal protein L4L1 family
MAVAAARPIVSVQTLEGDATPTVPLPDVMKASIRPDIVNFVHSNISRNSRQPYAVSKRAGHQTSAESWGTGRAVSRIPRVPGGGTHRAGQGTFGNMCRGGRMFAPTKIWRRWHRKINVQQKRHAVVSAIAASAIPSLVQARGHRIESVPELPLVVSDTVESVEKSKEAVKILQKIGAFTDAEKAKLSHGIRPGKGKMRNRRYISGKGPLIVYGTEGAKAIKAFRNIPGVEVANVDRLNLLKLAPGGHLGRFIIWTKSAFEKLDSIYGSFDKASEKKNGYLLPRPKMINSDLARIINSDEVQSVVRPIKKDVKRAPLKKNPLTNLNAMLKLNPYAKTAKRMALLAEKQRIVAKKEKLHKKRNIVSKEEASAIKAAGKSVVLERKRFYFFTFFLHSLFAVASYFIKMSAMDMIKSLSSKPEKFMGEIFFCWQQQMKFWLTELDLYSVISKREIKTSTSSTDIVQTDATIKHDVSDKDILCHGRILSALADNIYKIFCHTKTSVELWEALELKYGSAEKGLSRYSCEKMIEFQMIDGKSISDQIHEFENIIL

SEQ ID NO: 224524 - protein, 386 aa, Glycine max
  Coding DNA Sequence Number=SeqID_107746
  Gene Ontology: Mol. function=DNA binding; Cellular component=nucleus; Biological process=regulation of transcription, DNA-dependent
  Homolog annotation: Hit_ID=Q0PJJ0; Match level="QueryCoverage=63%, HitCoverage=84%, E-value=2e-92, Identity=76%"; Hit description=MYB transcription factor MYB118
MAMVGLERRLESLILLPSQGRAGPRKNTTSFSKLFNYLTEIGRKLKILLVQKQLFRLGNSSSARCSNFYLLLCHYVVSLTVSLLSCLQIRSHAQKYFLKVQKNGAVAHVPPPRPKRKASHPYPQKASKNVLLPLPASMVYVSSTSALPPGYVTWDENSLLMNSGSNKSVPSDIGSKGITRIGHSSLSGVGNSTRNLPATEMAKQGKQAQVIHGLPDFAEVYSFIGSVFDPDTKGHVQKLKEMDPINFETGVAPFGSVFQETIKKTSYPIARRFFALRRYGRGMLYAALPLHMQGGCFRIRTHDQQVIKAQLYRCTRVRPLSKKPLKKIKVLLVLLLMKNLTVNLSSPDFEPVRKAMSSYDVNTNTVGVTAGIDVKKQTNDLSCQTA

SEQ ID NO: 224525 - protein, 222 aa, Glycine max
  Coding DNA Sequence Number=SeqID_107747
  Gene Ontology: Mol. function=nucleic acid binding; Cellular component= cytoplasm; Biological process=metabolic process
  Homolog annotation: Hit_ID=Q4SG97; Match level="QueryCoverage=75%, HitCoverage=50%, E-value=2e-30, Identity=43%"; Hit description =Chromosome 17 SCAF14597, whole genome shotgun sequence
MEDWDQETLEKVVESKKTEYNQNKPTDIVCKYFLDAVEKKQYGWFWVCPNGGKNCHYRHALPPGYVLKSQMKALLEEESEKITIEEEIENQRAKVTTTTPMTPELFMQWKKKKIEERDANLAAQQAERAKNDRMSGRELFLSDASLFVDDDEAYDKYQREPESESGDTEQNANGNATEDGPSTLIASADVDDDDELDMDELDELEASLSKTSIQIKELGAET

SEQ ID NO: 224526 - protein, 85 aa, Glycine max
  Coding DNA Sequence Number=SeqID_107748
MCVNSQSKATGNQIFLHVVVVAKATLGKLGLEGGCVTQRVVKIKDFFAKFRCYSHRDRCSSYGVDCNRCFGHQGYHYDSTIYVNL

SEQ ID NO: 224527 - protein, 195 aa, Glycine max
  Coding DNA Sequence Number=SeqID_107749
  Gene Ontology: Mol. function=metal ion binding; Cellular component =integral to membrane; Biological process=electron transport
  Homolog annotation: Hit_ID=Q3LGX5; Match level="QueryCoverage=85%, HitCoverage=72%, E-value=1e-69, Identity=72%"; Hit description =Cytochrome b561
  Pfam annotation: Domain name=Cytochrom_B561; Domain location=2-188; Score=174.1; E_value=3.6e-49; Accession=PF03188.6; Description =Cytochrome b561
GPYILRTFPFVQIHPVLIVIGLLVHGGEAIISYKAFPLKKEVKKLIHLVFHAIALILGIVGIYTAFKFHNESGIANLYSLHSWLGIGVIVLYGIQWIYGFVIFFFPGGTPDIRRASLPWHALFGLFVFVLAVGTAALGFLEKLTFLENSGLDKYGSEALLVNFTAIITILFGAFVVLSALADAPPAPAADDYEAI

SEQ ID NO: 224528 - protein, 48 aa, Glycine max
  Coding DNA Sequence Number=SeqID_107750
MATDGIQVTHEAMTYLSTLSIIYSHLASLPMEGGYEPTLTMAPPPFDQ

SEQ ID NO: 224529 - protein, 130 aa, Glycine max
  Coding DNA Sequence Number=SeqID_107751
  Gene Ontology: Mol. function=nucleic acid binding
MEGVVTHDGDIFKLTIENNSYWKPMMEDHLYCKDLHEPKGKINDKELVKLEYKDGHSMIEHLNIFKGLVNQLTKIDMRIDDELQALLLLSSLPESWDTLVVTLSNSTPKGKLTMDIVIDSLLNEEARRKE

SEQ ID NO: 224530 - protein, 68 aa, Glycine max
  Coding DNA Sequence Number=SeqID_107752
MALGVPALPLTYVAHVLAVVASVLVVVWVVNFRGGLAWDSDNKSLIFNLIAQYHKLTPGPNCKPPFAV

SEQ ID NO: 224531 - protein, 646 aa, Glycine max
  Coding DNA Sequence Number=SeqID_107753
  Gene Ontology: Mol. function=nucleic acid binding; Cellular component= intracellular; Biological process=DNA integration
  Pfam annotation: Domain name=rve; Domain location=116-277; Score= -11.6; E_value=0.056; Accession=PF00665.16; Description=Integrase core domain
  Pfam module annotation: Pfam domain module=RVT_2::rve; Domain location=326-515::116-277
MATDQDDDVFLIGEDNYLNVACDDCSWIVDSSAPFHVSLHGGFFSTYQSGDFGTVKMGNCVTCKIVSIGDITSMIDTGHELVLKEVRHVSDIRLNLISIGKLDDVGLVNHFANVAHGDSTMKLWHKRLGHMSKKGLQILARKNHLPNGKDVCSMSEKCLGAFKERETERKLKCVRVDNGGEYCGPFEAYCKTYGIKLEKTSPKTQQLNAVKTVVDVINLSLASPLDGDILEEIWSGKRVSYNYLKDQSIEDLKQSKKPKCRVNFDHDSFPTAHDVLREQVVEINQNEVDYGFEHNEASMEQSIETNNTEPIKAKESLKVMKKLWPTMIEKNGLKIEENSSRPRYKARIDVKGCNQKKGIDFEEIFSLVVKMSSIIVVLRIAASLDYEIKQLDVKTTFLYGDLEEKFYMEQPKGFEVLGKENLVHVSGDFVILMLNVDDMLIVGHDKKKIVALKLELSKSFAMKYLGPTKKILAMKITRDQSKRLLWLSREEYIEKILDRFNMYKAKPVSIPLVGQFKLSKKQSPTSEGDKEEMKNVPYSYVVGSLMYAMICTRSDIAYAVSVVSRFLKVCVRRIHKCGMIGDVDSRKSTFGYLTTFARGAMSWQAKLQKCMPLSITKAEYIAATEACKKMLWMEIFLHQLCHEQQN

SEQ ID NO: 224532 - protein, 764 aa, Glycine max
  Coding DNA Sequence Number=SeqID_107754
  Gene Ontology: Mol. function=receptor activity; Cellular component =chromosome; Biological process=DNA topological change
  Homolog annotation: Hit_ID=Q9FHD1; Match level="QueryCoverage=100%, HitCoverage=87%, E-value=1e-146, Identity=41%"; Hit description =Hyaluronan mediated motility receptor-like protein
MFKSWSKKNKIKALFKLDFQATQVPKMKKNAIMVSLVPDDVGKPTVKLEKTAVQDGTCSWENPVFEPVKLVRDSKSGKVHEKIYHFIVSTGSSKSGFLGEASIDFADFVAETEPMTISLPLKFANSGIVLHVTIQNVEGYAAERNGEDNEAEGLCSEGNLKHQLSYGSTDHESYNVDENGHTARTRSEYSEQDASNGISPGVASWEDPYSFRQNSIPSRGTVKATATETQVHKRSNTNWSTGSASDGSLGDWTNSLEDNLPRERLQEPSNNATESLKSEITSLKRQAEVSEIELQSLRRQVEKESSRGQNLSRQIISLREERDLLKTKYEQLKSQQNFNNESKTTKTLKSEIEDTRLQLEAIKDELVYEKDMKANLQLQLRKTQNSNSELLLAVTDLEAMLEQKNNEILDLSTNTKSQKITKEHDDATELDRLRQKIADQDEEIDNYYKQHEELSEQIKELTLEYDLLKKENVDISLRLKQDEAQHIKLQNEHSSCLVTIQQLESQVERLDERLKVQEEEFSASLVCIKELENEVKSLEKELKLQADQFEEDLHAMQCAKTEQEERAIQAEEALRKIRHNNVVASERFEEEYRLLSVEMSQKVEENEKMTMKAVAEADALRHQNKLIEEMLHKCNEELRLITDQNELKMKELLNQIDSKAETIEQMSQELEVKSKQLEDAQRQKDEKDASFSKQIQMLRSQIKMLMAEGALSETNLTKNTTETQKGERLMIPNDEEKILGTLLSEVETFKNQHNEIKQSLRKEQ

SEQ ID NO: 224533 - protein, 976 aa, Glycine max
  Coding DNA Sequence Number=SeqID_107755
  Gene Ontology: Mol. function=protein serine/threonine kinase activity; Cellular component=integral to membrane; Biological process=protein amino acid phosphorylation
  Homolog annotation: Hit_ID=Q9ZQC2; Match level="QueryCoverage=97%, HitCoverage=92%, E-value=0.0, Identity=60%"; Hit description =Putative receptor-like protein kinase
  Pfam annotation: Domain name=AT_hook; Domain location=570-582; Score =15.0; E_value=0.058; Accession=PF02178.9; Description=AT hook motif
  Pfam annotation: Domain name=LRR_1; Domain location=419-441; Score =3.3; E_value=69; Accession=PF00560.23; Description=Leucine Rich Repeat
  Pfam annotation: Domain name=LRR_1; Domain location=443-464; Score =12.3; E_value=1.4; Accession=PF00560.23; Description=Leucine Rich Repeat
  Pfam annotation: Domain name=LRR_1; Domain location=466-488; Score =14.3; E_value=0.44; Accession=PF00560.23; Description=Leucine Rich Repeat
  Pfam annotation: Domain name=Pkinase; Domain location=658-920; Score =74.3; E_value=3.7e-19; Accession=PF00069.15; Description=Protein kinase domain
  Pfam annotation: Domain name=Pkinase_Tyr; Domain location=659-920; Score=106.7; E_value=7e-29; Accession=PF07714.7; Description=Protein tyrosine kinase
  Pfam module annotation: Pfam domain module=AT_hook::LRR_1::LRR_1::LRR_ 1::Pkinase::Pkinase_Tyr; Domain location=570-582::419-441::443 -464::466-488::658-920::659-920
MESILLFFSSFKFALSLSLILHSPFSSAQIMQGFVSLDCGGTEKFADEIGLHWTPDDKLTYGQISTISVVNETRKQYTTLRHFPADSRKYCYTLEVVSRTRYLLRASFLYGNFDDNNVYPKFDISIGPTHWSTIVISDANSIEMRELIFLASSPTVSVCLSNATTGQPFISTLELRQFNGSVYYTQFEEHFYLSVSARINFGAESDAPIRYPDDPFDRIWESDSVKKANYLVDVAAGTEKISTTVPIDVNRDEMPPVKVMQTAVVGTNGSLTYRLNLDGFPGTGWAFTYFAEIEDLDPNESRKFRLVLPGQPDISKAVVNIEENAQGKYRLYEPGFTNISLPFVLSFRFGKTYDSSRGPLLNAMEINMYLEKNDGSLDGATISNILSHYSAEDWAQEGGDPCLPVPWSWVRCNSDPQPRIVSILLSNKNLTGNIPMDITKLVGLVELWLDGNMLTGPFPDFTGCMDLKIIHLENNQLTGVLPTSLTNLPSLRELQHETKVGVAEMRMLRWMCGKTRQDKIRNGAIRERVRVAPIVEKMMENRLRWFGHVERRPVDSIVRRVDQMERRQTIRGRGRPKKSIREVIKKDLELNDLDRIGASVLLLATIISCLYMRKGKRRYHEQDRIDSLPTQRLASWKSDDPAEAAHCFSFPEIENATNNFETKIGSGGFGIVYYGKLKDGKEIAVKVLTSNSYQGKREFSNEVTLLSRIHHRNLVQLLGYCRDEESSMLVYEFMHNGTLKEHLYVHGRSINWIKRLEIAEDAAKGCIPVVIHRDLKSSNILLDKHMRAKVSDFGLSKLAVDGVSHVSSIVRGTVGYLDPEYYISQQLTDKSDVYSFGVILLELISGQEAISNESFGVNCRNIVQWAKLHIESGDIQGIIDPLLRNDYDLQSMWKIAEKALMCVQPHGHMRPTISEVIKEIQDAISIERQAEALREGNSDDMSKHSFHSSMNMGSMDLGGAESYLSIDESIAQPTAR

SEQ ID NO: 224534 - protein, 130 aa, Glycine max
  Coding DNA Sequence Number=SeqID_107756
  Homolog annotation: Hit_ID=Q9FMC7; Match level="QueryCoverage=33%, HitCoverage=24%, E-value=1e-10, Identity=63%"; Hit description =Genomic DNA, chromosome 5, P1 clone:MUK11
MTNRWEKKPISNRETVKLPLLGRIAEMTRRGSMLATHVLMRFGKDPNTAKAQGVETLSPCQSHMPLSPLPQKFEVLWVVLGDKELQYSKQRTKIIFVRFKVSITTGGNILVSKEPFGRWDALCNKFMTIK

SEQ ID NO: 224535 - protein, 32 aa, Glycine max
  Coding DNA Sequence Number=SeqID_107757
MRVRLRNVTGFLGIYRGGRSVIDYKVWLPILV

SEQ ID NO: 224536 - protein, 58 aa, Glycine max
  Coding DNA Sequence Number=SeqID_107758
MEFCRKKPIWIGNPYDPYGLRFIHISDPYEPYRLAIHMNDPYDLYRLLIDMCRYHTDC

SEQ ID NO: 224537 - protein, 81 aa, Glycine max
  Coding DNA Sequence Number=SeqID_107759
MPVDPPTPVHEMPVDPPTPVLEIQEEPATPVLRLTITPPVTPYACPKAYCRNLPFGGRATRDSRDACSKKGIRAESPPTFI

SEQ ID NO: 224538 - protein, 45 aa, Glycine max
  Coding DNA Sequence Number=SeqID_107760
HSLTTVLKVTRLCPWKSWDRLLKNKEKVEKHIKVVIFISKTSWVQ

SEQ ID NO: 224539 - protein, 231 aa, Glycine max
  Coding DNA Sequence Number=SeqID_107761
  Gene Ontology: Mol. function=protein binding; Cellular component =cellulose and pectin-containing cell wall; Biological process =protein amino acid phosphorylation
  Homolog annotation: Hit_ID=O81765; Match level="QueryCoverage=99%, HitCoverage=33%, E-value=3e-81, Identity=62%"; Hit description =Extensin-like protein
  Pfam annotation: Domain name=LRR_1; Domain location=109-131; Score =11.1; E_value=2.4; Accession=PF00560.23; Description=Leucine Rich Repeat
  Pfam annotation: Domain name=LRR_1; Domain location=133-155; Score =9.4; E_value=4.9; Accession=PF00560.23; Description=Leucine Rich Repeat
  Pfam annotation: Domain name=LRR_1; Domain location=157-179; Score =11.5; E_value=2; Accession=PF00560.23; Description=Leucine Rich Repeat
  Pfam annotation: Domain name=LRR_1; Domain location=181-208; Score =0.2; E_value=2.6e+02; Accession=PF00560.23; Description=Leucine Rich Repeat
  Pfam annotation: Domain name=LRR_1; Domain location=38-60; Score =11.9; E_value=1.7; Accession=PF00560.23; Description=Leucine Rich Repeat
  Pfam annotation: Domain name=LRR_1; Domain location=61-83; Score=7.6; E_value=11; Accession=PF00560.23; Description=Leucine Rich Repeat
  Pfam annotation: Domain name=LRR_1; Domain location=84-106; Score =2.6; E_value=94; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=109-131::133-155::157 -179::181-208::38-60::61-83::84-106
FCGVLPKSFSKLKLLYEADISNNRFVGRFPEPVLPIPDLKFLDLRFNNFEGELPSELFNKSLDAIFLNNNRFTSTIPQNLGSSPASVVVFANNNLTGCVPSSIGNMTKTLNEFVLTNNNLTGCLPAEIGKLEKVTVFDISQNNFVGMLPRTLNGLKSVEHLSIEHNKLTGFVPRNVCSLSNLVNFTFSYNYFNGEEEGCVPPKKDVVLDDESNCIPDRPKQKVANICNVVI

SEQ ID NO: 224540 - protein, 70 aa, Glycine max
  Coding DNA Sequence Number=SeqID_107762
MGSSKRQVELWQVLWGAVIFCVWRKRNAAIFKQEVVTVFDIMCVWGTLLYVILHDQRKWCGVCWLEVEFL

SEQ ID NO: 224541 - protein, 343 aa, Glycine max
  Coding DNA Sequence Number=SeqID_107763
  Gene Ontology: Mol. function=transporter activity; Cellular component= membrane; Biological process=oligopeptide transport
  Homolog annotation: Hit_ID=Q1SQ95; Match level="QueryCoverage=98%, HitCoverage=56%, E-value=3e-85, Identity=47%"; Hit description=TGF -beta receptor, type I/II extracellular region
  Pfam annotation: Domain name=PTR2; Domain location=1-265; Score=2.5; E_value=5.1e-06; Accession=PF00854.12; Description=POT family
VFVAAFRNRKLLIPDNTDELHEIHEKQGGDYYEIIKSTDQFRNTVLSVPHLVFLEQWLPRFLDRAAIARSSTGARTTSGPWRLCTVTQVEETKILVRMLPIILSTIFMNTCLAQLQTFTIQQSTTMDTNLGGFKVPGPSVPVIPLLFMFVLIPLYDRVFVPLARRITGIPTGIRHLQRIGIGLVLSAVSMAVAGFVETRRKSVAIQHNMVDSTEPLPISVFWLGFQYAIFGAADMFTLIGLLEFFYAESSAGMKSLGTAISWSSVAFGYFTSTVVVEVVNKVSGGWLASNNLNRDNLNYFYWLLSVLSVVNFGFYLVCASWYRYKTVENEQGDSKDNVDMAKV

SEQ ID NO: 224542 - protein, 96 aa, Glycine max
  Coding DNA Sequence Number=SeqID_107764
MDRGSTAAKPGDLHQYTLFEISETTWHDEKRCTADSSASLQRGHSKSFCYMTFLLLKLSLVASLFLKSFQISCKKVSFGSWTLASKDNKEYADFVV

SEQ ID NO: 224543 - protein, 720 aa, Glycine max
  Coding DNA Sequence Number=SeqID_107765
  Gene Ontology: Mol. function=protein serine/threonine kinase activity; Cellular component=integral to membrane; Biological process=protein amino acid phosphorylation
  Homolog annotation: Hit_ID=Q1S227; Match level="QueryCoverage=98%, HitCoverage=92%, E-value=0.0, Identity=52%"; Hit description=Protein kinase; Actin-binding, actinin-type
  Pfam annotation: Domain name=LRR_1; Domain location=111-133; Score =11.2; E_value=2.3; Accession=PF00560.23; Description=Leucine Rich Repeat
  Pfam annotation: Domain name=LRR_1; Domain location=135-157; Score =13.9; E_value=0.61; Accession=PF00560.23; Description=Leucine Rich Repeat
  Pfam annotation: Domain name=LRR_1; Domain location=15-37; Score =14.5; E_value=0.38; Accession=PF00560.23; Description=Leucine Rich Repeat
  Pfam annotation: Domain name=LRR_1; Domain location=159-179; Score =5.5; E_value=26; Accession=PF00560.23; Description=Leucine Rich Repeat
  Pfam annotation: Domain name=LRR_1; Domain location=183-205; Score =13.0; E_value=1; Accession=PF00560.23; Description=Leucine Rich Repeat
  Pfam annotation: Domain name=LRR_1; Domain location=207-229; Score =17.0; E_value=0.068; Accession=PF00560.23; Description=Leucine Rich Repeat
  Pfam annotation: Domain name=LRR_1; Domain location=231-253; Score =17.2; E_value=0.058; Accession=PF00560.23; Description=Leucine Rich Repeat
  Pfam annotation: Domain name=LRR_1; Domain location=255-277; Score =13.9; E_value=0.6; Accession=PF00560.23; Description=Leucine Rich Repeat
  Pfam annotation: Domain name=LRR_1; Domain location=279-302; Score =7.6; E_value=11; Accession=PF00560.23; Description=Leucine Rich Repeat
  Pfam annotation: Domain name=LRR_1; Domain location=39-61; Score =14.7; E_value=0.33; Accession=PF00560.23; Description=Leucine Rich Repeat
  Pfam annotation: Domain name=LRR_1; Domain location=63-82; Score =14.2; E_value=0.48; Accession=PF00560.23; Description=Leucine Rich Repeat
  Pfam annotation: Domain name=LRR_1; Domain location=87-109; Score =13.6; E_value=0.71; Accession=PF00560.23; Description=Leucine Rich Repeat
  Pfam annotation: Domain name=Pkinase; Domain location=407-683; Score =145.8; E_value=1.2e-40; Accession=PF00069.15; Description=Protein kinase domain
  Pfam annotation: Domain name=Pkinase_Tyr; Domain location=407-683; Score=102.9; E_value=9.7e-28; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain location=111-133::135-157::15 -37::159-179::183-205::207-229::...
  Pfam module annotation: Domain location=231-253::255-277::279-302::39- 61::63-82::87-109::407-683::407-683
MLSGKIPAEISQLKNLKLLNFMGNKLSGPVPPGFGDLPQLEVLELWNNSLSGPLPSNLGKNSHLQWLDVSSNSLSGEIPETLCSQGNLTKLILFNNAFTGSIPSSLSMCPSLVRVRIQNNFLSGTVPVGLGKLGKLQRLELANNSLSGGIPDDISSSTSLSFIDLSRNKLHSSLPSTVLSIPNLQAFMVSNNNLEGEIPDQFQDCPSLAVLDLSSNHLSGSIPASIASCQKLVNLNLQNNQLTGEIPKALGKMPTLAMLDLSNNSLTGQIPESFGISPALEALNVSFNKLEGPVPANGILRTINPNDLLGNTGLCGGILPPCDQNSPYSSRHGSLHAKHIITAWIAGISTILVIGIAIVVARSLYIRWYTDGFCFRERFYKGSKGWPWRLVAFQRLGFTSTDILACIKETNVIGMGATGVVYKAEIPQSNTTVAVKKLWRTGTDIEVGSSDDLVGEVNVLGRLRHRNIVRLLGFIHNDIDVMIVYEFMHNGNLGEALHGRQATRLLVDWVSRYNIALGVAQGLAYLHHDCHPPVIHRDIKSNNILLDANLEARIADFGLAKMMIRKNETVSMVAGSYGYIAPEYGYALKVDEKIDVYSYGVVLLELLTGKRPLDSDFGESIDIVEWLRMKIRDNKSLEEVLDPSVGNSRHVVEEMLLVLRIAILCTAKLPKERPTMRDVIMMLGEAKPRRKSSSNSKDAANNKEIPVFSTSPVNNNNSLV

SEQ ID NO: 224544 - protein, 127 aa, Glycine max
  Coding DNA Sequence Number=SeqID_107766
  Gene Ontology: Mol. function=protein dimerization activity; Cellular component=nucleus; Biological process=regulation of transcription
  Homolog annotation: Hit_ID=Q38831; Match level="QueryCoverage=39%, HitCoverage=20%, E-value=4e-17, Identity=80%"; Hit description=Auxin- responsive protein IAA13
  Pfam annotation: Domain name=AUX_IAA; Domain location=1-78; Score= -66.0; E_value=9.7e-05; Accession=PF02309.7; Description=AUXIAA family
MALTSLSVGSNGEDHGTEVGADGHSKLLHGSSDLVLTYEDKEGDWMLVGDVPWWMFLNSVRRLRIMRTPEANGLALIQLLICSPKIEGKEQKIEMQAHIDNVIVCTFTCARIHKTYELKCTTRIEGI

SEQ ID NO: 224545 - protein, 61 aa, Glycine max
  Coding DNA Sequence Number=SeqID_107767
  Subcellular localization annotation: CTP_CleavageSite=31; ConfidenceScore=5.08e-01
MSSSSEYSQFSGQKPARSPEKSSFSQTCSLLSQYIKEKGSFGDLTLGMTSCVLGLNLYLNS

SEQ ID NO: 224546 - protein, 271 aa, Glycine max
  Coding DNA Sequence Number=SeqID_107768
  Gene Ontology: Mol. function=transporter activity; Cellular component= membrane; Biological process=oligopeptide transport
  Homolog annotation: Hit_ID=Q1S2G7; Match level="QueryCoverage=87%, HitCoverage=37%, E-value=1e-52, Identity=44%"; Hit description=TGF -beta receptor, type I/II extracellular region
MANELLILKKLAARSILKKTLTMGICRNMGTQPRVQRRLGGNRATLFVYAMEGLENMAFVANAVSLVTYFFGYMNFSLTKSATTLTNFMGTAFLLALVGGLISDTYLSRFKTCVLFACMELLGYGILTVQARFHQLRPIPCKDLATTQMSQCEAATGGHAAILYTGLYLVALGTGGIKAALPALGADQFDEKDPKEATQLSSFFNWFLFSLTIGAIIGVTFIVWIGVNLGWDWSFIVCTLTILFAIVFICMGNSLYRNNVPKGSPLVRIIQ

SEQ ID NO: 224547 - protein, 646 aa, Glycine max
  Coding DNA Sequence Number=SeqID_107769
  Gene Ontology: Mol. function=histone-lysine N-methyltransferase activity; Cellular component=nucleus; Biological process=chromatin modification
  Homolog annotation: Hit_ID=Q1S200; Match level="QueryCoverage=99%, HitCoverage=88%, E-value=0.0, Identity=63%"; Hit description=SET -related region; Pre-SET; Histone H3-K9 methyltransferase
  Pfam annotation: Domain name=Pre-SET; Domain location=400-546; Score=- 6.8; E_value=0.0023; Accession=PF05033.6; Description=Pre-SET motif
  Pfam annotation: Domain name=SET; Domain location=548-645; Score =14.9; E_value=3.4e-05; Accession=PF00856.18; Description=SET domain
  Pfam module annotation: Pfam domain module=Pre-SET::SET; Domain location=400-546::548-645
MAPNPRVVAAFTAMANLGIHESKVKPVLKKLLKLYDKNWALIEEESYRALADAIFEEEENKVNEPDQNNKNKNGVVDDEEAHTHGEPVRPLKRLRLRGQEGQSLRPLTSSGPSSAAFPLKAPKLEDGAVPESSSRRQPQSMAALSDGNARIGARHVPPQDAVVDKGKKPISPQLTPRARRSLAEPTVEAGAALLANNKMPHPFILIKPKDEPVDGIPDYEIPLAVIPPEPSSGGDSLMGAAGKKDCHDTVVSQCRDENVEHEYVFPSSNEEATSNVDVALSSMGEEQSVKITQTDDVSKESETNDSPIVRGNKDSVIANGSISVESSAMAELQVPSSIPCSSDLDNAVPAPKKVGMNGFLQSDSGKELEHPIIPNSRTLVVVPKHQLTNDDVRAVHDVNDLTKGEERVKISWVNNTTNDFPPPCHYIPRNLVFREAYVNISLSRIGNEDCCSTCMGNCVLSSKSCSCTNKTGGEFAYTAKGLLKEEFLDECIALNRDPQNYFYCKACPLERSKNDDCLEPCKGHLKRKFIKECWSKCGCGKHCGNRVVQRGITCKLQVFLTSDRKGWGLRTLEDLQKGAFVCEFVGEILTIKELHERRLKYPKNGKYTYPILLDADWGSGIVKDREALCLYAASYGNAARFINHRY

SEQ ID NO: 224548 - protein, 187 aa, Glycine max
  Coding DNA Sequence Number=SeqID_107770
  Homolog annotation: Hit_ID=Q1S209; Match level="QueryCoverage=92%, HitCoverage=90%, E-value=2e-71, Identity=77%"; Hit description =Expressed protein
MVLDCEYHFLSSCSSMKKVDEETGKYYGRKAVSFVLITITGGVALSALDDLAIYHGCSSKAMEKVSKNQAIIDSIGEPIVKGPWYNASLAVAHERRSVSCSFPVSGPQGNGVLQLKAVRNGDDTWSSFFLPRDWDILIMDALLHIPENEKHRTLRINLADKPLSCTACTDSTPHPSENSKAKLSANQ

SEQ ID NO: 224549 - protein, 50 aa, Glycine max
  Coding DNA Sequence Number=SeqID_107771
MSSVVIVGEEIVAVVGEEEASVWGSRPGKDGEGATTTAAKNVVSGGGGKL

SEQ ID NO: 224550 - protein, 375 aa, Glycine max
  Coding DNA Sequence Number=SeqID_107772
  Gene Ontology: Mol. function=binding; Cellular component =intracellular; Biological process=RNA processing
  Homolog annotation: Hit_ID=Q1S208; Match level="QueryCoverage=94%, HitCoverage=99%, E-value=1e-100, Identity=58%"; Hit description =Tetratricopeptide-like helical
  Pfam annotation: Domain name=TPR_2; Domain location=247-281; Score =14.5; E_value=0.4; Accession=PF07719.7; Description=Tetratricopeptide repeat
  Pfam annotation: Domain name=TPR_2; Domain location=282-316; Score =8.4; E_value=3.5; Accession=PF07719.7; Description=Tetratricopeptide repeat
  Pfam module annotation: Pfam domain module=TPR_2::TPR_2; Domain location=247-281::282-316
MMLRSSSTPVLGSLLSSFTDSPNNNIHSETCHALKHFPPTTVPQHYHKLTFHQTGSSACGSSPISPSIGELERQNKGLIRRVQSDGNLQDLAFFSCNNEERFEFSDPSKRFSARHRSLVLETIPSFSTAKHNGLSEEEEDEEMESESEDGFSVLNGGKGVIFSEEVRVKDGVCRVSFGDQEEVSSGKEMYLAKGLGVECCGDGIGGCRGGGGGGGDHNPLGSGGNDGERHGVEEYYKKMVRENPGDPLFLRNYANFLYQCKQDREGAEEYYSRAILADPNDGEVLSQYGKLVWELHHNQERASSYFERAVQASPEDSHVQAAYASFLWDTEEDEDGINEPQSLPPHSHQGAVATADNRTMTHETESNQNMLQKPA

SEQ ID NO: 224551 - protein, 292 aa, Glycine max
  Coding DNA Sequence Number=SeqID_107773
  Gene Ontology: Mol. function=receptor activity; Biological process =protein amino acid phosphorylation
  Homolog annotation: Hit_ID=O22784; Match level="QueryCoverage=88%, HitCoverage=89%, E-value=4e-61, Identity=45%"; Hit description =Expressed protein
  Pfam annotation: Domain name=DUF26; Domain location=187-238; Score =46.0; E_value=1.3e-10; Accession=PF01657.8; Description=Domain of unknown function DUF26
  Pfam annotation: Domain name=DUF26; Domain location=79-135; Score =39.2; E_value=1.4e-08; Accession=PF01657.8; Description=Domain of unknown function DUF26
  Pfam module annotation: Pfam domain module=DUF26::DUF26; Domain location=187-238::79-135
MGILKSKHHKHTLLFFLSISFPLFLLTPITTSDNTNLIYKGCADQKMQGQYSQNLKPLLDSLVSASAQKGFAATTQNALTGAYQCRGDLSNSECYNCVSKIPNMLGRLCGGDDVAAARVQLSGCYLRYEVVGFKVVPATQLLYKVCGARKVVDGGGFEARRDAAFGMAENGVQNSGNLFYTGSYQSLYVLGQCEGSLGNADCGGCIKSAAEQAGDQCADSISAQVYLQSCFLSYSFYPNGVPTLSSSSGGGGGHPHTERTVALAVGGVAALGFLIVCLLFLKSVLKRRGGKR

SEQ ID NO: 224552 - protein, 1569 aa, Glycine max
  Coding DNA Sequence Number=SeqID_107774
  Gene Ontology: Mol. function=protein serine/threonine kinase activity; Cellular component=integral to membrane; Biological process=protein amino acid phosphorylation
  Homolog annotation: Hit_ID=Q337M0; Match level="QueryCoverage=97%, HitCoverage=98%, E-value=0.0, Identity=51%"; Hit description=Leucine Rich Repeat family protein, expressed
  Pfam annotation: Domain name=LRRNT_2; Domain location=29-72; Score =19.3; E_value=0.0083; Accession=PF08263.3; Description=Leucine rich repeat N-terminal domain
  Pfam annotation: Domain name=LRR_1; Domain location=102-124; Score =11.9; E_value=1.7; Accession=PF00560.23; Description=Leucine Rich Repeat
  Pfam annotation: Domain name=LRR_1; Domain location=126-148; Score =12.0; E_value=1.6; Accession=PF00560.23; Description=Leucine Rich Repeat
  Pfam annotation: Domain name=LRR_1; Domain location=150-172; Score =12.0; E_value=1.6; Accession=PF00560.23; Description=Leucine Rich Repeat
  Pfam annotation: Domain name=LRR_1; Domain location=174-195; Score =0.6; E_value=2.2e+02; Accession=PF00560.23; Description=Leucine Rich Repeat
  Pfam annotation: Domain name=LRR_1; Domain location=199-223; Score =5.2; E_value=30; Accession=PF00560.23; Description=Leucine Rich Repeat
  Pfam annotation: Domain name=LRR_1; Domain location=224-247; Score =5.9; E_value=23; Accession=PF00560.23; Description=Leucine Rich Repeat
  Pfam annotation: Domain name=LRR_1; Domain location=249-271; Score =12.5; E_value=1.3; Accession=PF00560.23; Description=Leucine Rich Repeat
  Pfam annotation: Domain name=LRR_1; Domain location=273-295; Score =10.4; E_value=3.2; Accession=PF00560.23; Description=Leucine Rich Repeat
  Pfam annotation: Domain name=LRR_1; Domain location=321-343; Score =9.7; E_value=4.4; Accession=PF00560.23; Description=Leucine Rich Repeat
  Pfam annotation: Domain name=LRR_1; Domain location=345-367; Score =16.8; E_value=0.081; Accession=PF00560.23; Description=Leucine Rich Repeat
  Pfam annotation: Domain name=LRR_1; Domain location=369-392; Score =6.4; E_value=18; Accession=PF00560.23; Description=Leucine Rich Repeat
  Pfam annotation: Domain name=LRR_1; Domain location=394-416; Score =12.7; E_value=1.2; Accession=PF00560.23; Description=Leucine Rich Repeat
  Pfam annotation: Domain name=LRR_1; Domain location=418-440; Score =7.8; E_value=10; Accession=PF00560.23; Description=Leucine Rich Repeat
  Pfam annotation: Domain name=LRR_1; Domain location=442-464; Score =11.9; E_value=1.7; Accession=PF00560.23; Description=Leucine Rich Repeat
  Pfam annotation: Domain name=LRR_1; Domain location=466-488; Score =10.9; E_value=2.6; Accession=PF00560.23; Description=Leucine Rich Repeat
  Pfam annotation: Domain name=LRR_1; Domain location=490-512; Score =5.4; E_value=27; Accession=PF00560.23; Description=Leucine Rich Repeat
  Pfam annotation: Domain name=LRR_1; Domain location=514-536; Score =2.0; E_value=1.2e+02; Accession=PF00560.23; Description=Leucine Rich Repeat
  Pfam annotation: Domain name=LRR_1; Domain location=538-560; Score =10.7; E_value=2.8; Accession=PF00560.23; Description=Leucine Rich Repeat
  Pfam annotation: Domain name=LRR_1; Domain location=562-584; Score =11.7; E_value=1.8; Accession=PF00560.23; Description=Leucine Rich Repeat
  Pfam annotation: Domain name=LRR_1; Domain location=586-608; Score =10.1; E_value=3.6; Accession=PF00560.23; Description=Leucine Rich Repeat
  Pfam annotation: Domain name=LRR_1; Domain location=610-632; Score =9.2; E_value=5.3; Accession=PF00560.23; Description=Leucine Rich Repeat
  Pfam annotation: Domain name=LRR_1; Domain location=634-656; Score =12.5; E_value=1.3; Accession=PF00560.23; Description=Leucine Rich Repeat
  Pfam annotation: Domain name=LRR_1; Domain location=658-680; Score =17.5; E_value=0.049; Accession=PF00560.23; Description=Leucine Rich Repeat
  Pfam annotation: Domain name=LRR_1; Domain location=682-704; Score =8.9; E_value=6.1; Accession=PF00560.23; Description=Leucine Rich Repeat
  Pfam annotation: Domain name=LRR_1; Domain location=706-728; Score =17.8; E_value=0.039; Accession=PF00560.23; Description=Leucine Rich Repeat
  Pfam annotation: Domain name=LRR_1; Domain location=730-752; Score =17.4; E_value=0.053; Accession=PF00560.23; Description=Leucine Rich Repeat
  Pfam annotation: Domain name=LRR_1; Domain location=754-777; Score =1.4; E_value=1.5e+02; Accession=PF00560.23; Description=Leucine Rich Repeat
  Pfam annotation: Domain name=LRR_1; Domain location=77-100; Score =6.7; E_value=16; Accession=PF00560.23; Description=Leucine Rich Repeat
  Pfam annotation: Domain name=LRR_1; Domain location=779-801; Score =20.2; E_value=0.0074; Accession=PF00560.23; Description=Leucine Rich Repeat
  Pfam annotation: Domain name=LRR_1; Domain location=803-826; Score =12.3; E_value=1.4; Accession=PF00560.23; Description=Leucine Rich Repeat
  Pfam annotation: Domain name=Pkinase; Domain location=1258-1510; Score=22.1; E_value=7.1e-10; Accession=PF00069.15; Description =Protein kinase domain
  Pfam annotation: Domain name=Pkinase; Domain location=930-1204; Score= 116.6; E_value=6.9e-32; Accession=PF00069.15; Description=Protein kinase domain
  Pfam annotation: Domain name=Pkinase_Tyr; Domain location=930-1204; Score=116.8; E_value=6.1e-32; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::Pkinase::Pkinase::Pkinase_Tyr; Domain location=29 -72::102-124::126-148::150-172::174-195::199-223::224-247::249 -271::273-295::321-343::...
  Pfam module annotation: Domain location=345-367::369-392::394 -416::418-440::442-464::466-488::490-512::514-536::538-560::562 -584::586-608::610-632::634-656::658-680::682-704::706-728::730 -752::754-777::77-100::779-801::...
  Pfam module annotation: Domain location=803-826::1258-1510::930 -1204::930-1204
  Subcellular localization annotation: CTP_CleavageSite=70; ConfidenceScore=5.06e-01
MASFLKVHALLFHILFFISLLPFKITSSQITESEALVKWKNSLSPPLPSSLNSSWSLTNLGNLCNWDAIVCDNTNTTVLEINLSDANLTGTLTALDFASLPNLTQLNLTANHFGGSIPSAIGNLSKLTLLDFGNNLFEGTLPYELGQLRELQYLSFYDNSLNGTIPYQLMNLPKVWYMDLGSNYFITPPDWFQYSCMPSLTRLALHQNPTLTGEFPSFILQCHNLTYLDISQNNWNGTIPESMYSKLAKLEYLNLTNSGLQGKLSPNLSMLSNLKELRIGNNMFNGSVPTEIGLISGLQILELNNISAHGKIPSSLGQLRELWSLDLRNNFLNSTIPSELGQCTKLTFLSLAGNSLSGPLPISLANLAKISELGLSENSFSGQLSVLLISNWTQLISLQLQNNKFTGRIPSQIGLLKKINYLYMYKNLFSGLIPLEIGNLKEMIELDLSQNAFSGPIPSTLWNLTNIQVMNLFFNELSGTIPMDIGNLTSLQIFDVNTNNLYGEVPESIVQLPALSYFSVFTNNFSGSIPGAFGMNNPLTYVYLSNNSFSGVLPPDLCGHGNLTFLAANNNSFSGPLPKSLRNCSSLIRVRLDDNQFTGNITDAFGVLPNLVFVSLGGNQLVGDLSPEWGECVSLTEMEMGSNKLSGKIPSELSKLSQLRHLSLHSNEFTGHIPPEIGNLSQLLLFNMSSNHLSGEIPKSYGRLAQLNFLDLSNNNFSGSIPRELGDCNRLLRLNLSHNNLSGEIPFELGNLFSLQIMLDLSSNYLSGAIPPSLEKLASLEVLNVSHNHLTGTIPQSLSDMISLQSIDFSYNNLSGSIPTGHVFQTVTSEAYVGNSGLCGEVKGLTCPKVFSSHKSGGVNKNVLLSILIPVCVLLIGIIGVGILLCWRHTKNNPDEESKITEKSDLSISMVWGRDGKFTFSDLVKATDDFNDKYCIGKGGFGSVYRAQLLTGQVVAVKRLNISDSDDIPAVNRQSFQNEIESLTEVRHRNIIKLYGFCSCRGQMFLVYEHVHRGSLGKVLYGEEEKSELSWATRLKIVKGIAHAISYLHSDCSPPIVHRDVTLNNILLDSDLEPRLADFGTAKLLSSNTSTWTSVAGSYGYMAPELAQTMRVTNKCDVYSFGVVVLEIMMGKHPGELLFTMSSNKSLSSTEEPPVLLKDVLDQRLPPPTGNLAEAVVFTVTMAMACTRAAPESRPMMRSVAQQLSLATKQPCLTEPFGMITISKLTAGPGGTVCNSGSLDVFLQIFLQRFKGGVGSEGIIPKLLHCGGASEVAQTEPFEDAAPLIGQVVAVKRLNISDSDDIPAVNRQSFQNEIESLTEVRHRNIIKLYGFCSWSGQMFLVYEHVQRGSMGKVLYGEETKLELSWATRLKIVQGIAHAISYLQSDCSPAIVHRDVTLNNILLDSDLEPRLGTAKLLSSNTSTWTSVAAGLYGYMAPELIQTMRVTDKCDVYSFGVVVLEIFMGKHPGELLTTMSSNKYLTSMEEPQMLLKDVLDQRLPPPTGQLAVAVVFTMTIDMACTCDGFCGTTIVGYYAGLSLRAIWDDNYKQAYRVPEIVPCRTAGSVAMWHNL

SEQ ID NO: 224553 - protein, 105 aa, Glycine max
  Coding DNA Sequence Number=SeqID_107775
MQTRAGAFNSITGKAKKVGWVLARVNRTVTNEWALALAPFGWRNSSWQPYAPRWRVKLTIGDWIGDDPVAVPGQFQSQSESQGQGIQSGTHRFFCWYFLPTATFT

SEQ ID NO: 224554 - protein, 127 aa, Glycine max
  Coding DNA Sequence Number=SeqID_107776
MEAWHKALCGGKSGNEFGSGLLKVASKRKKKVKKKVAPTTKKVMDEVEEGELGTLGCELENEEFVLEKLIMLTRRSEIENEKIDDIEKGEFIPSRWHDIGETWGGMIMAMPGRDKGWKNEWEGTLLK

SEQ ID NO: 224555 - protein, 421 aa, Glycine max
  Coding DNA Sequence Number=SeqID_107777
  Gene Ontology: Mol. function=protein serine/threonine kinase activity; Cellular component=integral to membrane; Biological process=protein amino acid phosphorylation
  Homolog annotation: Hit_ID=Q337M0; Match level="QueryCoverage=99%, HitCoverage=95%, E-value=2e-46, Identity=31%"; Hit description =Leucine Rich Repeat family protein, expressed
  Pfam annotation: Domain name=LRRNT_2; Domain location=1-42; Score =14.4; E_value=0.027; Accession=PF08263.3; Description=Leucine rich repeat N-terminal domain
  Pfam annotation: Domain name=LRR_1; Domain location=134-157; Score =0.9; E_value=1.9e+02; Accession=PF00560.23; Description=Leucine Rich Repeat
  Pfam annotation: Domain name=LRR_1; Domain location=158-181; Score =5.2; E_value=31; Accession=PF00560.23; Description=Leucine Rich Repeat
  Pfam annotation: Domain name=LRR_1; Domain location=183-210; Score =10.7; E_value=2.8; Accession=PF00560.23; Description=Leucine Rich Repeat
  Pfam annotation: Domain name=LRR_1; Domain location=212-235; Score =8.3; E_value=7.9; Accession=PF00560.23; Description=Leucine Rich Repeat
  Pfam annotation: Domain name=LRR_1; Domain location=258-280; Score =14.1; E_value=0.51; Accession=PF00560.23; Description=Leucine Rich Repeat
  Pfam annotation: Domain name=LRR_1; Domain location=282-304; Score =13.9; E_value=0.58; Accession=PF00560.23; Description=Leucine Rich Repeat
  Pfam annotation: Domain name=LRR_1; Domain location=306-327; Score =0.4; E_value=2.4e+02; Accession=PF00560.23; Description=Leucine Rich Repeat
  Pfam annotation: Domain name=LRR_1; Domain location=47-70; Score=6.2; E_value=20; Accession=PF00560.23; Description=Leucine Rich Repeat
  Pfam annotation: Domain name=LRR_1; Domain location=85-107; Score =6.4; E_value=18; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=1 -42::134-157::158-181::183-210::212-235::258-280::282-304::306 -327::47-70::85-107
TEAEALVKWKNSLSPPLPPSLNSSWSLTNLANLCIWDAIACDNTNTTVSQINLSGANLTGTLTALDFAFLPHLTQINLNGNHFGGFNILVFSYNNLNGTIPYQLMNLPNVWYMDFGSNHFITPPDWSHYSSMPSVTHLALDFNYFTAEFPSFILECHNLTYLDISQNDWNGTIPESMSSNLAKLEYLNLTNSGLEGKILTGPLPMSLANLAKISELGLSDNFFSGQLSASLISNWTQLISLQNLFSGPIPEEIGNLKELIKLDLSQNQFSSPIPSTLWNLTNIQVLNLFSNEFSGTIPMDIENLASLQIFDVSTNYLHGVLPETKRHDEVTDKCDVYSFEVVVLEIFMGKHPGELLTTMSSNEYLTSTEEPQMLLKDVLDQRLPPPAGQLAEAVVFIVTIALACTHAAPESRPLMRFVAQS

SEQ ID NO: 224556 - protein, 908 aa, Glycine max
  Coding DNA Sequence Number=SeqID_107778
  Gene Ontology: Mol. function=binding; Cellular component =intracellular; Biological process=RNA processing
  Homolog annotation: Hit_ID=Q10Q44; Match level="QueryCoverage=88%, HitCoverage=87%, E-value=0.0, Identity=52%"; Hit description=Pre -mRNA processing protein prp39, putative, expressed
MGDSEAVVTEASAAEAYASAGYAETGSNPAPEAGATVDQSAGEAAQASSTYGYGYSNVGDVNSYAGDPNSILQQAQFSATGESKPAGGAADSNEASAGVGSTAADSTMVSDYNSSVNGGVAGAVTNTSGLENGNALENADGSADEKQQADGYAALSAEEDRLWNIVRANSLDFTAWTSLIEETEKAAEDNILKIRRVYDAFLAEFPLCYGYWKKYADHEARLGSIDKVVEVYERAVQGVTYSVDMWLHYCIFAITTYGDPDTVRRLFERGLAYVGTDYLSFPLWDKYIEYEYMQQDWARLAVIYTRILENPNQQLDRYFSSFKELAGNRPLSELRTADEAAAVAGVASEATGQATEGEVHPDGAERSPKSVSAGLTEAEELEKYIAIREEMYKKAKEFDSKIIGFETAIRRPYFHVRPLNVGELENWHNYLDFIEREGDLSKVSSYLPNHLSQARRVPPFIFEGPLCPAKELSSCMRDVSLHVPIILSIGYAMFCVWKPVEAWILQIMFLLGQPKSLLSLLQFEVWILKCMDPFYLMFEIGLLKNWVGNNLVPHTWSLERQPEIHIFCARFKEQTGDIDGARAAYQLVHTETSPGLLEAIIKHANMEYRLEKMEDAFSLYEQAIAIEKGKEHSQTLPMLFAQYSRFVYLASGNAEKARQILVEGLENVLLSKPLLEAILHFEAIQPLPKRVDIDFLESWVVKFIMPNSESPGVASATEREELSSIFLEACVCICVLGVWFLNLFGDVQSIKRAEDRHAKLFLPHRSMSELKKRHAEDFLASDKTKAPRSYSAQSPAQSGMGAYPNAQNQWSNYGVQPQTWPPVTQAQGQQWTAGYTQQASYGAYAGYGGNYANSQLPTSVPQSTAYGAYPPAYPAQPAVPQQNYAQPVAAAPAQQPAAVPQAYYGSYY

SEQ ID NO: 224557 - protein, 485 aa, Glycine max
  Coding DNA Sequence Number=SeqID_107779
  Gene Ontology: Mol. function=DNA binding; Biological process =regulation of transcription
  Homolog annotation: Hit_ID=Q94CL7; Match level="QueryCoverage=78%, HitCoverage=87%, E-value=1e-82, Identity=50%"; Hit description =Phosphate starvation response regulator 1
  Pfam annotation: Domain name=Myb_DNA-binding; Domain location=261 -312; Score=48.0; E_value=3.2e-11; Accession=PF00249.21; Description =Myb-like DNA-binding domain
MEAHSAFSIERSNANDMGMSEVFPSSLPVLPSPLEETFPKLSDSRPAFMEKELKTKPFTHSSHLTSSGAVGHMFSSSPGYSTDLHHSSFSSYEKQPRNTHFISQPLGNMASLPLSYSSNSEPIPSTTSTPYSNGNSVSWHTDSLPSFLDFTANTSIDNSQVENRACNIMATEEYSKRNDWQEWADQLISDVDPLTSNWNDLLADNIQDLEPKAVYQVTKSSSQLPIEHQSQSHQQLCASSGENRVGVAPTSSANSAPAKPRMRWTPELHEAFVEAVNQLGGSERATPKGVLKLMKVEGLTIYHVKSHLQKYRTARYRPESSEGAAEKNLSRIEEMSSLDLKTGIEITEALRLQMEVQKRLHEQLEIQRNLQLRIEEQGRYLQMMFEKQCKPGIETFKASSSVIESQSGVSSDAIKDSPAKTESETIKVDHCKSGADLANGSTTVEESSLEVAEKQDAPEIQASDNPEQHASEDSGNASKRPRTEE

SEQ ID NO: 224558 - protein, 102 aa, Glycine max
  Coding DNA Sequence Number=SeqID_107780
MAVSWGWTNARWHEGCRKRSMKTIDKNMGQDKNDEHVSHTLMSLSKTLVNHATFLLLDIPSLHFTLDNLRLESGEGSSIQCLKMTTLLHWILLLLTFNYLSL

SEQ ID NO: 224559 - protein, 106 aa, Glycine max
  Coding DNA Sequence Number=SeqID_107781
MATTPVLELSQFALPFHEETDAFAMAIGAILSQQGHPIAYFSKMLCHKVRVAFEYAREMLAITDAIKNAKEDPKPKSEPKDEASDASHDSEVELPLDQEEDAPLTL

SEQ ID NO: 224560 - protein, 226 aa, Glycine max
  Coding DNA Sequence Number=SeqID_107782
  Gene Ontology: Mol. function=RNA-directed DNA polymerase activity; Cellular component=exocyst; Biological process=RNA-dependent DNA replication
  Homolog annotation: Hit_ID=Q2HTR6; Match level="QueryCoverage=82%, HitCoverage=54%, E-value=3e-29, Identity=34%"; Hit description=RNA -directed DNA polymerase
MVSFQLDLLNRIGDGCCLMEAVSGCGGYKSLGLDGNGKIPQGGNPLFIAMVISKVLSKRMKVILEGIIDERQCAFVGGRNMLDGVLIANEMEIFETWISWIKRGLELVMVSILVNGSPIEEFPTIRRFRQRDPITPFFFLVVVEGLSVLMRMATRGGLFLEYKAILRCFELVSDLWVNIHKSKLASVGVESRAIGTYASLLNCGTTNISFMYLGIPINANPHKEAA

SEQ ID NO: 224561 - protein, 312 aa, Glycine max
  Coding DNA Sequence Number=SeqID_107783
  Gene Ontology: Mol. function=protein serine/threonine kinase activity; Cellular component=integral to membrane; Biological process=protein amino acid phosphorylation
  Homolog annotation: Hit_ID=Q337M0; Match level="QueryCoverage=87%, HitCoverage=64%, E-value=5e-41, Identity=31%"; Hit description =Leucine Rich Repeat family protein, expressed
  Pfam annotation: Domain name=LRR_1; Domain location=110-132; Score =10.6; E_value=3; Accession=PF00560.23; Description=Leucine Rich Repeat
  Pfam annotation: Domain name=LRR_1; Domain location=134-156; Score =6.2; E_value=20; Accession=PF00560.23; Description=Leucine Rich Repeat
  Pfam annotation: Domain name=LRR_1; Domain location=158-179; Score =11.2; E_value=2.3; Accession=PF00560.23; Description=Leucine Rich Repeat
  Pfam annotation: Domain name=LRR_1; Domain location=181-204; Score =14.4; E_value=0.41; Accession=PF00560.23; Description=Leucine Rich Repeat
  Pfam annotation: Domain name=LRR_1; Domain location=206-228; Score =11.3; E_value=2.2; Accession=PF00560.23; Description=Leucine Rich Repeat
  Pfam annotation: Domain name=LRR_1; Domain location=230-252; Score =10.2; E_value=3.6; Accession=PF00560.23; Description=Leucine Rich Repeat
  Pfam annotation: Domain name=LRR_1; Domain location=254-276; Score =16.4; E_value=0.1; Accession=PF00560.23; Description=Leucine Rich Repeat
  Pfam annotation: Domain name=LRR_1; Domain location=296-310; Score =7.4; E_value=12; Accession=PF00560.23; Description=Leucine Rich Repeat
  Pfam annotation: Domain name=LRR_1; Domain location=62-84; Score=6.0; E_value=22; Accession=PF00560.23; Description=Leucine Rich Repeat
  Pfam annotation: Domain name=LRR_1; Domain location=86-108; Score =12.3; E_value=1.4; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=110 -132::134-156::158-179::181-204::206-228::230-252::254-276::296 -310::62-84::86-108
MKKTFQLTIFSLVLSCILGEISAQKEEESLRTWMNSTVVEIKLHNSGLDGTLNRFDFSACSNLSNFNVSMNNLVGEIPAGIGNATKLKILYLSSNNFTFPIPPEMGNILQLQVLSLNNNSLLNQIPVQLSNLQNLWFLDLGANYLENPDPVQFKGMASITELNLTYNYLTEVPPFVSKCPKLVSLDLSLNTITGQIPIHLLTSLRNLTILDMTNNYFEGLILAEIKNLTNLKHMKLGKNKLNGTIPKEIGLLSNLEVLELNQNVFQGPIPSSIGNLHRLRRLDLHKSGLNSSIPTNLTYLDMSGNSLTGSLS

SEQ ID NO: 224562 - protein, 97 aa, Glycine max
  Coding DNA Sequence Number=SeqID_107784
  Gene Ontology: Mol. function=diaminohydroxyphosphoribosylaminopyrimidi ne deaminase activity; Biological process=riboflavin biosynthetic process
  Homolog annotation: Hit_ID=Q1S453; Match level="QueryCoverage=63%, HitCoverage=4%, E-value=2e-13, Identity=59%"; Hit description =CMP/dCMP deaminase, zinc-binding; Bacterial bifunctional deaminase- reductase, C-terminal
MVTVAVVELHVEICGGTAVEFVGGVDSLDLCGGDSRGVEVAFASDFVREGDNHPAEVGVGGGRLLLILLLWVIVFQTIKGRKFLNSDGGGVIFTLKL

SEQ ID NO: 224563 - protein, 391 aa, Glycine max
  Coding DNA Sequence Number=SeqID_107785
  Homolog annotation: Hit_ID=Q10S15; Match level="QueryCoverage=99%, HitCoverage=98%, E-value=8e-29, Identity=30%"; Hit description =Expressed protein
MGCFLHCFGSSKSTKPRRKAQHHHHRIARDRLEQPTACCSVQDYSETVVLSTASQEVQAKPLEQINVSPKKKVTFDVNVKTYEPEPDEVADYQLVRSEEGREESAFVEKLSQTKSYSEVSSVTSARSYPTNHRYHSCTCSDDEDGAMEYWDSDVTDEDEDDDDDGDSDMGEEYDEVEEDFEDGIVYSRSRNGANQVVVGEVESPIPMHDKDLKSIGLNSNVRDRSVYVNPLLNPVENLTQWKTVKAKRAPPLVSQKENLVLNQESRAAFGAETETPKKLNREIAVDASLSNWLGSSETTPVVSKGLYAGTPERSSSSSQGSNSVVSHEDRPILGALTVEELKHFSASSLPRKSPRDEMMPIIGSVGSYWNCGGYAEDSGSANRVRSRKGYI

SEQ ID NO: 224564 - protein, 91 aa, Glycine max
  Coding DNA Sequence Number=SeqID_107786
MVLMSGHINLIVHHKGRLERDDHGTLEYVDNEFYVWENCEVDLMTLWIVLDLCKSRGGYQRCVVFFWILTLTGMVVNQIEDGTEGIDTDLD

SEQ ID NO: 224565 - protein, 404 aa, Glycine max
  Coding DNA Sequence Number=SeqID_107787
  Gene Ontology: Mol. function=ubiquitin-protein ligase activity; Cellular component=ubiquitin ligase complex; Biological process =protein ubiquitination
  Homolog annotation: Hit_ID=Q3HLY8; Match level="QueryCoverage=98%, HitCoverage=97%, E-value=4e-80, Identity=41%"; Hit description=U-box protein
  Pfam annotation: Domain name=U-box; Domain location=5-82; Score=81.4; E_value=2.9e-21; Accession=PF04564.6; Description=U-box domain
MEEVEIPQYFVCPISFQIMEDPVTTVTGITYDRESIEQWLLKAKDCVCPVSKQPLPRSSQYLTPNHTLRRLIQAWCSANTANGVDRIPTPKTPLSMIQVQKLVKGLEAPCSYQTSLEKLHALATIERNRTCMAEASVAKAMIKLINKSFKEGNTNTTCIEKALRIVHVLWSNDQYSMKTLVGEDLDFINSLTWIVRLHLDENNIKMVNEAMPLLKLTIEVVDSTLLGNLSLEFFKEMVRVLRKKRLSQQAIKYALWVLTETSTLGRNRTRIVEAGAVTELIELELEKPEKNMTELIFNLLALLCSCADGREQFLRHAAGIAVLSKRVFRVSAATDDRAIHVFSVIAKFSASNEVVLEMLRVGAVSKLCMVMQADCASYLKEKARDILRLHSKVWNNSPCIQNVL

SEQ ID NO: 224566 - protein, 508 aa, Glycine max
  Coding DNA Sequence Number=SeqID_107788
  Gene Ontology: Mol. function=protein serine/threonine kinase activity; Cellular component=nucleus; Biological process=protein amino acid phosphorylation
  Homolog annotation: Hit_ID=Q10EQ9; Match level="QueryCoverage=69%, HitCoverage=48%, E-value=6e-81, Identity=46%"; Hit description =Protein kinase domain containing protein, expressed
  Pfam annotation: Domain name=Pkinase; Domain location=303-506; Score =110.4; E_value=5.3e-30; Accession=PF00069.15; Description=Protein kinase domain
  Pfam annotation: Domain name=Pkinase_Tyr; Domain location=307-508; Score=6.6; E_value=7.1e-13; Accession=PF07714.7; Description=Protein tyrosine kinase
  Pfam module annotation: Pfam domain module=Pkinase::Pkinase_Tyr; Domain location=303-506::307-508
  Subcellular localization annotation: CTP_CleavageSite=95; ConfidenceScore=5.35e-01
MSATNSKKLSSPSPTIHQRRLTRQRKLRYLTDKDAGLHSTSSLPASPLPSFKSASSSDHWSSSAVPQPLPRPDSPLTRRHDHHHLGSPPFEHPAFAFHRRSVDHDPVRSLRSASNLSRPSFDPATPNAKFDLRVNIPPARVLAGNTSSCKDHRELSHDNDSENVSNLRLHFAAKSAPNSIFSSPVTSPRRSSNVDFYDPSIIFPQDFNDILKVSPAKTAQSPDLSPLRSPGSHLNQEGSQLRKFSSRVWPENNHVDAHPHPHPLPLPPRASPQTTHSSPQQQPTMANLTTENSPSMKVTHTHSCSVCVRETGASCAMKEVDLFPDDPKSADCIKQLEQEIRILRQLHHPNIVQYYGSEIVGDRLYIYMEYVHPGSLHKFMHEHCGAMTESVVRNFTRHILSGLAYLHGTKTIHRDIKGANLLVDASGSVKLADFGVSKILTEKSYELSLKGSPYWMAPELMKAAIKKESSPDIAMAIDIWSLGCTIIEMLTGKPPWSEFEGVSTYLCM

SEQ ID NO: 224567 - protein, 189 aa, Glycine max
  Coding DNA Sequence Number=SeqID_107789
  Gene Ontology: Mol. function=transporter activity; Cellular component= membrane; Biological process=oligopeptide transport
  Homolog annotation: Hit_ID=Q10S13; Match level="QueryCoverage=97%, HitCoverage=30%, E-value=9e-71, Identity=69%"; Hit description=POT family protein, expressed
MAVVEEKGFASGREDYTQDGTVDLKGRPVLRSNTGRWRACSFIVGYEMIERMAYYAIASNLVQYLTKKLHEGTVKSSNNVTNWSGTVWIMPAAGAYIADAYLGRYWTFVIASAIYLLGMCLLTLAVSLPALRPPPCAPGIADKDCQRASSFQVGIFFFALYIIAAGTGGTKPNISTMGADQFDEFEPKE

SEQ ID NO: 224568 - protein, 227 aa, Glycine max
  Coding DNA Sequence Number=SeqID_107790
  Homolog annotation: Hit_ID=P04670; Match level="QueryCoverage=18%, HitCoverage=14%, E-value=3e-08, Identity=69%"; Hit description =Uricase-2 isozyme 1
MVLNFKNLHKNYVRDALLVKFEDDVYLPTDEPHGSIQASLSRLWYYLKGPVVFTDVTWFCEDCATKLGVPPALDQSTPISFKLKKKQKEGKTNSSLVAKTKGVLSSRHISPEPKHPQCSNRCEECEVKDDCGPKDVANFDVGEEESVARDLANSDEVVGVNIIWRYINVTDEAVQKGIFYPSIDCIRYVTTEVEAVVVHATIVEKQPKGHGDVGFKDLSRNQKYGKF

SEQ ID NO: 224569 - protein, 130 aa, Glycine max
  Coding DNA Sequence Number=SeqID_107791
  Homolog annotation: Hit_ID=Q10EQ9; Match level="QueryCoverage=36%, HitCoverage=6%, E-value=1e-12, Identity=68%"; Hit description =Protein kinase domain containing protein, expressed
MFKVLHKSPDIPESLSSEGQDFLQQCFKRNPAERPSAAVLLTHAFVQNLHEQDVQVHSQGQSCPRGDAGPGDDSRRHSPSNSSRNSRGVVSASFRARPQSPLKPSAHNHMTVTNPSNIPLSAVMKIIRNM

SEQ ID NO: 224570 - protein, 426 aa, Glycine max
  Coding DNA Sequence Number=SeqID_107792
  Gene Ontology: Mol. function=protein-tyrosine kinase activity; Cellular component=microtubule organizing center; Biological process= microtubule cytoskeleton organization and biogenesis
  Homolog annotation: Hit_ID=UPI00005DC1F3; Match level="QueryCoverage =91%, HitCoverage=59%, E-value=2e-67, Identity=46%"; Hit description =EMB1427; tubulin binding
MGGAGYNMGGVGRKCWGTIQIGPCAAQLIRVSSRADSVVRGVLRMLQGFSGPPFFWDKNANIFRAKSGVYVSHLSQKSLHSLLNQFIHAATCLQLVAITLNKVETAVPKSPPTLNAFVCLKGLRNIALKEETSTSNADCVTTPTLLGLANSLSSLCSGAEFLFGVVHEAIPAVYFEFGLSVPAAELTVHVLDYLHKKLDEVCLVQGGEEAYQMVLYMYVGSLLPYIEGLDSWLFEGILDDPFGEMSFFTDKEVSVDEAEFWEKSYLLRRLQHSKLDSEFFSSTNYVNDPVPASNDKEMDRRIPSLCLVQLKEKSRAFEIVQPAIFGGENAAFSDSEGMNYTFGFHFGESEYLRSQDDRKLLEMLFPFPTILPLFQDDLPVSELLPFQRNSSLISRVLHWMQNVDLRTTPLPLVIMQYCLTVYIQKQ

SEQ ID NO: 224571 - protein, 181 aa, Glycine max
  Coding DNA Sequence Number=SeqID_107793
MARTKKIAQMMYKAAKEITDKIDSLEEQASQGSFVSHGRQDILAATIRRPEHPFRVHPTRAGPITEKVTQQRMLSFSQMHSQFQSHMQSQGLTVPPEPEVGPSAACVSTKESCVDHSGKNSDTGDLEKYGLYVKENSPRLVALGRLYEWPTTVHNIPLRHDQVKVGIEEVRDVDAPIHVPT

SEQ ID NO: 224572 - protein, 1228 aa, Glycine max
  Coding DNA Sequence Number=SeqID_107794
  Gene Ontology: Mol. function=protein serine/threonine kinase activity; Cellular component=integral to membrane; Biological process=protein amino acid phosphorylation
  Homolog annotation: Hit_ID=Q337M0; Match level="QueryCoverage=97%, HitCoverage=98%, E-value=0.0, Identity=48%"; Hit description=Leucine Rich Repeat family protein, expressed
  Pfam annotation: Domain name=LRRNT_2; Domain location=29-72; Score =18.8; E_value=0.0095; Accession=PF08263.3; Description=Leucine rich repeat N-terminal domain
  Pfam annotation: Domain name=LRR_1; Domain location=102-124; Score =17.9; E_value=0.036; Accession=PF00560.23; Description=Leucine Rich Repeat
  Pfam annotation: Domain name=LRR_1; Domain location=126-148; Score =8.1; E_value=8.6; Accession=PF00560.23; Description=Leucine Rich Repeat
  Pfam annotation: Domain name=LRR_1; Domain location=150-172; Score =13.0; E_value=1.1; Accession=PF00560.23; Description=Leucine Rich Repeat
  Pfam annotation: Domain name=LRR_1; Domain location=174-197; Score =1.0; E_value=1.8e+02; Accession=PF00560.23; Description=Leucine Rich Repeat
  Pfam annotation: Domain name=LRR_1; Domain location=199-222; Score =2.9; E_value=82; Accession=PF00560.23; Description=Leucine Rich Repeat
  Pfam annotation: Domain name=LRR_1; Domain location=223-246; Score =6.0; E_value=22; Accession=PF00560.23; Description=Leucine Rich Repeat
  Pfam annotation: Domain name=LRR_1; Domain location=248-270; Score =11.6; E_value=1.9; Accession=PF00560.23; Description=Leucine Rich Repeat
  Pfam annotation: Domain name=LRR_1; Domain location=272-294; Score =10.7; E_value=2.8; Accession=PF00560.23; Description=Leucine Rich Repeat
  Pfam annotation: Domain name=LRR_1; Domain location=320-342; Score =5.6; E_value=26; Accession=PF00560.23; Description=Leucine Rich Repeat
  Pfam annotation: Domain name=LRR_1; Domain location=344-366; Score =17.7; E_value=0.042; Accession=PF00560.23; Description=Leucine Rich Repeat
  Pfam annotation: Domain name=LRR_1; Domain location=368-391; Score =5.5; E_value=26; Accession=PF00560.23; Description=Leucine Rich Repeat
  Pfam annotation: Domain name=LRR_1; Domain location=393-415; Score =9.5; E_value=4.7; Accession=PF00560.23; Description=Leucine Rich Repeat
  Pfam annotation: Domain name=LRR_1; Domain location=417-439; Score =14.1; E_value=0.51; Accession=PF00560.23; Description=Leucine Rich Repeat
  Pfam annotation: Domain name=LRR_1; Domain location=441-463; Score =15.2; E_value=0.23; Accession=PF00560.23; Description=Leucine Rich Repeat
  Pfam annotation: Domain name=LRR_1; Domain location=465-487; Score =10.2; E_value=3.6; Accession=PF00560.23; Description=Leucine Rich Repeat
  Pfam annotation: Domain name=LRR_1; Domain location=489-511; Score =5.4; E_value=28; Accession=PF00560.23; Description=Leucine Rich Repeat
  Pfam annotation: Domain name=LRR_1; Domain location=513-535; Score =2.6; E_value=92; Accession=PF00560.23; Description=Leucine Rich Repeat
  Pfam annotation: Domain name=LRR_1; Domain location=537-556; Score =12.4; E_value=1.4; Accession=PF00560.23; Description=Leucine Rich Repeat
  Pfam annotation: Domain name=LRR_1; Domain location=561-583; Score =11.0; E_value=2.5; Accession=PF00560.23; Description=Leucine Rich Repeat
  Pfam annotation: Domain name=LRR_1; Domain location=585-607; Score =12.9; E_value=1.1; Accession=PF00560.23; Description=Leucine Rich Repeat
  Pfam annotation: Domain name=LRR_1; Domain location=609-631; Score =6.5; E_value=17; Accession=PF00560.23; Description=Leucine Rich Repeat
  Pfam annotation: Domain name=LRR_1; Domain location=633-655; Score =14.8; E_value=0.32; Accession=PF00560.23; Description=Leucine Rich Repeat
  Pfam annotation: Domain name=LRR_1; Domain location=657-679; Score =16.9; E_value=0.076; Accession=PF00560.23; Description=Leucine Rich Repeat
  Pfam annotation: Domain name=LRR_1; Domain location=681-703; Score =6.1; E_value=21; Accession=PF00560.23; Description=Leucine Rich Repeat
  Pfam annotation: Domain name=LRR_1; Domain location=705-727; Score =17.8; E_value=0.039; Accession=PF00560.23; Description=Leucine Rich Repeat
  Pfam annotation: Domain name=LRR_1; Domain location=729-751; Score =18.0; E_value=0.035; Accession=PF00560.23; Description=Leucine Rich Repeat
  Pfam annotation: Domain name=LRR_1; Domain location=754-776; Score =0.5; E_value=2.3e+02; Accession=PF00560.23; Description=Leucine Rich Repeat
  Pfam annotation: Domain name=LRR_1; Domain location=77-100; Score =4.6; E_value=39; Accession=PF00560.23; Description=Leucine Rich Repeat
  Pfam annotation: Domain name=LRR_1; Domain location=778-800; Score =20.2; E_value=0.0074; Accession=PF00560.23; Description=Leucine Rich Repeat
  Pfam annotation: Domain name=LRR_1; Domain location=802-825; Score =12.2; E_value=1.5; Accession=PF00560.23; Description=Leucine Rich Repeat
  Pfam annotation: Domain name=Pkinase; Domain location=929-1179; Score= 111.8; E_value=2e-30; Accession=PF00069.15; Description=Protein kinase domain
  Pfam annotation: Domain name=Pkinase_Tyr; Domain location=936-1203; Score=101.6; E_value=2.3e-27; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::Pkinase::Pkinase_Tyr; Domain location=29-72::102 -124::126-148::150-172::174-197::199-222::223-246::248-270::272 -294::320-342::344-366::...
  Pfam module annotation: Domain location=368-391::393-415::417 -439::441-463::465-487::489-511::513-535::537-556::561-583::585 -607::609-631::633-655::657-679::681-703::705-727::729-751::754 -776::77-100::778-800::802-825::929-1179::936-1203
MTSFQKVHALLFHILFFIPLLPLKITSSQRTEAEALVKWKNSLSPPLPPSLNSSWSLSNLGTLCNWDAIVCDNTNTTVSQINLSDANLTGTLTTFDFASLPNLTQLNLNGNNFEGSIPSAIGKLSKLTLLDFGTNLFEGTLPYELGQLRELQYLSFYNNNLNGTIPYQLMNLPKVWHLDLGSNYFITPPDWSQYSGMPSLTHLALDLNVFTGGFPSFILECHNLTYLDISQNNWNGIIPESMYSNLAKLEYLNLTNSGLKGKLSPNLSKLSNLKELRIGNNMFNGSVPTEIGFVSGLQILELNNISAHGKIPSSLGQLRELWRLDLSINFFNSTIPSELGLCTNLTFLSLAGNNLSGPLPMSLANLAKISELGLSDNSFSGQFSAPLITNWTQIISLQFQNNKFTGNIPPQIGLLKKINYLYLYNNLFSGSIPVEIGNLKEMKELDLSQNRFSGPIPSTLWNLTNIQVMNLFFNEFSGTIPMDIENLTSLEIFDVNTNNLYGELPETIVQLPVLRYFSVFTNKFTGSIPRELGKNNPLTNLYLSNNSFSGELPPDLCSDGKLVILAVNNNSFSGPLPKSLRNCSSLTRVRLDNNQLTGNITDAFGVLPDLNFISLSRNKLVGELSREWGECVNLTRMDMENNKLSGKIPSELSKLNKLRYLSLHSNEFTGNIPSEIGNLGLLFMFNLSSNHFSGEIPKSYGRLAQLNFLDLSNNNFSGSIPRELGDCNRLLSLNLSHNNLSGEIPFELGNLFPLQIMLDLSSNSLSGAIPQGLEKLASLEVLNVSHNHLTGTIPQSLSDMISLQSIDFSYNNLSGSIPTGRVFQTATSEAYVGNSGLCGEVKGLTCSKVFSPDKSGGINEKVLLGVTIPVCVLFIGMIGVGILLCRWPPKKHLDEESKSIEKSDQPISMVWGKDGKFTFSDLVKATDDFNDKYCTGKGGFGSVYRAQLLTGQVVAVKRLNISDSDDIPAVNRQSFQNEIKLLTRLRHQNIIKLYGFCSRRGQMFFVYEHVDKGGLGEVLYGEEGKLELSWTARLKIVQGIAHAISYLHTDCSPPIVHRDITLNNILLDSDFEPRLADFGTAKLLSSNTSTWTSVAGSYGYVAPELAQTMRVTDKCDVYSFGVVVLEIFMGKHPGELLTTMSSNKYLTSMEEPQMLLKDVLDQRLPPPTGQLAEAVVLTVTIALACTRAAPESRPMMRAVAQELSATTQATLAEPFGTITISKLTGFQK

SEQ ID NO: 224573 - protein, 328 aa, Glycine max
  Coding DNA Sequence Number=SeqID_107795
  Gene Ontology: Mol. function=protein serine/threonine kinase activity; Cellular component=integral to membrane; Biological process=protein amino acid phosphorylation
  Homolog annotation: Hit_ID=Q337M0; Match level="QueryCoverage=97%, HitCoverage=26%, E-value=1e-110, Identity=60%"; Hit description =Leucine Rich Repeat family protein, expressed
  Pfam annotation: Domain name=Pkinase; Domain location=24-272; Score =58.2; E_value=2.7e-14; Accession=PF00069.15; Description=Protein kinase domain
  Pfam annotation: Domain name=Pkinase_Tyr; Domain location=24-298; Score=68.0; E_value=3e-17; Accession=PF07714.7; Description=Protein tyrosine kinase
  Pfam module annotation: Pfam domain module=Pkinase::Pkinase_Tyr; Domain location=24-272::24-298
SISMLWGRDGKFTFSDLVKATNGFNDMYCIGKGAFGSVYRAQVLTDQVVAVKRLNISDSDDIPAVNRQSFQNEIESLTEVRHHNIIKFYGFCSCRGQMFLVYEHVHRGSLGKVLYGEEGKSELSWATMLKIVQGIAHAISYLHSDCSPPIVHRDVTLNSILLDSDLEPRLAVSSTAKLLSSNTSTWTSVAGSYGYMTPELAQTKRVTDKCDVYSFGVVVLEIMMGKHPGELLFTMSSNKSLSSTEEPPVLLKDVLDQRLRPPTGNLAEAVVFTVTMAMAYTRAAPESRPMMRPVAQQLALATKQPCLTEPFGMITLPVSSDWKVRNPH

SEQ ID NO: 224574 - protein, 382 aa, Glycine max
  Coding DNA Sequence Number=SeqID_107796
  Gene Ontology: Mol. function=ubiquitin-protein ligase activity; Cellular component=ubiquitin ligase complex; Biological process =protein ubiquitination
  Homolog annotation: Hit_ID=Q2HVY1; Match level="QueryCoverage=99%, HitCoverage=100%, E-value=1e-134, Identity=64%"; Hit description=U box
  Pfam annotation: Domain name=U-box; Domain location=5-82; Score=86.6; E_value=7.4e-23; Accession=PF04564.6; Description=U-box domain
MDEIEVPTLFLCPISLQLMSDPVTVCTGITYDRENIERWLFSSCKKNKTCPVTRQSLPHTDLTPNHTLQRLIQAWCTNNNNAWFGIETIISSPKPTIDQTQIVKLLMEAKKFPEKQLKCLRRLQSIAFESESNKIYLESAGAIDFLASSVMSEAAIELLFHLNPSESHLKNLVNSEGIQFIESLFHVLKHGKCQSRAYATVLLKSSFEVAGPTQLSNVTSEMFVEMFRVLRDQISQEASKAALKLLVELCSWSRNRIKAVEGGGVLALIELLLDVLCGCAEGREELMNHGAGVAVVAKKILRVSHVASDRGVKILTSICRHSATPRVLSEMLLFGAVSKLCLVLQMEGSCNAKERARETLKLHSMVWRNSTCIPFSLLASYP

SEQ ID NO: 224575 - protein, 253 aa, Glycine max
  Coding DNA Sequence Number=SeqID_107797
  Gene Ontology: Mol. function=phosphatidylcholine-sterol O -acyltransferase activity; Cellular component=endoplasmic reticulum; Biological process=lipid metabolic process
  Homolog annotation: Hit_ID=Q8GZM5; Match level="QueryCoverage=87%, HitCoverage=35%, E-value=1e-125, Identity=95%"; Hit description =Lecithine cholesterol acyltransferase-like protein
  Pfam annotation: Domain name=LACT; Domain location=65-252; Score =40.5; E_value=6.5e-15; Accession=PF02450.6; Description =Lecithin:cholesterol acyltransferase
MAKKPLLCWLLLLAVLAEAGASDEDGAELDYSKLSGIIIPGFASTQLRAWSILDCPYSPLDFNPLDLVWLDTTKLLSAVNCWLKCMVLDPYNQTDHPDCKSRPDSGLSGITELDPGYITGPLSSVWKEWIKWCIEFGIEANAIIAVPYDWRLSPSKLEERDLYFHKLKITFETAYKLRGGPSLVFAHSLGNHVFRYFLEWLKLEIAPKHYIQWLDQHIRAYFAVGAPLLGAMETIEATLSGFTFGLPISEVTF

SEQ ID NO: 224576 - protein, 883 aa, Glycine max
  Coding DNA Sequence Number=SeqID_107798
  Gene Ontology: Mol. function=zinc ion binding; Cellular component =intracellular
  Homolog annotation: Hit_ID=Q7XDK0; Match level="QueryCoverage=25%, HitCoverage=80%, E-value=2e-39, Identity=30%"; Hit description =Leucine Rich Repeat family protein
  Pfam annotation: Domain name=BRCT; Domain location=430-512; Score =50.6; E_value=5.4e-12; Accession=PF00533.16; Description=BRCA1 C Terminus (BRCT) domain
  Pfam annotation: Domain name=BRCT; Domain location=546-650; Score =31.4; E_value=3.2e-06; Accession=PF00533.16; Description=BRCA1 C Terminus (BRCT) domain
  Pfam annotation: Domain name=LRR_1; Domain location=699-721; Score =2.6; E_value=93; Accession=PF00560.23; Description=Leucine Rich Repeat
  Pfam annotation: Domain name=LRR_1; Domain location=723-745; Score =2.1; E_value=1.1e+02; Accession=PF00560.23; Description=Leucine Rich Repeat
  Pfam annotation: Domain name=LRR_1; Domain location=747-769; Score =0.3; E_value=2.5e+02; Accession=PF00560.23; Description=Leucine Rich Repeat
  Pfam annotation: Domain name=LRR_1; Domain location=771-793; Score =4.9; E_value=35; Accession=PF00560.23; Description=Leucine Rich Repeat
  Pfam annotation: Domain name=LRR_1; Domain location=796-814; Score =1.2; E_value=1.7e+02; Accession=PF00560.23; Description=Leucine Rich Repeat
  Pfam annotation: Domain name=LRR_1; Domain location=819-841; Score =11.0; E_value=2.5; Accession=PF00560.23; Description=Leucine Rich Repeat
  Pfam annotation: Domain name=LRR_1; Domain location=843-865; Score =9.5; E_value=4.9; Accession=PF00560.23; Description=Leucine Rich Repeat
  Pfam module annotation: Pfam domain module=BRCT::BRCT::LRR_1::LRR _1::LRR_1::LRR_1::LRR_1::LRR_1::LRR_1; Domain location=430-512::546 -650::699-721::723-745::747-769::771-793::796-814::819-841::843-865
MDDSGSKTKLLNPWMLHFQKLALELKCPLCSCLADCITAGSECAVCKTTYAQTDVRHIPFVENVVAIYRSLDATFCASLFQSRSSGGGRVLEPCQTILNSTSSSLKTGKLPRNLTNLNEVGVGQTFKSKSVVHDKAEELELSCGRGKPNPMQSSQMGLGGREQCGVMEMDVNQVTQSAPDSPPFCDTKGSDNDCSDQDSEHPLPPGRLENSSLNRASAGNGNLKERMGQLRSESSVSETEGLARDLKRQKNLDFKPGKDPGAPLPTNASIDLCPIGRICSFCQSSKISEVTGPMLHYANGNLVTGDAAMKPNVVPVHRICIDWAPQVYFDGEVVKNLKAEVARGAKLKCSKCNLKGAALGCYVKSCRRTYHVPCAMDISDCRWDHEDFLLLCPVHSNVKFPCEKIRSKKQATQKHPTLSHLPSHHSNPLEASHDDDVKLVFCGSALSNEEKVLLINYASKVGATVTKFWTSNVTHVIAATDAHGACSRTLKVLMAILNGRWVLKMDWIKACMEEVNPVEEEPYEINLDNQGCQGGPKAGRLRALANEPKLFNGLKFYFSGDYVSTYKEDLEELIEVGGGTVLRSKEELESQRHECKGDSSQLLIVYNLDPPQGCKLGEEVSILWQRLNDAEDLAANTLQVIGHTWILESIAAFPTEIGLISGLQILEWNNIAANGKIPSSLGQLKELWSLDLRNWKPDGNQELDLSQNRFSVPIPPTLWNLTNIQVTNLFFNEFSGTISTDIENLTSPEIFDVNTNNLYGELPETILQLNALRNFSVFTNNFTGSIPREFGKSNPSLTHVYLSNSFSGELHPDLCSDGKLVILAVNNNSFSGPLPKSLRNCSSLFRVWLDDNQLTGNIADAFGVLPAAEISWLVSPPGSGVNV

SEQ ID NO: 224577 - protein, 46 aa, Glycine max
  Coding DNA Sequence Number=SeqID_107799
METSIHSPLTFRNLNRATGGRALESIRNATIDNRERFSDYIELMSQ

SEQ ID NO: 224578 - protein, 771 aa, Glycine max
  Coding DNA Sequence Number=SeqID_107800
  Gene Ontology: Mol. function=binding; Cellular component=membrane; Biological process=photosynthesis
  Homolog annotation: Hit_ID=Q337L2; Match level="QueryCoverage=94%, HitCoverage=97%, E-value=1e-174, Identity=47%"; Hit description=TPR Domain containing protein, expressed
  Pfam annotation: Domain name=TPR_1; Domain location=183-216; Score =1.4; E_value=3.7; Accession=PF00515.18; Description=Tetratricopeptide repeat
  Pfam annotation: Domain name=TPR_1; Domain location=662-695; Score =18.5; E_value=0.024; Accession=PF00515.18; Description =Tetratricopeptide repeat
  Pfam annotation: Domain name=TPR_1; Domain location=732-765; Score =12.4; E_value=0.18; Accession=PF00515.18; Description=Tetratricopepti de repeat
  Pfam annotation: Domain name=TPR_2; Domain location=116-149; Score =0.5; E_value=29; Accession=PF07719.7; Description=Tetratricopeptide repeat
  Pfam annotation: Domain name=TPR_2; Domain location=183-216; Score =6.9; E_value=5.2; Accession=PF07719.7; Description=Tetratricopeptide repeat
  Pfam annotation: Domain name=TPR_2; Domain location=368-401; Score =9.5; E_value=2.6; Accession=PF07719.7; Description=Tetratricopeptide repeat
  Pfam annotation: Domain name=TPR_2; Domain location=525-558; Score =6.8; E_value=5.4; Accession=PF07719.7; Description=Tetratricopeptide repeat
  Pfam annotation: Domain name=TPR_2; Domain location=561-594; Score =5.9; E_value=6.8; Accession=PF07719.7; Description=Tetratricopeptide repeat
  Pfam annotation: Domain name=TPR_2; Domain location=662-695; Score =24.7; E_value=0.00034; Accession=PF07719.7; Description =Tetratricopeptide repeat
  Pfam annotation: Domain name=TPR_2; Domain location=732-765; Score =16.0; E_value=0.14; Accession=PF07719.7; Description=Tetratricopeptid e repeat
  Pfam module annotation: Pfam domain module=TPR_1::TPR_1::TPR_1::TPR _2::TPR_2::TPR_2::TPR_2::TPR_2::TPR_2::TPR_2; Domain location=183 -216::662-695::732-765::116-149::183-216::368-401::525-558::561 -594::662-695::732-765
MAKINEQQLMMSLYFYQLSNKCCCGGGIMGSRAKQGRRLQKMMKCMCLREPLKKGGEDETVPSSDSLAITEFYSSTASGRSGLDGEIEKMGSGSGNMDEAELSLRESGIMDIMDNEEARALLGKDEYQEGNIEAALRIYERINISAVTSKMKISLAKSREHHKKHSHYYATPPMSIYTVGLLLEAIFLKAKCLQVLGRFKESAQTCKVILDIVESSLPEGLPQNFGHEGKLQETLGKVVELLPELWKLADSPRDVILSYRRALLHQWNLDAKTIAKIQKEFVVFLLYSGGEAIPSNLRSHMDSSFVPRNNLEEAILLLMILLRKISLNKIEWDPSILDHLSFALSVSGDLTTLAHQWEELLPGTINRRERYHALSLCYYGAGNDLVALNLLRKLLSSREDPKHVPSLLMASKICSENPDLAKDGASLARKVLENLDGRCDRLESLSSCLLGVSLSAHSKIDISNSERVEKQSEALHSLETASKVTKMSNPLVIYYLSLECAEQRKLDAALHYAKCFLNLEVGSNIKGWLLLARILSAQKQFLDAESIVNEALNQTGIWDQGELLRTKAKLQIAQGQLKSAIETYTQLLAILLVQRKTFGSKKKLYKDYIDHARSMEVEIWHDLAFVYISLSRWHDAESKLCNKLDAVRCQEITELGCEAKHALLNKCVGTMHEAKGLYKEALKAFRDALNIDPGHVPSLISAAVVLRWCSNRSNPAIRSFLMDALRHDRFNASAWYNLGIFHKDEGTILEAAECFETANSLEESAPVEPFR

SEQ ID NO: 224579 - protein, 141 aa, Glycine max
  Coding DNA Sequence Number=SeqID_107801
  Gene Ontology: Mol. function=phosphatidylcholine-sterol O -acyltransferase activity; Biological process=lipid metabolic process
  Homolog annotation: Hit_ID=Q8GZM5; Match level="QueryCoverage=90%, HitCoverage=20%, E-value=3e-65, Identity=88%"; Hit description =Lecithine cholesterol acyltransferase-like protein
MVGYYYAPSGKPYPDNWIITDVVYEFEGSLISRSGNQVEGNPGAISGDETVPYLSLSWCKNWLGPKVNITKAPQSEHDGSDVQIKLNVKHPHEEDIVPNMTRSPRVKYITYYEDSESLPGKRTAVWELDKGAWLVLGVVMD

SEQ ID NO: 224580 - protein, 119 aa, Glycine max
  Coding DNA Sequence Number=SeqID_107802
  Gene Ontology: Mol. function=phosphatidylcholine-sterol O -acyltransferase activity; Biological process=lipid metabolic process
  Homolog annotation: Hit_ID=Q8GZM5; Match level="QueryCoverage=89%, HitCoverage=16%, E-value=2e-52, Identity=86%"; Hit description =Lecithine cholesterol acyltransferase-like protein
MPFSKYCRTDNKYWKHFSGGSHVGPQTYHCDEQEFKTNLSGWPTKIINIEIPSTRAFDAYPSFSEIPEANLSSMECGLPTQLSFSAREISDGTFFKAIEDYDPDSKRLLYLLEKLVLSH

SEQ ID NO: 224581 - protein, 709 aa, Glycine max
  Coding DNA Sequence Number=SeqID_107803
  Homolog annotation: Hit_ID=Q9M8U1; Match level="QueryCoverage=17%, HitCoverage=92%, E-value=1e-19, Identity=47%"; Hit description =Calmodulin-like protein 18
MPRIRNERVEQGRDIAIPEKQGFAPAVKRRRKEEQKNEQKAEGGEIGRGANCRIAGNLSLIRSKQGREPDAVGAEFASAIAGSEAESGSVKGWIPTIIGWWPEFVTLVAPELLPAKSPYTEEQLRHLFRMFDRDGSGLVTAADTNGDDMINFKEFAQTITSAAFHNSWPYLSLSREVQDRRLSIIDVSSADDSLLDGNPLSHQHSENQEHSDMLCTPNSKKFEDAATKLQQWEHDPHSNDSSGNGKPKKNSKCNLRKSLAWDSAFFTSAGVLDPEELTCIIEGVEKDEKHELPAIQEDVYKSCESISTLASDSLTFESVDMEGDLFEDVRASIQKSSKKSCPAASNTKVPSSPAVPLFQTHDSSKKVGMVSRKKEICYEKWRCAFPMRNGEDFYCSTVVPPASKNPIAGMQGFGKMTKKNNPIFPQIPQPVATRRESSILKQSKAPVRSSLSSTLPSKRDSLGNLHVKSERDKAKQTVGDRVSSVAKASVLGGSRGSVPKPTLPSKSPVGPTVSTRTRSVTSTSSGNNLSDNIGKSSFSYLKRSYKPTSCCSVVKTPSRIASRNKAEPEISSLSSLMSATKLSSSISPASSISDWSSSESSSTTSMAKRVCNSSRSSIDSGSSRKVLLNTDTDQGTHPQTPLSDSSLLERQEAWHSGIISQKERTAPGAAVLPPASKKASGLRLPSPKIGFFDGVSFALFIFDVASNRV

SEQ ID NO: 224582 - protein, 42 aa, Glycine max
  Coding DNA Sequence Number=SeqID_107804
MIPEYFRKSSSYISHNLRIRRWGAKLELFKPEISAIKLKNKS

SEQ ID NO: 224583 - protein, 451 aa, Glycine max
  Coding DNA Sequence Number=SeqID_107805
  Gene Ontology: Mol. function=transferase activity, transferring glycosyl groups; Biological process=biosynthetic process
  Homolog annotation: Hit_ID=Q9LPN6; Match level="QueryCoverage=82%, HitCoverage=76%, E-value=1e-157, Identity=70%"; Hit description =Mannosyltransferase, putative
  Pfam annotation: Domain name=Glycos_transf_1; Domain location=230 -427; Score=11.1; E_value=0.0003; Accession=PF00534.10; Description =Glycosyl transferases group 1
MGERYSEFNGNQVNLQWWSFVFSASEGMYEAFLGVCFAVLLKAGHEAGEVFAGGGTVWLRRLGGGGYSSEGWSYVLALHGHRKMQSFRLAIEHHGDLESLEFWEGLPHDMKNLASELYQNQCRMNETIVICHSEPGAWYPPLFETFPCPPSSYHDFKSVIGRTMFETDRVNDEHVERCNRMDYVWVPTEFHKSTFVQSGVHPSKVVKIVQPVDVEFFDPVRYKPLDLASRAKLVLGSGVRKSFVFLSVFKWEYRKGWDVLLKSYLKEFSQDDRVALYLLTNPYHTDRDFGNKILDFVESSDMVEPVSGWASVYVIDTHIASREFPRVYRAADAFVLPSRGEGWGRPLVEAMSMALPVIATNWSGPTEFLTEDNSYPLPVDRMSEVIEGPFKGHLWAEPSEDKLRVFMRQVMDNLTEATAKGRKARDDMIRRFSPEIVADIVADHIQNILAQ

SEQ ID NO: 224584 - protein, 357 aa, Glycine max
  Coding DNA Sequence Number=SeqID_107806
  Gene Ontology: Mol. function=receptor activity; Cellular component =integral to membrane; Biological process=protein amino acid phosphorylation
  Homolog annotation: Hit_ID=Q9SSM0; Match level="QueryCoverage=99%, HitCoverage=87%, E-value=2e-96, Identity=40%"; Hit description =Highly similar to receptor-like protein kinase
  Pfam annotation: Domain name=LRR_1; Domain location=1-23; Score=14.1; E_value=0.5; Accession=PF00560.23; Description=Leucine Rich Repeat
  Pfam annotation: Domain name=LRR_1; Domain location=121-143; Score =8.7; E_value=6.7; Accession=PF00560.23; Description=Leucine Rich Repeat
  Pfam annotation: Domain name=LRR_1; Domain location=145-167; Score =15.9; E_value=0.15; Accession=PF00560.23; Description=Leucine Rich Repeat
  Pfam annotation: Domain name=LRR_1; Domain location=169-191; Score =10.2; E_value=3.6; Accession=PF00560.23; Description=Leucine Rich Repeat
  Pfam annotation: Domain name=LRR_1; Domain location=193-215; Score =9.0; E_value=5.8; Accession=PF00560.23; Description=Leucine Rich Repeat
  Pfam annotation: Domain name=LRR_1; Domain location=217-239; Score =19.3; E_value=0.014; Accession=PF00560.23; Description=Leucine Rich Repeat
  Pfam annotation: Domain name=LRR_1; Domain location=241-263; Score =9.8; E_value=4.1; Accession=PF00560.23; Description=Leucine Rich Repeat
  Pfam annotation: Domain name=LRR_1; Domain location=25-47; Score=8.0; E_value=9.1; Accession=PF00560.23; Description=Leucine Rich Repeat
  Pfam annotation: Domain name=LRR_1; Domain location=265-287; Score =6.6; E_value=17; Accession=PF00560.23; Description=Leucine Rich Repeat
  Pfam annotation: Domain name=LRR_1; Domain location=289-308; Score =7.8; E_value=10; Accession=PF00560.23; Description=Leucine Rich Repeat
  Pfam annotation: Domain name=LRR_1; Domain location=313-332; Score =11.3; E_value=2.2; Accession=PF00560.23; Description=Leucine Rich Repeat
  Pfam annotation: Domain name=LRR_1; Domain location=337-356; Score =7.3; E_value=12; Accession=PF00560.23; Description=Leucine Rich Repeat
  Pfam annotation: Domain name=LRR_1; Domain location=49-71; Score =16.1; E_value=0.13; Accession=PF00560.23; Description=Leucine Rich Repeat
  Pfam annotation: Domain name=LRR_1; Domain location=73-95; Score =18.5; E_value=0.025; Accession=PF00560.23; Description=Leucine Rich Repeat
  Pfam annotation: Domain name=LRR_1; Domain location=97-119; Score =18.2; E_value=0.029; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1; Domain location=1-23::121-143::145-167::169 -191::193-215::217-239::...
  Pfam module annotation: Domain location=241-263::25-47::265-287::289 -308::313-332::337-356::49-71::73-95::97-119
MLEYLNLSVNNFSGGIPESFKSLQNLKHIYLLSNHLNGEIPESLFEISHLEEVDLSRNSLTGSIPLSVGNITKLVTLDLSYNQLSGTIPISIGNCSNLENLYLERNQLEGVIPESLNNLKNLQELYLNYNNLGGTVQLGSGYCKKLSILSISYNNFSGGIPSSLGNCSGLIEFYASGNNLVGTIPSTFGLLPNLSMLFIPENLLSGKIPPQIGNCKSLKELSLNSNQLEGEIPSELGNLSKLRDLRLFENHLTGEIPLGIWKIQSLEQIHMYINNLSGELPLEMTELKHLKNVSLFNNQFSGVIPQSLGINSSLVVLDFMYNNFTGTLPPNLCFGKHLVRLNMGGNQFIGSIPPDVG

SEQ ID NO: 224585 - protein, 91 aa, Glycine max
  Coding DNA Sequence Number=SeqID_107807
  Gene Ontology: Mol. function=hydrolase activity
  Homolog annotation: Hit_ID=Q1T2K5; Match level="QueryCoverage=88%, HitCoverage=20%, E-value=1e-22, Identity=59%"; Hit description =Alpha/beta hydrolase fold
MKRLQSISINPNHDRLTEVVKVRMHPPSASRVLLPDGRYMAYPDQGIPGVKTSLLDEYGVAWSHMIFLGLGRVILIPTGISTRQRWILGLH

SEQ ID NO: 224586 - protein, 66 aa, Glycine max
  Coding DNA Sequence Number=SeqID_107808
MQKQHITRKKNIEAARDTDTPYRKELEGATTSLQEEQRKVVSCFAHEIREEEVEAENEESILLFFI

SEQ ID NO: 224587 - protein, 123 aa, Glycine max
  Coding DNA Sequence Number=SeqID_107809
  Gene Ontology: Mol. function=ATP-dependent helicase activity; Cellular component=nucleus; Biological process=rRNA processing
  Homolog annotation: Hit_ID=Q1T2K0; Match level="QueryCoverage=99%, HitCoverage=19%, E-value=4e-45, Identity=74%"; Hit description =Helicase, C-terminal; Type III restriction enzyme, res subunit
  Pfam annotation: Domain name=Helicase_C; Domain location=1-64; Score =44.4; E_value=4e-10; Accession=PF00271.21; Description=Helicase conserved C-terminal domain
RENAVDNFRAGKTWVLIATDVVARGMDFKGVNCVINYDFPDSAAAYVHRIENVDFSLGRSGRAGRTGEAITFYTEDDIPFLRNVANLMAASGCEVPSYLMKLRKKKWKKHRPKRDSISTKPDL

SEQ ID NO: 224588 - protein, 763 aa, Glycine max
  Coding DNA Sequence Number=SeqID_107810
  Gene Ontology: Mol. function=binding; Cellular component =intracellular; Biological process=metabolic process
  Homolog annotation: Hit_ID=Q1T2K1; Match level="QueryCoverage=98%, HitCoverage=95%, E-value=0.0, Identity=76%"; Hit description =Tetratricopeptide-like helical
  Pfam annotation: Domain name=PPR; Domain location=132-166; Score =40.2; E_value=7.1e-09; Accession=PF01535.11; Description=PPR repeat
  Pfam annotation: Domain name=PPR; Domain location=167-201; Score=8.9; E_value=0.65; Accession=PF01535.11; Description=PPR repeat
  Pfam annotation: Domain name=PPR; Domain location=233-267; Score =21.6; E_value=0.0028; Accession=PF01535.11; Description=PPR repeat
  Pfam annotation: Domain name=PPR; Domain location=335-369; Score =34.7; E_value=3.1e-07; Accession=PF01535.11; Description=PPR repeat
  Pfam annotation: Domain name=PPR; Domain location=437-471; Score =32.3; E_value=1.7e-06; Accession=PF01535.11; Description=PPR repeat
  Pfam annotation: Domain name=PPR; Domain location=538-572; Score =44.8; E_value=2.8e-10; Accession=PF01535.11; Description=PPR repeat
  Pfam annotation: Domain name=PPR; Domain location=573-607; Score=9.9; E_value=0.51; Accession=PF01535.11; Description=PPR repeat
  Pfam annotation: Domain name=PPR; Domain location=66-100; Score=13.4; E_value=0.19; Accession=PF01535.11; Description=PPR repeat
  Pfam annotation: Domain name=PPR; Domain location=675-709; Score=0.2; E_value=7.2; Accession=PF01535.11; Description=PPR repeat
  Pfam module annotation: Pfam domain module=PPR::PPR::PPR::PPR::PPR::PP R::PPR::PPR::PPR; Domain location=132-166::167-201::233-267::335 -369::437-471::538-572::573-607::66-100::675-709
MTIQSQIRCIYNCVRPILPTRIVSCLSRELSTNSYINLMCKQRHYREALDTFNFHPKNSSIQLESSTYGNLILACTSIRSLKYGKKIHDHILKSNCQPDLVLQNHILNMYGKCGSLKDARKAFDTMQLRNVVSWTIMISGYSQNGQENDAIIMYIQMLQSGYFPDPLTFGSIIKACCIAGDIDLGRQLHGHVIKSGYDHHLIAQNALISMYTRFGQIVHASDVFTMISTKDLISWASMITGFTQLGYEIEALYLFRDMFRQGFYQPNEFIFGSVFSACRSLLEPEFGRQIHGMCAKFGLGRNVFAGCSLCDMYAKFGFLPSAIRAFYQIESPDLVSWNAIIAAFSDSGDVNEAIYFFCQMMHTGLMPDGITFLSLLCACGSPVTINQGTQIHSYIIKIGLDKEAAVCNSLLTMYTKCSNLHDAFNVFKDVSENANLVSWNAILSACLQHKQAGEVFRLFKLMLFSENKPDNITITTILGTCAELASLEVGNQVHCFSVKSGLVVDVSVSNRLIDMYAKCGSLKHARDVFGSTQNPDIVSWSSLIVGYAQFGLGHEALNLFRMMKNLGVQPNEVTYLGVLSACSHIGLVEEGWHFYNTMEIELGIPPTREHVSCMVDLLARAGCLYEAENFIKKMGFNPDITMWKTLLASCKTHGNVDIAERAAENILKLDPSNSAALVLLSNIHASVGNWKEVARLRNLMKQMGVQKVPGQSWIAVKDQIHVFFSEDNSHQQRGDIYTMLEDLWLQMLDDGYDPCQRLDISIW

SEQ ID NO: 224589 - protein, 620 aa, Glycine max
  Coding DNA Sequence Number=SeqID_107811
  Gene Ontology: Mol. function=triacylglycerol lipase activity; Biological process=lipid metabolic process
  Homolog annotation: Hit_ID=Q56R03; Match level="QueryCoverage=98%, HitCoverage=98%, E-value=1e-161, Identity=49%"; Hit description=EDS1
  Pfam annotation: Domain name=Lipase_3; Domain location=42-196; Score =69.5; E_value=1.1e-17; Accession=PF01764.16; Description=Lipase (class 3)
MTQVMRGEVIEKAYAGSWKAHKSPDKPYLIEKINRNDPQEVIFCFPGSGAVRDWYSQKNFGETKIDLGLFPSLRSIGIDEQALVNEAFQKKFQEILSAKPSLADEVEKAMSKKKQIVFAGHSSGGAVAILATLWALENYQPPKSHGGIPPLCVTFGSPLVGNHIFSHATRRENWSHYFFHYVMRYDIVPRILLAPLSSLDPKFEPISQSFNPKSKSFMSDSVGRASAETTSEFYFAIISNAATVTSHAASKLMGTTDTTLETWSNFITLSPYRPFGTYYFCTGNGKSGKKIVITNSNAVLQVLFFSAQLSTEAEAAQVPYRSLRDHTIYGTELQQMGPQNVVHLDQHQLQNLPLSEDGAGGSNATINTALNDLGLIPRARLCLRAAAEWEARRTDNENKIKEKKDFVAKKLDVLREYRKMYKDKRVGFYDGFREHKQGEDDFKANVTRLELAGVWDEMMEKVRSYELPDEFEGNKDYIDLGTELRKLMEPLDIANYYRHGRNYEDSSSSYMIKGRPKRYRYPQRWLEHAERKSHESLSASCFWAEVEELHYKTSRSSNIVSLDQQFKERIEKLEIQIKAWSDRKELDEDVFLEGSTLVKWWKALPQQHKQHSCIKTLIRE

SEQ ID NO: 224590 - protein, 712 aa, Glycine max
  Coding DNA Sequence Number=SeqID_107812
  Gene Ontology: Mol. function=actin filament binding; Cellular component=intercellular junction; Biological process=actin cytoskeleton organization and biogenesis
  Homolog annotation: Hit_ID=UPI0000162EB3; Match level="QueryCoverage =67%, HitCoverage=58%, E-value=5e-81, Identity=37%"; Hit description =actin binding
  Pfam annotation: Domain name=Extensin_2; Domain location=140-421; Score=-142.0; E_value=0.095; Accession=PF04554.4; Description =Extensin-like region
  Pfam annotation: Domain name=FH2; Domain location=245-658; Score =391.1; E_value=1.7e-114; Accession=PF02181.13; Description=Formin Homology 2 Domain
  Pfam module annotation: Pfam domain module=Extensin_2::FH2; Domain location=140-421::245-658
MSAPSHAIVKAVAATAGAMLLIAAIFVYFFYKFVLARYHQRHKVGASLLRESGVNLEYINKVGGNVKGLIVEENGVDVLYVMDTERRPLITGFPNSIFNPSYELDEEEKRIDIMVQRSKVSKPEIPEACESPSVVGHENQVKPVSQASSISTSLTPRQNLPQSPQPLPQSSPMIDENKKTQPSPPPPPPPPPPPPPPTRPPPPPPGPPPLPKASGFISSLKPPPAPKGKTNIRSTKEGMVGESSREKGVGQTRLKPLHWDKVAANVDHSTVWDQINDGSFRFDDELMESLFGYSSSYKTQERNRTLSTLAKSNSNAPAQIFILEPRKSQNTAIVLRSLAISRKGILDAVLDGQGLSVETLERLTKIAPTQEEEAKIIQFSGNPDQLADAESFLYFILKAVPTAFNRLKAMLFRSSYNCEVLQLKEQLQALEMGCKELRTSGLFLKLLEAILKAGNRMNAGTSRGNAQGFNLSSLRKLSDVKSTDGKTSLLHFIVEQVVQSEGKRQAIYQKHKLHISNGETSNVNNRPYSYSLIQQEADKEHVLLGLQVLGGLSEELSEAKKAASLEYHNFITMCSTLNAHVSEIRQIITCCGNIRSGGFINEMKGFLEECEGELDVVKEEQTRIMELVKKTNEYYLAGASKDNMSFVDMVDKACIELKKKVEKKNIVGGEAVSTTPPLSPSKRTPLRFPNFDLYFLSNVSETTSSSQSEDDF

SEQ ID NO: 224591 - protein, 86 aa, Glycine max
  Coding DNA Sequence Number=SeqID_107813
  Homolog annotation: Hit_ID=O48719; Match level="QueryCoverage=44%, HitCoverage=26%, E-value=4e-07, Identity=57%"; Hit description =Expressed protein
MPMYQQQEQPPPMISVTQQSSHESIGPLIGVLVVVIVLGVIAVMIGRLCSGRRIMGHGQYDVESWAERKCSSCIDGRINLSLPTRV

SEQ ID NO: 224592 - protein, 228 aa, Glycine max
  Coding DNA Sequence Number=SeqID_107814
  Gene Ontology: Mol. function=protein-tyrosine kinase activity; Cellular component=microtubule organizing center; Biological process= microtubule cytoskeleton organization and biogenesis
  Homolog annotation: Hit_ID=UPI00005DC1F3; Match level="QueryCoverage =94%, HitCoverage=22%, E-value=1e-73, Identity=65%"; Hit description =EMB1427; tubulin binding
MESIRNSADCMLLSAPDSLVVSITKNHVDSDEEASTAGVVLSTPPQSHVNSFGINGLDMLKFTYRVPWPLELIANTEAIKKYNQVMRFLLKVKRAKFVLDKVRRWKWKGKGSATNNRKHHWEPEHFYLLLQFLWRELCEGMTAAKSLDEVIEVHEAYILSIQRQCFVVPDKLGALIASRINSILGIALDFYNIQQTLGSGGAVSAIKARCEMEVDRIDNSLMIALLSY

SEQ ID NO: 224593 - protein, 81 aa, Glycine max
  Coding DNA Sequence Number=SeqID_107815
MALGKNSTMQGEPNPTMIFNTKRCKEDRVTKNKVAEKYLGTVARCHGGDKVVERGRVAKKKLRWRRRESKKNRTRVNIGFQ

SEQ ID NO: 224594 - protein, 50 aa, Glycine max
  Coding DNA Sequence Number=SeqID_107816
MLLDITRLCNRIRFPREGGMAPSRLLPPGLNRSPPNHHSTFIGLNQSESI

SEQ ID NO: 224595 - protein, 72 aa, Glycine max
  Coding DNA Sequence Number=SeqID_107817
MSSDDNNYNHKQGQGQLQITLFRGGAVRDEACLSWWPRATTPYSSTSEGGLHGVIRVIRPCYSAISCQKQGL

SEQ ID NO: 224596 - protein, 120 aa, Glycine max
  Coding DNA Sequence Number=SeqID_107818
  Homolog annotation: Hit_ID=Q2QP91; Match level="QueryCoverage=63%, HitCoverage=12%, E-value=4e-17, Identity=57%"; Hit description=Dor1 -like family protein, expressed
MESTTVSSSELETMLPLPLASESQQPCVSELLSFTLDCLHKEPELLCVDADCIHHQMQEVAVGNYRSFIAAADALIAIHQEVSSIDNHLESLVLLVAEQRIRTNKWCLPWGIDQDQERLE

SEQ ID NO: 224597 - protein, 283 aa, Glycine max
  Coding DNA Sequence Number=SeqID_107819
  Homolog annotation: Hit_ID=Q1RYY9; Match level="QueryCoverage=99%, HitCoverage=100%, E-value=7e-63, Identity=44%"; Hit description =Immunoglobulin/major histocompatibility complex
MAPISTEELYQFHKTHREVFCFLVFKLHRDLAKSLLVMALWIWLEYNGYPQITHEVMDVPYTFVNGLVDEAVSCLECLEEENFVVPNNGGLPLTTRLTKSGISMKIFKQKRYTIIAGIKSVLKNICTRIFSDLVQIALRININRAGTSQGNISHITIPSFPHPLFGTFDMTPMDTVSLDLFDERIWTKGPCDDVTPDDKSMFVTFSRGFPVSRDEVIKLFTYAYGNCLEDLSMGNPDENKQSLFAMVVLKTVETVDQILNGKRVAKLRINGKHIWVRKYERRD

SEQ ID NO: 224598 - protein, 68 aa, Glycine max
  Coding DNA Sequence Number=SeqID_107820
MLFPSVFALSEGTTLNAPYGALSVEMAKEQVPNHCISILCTYNGLNKYLGGHEMPMEILMLYLLRLTF

SEQ ID NO: 224599 - protein, 191 aa, Glycine max
  Coding DNA Sequence Number=SeqID_107821
  Gene Ontology: Mol. function=RNA-directed DNA polymerase activity; Biological process=RNA-dependent DNA replication
  Homolog annotation: Hit_ID=Q1SFJ7; Match level="QueryCoverage=60%, HitCoverage=13%, E-value=3e-20, Identity=43%"; Hit description=RNA -directed DNA polymerase
MSTREGMGYIGFRGSINNESNPLVILNIYSSCTLEVFGDVKNKQGCVVKEIRDLDSKDEKKEPVRVKEEVKMFFEAKFKEQEGSAISLDGVPFASIDHNNNYLLVAKFLEEEMRQSIWECDGDKFPGLDDYNFHFIRSCWELLKEDILKVMKEFHRKEILPRGSNATILAHIPKIESPIGLNDYRPISLAC

SEQ ID NO: 224600 - protein, 166 aa, Glycine max
  Coding DNA Sequence Number=SeqID_107822
MFGFLRFKGVENALKLERQLEQTVIRNVKMHVNLQEYKRRKYDDLGFYMKGKQYGGAYEGPQQRSDEQGEQKEVDDGMREKINKGKIHGIWSLFLSLEKRNPTIVPGNRMAWIICMGIPLMNLKEENFKCFEGKLMQKFEEKVFKKKLKIGTTRLAHKTGPAQLLA

SEQ ID NO: 224601 - protein, 249 aa, Glycine max
  Coding DNA Sequence Number=SeqID_107823
  Homolog annotation: Hit_ID=Q1RVI7; Match level="QueryCoverage=40%, HitCoverage=35%, E-value=1e-13, Identity=45%"; Hit description =Fasciclin domain, putative
MGIVYTDNSVNISAGVVNATLTDIVYTDKTLAIYHVEQPLIPLDFSKPKPIASAPAMAKAPKADKENSSAEDEDQAQAAKDNSDTTRFVGIHGTMLVSIGVALLTVTTTMSFGIDVQPYLTSYYFNILLDTTVLCTKGGIMLCVLDCVVCFPFKTGSDILLVFGDYLSSLLNLMLYLCGGNIFVHVSAMQMGDDKQHWKSIPVVPVTDGYVIGSSIKSIPIVGKDITLFVQQLMRGFEGSVITWKRKIP

SEQ ID NO: 224602 - protein, 506 aa, Glycine max
  Coding DNA Sequence Number=SeqID_107824
  Gene Ontology: Mol. function=transporter activity; Cellular component= integral to membrane; Biological process=phosphate transport
  Homolog annotation: Hit_ID=Q9S735; Match level="QueryCoverage=97%, HitCoverage=95%, E-value=1e-144, Identity=53%"; Hit description =Inorganic phosphate transporter 1-9 (AtPht1;9) (H(+)/Pi cotransporter)
  Pfam annotation: Domain name=MFS_1; Domain location=26-450; Score =102.1; E_value=1.7e-27; Accession=PF07690.6; Description=Major Facilitator Superfamily
  Pfam annotation: Domain name=Sugar_tr; Domain location=22-500; Score =96.5; E_value=8.1e-26; Accession=PF00083.14; Description=Sugar (and other) transporter
  Pfam module annotation: Pfam domain module=MFS_1::Sugar_tr; Domain location=26-450::22-500
MARLKVLSALDTARTQYYHFKAIIIAGMGLFTDAYDLFSITLIIKIIGRVYYGHREGENRYETPPEVVSALVAVALLGTAVGQLVFGRLGDLKGRRRVYGFALLLMVFSSLASGFSICIRKTCVLLTLGFFRFFLGLGIGGDYPLSSTIMSEFANKKTRGSFIAAVFSMQGFGILASSTVTMAVCSIFGAASKNSEADVAWRLILMLGSVPAAMTYYWRMMMPETARYTALVEQNVMQAAKDMEKVLDVTLSQIAEEDPLPPTPHPYPLLSWEFLRRHGPDLFACSSTWFLVDIVFYSQVLFQSEIYKRYLDKKEDVDVYQETFHAAWIQAVIAVCSTIPGYFFSMYFIDKWGRVKIQMMGFFFMALAFFSIGIPYYSYWTTKEHHKNKVFMVLYGLAFFFANFGPNTTTFIVPAELFPARFRSSCHGISGAVGKVGAIIGSVGFLWASHRKKEDGYPKGIGMKVSLIILGGVCLLGMVITYFFTRETMGRSLEENEVEIEEQDNL

SEQ ID NO: 224603 - protein, 150 aa, Glycine max
  Coding DNA Sequence Number=SeqID_107825
  Homolog annotation: Hit_ID=O81865; Match level="QueryCoverage=51%, HitCoverage=35%, E-value=2e-10, Identity=42%"; Hit description =Lectin like protein
MGASESHEKLQSQQPQPQSQHVQHQQPQPQLHEPTRRRESSLLPPDQGNTKASKDRTKAVVDNNATMMPVKSLKGLPIPHNYEHILKSNADSPVDKSLLDKLYAGKYWVEKKSNGNCFMLYARALSITWAENPNYWKWVQHKEERFDLIL

SEQ ID NO: 224604 - protein, 85 aa, Glycine max
  Coding DNA Sequence Number=SeqID_107826
MVLNFFMWDFTSHLYSNMSRVAKSGLIACVALVPRASTNTYKQTRNRDKTKPMYYSQGTSHDPLSGKTTCHIKQLDNITTVIIDI

SEQ ID NO: 224605 - protein, 747 aa, Glycine max
  Coding DNA Sequence Number=SeqID_107827
  Homolog annotation: Hit_ID=Q75HJ9; Match level="QueryCoverage=91%, HitCoverage=89%, E-value=5e-77, Identity=28%"; Hit description =Expressed protein
FCQEKAQAVKILPSVKRIEHLTVWVKDQASQKLKLISEEAVEVKHELIELQKHISAQGILVQDLMTGVCRELEEWNQSSNDVAEIQQEPELPELLEPLPNERNDQKILFLETIDVLLAEHKFEEALEALDAEEINSAELKGSGNNSSDDVSLYKSSLLERKAMLEDQLVGIAEQPSVSFPELKTALNGLIKLGKGPLAHQLMLKFYQSHLQKRIEALLPSSSLCPETFPSTLSKIVFSVISLTIKESALIFGDNPVYTNRVVQWAEWEIEYFVRVVKENAPLSETVSALRAASISIQASLNYCSILESQGLKLSKLLLVLLRPSVEEVLESNFRRARRVVLDMAECCPLSPQFASSLSAIASSSSSMLVESGMRFMHIVEEILEQLTPTVSLHFGGNVLNRILQLFDKYMDALTRALPGPSDDDNLPELKEVALFRAETDSEQLAILGIAFTILDELLPNAVLSRWMLQSESKAKEPNSGATENVTFNTNASVELKEWRKHLQHSFDKLRDHFCLQYIVTFIYSREGKTRLNAHIYLSDNREDLYWDSDPLPSLPFQALFAKLQQLATVAGDVLLGKEKIQKMLLARLTETLVMWLSDEQEFWGALEDNSAPLKPLGLQQLILDMHFTVEIARFAGYPSRHIHQIASAITARAIRTFSARGIDPQSALPEDEWFVETAKSAINKLLLGASGSEASDTDEDHIIVHHDEVVSDSDTVSSLSSTESTESFASASMAELDSPSNLSDPDN

SEQ ID NO: 224606 - protein, 102 aa, Glycine max
  Coding DNA Sequence Number=SeqID_107828
MKKNQIAELESELNVAQSKLQEKEAELQALKNCITLLSELPLSTVSGKLSSRVAQGTEAAETEILLTFYALLLGDINTEITKLHPHFVWFCELNCIHIRIGL

SEQ ID NO: 224607 - protein, 148 aa, Glycine max
  Coding DNA Sequence Number=SeqID_107829
MAKTVEELKYELIIRKSSLAHQVLDYVGNIGMECCKMSGREDEIMLKQTKSELRDNNVKFWNLPVNDNGECETSALTEDSDPLVLEMDQLEAELEFDQLQKLLGHPVDTNFHEEIRPKLDEVNFMSIFSFVYLFLCSRIDSNTVMTEV

SEQ ID NO: 224608 - protein, 453 aa, Glycine max
  Coding DNA Sequence Number=SeqID_107830
  Gene Ontology: Mol. function=transcription factor activity; Cellular component=transcription factor complex; Biological process =regulation of progression through cell cycle
  Homolog annotation: Hit_ID=Q1SSY4; Match level="QueryCoverage=63%, HitCoverage=90%, E-value=1e-55, Identity=43%"; Hit description =Transcription factor E2F/dimerisation partner
  Pfam annotation: Domain name=E2F_TDP; Domain location=12-77; Score =115.1; E_value=2e-31; Accession=PF02319.11; Description =Transcription factor E2Fdimerisation partner (TDP)
MTSLSTHHTYSRKQKSLGLLCTNFLSLYNKEGVRLVGLDDAASRLGVERRRIYDIVNVLESVGVLTRKAKNQYTWKGFCAIPAALQELKDEGLKENPGSFDDSNDNAKVSDDEEEEEETFPNINIGSQSEKENPDYTATVKSSKNGLNFRSGPSQPISRMHLKFNGWIGLGLDFICAFQVDLAQNSNVKESRKRMFGTDIGNISFKRNKVDLSMDGQNSKMQNQHENISPRAQLEKIIIKKDAKQTSESYQFGPFAPAYVPKVGTSENNSVKKVHDWDSLAQEHRPQYQNQVWIGNRRAYLGNMRGSLVSIRKRCFDFVKGSVCENGVFDKSWRRRGKWGWSLETVVECGMEDKMNVRRRGQTKFVCHCSYVIDSLAQKNPFVHFKGNVNAVLVYLINHVLFSERQARLVGADHRGTKRAHAKVDISLDMLIEAWPMVAWMIGWPAIRVECSS

SEQ ID NO: 224609 - protein, 105 aa, Glycine max
  Coding DNA Sequence Number=SeqID_107831
MAMVDSFLSKSKGWEKSVRQGSELKGGVGFEGNVVIMRPMWVERPFGVAKTEEMKGNNCVHAVEIFVKDKELWGHVDKTDYASDKTMHKKAHAKWEYKANLEDKT

SEQ ID NO: 224610 - protein, 252 aa, Glycine max
  Coding DNA Sequence Number=SeqID_107832
  Gene Ontology: Mol. function=two-component response regulator activity; Cellular component=nucleus; Biological process=two -component signal transduction system (phosphorelay)
  Homolog annotation: Hit_ID=Q1SSY8; Match level="QueryCoverage=98%, HitCoverage=100%, E-value=8e-62, Identity=56%"; Hit description =Response regulator receiver
  Pfam annotation: Domain name=Response_reg; Domain location=21-127; Score=21.5; E_value=7.7e-05; Accession=PF00072.14; Description =Response regulator receiver domain
MASAGDLFTHGLPEVGGAGKLHVLAVDDSHVDRKVIERLLKISSCKDMGSLAVTVVESGSRALQYLGLDGEKSSIGFDSVDVNLIMTDYSMPGMTGYELLKKIKESSVFREVPVVVMSSENILTRIDRSPRVWTGLGHPDHMVFSHVKKEWREETMISEEIIKRVKGILCCLEEGAEEFLLKPVKLSDVKRVTDFIMRGEGMKGVKRSKKRSRSDDCIPSLSTAFASVSHPCDLSSPPSPCVSQSKKSRLSI

SEQ ID NO: 224611 - protein, 154 aa, Glycine max
  Coding DNA Sequence Number=SeqID_107833
  Subcellular localization annotation: CTP_CleavageSite=43; ConfidenceScore=5.31e-01
MEEKDWNDDSLTMTTVSQHCFGNDSEAPSFSISNIKRSSRRVCLAAQSSIFRSQRCLGVGTSLPSLVATKLGACVTLIDDFTRLGGSLPLISDYIGHVVNKRKFANACVGIDMGSLRFIHIQFTTNNYSKADLLYDSNEIALISKDNARGSSKL

SEQ ID NO: 224612 - protein, 305 aa, Glycine max
  Coding DNA Sequence Number=SeqID_107834
  Pfam annotation: Domain name=Transp_Tc5_C; Domain location=54-107; Score=-10.1; E_value=0.063; Accession=PF04236.6; Description=Tc5 transposase C-terminal domain
  Subcellular localization annotation: CTP_CleavageSite=73; ConfidenceScore=5.85e-01
MKLSAKPISSPGRTDKFPPPLMRFLRSNAASRSTRRSKSSPMFVRKKNTTAIETQTQEPSSPKVTCMGQVRVKQAATTSRDLAPPRCRCRCYCCWIRSPNNHPCRCKPLWPNWPSFFRRKPTTLKHHSEPERNFHDQESELPFHERVNVDKDSDFASNSSTPPRNALLLTRCRSAPYRSSSLASRFWSSPVKDQETEFPIPNTTEQQHTSEEPQTEPELGFLREKIASLTEPEKVEEVETETESASSRPTVLTRCKSEPARTGHRLLDPLIIVGFSDQLSNWVESAKWKVNLDWNSVSLLFRTLP

SEQ ID NO: 224613 - protein, 173 aa, Glycine max
  Coding DNA Sequence Number=SeqID_107835
  Homolog annotation: Hit_ID=Q1T2J4; Match level="QueryCoverage=99%, HitCoverage=63%, E-value=4e-69, Identity=73%"; Hit description =Uncharacterized Cys-rich domain
  Pfam annotation: Domain name=PLAC8; Domain location=1-144; Score =56.6; E_value=8e-14; Accession=PF04749.7; Description=PLAC8 family
LLGSVAPCVLYGSNVERLGSARGTFANHCLPYSGMYIIGNSCFGWNCLAPWFSYPSRTAIRRRFNLEAITVLIGQHDWGGGKEVVTKECIGEMRGSCEALNRSCGCCGSILEDEVQREHCESACDLATHVFCHVCALCQEGRELRRRLPHPGFNAQPVLVMIPPGEQTMGREA

SEQ ID NO: 224614 - protein, 151 aa, Glycine max
  Coding DNA Sequence Number=SeqID_107836
  Gene Ontology: Mol. function=sequence-specific DNA binding; Cellular component=intracellular; Biological process=regulation of transcription, DNA-dependent
  Homolog annotation: Hit_ID=Q1XPI3; Match level="QueryCoverage=91%, HitCoverage=45%, E-value=2e-40, Identity=53%"; Hit description=Helix- turn-helix, AraC type
MTAKLGKDIESIFPKGLHKDIGHFNVFDIAQTIEKVKTTSEMPYNRRKYYKISLIRGRNRAEYADKVIPIKENALLFATPKVPYHWVPEDPNQSGSFCVFTEDFFIKDKSHNTLEDLPIFQPGAFPVFEIDALLADEIEVLFRKIKTEIGV

SEQ ID NO: 224615 - protein, 140 aa, Glycine max
  Coding DNA Sequence Number=SeqID_107837
  Homolog annotation: Hit_ID=Q9AUH7; Match level="QueryCoverage=43%, HitCoverage=62%, E-value=1e-10, Identity=53%"; Hit description=UVI1
  Subcellular localization annotation: CTP_CleavageSite=39; ConfidenceScore=5.06e-01
MGSNGTSWADQWDNGPDPVTVSNESKKKNKKAFGKTKAVASTGVKKLKEGNTLAELALGPALWAVVGGYISGVEKLVAVEEKKPEKNKVEDNKAEEEEKKEEEKKSKESKDDKKSKEESTPSKIVQGTTFAMHGHFKHDF

SEQ ID NO: 224616 - protein, 175 aa, Glycine max
  Coding DNA Sequence Number=SeqID_107838
  Gene Ontology: Mol. function=aminobutyraldehyde dehydrogenase activity; Cellular component=chloroplast; Biological process =metabolic process
  Homolog annotation: Hit_ID=Q8VWZ1; Match level="QueryCoverage=94%, HitCoverage=33%, E-value=8e-71, Identity=78%"; Hit description =Aminoaldehyde dehydrogenase
  Pfam annotation: Domain name=Aldedh; Domain location=16-175; Score= -281.6; E_value=0.0013; Accession=PF00171.12; Description=Aldehyde dehydrogenase family
MAISIPSRQLFIDGEWKVPLLNNRFPIINPATEDIIGHIPAATKEDVDLAVDAAKRAFSHNKGKDWSSAPGSVRARYLRAIASKITEKKDELGKLEAIDCGKPLDEALADLDDVIGCFNYYAELAEGLDAKQNAPVSLPMETFKSYVLKEPIGVVALITPWYLLFLHFNCLCISM

SEQ ID NO: 224617 - protein, 145 aa, Glycine max
  Coding DNA Sequence Number=SeqID_107839
  Gene Ontology: Mol. function=hydrolase activity, acting on glycosyl bonds; Cellular component=extracellular space; Biological process =metabolic process
  Homolog annotation: Hit_ID=Q9FNA3; Match level="QueryCoverage=67%, HitCoverage=12%, E-value=1e-36, Identity=69%"; Hit description=Alpha- N-acetylglucosaminidase
MEEPATYTTGDHEITLTLKFNNLYLVGLVIRNKGLRVEVRRGGESDTFDENTPPVDDPEYISSLGAATFKGMQSGDDDAVWLMQGWLFSYDPFWRPPQMKALLHSVPVGKLVVLDLFAEVKPIWVTSEQFYGVPYIWKVIFHFMK

SEQ ID NO: 224618 - protein, 78 aa, Glycine max
  Coding DNA Sequence Number=SeqID_107840
MRYLGEYPEFEAGGVRWQQAEKNAARGGFLDRRGSPLAVLDPNKAENGVDARAGGGGREEEDEDEKNGGKWKLHADGF

SEQ ID NO: 224619 - protein, 52 aa, Glycine max
  Coding DNA Sequence Number=SeqID_107841
MGQWLSMMMKAHMLGAEVESFAKTTLGSILDGIGVEDVEDDFEGVKGVHIRG

SEQ ID NO: 224620 - protein, 44 aa, Glycine max
  Coding DNA Sequence Number=SeqID_107842
MAIFLSNGSGGENSRRMMRNSEKPQNIPNQNTVLNRGKGKMEEA

SEQ ID NO: 224621 - protein, 180 aa, Glycine max
  Coding DNA Sequence Number=SeqID_107843
  Gene Ontology: Mol. function=pepsin A activity; Cellular component =cellulose and pectin-containing cell wall; Biological process =proteolysis
  Homolog annotation: Hit_ID=Q6QJL5; Match level="QueryCoverage=77%, HitCoverage=30%, E-value=5e-28, Identity=49%"; Hit description =Aspartic protease
MLEPDVNGDGGFIVDSGSTLTFMERPIFDLVAEEFVKQVNYTRARELEKQFGLSPCFVLAGGAETASFPEMRFEFRGGAKMRLPVANYFSRVGKGDVACLTIVSDDVAGQGGAVGPAVILGNYQQQNFYVECDLENERLLFMKILLSKEAVLKHKKIGCNVHGSTIYQDQKSAYLKCWST

SEQ ID NO: 224622 - protein, 283 aa, Glycine max
  Coding DNA Sequence Number=SeqID_107844
  Gene Ontology: Mol. function=pepsin A activity; Cellular component =cellulose and pectin-containing cell wall; Biological process =proteolysis
  Homolog annotation: Hit_ID=Q6QJL5; Match level="QueryCoverage=66%, HitCoverage=40%, E-value=2e-33, Identity=43%"; Hit description =Aspartic protease
  Subcellular localization annotation: CTP_CleavageSite=41; ConfidenceScore=5.23e-01
MKTSISVINKQPKTKKTSSKPSHHLHTRRRFCVFSFPQNASSSHYSLPLLFPLHHITIHHHYFIHPHPQHHHHPPLFTHHPSSSNSHPFHTLQLAVSTSITRAHHLKNHNNPSSLKTLVHPETYGGYSIDLKFGTPPQTFPFVLDTGSSLVWLPCYSHYLCSKCNSFSNNNTPKFIPKDSFSSKFVGCRNPKCAWVFGSDVTSHCCKLAKAAFSNNNNCSQTCPAYTVQYGLGSTAGFLLSENLNFPAKNVSDFLVGCSVVSVYQPGGIAGFGRGEESLHGAR

SEQ ID NO: 224623 - protein, 170 aa, Glycine max
  Coding DNA Sequence Number=SeqID_107845
RVAFGAEVVGVAWEPDEAASSVENEGERLWWWALVMDVETASWRVWNGCELLEEGWWVNKGGKKHFEGKKKRKNAFECEGDGMVLTKDPWACTSNYLYWFYKVSHIYVIPWEERQSPRGLVCLLLNPRQSQPRSIPDGVKGYVKLIGPQSSAKGHRKRPGKDGGKGGRGN

SEQ ID NO: 224624 - protein, 83 aa, Glycine max
  Coding DNA Sequence Number=SeqID_107846
  Gene Ontology: Mol. function=sugar binding; Cellular component =integral to membrane
  Homolog annotation: Hit_ID=Q5ZEM1; Match level="QueryCoverage=97%, HitCoverage=34%, E-value=2e-15, Identity=48%"; Hit description =Putative lectin 2
MLEESSQGWEVPINVGFVLPGGKRQQHKVNLNEKSRESWLEILVGEFVASKKDVGEMKISLYEYGGMWKTGLVIQGVVIKPKN

SEQ ID NO: 224625 - protein, 94 aa, Glycine max
  Coding DNA Sequence Number=SeqID_107847
NSPMEVTKYEEPIPPALVAKPGCSERPLHLVRASKEPISPALTLCTYDTLNWTRQSNQRDESTLNSPMEVTITTGYVANGSSEKSRARPSSYRQ

SEQ ID NO: 224626 - protein, 97 aa, Glycine max
  Coding DNA Sequence Number=SeqID_107848
GVVLAEVLLADSRFTRPDMGFHPTKLNFVPSDADEAPLRYPFHPGLFVGDAGGFQSPTREPLNVGGLVPPHCSLKSVVSDDACPGACFVQRDATTLS

SEQ ID NO: 224627 - protein, 84 aa, Glycine max
  Coding DNA Sequence Number=SeqID_107849
MSDGVDVEVDMDNDVRIDEDIHKDYGQEIGKIVDCSKTFITTKVHHQTQHLQVQHHQLQHIREFHKSLAPHLQLQVFNVYVHME

SEQ ID NO: 224628 - protein, 39 aa, Glycine max
  Coding DNA Sequence Number=SeqID_107850
MGTTPTRFSILHLGGNYAHPQGTQVTRIVSTQVFPLETP

SEQ ID NO: 224629 - protein, 290 aa, Glycine max
  Coding DNA Sequence Number=SeqID_107851
  Gene Ontology: Mol. function=sugar binding; Cellular component =membrane; Biological process=protein amino acid phosphorylation
  Homolog annotation: Hit_ID=Q5ZEM1; Match level="QueryCoverage=52%, HitCoverage=65%, E-value=1e-42, Identity=52%"; Hit description =Putative lectin 2
  Subcellular localization annotation: CTP_CleavageSite=55; ConfidenceScore=5.13e-01
MGASQSQEELQSQRQFQQHQHPNELTRRESLLLSPAASNNTKQFSNSTKVVDNVTAANSTNTNCFMLNARALSITWAENPDYWTWVQDKDESGTMIELPNLKMVCWLEVHGKFDTRKLSLGILYQVSFIVMLKDSAQGWEVPINVRLVLPGGKKQQHKENLNEKLRECWIEIPVGEFVASEKDVGNIEISMYEYEGGKWKTGLIIQGIAIKPKNETNQSQHHQQPHELTRRESWLMSPAGNSKYFKNSTKAIDNVTSANNTNSFMVYARSLSITWAENPNYWKWVQHKEA

SEQ ID NO: 224630 - protein, 58 aa, Glycine max
  Coding DNA Sequence Number=SeqID_107852
MAALDFTYESLCIQYLDEGVPYVLKIGLIHLLPKFHGLAGSGKRLAILPCSQVHFQLG

SEQ ID NO: 224631 - protein, 375 aa, Glycine max
  Coding DNA Sequence Number=SeqID_107853
  Gene Ontology: Mol. function=protein kinase activity; Cellular component=integral to membrane; Biological process=protein amino acid phosphorylation
  Homolog annotation: Hit_ID=Q9M2R4; Match level="QueryCoverage=81%, HitCoverage=47%, E-value=5e-82, Identity=52%"; Hit description =Receptor-like protein kinase
  Pfam annotation: Domain name=Pkinase; Domain location=71-369; Score =19.5; E_value=1e-09; Accession=PF00069.15; Description=Protein kinase domain
  Pfam annotation: Domain name=Pkinase_Tyr; Domain location=65-369; Score=11.9; E_value=3.4e-13; Accession=PF07714.7; Description =Protein tyrosine kinase
  Pfam module annotation: Pfam domain module=Pkinase::Pkinase_Tyr; Domain location=71-369::65-369
MVVISGILLCFAVVFMILRRGRCGDEGQFGKVEGGNVGCVDDVKGRFVVVEEEGGVLGGMELEDLLRGSAYVVGKSRSGIVYKVVGVGKGAAAARVVAVRRLGEGGAAWRLKEFEAEVEGVARVRHPNVVALRAYYYAREEKLLVTDFVRNGNLHTALHGGPSNSFSPLPWAARLKIAQGAARGLTYIHEFSGRKYVHGNLKSTKILLDEDHSPYISGFGLTRLGIGSSNSKSLSSEPKRSNHSIATSAIVSIGSNVSTSSNIYLAPEARIAGGKFTQKCDVYSFGIVLLELLTGRLPDLGAENDGMGLESFVRKAFREEQPLSEIIDPALLPEVYAKKQVIAVFHVALNCTELDPELRPRMRTVSETLDRIKLQ

SEQ ID NO: 224632 - protein, 217 aa, Glycine max
  Coding DNA Sequence Number=SeqID_107854
  Homolog annotation: Hit_ID=Q9M2R4; Match level="QueryCoverage=44%, HitCoverage=24%, E-value=3e-13, Identity=55%"; Hit description =Receptor-like protein kinase
MVTGRDPREDGMLPVKRLCDKLSVPAREGRLERVTGSEGVVGEIEDEEGGGIEEGGGDCVGEVTPAQVQGVREVSVQVARAPVGSTEIAALKASNESPSEFRGSVRGREMRKKNKERWRSGNRRRSLEELEIAYVTMKMLEEYHVATNPILKNHGGDEDGFTEAVERVDTDEGKVVGRIDGSTLVVMFKVQTCDGVVVMMGSGGSVFVVVFEAQASD

SEQ ID NO: 224633 - protein, 156 aa, Glycine max
  Coding DNA Sequence Number=SeqID_107855
MEFYWGFRAFIPIDELCDPSNGFIVNDTCLIEVENLFSQSEHLNLNLVEQPVSKIYDKAIEHTADPIPKEMCTTSLDEFVDFRGLGKIEKSFVPLLEDLKRKREENVTALAMKEERLKKKMKEIEAELGIARRDLVQAGEDFEACNLDAEVGYGRP

SEQ ID NO: 224634 - protein, 165 aa, Glycine max
  Coding DNA Sequence Number=SeqID_107856
  Gene Ontology: Mol. function=electron carrier activity; Cellular component=chloroplast; Biological process=electron transport
  Homolog annotation: Hit_ID=Q93VA3; Match level="QueryCoverage=94%, HitCoverage=97%, E-value=5e-45, Identity=56%"; Hit description =Cytochrome c6, chloroplast precursor
  Pfam annotation: Domain name=Cytochrom_C; Domain location=70-153; Score=7.3; E_value=0.066; Accession=PF00034.11; Description =Cytochrome c
MKIASLISGCNDYTHLLSIKEHVMREEKPIPTTRKSEVKFLKSLTRLVAAFLVLSPICSIPVSSAQTVDIQRGTTLFRQACIGCHDAGATLFTKDLQRNEVDTEEAIYRVTYYGKARMPGFGKECMPRGQCTFGARLEDEDIKTLAEFVKLQADQGWPSIETKEE

SEQ ID NO: 224635 - protein, 300 aa, Glycine max
  Coding DNA Sequence Number=SeqID_107857
  Gene Ontology: Mol. function=phosphatidylcholine-sterol O -acyltransferase activity; Biological process=lipid metabolic process
  Homolog annotation: Hit_ID=Q71LX7; Match level="QueryCoverage=99%, HitCoverage=58%, E-value=1e-102, Identity=57%"; Hit description =Lecithine cholesterol acyltransferase-like protein
MAILLGEILQSLELWLKLIKNPQPQPYVNPNLDPVLLVPGVGGSMLHAVDESEGSRERVWVRFLNAEYTLKTKLWSRYDPSTGKTESMDPNSRIMVPEDRHGLHAIDILDPDLMLGSDSVYYFHDMIVEMRKWGFEEGKTLFGFGYDFRQSNSVSIFWLLVGSMISHNPKDKIFEKYVKNWVAICAPFQGAPGTINSTFLNGMSFVEGWEQNFYISKWSMHQLNYLLKLLPMSQLIECPSIYELMGCPNSHWKHIPALELWRERHDSDGKSHIVLESYPPCDSIKVLEQALVNNIVSYQC

SEQ ID NO: 224636 - protein, 64 aa, Glycine max
  Coding DNA Sequence Number=SeqID_107858
  Subcellular localization annotation: CTP_CleavageSite=22; ConfidenceScore=5.56e-01
MEIFRKKLPPGTFRMTFFRKLSVSTSGRHKFFFRKKLCQRQPKSEKRHTSVVSLFSRFLTPEKG

SEQ ID NO: 224637 - protein, 130 aa, Glycine max
  Coding DNA Sequence Number=SeqID_107859
  Subcellular localization annotation: CTP_CleavageSite=40; ConfidenceScore=5.39e-01
MESTYLTQKCKNSGDLVGKCLTSTSPPTLCPTRNDTSNCHMQMRSPPALCVVVLYGLTNMSFTFHLTLLNDTSVMELCVCPAHGTVKGDVITQLLAMMKSDKECDDTTKEFRVEKRTLQLEPHWVCSIFD

SEQ ID NO: 224638 - protein, 364 aa, Glycine max
  Coding DNA Sequence Number=SeqID_107860
  Gene Ontology: Mol. function=protein transporter activity; Cellular component=integral to membrane; Biological process=intracellular protein transport
  Homolog annotation: Hit_ID=Q9SF29; Match level="QueryCoverage=83%, HitCoverage=96%, E-value=7e-83, Identity=55%"; Hit description =Syntaxin-71
MMKQQGRKKLVFIDIVVTGWTVLTNGSSCPLICNRGGLDKTTTIFRTLTRPHHTMSVIDILTRVDSICKKYDKYDVQSQRDSNLSSDDAFAKLYASVDADIEALLQKADTASKEKSKASTVAINAEIRRTKARLLEEVPKLQRLAMKKVKGLSSQEFAARNDLALALPDRIQAIPDGTPAASKQSGSWAASASRPGIKFDSDGKFDDEYFQQTEESSGFRKEYEMRKMKQAKGLDTLKNMAHDMNEELDRQVPLMDEIDTKPLCICKDKAAYNIPLPYLRIAKSLWAMGYEVFFFTLKPKYLERKSKSSKLELVDRASSDLKNTNVRLRDTVNQIKIYASSFSFLVWIYISVHILGLPCVPLLE

SEQ ID NO: 224639 - protein, 514 aa, Glycine max
  Coding DNA Sequence Number=SeqID_107861
  Gene Ontology: Mol. function=nucleic acid binding; Cellular component= intracellular; Biological process=regulation of transcription
  Homolog annotation: Hit_ID=Q1SZA5; Match level="QueryCoverage=68%, HitCoverage=82%, E-value=1e-106, Identity=59%"; Hit description=Zinc finger, C2H2-type
  Pfam annotation: Domain name=RS4NT; Domain location=128-165; Score =15.7; E_value=0.027; Accession=PF08071.2; Description=RS4NT (NUC023) domain
  Pfam annotation: Domain name=zf-C2H2; Domain location=143-165; Score =22.0; E_value=0.0022; Accession=PF00096.16; Description=Zinc finger, C2H2 type
  Pfam annotation: Domain name=zf-C2H2; Domain location=170-191; Score =14.6; E_value=0.27; Accession=PF00096.16; Description=Zinc finger, C2H2 type
  Pfam annotation: Domain name=zf-C2H2; Domain location=67-89; Score =25.6; E_value=0.00018; Accession=PF00096.16; Description=Zinc finger, C2H2 type
  Pfam module annotation: Pfam domain module=RS4NT::zf-C2H2::zf -C2H2::zf-C2H2; Domain location=128-165::143-165::170-191::67-89
  Subcellular localization annotation: CTP_CleavageSite=12; ConfidenceScore=5.21e-01
MQMIPGDPFSLSTSLPAGLPNEQSTNTNPNPNPPPPNKKKRNLPGTPDPDAEVIALSPKTLMATNRFICEICNKGFQRDQNLQLHRRGHNLPWKLRQRSNKEVRKKVYICPEKTCVHHDAARALGDLTGIKKHYSRKHGEKKWKCEKCSKKYAVQSDWKAHTKTCGTREYKCDCGNLFSRKDSFITHRAFCDALADESSRLTSVASTSLNFKSEDATMINTQASLSTRGLITDHGMQNVSQFGPHGFRLMNMGTDQQRPNLSLWLNQGNHHINNPLDVALSSSSSGLPEVVHMAQANINNNALIGSSSVFSNFGMPASSNSSNPNLMGKKGDGGASDLASMYSESQNKNSNSTSPMSATALLQKAAQMGSTRSTNPSIFSGSFGVMSSSSTQSTSLNSNIANQSCDQLNQAFQNFNATSSSSATMLGSSTNFSSLTHSSNGFDQFMMQNNVEPTQLKLHHPGSNSVEHNLTRDFLGVSGNGGGQVHHAFLPQELAKFASLGSSMGLNQFTVGHQ

SEQ ID NO: 224640 - protein, 204 aa, Glycine max
  Coding DNA Sequence Number=SeqID_107862
  Gene Ontology: Mol. function=DNA binding; Cellular component=nucleus; Biological process=regulation of transcription
  Homolog annotation: Hit_ID=Q1SZA2; Match level="QueryCoverage=99%, HitCoverage=62%, E-value=3e-96, Identity=82%"; Hit description=No apical meristem (NAM) protein
  Pfam annotation: Domain name=NAM; Domain location=11-139; Score =282.2; E_value=9.8e-82; Accession=PF02365.6; Description=No apical meristem (NAM) protein
MDKDANIEIQLPPGFRFHPSDEELIVHYLRNKVASSPLPASFITEIDLYKYNPWELPSKALFGEDEWYFFTPRDRKYPNGVRPNRPDASGYWKATVNDKPIFTSCGMKSIAVKKALVFYKGRPPKGSKTDWIMHEYRLHDSMISNSRQRGSMRLDEWVLCRVRQKTISPKSILEDSNEPIYEPTSHFQQMSVNSNPEAVKNSAQ

SEQ ID NO: 224641 - protein, 74 aa, Glycine max
  Coding DNA Sequence Number=SeqID_107863
MARFTAFISMLSIVLLRKCIHMYNEYAPMLMDMAFVLMSSVRFSGSRRFRPTEAVSGRILTPMMTSMMGRPDRI

SEQ ID NO: 224642 - protein, 259 aa, Glycine max
  Coding DNA Sequence Number=SeqID_107864
  Gene Ontology: Mol. function=GPI anchor binding; Cellular component =membrane; Biological process=cell adhesion
  Homolog annotation: Hit_ID=Q1SZB4; Match level="QueryCoverage=71%, HitCoverage=73%, E-value=4e-64, Identity=69%"; Hit description=Beta -Ig-H3/fasciclin
  Pfam annotation: Domain name=Fasciclin; Domain location=43-177; Score= 107.5; E_value=3.8e-29; Accession=PF02469.12; Description=Fasciclin domain
MTKLFNFLPFLFLNIFIQTISAQVAPAPAGPTNITQVLEKAGQFTTFIKLLKASQIADRINSQLNNSNQGLTVFAPTDNAFSSLKAGTLNSINSQDQMQLIQFHILPTLYTISQFQTASNPLHTQAGNSDDGEYPLNVTTSGNQVNVTTGVVDTTVSNTIYSDNQLAVYQVDKVLLPMKLFGAMAPAASPAEAPAPTKPEKNVRAGAADSPSGSDTSADASSAVSLKRHMVEGVGWSWMGPGWSNDSNIPNSSEGRSSN

SEQ ID NO: 224643 - protein, 193 aa, Glycine max
  Coding DNA Sequence Number=SeqID_107865
  Gene Ontology: Biological process=cell adhesion
  Homolog annotation: Hit_ID=Q1SZB4; Match level="QueryCoverage=44%, HitCoverage=38%, E-value=1e-27, Identity=70%"; Hit description=Beta -Ig-H3/fasciclin
MEFNVPALRLENALSVGANTVRPWFELFSCELILSAICEALRSLMKVVNCPAFSRTWVMLVGPAGAAGVWAEIVWMKRKRRKWISFAICVSEEAKKTKIFVTSGRRGCGVVYLYYMVLRFEGHYREERGAGIALGGRNNSRLERLTWDSNSSGLAMVVVVVVGVIVNDRGFWRIEPIDIGVSLNRVFQFYTGN

SEQ ID NO: 224644 - protein, 83 aa, Glycine max
  Coding DNA Sequence Number=SeqID_107866
MASQLQYNWLRVSGLNTRNAILVYSREYHGDKKGCNVLKCLSHYFHGVENQSKLGEWSLMNVINEAVPPLGNQAIVFSISKTQ

SEQ ID NO: 224645 - protein, 498 aa, Glycine max
  Coding DNA Sequence Number=SeqID_107867
  Gene Ontology: Mol. function=molecular_function; Cellular component =nucleus; Biological process=negative regulation of transcription by carbon catabolites
  Homolog annotation: Hit_ID=Q1SZB7; Match level="QueryCoverage=90%, HitCoverage=91%, E-value=0.0, Identity=71%"; Hit description=WD40 -like
  Pfam annotation: Domain name=WD40; Domain location=258-296; Score =29.0; E_value=1.7e-05; Accession=PF00400.22; Description=WD domain, G-beta repeat
  Pfam annotation: Domain name=WD40; Domain location=323-374; Score =21.1; E_value=0.004; Accession=PF00400.22; Description=WD domain, G -beta repeat
  Pfam annotation: Domain name=WD40; Domain location=424-460; Score =13.9; E_value=0.6; Accession=PF00400.22; Description=WD domain, G -beta repeat
  Pfam module annotation: Pfam domain module=WD40::WD40::WD40; Domain location=258-296::323-374::424-460
MMNTANGTMISPSSSSGTAAQSPGLKTYFKTPEGRYKLQYEKTHPSGLLHYAHGKTVTQVTLAHLKDKPAPSTPTASSSSSFSASSGVRSAAARLLGGSNGSRALSFVGGNGGSKSNGGNTRISSIGASSTSSAMANPNFDGKGTYLIFNVGDAIFISDLNSQDKDPIKSIHFSNSNPVCHTFDQDAKDGHDLLIGLNSGDVYSVSLRQQLQDVGKKLVGAQHYNKDGSNKDGAGDSSFPVVKDQTQFSVAHARYSKSNPIARWHICQGSINSISFSMDGAYLATVGRDGYLRVFDYSKEQLICGGKSYYGALLCCAWSMEDRKVVAWGEGHNSWVSGVAFDSYWTSPNSNDNGETVTYRFGSVGQDTQLLLWDLEMDEIVVPLRRPPGGSPTYSTGSQSSHWDNVVPLGTLQPAPSMRDVPKISPLVAHRVHTEPLSGLIFTQESVLTACREGHIKIWMRPGVAESQSSNSENLLATSLKEKPSLSSKISSNSSYKQ

SEQ ID NO: 224646 - protein, 41 aa, Glycine max
  Coding DNA Sequence Number=SeqID_107868
MDKTMPQGKCVANEANSHCLASYSQNQESKYCYWSLNFRPN

SEQ ID NO: 224647 - protein, 517 aa, Glycine max
  Coding DNA Sequence Number=SeqID_107869
  Gene Ontology: Mol. function=methyltransferase activity; Biological process=metabolic process
  Pfam annotation: Domain name=Methyltransf_11; Domain location=166 -240; Score=-0.4; E_value=0.06; Accession=PF08241.2; Description =Methyltransferase domain
  Subcellular localization annotation: CTP_CleavageSite=27; ConfidenceScore=5.10e-01
MGVGRFKPTLKRKRVPMRVWLSFQKSMGVLVGGNHTSSSAASLSLSYLTRQLQPHYSMDAKVFKFQILQGSIAKRVVIRSILLACAVSIVSIYRAQSLFDFGTLAPIATYFDCVSGFEGVTFRPGSHLLRTRFWASANCEKDANLTLSVVTDLTGNNLLYTGAKSLCVGEGSSMAVTAMKQLGFSSVSAVQTHRFVQRNVLYEDNSFDFVFSRDLDKVSVPALLVLEVERVLKPRGIGAFLVGTTSSHPNDLIRAATPVSSLLRSSNVVHVGSVNELNLVVFKKRVGNATSFYQHGNLPADCPSLTFTKSLIELMEPLVSEKQKPPPLEFHKRIPYLPKFVDVSTRKRLVYIDIGVGELLDANVSDWFLPSYPIDQKDFNIYFVHYNTSIMLSHVKQPGITFVYHPGLSGIDKVNAKLGSDDDDDMDPLLGEEEKFDFLAWFKETVQYADFVVLKMNAGSVELKFLSDIFENGAICYVDELFLKCPERGGDASKGSCMDIYKDLRSNGVYVHQWWGD

SEQ ID NO: 224648 - protein, 281 aa, Glycine max
  Coding DNA Sequence Number=SeqID_107870
  Gene Ontology: Mol. function=zinc ion binding; Biological process =ubiquitin cycle
  Homolog annotation: Hit_ID=Q2HV40; Match level="QueryCoverage=77%, HitCoverage=74%, E-value=8e-70, Identity=66%"; Hit description=Zinc finger, RING-type
HPPPPPPVTPQPEIAANPFVYHGAAAPYPNPPLHYPQYHYPGYYPPVPPMPYHPHQHQHHHRHMDPAWIQGHFPSGPMMPNPAPFVEHQKAVTIKNDVNIRKETLKLEPDVENSGHFLVSFSFDATVSGSITIYFFAKEGEGCILTPMKENQLAPVSVHFEQGLGQKFRQAAGTGIDFSVFEESELLKVGEKDVYPLAVKADASPGNHDESDRSPTSSNTNSQITQTMFEKEKGEFRVKVVKQILWVNGMSVCVADVQRILGSRQIDAQFADNQLRGCWRY

SEQ ID NO: 224649 - protein, 76 aa, Glycine max
  Coding DNA Sequence Number=SeqID_107871
MAPRTPFVKAITVLMGSANGIQGARHAKIIYEEVEAIKQHNIYSMKEDKAFHVPPKDKNTTRLLWLLFLLGKQPSS

SEQ ID NO: 224650 - protein, 363 aa, Glycine max
  Coding DNA Sequence Number=SeqID_107872
  Gene Ontology: Mol. function=protein serine/threonine kinase activity; Cellular component=membrane; Biological process=protein amino acid phosphorylation
  Homolog annotation: Hit_ID=Q653V5; Match level="QueryCoverage=85%, HitCoverage=81%, E-value=1e-89, Identity=52%"; Hit description =Receptor protein kinase PERK-like
  Pfam annotation: Domain name=Pkinase; Domain location=36-286; Score =154.1; E_value=3.6e-43; Accession=PF00069.15; Description=Protein kinase domain
  Pfam annotation: Domain name=Pkinase_Tyr; Domain location=36-308; Score=118.4; E_value=2.1e-32; Accession=PF07714.7; Description =Protein tyrosine kinase
  Pfam module annotation: Pfam domain module=Pkinase::Pkinase_Tyr; Domain location=36-286::36-308
MDCICYYPTEEPDEDNNDGSFRIFTYRELNSATRGFHPSEKIGEGGFGTVYKGQLRDGTFVAVKVLSIELDSLRGEREFVAELNTLANVKHQNLVILRGCCVEGGHRYIVYDYMENNSLRHTFLGSEQKKMNFSWETRRDVSIGVASGLAFLHEEHQPHIVHRDIKSSNVLLDRNFTPKVSDFGLAKLLRDEKSHVTTHVAGTFGYLAPDYASSGHLTRKSDVYSFGVLLLEIVSGQRVVDSSQNGERFIVEKAWAAYEANDLLRMVDPVLNKNYPVEEAKRFLMVGLRCVQQMARLRPRMPEVVDMLTNNVETVEFSVSQPGFVADLSSARIRKQMNPSEESSATAATFADSSGWCTTNLVR

SEQ ID NO: 224651 - protein, 59 aa, Glycine max
  Coding DNA Sequence Number=SeqID_107873
MNPRLKRKVKRRKGVMKKSDTIEGLKDVEELEQCDNNRLASRGANLEGLLVGKCLHLRT

SEQ ID NO: 224652 - protein, 40 aa, Glycine max
  Coding DNA Sequence Number=SeqID_107874
MAANRCQTRMKQQHQVTIWDIGFDSYFLGDVTLYFDKPND

SEQ ID NO: 224653 - protein, 286 aa, Glycine max
  Coding DNA Sequence Number=SeqID_107875
  Gene Ontology: Mol. function=transporter activity; Cellular component= integral to membrane; Biological process=transport
  Homolog annotation: Hit_ID=Q2HV44; Match level="QueryCoverage=99%, HitCoverage=100%, E-value=1e-138, Identity=86%"; Hit description =Major intrinsic protein
  Pfam annotation: Domain name=MIP; Domain location=31-265; Score =443.8; E_value=2.3e-130; Accession=PF00230.10; Description=Major intrinsic protein
MAKDIETEVQSGLPHKDYHDPPAAAFYDPAELRKWSFYRALIAEFVATLLFLYVTILTVIGYNHQTATGSPDLCNGVGVLGIAWAFGGMIFVLVYCTAGISGGHINPAVTFGLFLARKVSLIRAVGYMVAQVLGAISGVGLVKALQKSYYNRYNGGVNMLADGYSKGTGLGAEIIGTFILVYTVFSATDPKRVARDSHVPVLAPLPIGFAVFIVHLATIPITGTGINPARSLGPAVIFNNEKAWDDQWIFWVGPFIGAAIAAFYHQSVLRAQAAKALGSFRSSSNL

SEQ ID NO: 224654 - protein, 79 aa, Glycine max
  Coding DNA Sequence Number=SeqID_107876
MFVGNLFVEEDESLTCSFKLKEVEMECLREMLKVAVHAWCPEIRSMRVGVAARVNEENVDLLNLPPVWWSQMSYRSKCI

SEQ ID NO: 224655 - protein, 598 aa, Glycine max
  Coding DNA Sequence Number=SeqID_107877
  Homolog annotation: Hit_ID=Q8S8Q2; Match level="QueryCoverage=96%, HitCoverage=97%, E-value=0.0, Identity=70%"; Hit description =Expressed protein
MNQNQLDLRAHHSGSTQSEESALDLERSYYGHPNPSSPSPLQPFAGGAQHSESNAAYFSWPTLSRWNDAAEDRANYFGNLQKGVLPETLGRLPTGQQATTLLELMTIRAFHSKILRRFSLGTAIGFRIRGGVLTDIPAILVFVARKVHRQWLNHIQCLPAALEGPGGVWCDVDVVEFSYYGAPAQTPKEQLYTELADGLRGSDSCVGSGSQVASQETYGTLGAIVRSRSGNREVGFLTNRHVAVDLDYPNQKMFHPLPPSLGPGVYLGAVERATSFITDDLWYGIFAGTNPETFVRADGAFIPFAEDFNMNNVITTVKGVGEIGDVNIIDLQSPINSLIGRQVVKVGRSSGLTTGTIMAYALEYNDEKGICFLTDFLVVGENQQTFDLEGDSGSLILLTGQNGEKPCPVGIIWGGTANRGRLKLKVGQPPENWTSGVDLGRLLDLLELDLITTNEALQAAVLEQRNGSAAGIDSTVGESSPTVPIKEKLEESFEPFCLNIPLAQVEDEPSQRVNPSIRPCEFHIKSEIEIAPNVEHQFIPSYAGKSPARQSYLKEDMELKSLAELRNGPDEDNFVSLHLGEPEMKRRKLSNSSFCIKE

SEQ ID NO: 224656 - protein, 101 aa, Glycine max
  Coding DNA Sequence Number=SeqID_107878
MGKQCVQKQTHLRKRKREKTQFLNSGTISVKTKNATHSLKRDVKKEKNLQNQSEKTHRSAMLEQWKWPPRNKEARRVYEGVLRRERERESSDDDERALLAK

SEQ ID NO: 224657 - protein, 252 aa, Glycine max
  Coding DNA Sequence Number=SeqID_107879
  Gene Ontology: Mol. function=transferase activity; Cellular component= cytoplasm; Biological process=autophagic vacuole formation
  Homolog annotation: Hit_ID=Q2MGR6; Match level="QueryCoverage=95%, HitCoverage=72%, E-value=1e-109, Identity=76%"; Hit description =Glutathione S-transferase, C-terminal-like
  Pfam annotation: Domain name=GST_C; Domain location=164-249; Score =13.2; E_value=0.01; Accession=PF00043.15; Description=Glutathione S -transferase, C-terminal domain
LDEISDTGAFVRSASTFRNWISRDPNSLFPPESGRCLAYLNIKGLDKAISFSAVKPIFERTRESDEYKGWIFPESETEVPGAEPDRFNGAKTIRELYEIASENYAGKYTVPVLWDKKLKTIVNNESSEIIRMFNTEFNNIAENPTLDLYPTDLKAQIDDTNEWIYDSINNGVYKCGFAKKQEPYNEAARQLYGALDKCEDILSKQRYICGNTLTEADIRLFVTLIRFDEVKAETFQEKRKYLTNCKACLTDS

SEQ ID NO: 224658 - protein, 145 aa, Glycine max
  Coding DNA Sequence Number=SeqID_107880
  Homolog annotation: Hit_ID=Q1SIY6; Match level="QueryCoverage=37%, HitCoverage=4%, E-value=3e-14, Identity=63%"; Hit description =Integrase, catalytic region; Zinc finger, CCHC-type
DHNESDNNDNHDGDCDNSHDDDIDDDKDHDNRAMMMMVAIDDDDDRGDNYDDDCNDAHDNNNNNHDNEKTPEPIIEAYLEANDLWEAVEENYDVLPLPDNPTLAQIRNWKERKARNSKAKASLFSAISQENSLEISIGNLALPQG

SEQ ID NO: 224659 - protein, 1321 aa, Glycine max
  Coding DNA Sequence Number=SeqID_107881
  Gene Ontology: Mol. function=transmembrane receptor activity; Cellular component=membrane; Biological process=defense response
  Homolog annotation: Hit_ID=Q1T1A2; Match level="QueryCoverage=65%, HitCoverage=94%, E-value=0.0, Identity=43%"; Hit description=TIR; Disease resistance protein; AAA ATPase
  Pfam annotation: Domain name=LRR_1; Domain location=1042-1063; Score =7.8; E_value=10; Accession=PF00560.23; Description=Leucine Rich Repeat
  Pfam annotation: Domain name=LRR_1; Domain location=1065-1086; Score =3.2; E_value=73; Accession=PF00560.23; Description=Leucine Rich Repeat
  Pfam annotation: Domain name=LRR_1; Domain location=614-635; Score =0.2; E_value=2.6e+02; Accession=PF00560.23; Description=Leucine Rich Repeat
  Pfam annotation: Domain name=LRR_1; Domain location=637-658; Score =4.6; E_value=40; Accession=PF00560.23; Description=Leucine Rich Repeat
  Pfam annotation: Domain name=LRR_1; Domain location=660-682; Score =8.5; E_value=7.4; Accession=PF00560.23; Description=Leucine Rich Repeat
  Pfam annotation: Domain name=LRR_1; Domain location=684-706; Score =2.6; E_value=95; Accession=PF00560.23; Description=Leucine Rich Repeat
  Pfam annotation: Domain name=LRR_1; Domain location=728-750; Score =6.7; E_value=16; Accession=PF00560.23; Description=Leucine Rich Repeat
  Pfam annotation: Domain name=LRR_1; Domain location=752-771; Score =3.6; E_value=62; Accession=PF00560.23; Description=Leucine Rich Repeat
  Pfam annotation: Domain name=LRR_1; Domain location=775-797; Score =7.7; E_value=10; Accession=PF00560.23; Description=Leucine Rich Repeat
  Pfam annotation: Domain name=LRR_1; Domain location=819-843; Score =0.3; E_value=2.5e+02; Accession=PF00560.23; Description=Leucine Rich Repeat
  Pfam annotation: Domain name=LRR_1; Domain location=866-887; Score =7.8; E_value=9.9; Accession=PF00560.23; Description=Leucine Rich Repeat
  Pfam annotation: Domain name=LRR_1; Domain location=889-908; Score =4.2; E_value=46; Accession=PF00560.23; Description=Leucine Rich Repeat
  Pfam annotation: Domain name=LRR_1; Domain location=910-931; Score =5.7; E_value=25; Accession=PF00560.23; Description=Leucine Rich Repeat
  Pfam annotation: Domain name=LRR_1; Domain location=998-1019; Score =14.1; E_value=0.51; Accession=PF00560.23; Description=Leucine Rich Repeat
  Pfam annotation: Domain name=LRR_3; Domain location=614-633; Score =30.8; E_value=4.8e-06; Accession=PF07725.3; Description=Leucine Rich Repeat
  Pfam annotation: Domain name=LRR_3; Domain location=866-885; Score =2.2; E_value=15; Accession=PF07725.3; Description=Leucine Rich Repeat
  Pfam annotation: Domain name=LRR_3; Domain location=998-1017; Score =2.1; E_value=16; Accession=PF07725.3; Description=Leucine Rich Repeat
  Pfam annotation: Domain name=NACHT; Domain location=219-372; Score= -21.4; E_value=0.0027; Accession=PF05729.3; Description=NACHT domain
  Pfam annotation: Domain name=NB-ARC; Domain location=180-475; Score =130.6; E_value=4.4e-36; Accession=PF00931.13; Description=NB-ARC domain
  Pfam annotation: Domain name=TIR; Domain location=23-155; Score =174.7; E_value=2.3e-49; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_3::LRR_3::LRR_3::NACHT::NB-ARC::TIR; Domain location =1042-1063::1065-1086::...
  Pfam module annotation: Domain location=614-635::637-658::660 -682::684-706::728-750::752-771::775-797::819-843::866-887::889 -908::910-931::998-1019::614-633::866-885::998-1017::219-372::180 -475::23-155
MVTISSEAASSFSFASPLKRYDVFISFRGEDTRNNFTSHLYAAFQLNKIQAFIDNRLHKGDEISPSIFKAIKHCNLSVVVLSKHYASSTWCLRELAEILDHKKRGGHIVIPVFYKIDPSHVRKQTGTYGKAFEKYERDVKHNMAMLQKWKAALTEVANLVGWEFKNHRTENELIEGIVKDVMEKLNRIYPTEVKETLVGIDQNIAPIESLLRIGSKEVRIIGIWGMGGVGKTTIANALFTKLSSQYEGSCFLANVREEYENQGLGYLRNKLFSEVLEDDVNLHISTPKVRSTFVMRRLRQKKVLIVLDDVDDSKKLEYLAAQHDCLGSGSIVIVTTRDKHVISKGVDETYEVKGLSLHHAVRLFSLNAFGKTYPEKGFEMLSKQVVDHANGNPLALKVLGSLLHSRNEQQWANALRKLTKVPNAEIQNVLRWSYDGLDYEQKNMFLDIACFFRGENIENVIRLLEICGFYPYIGIKILQEKSLVTFSDDGKVCMHDLIQEMGWEIVHRESIKDPGRRSRLWDPKEVYDVLKNNRGTDAVEGIILDVSQISDLPLSYETFSRMINIRFLKFYMGRGRTCNLLLPSGLKSLPNKLMYLQWDGYPSKSLPSTFCTDNLVVLSMMESHVEKLWDGIKSFASLKEINLRASKKLTNLPDLSLAPNLETIDVSHCTSLLHVPLSIQYVKKLLLFNLESCKNLKSLPINIHLSSLEMFILRRCSSLDEFSVTSQNMTNLDLRETAIKDFPEYLWEHLNKLVYLNLESCSMLKSLTSKIHLKSLQKLSLRDCSSLEEFSVTSENMGCLNLRGTSIKELPTSLWRNNKLFTLVLHSCKKLVNFPDRPKLEDLPLIFNGVSSSESPNTDEPWTLSSLADLSLKGSSIENLPVSIKDLPSLKKLTLTECKKLRSLPSLPPSLEDLSLDESDIECLSLSIKDLSHLKILTLTNYKKLMSPQDLPSSSKASLLNESKVDSHLVSMKGLSHLQKFPLVKWKRFHSLPELPPFLEELSLSESNIECIPKSIKNLSHLRKLAIKKCTGLRYLPELPPYLKDLFVRGCDIESLPISIKDLVHLRKITLIECKKLQVLPELPPCLQSFCAADCRSLEIVRSSKTVLIEDRYAYYYNCISLDQNSRNNIIADAPFEAAYTSLQQGTPLGPLISICLPGTEIPDWFSYQSTNSSLDMEIPQQWFKDSKFLGFALCLVIGGFLQNSYEGYDPDVKCYHFVKSAFNSDPSVPFLGHCTTVMQVPQGFNSDHMFICYYPTFNASILQDFKDLGMYYDANSLRLRVIFKFKGPYQRLDIVKKCGVRPLLIANTERFHIESELQPE

SEQ ID NO: 224660 - protein, 90 aa, Glycine max
  Coding DNA Sequence Number=SeqID_107882
MTKKAVHTMNPKCSTNGRTEADKYPGQIAAGSDSMGTLAMSPLLTFLLLLRLECSGAGVSSVMVAMTRYKALLYNLKSHAYMLYTIKNNE

SEQ ID NO: 224661 - protein, 477 aa, Glycine max
  Coding DNA Sequence Number=SeqID_107883
  Gene Ontology: Mol. function=galactosyltransferase activity; Cellular component=Golgi stack
  Homolog annotation: Hit_ID=Q2MGS1; Match level="QueryCoverage=99%, HitCoverage=70%, E-value=3e-66, Identity=56%"; Hit description =Glycosyltransferase sugar-binding region containing DXD motif; Alpha 1,4-glycosyltransferase conserved region
MLRSRRRSPYGAYLCAVISAVLLLFSVSLLYSRLSRSHPHSHHLPRPSLVSHSTSADISIASSDDPIDELDFIDETLDPPSLRLNPPPYHLFFDPLSASLRRSFHHRHSDNNNNFPFQSFSDNDDRSKTAFASDDVPVDFTVRSMAARVATIDDALLLKTSPLREGWSDWFDKKSVFLRKDRMFRSNFDVLNPLNNPLLQDPDAGAATTGLTRGDRIVQKWWIHEFKKVPFPGIKKKAPLNVNVNTLTKVGIERRTLNHNHNNNDDDNNNNEIIKEVVNSGSNGGESSIQKDVDVIGADRGVSVKNHVVNSGSNGGESSIEKDVDVVGAARGVSVKNHVYADGDTWGYYPGLPRLRLSFSDFMDEFFKLGKCVTRVFMVWNSPPWMYTVRHQRGLESLLFHHPDACVVVFSETVELDFFKDSFVKDGYKVAVAMPNLDELLKDMPAHIFASVWFEWKKTNFYSTHYSELIRLAALYK

SEQ ID NO: 224662 - protein, 120 aa, Glycine max
  Coding DNA Sequence Number=SeqID_107884
MVFYAWEFEATVSSTCEIMNVVVGIRCLLGVEVRGHKSGGGAILFLEIFSAETVAKLSTCISNTVSGTSLRVVHYAKSRPQNFFSLGFLTPMEEESRGVVFLSDELSRSKEAGSVEKSSV

SEQ ID NO: 224663 - protein, 938 aa, Glycine max
  Coding DNA Sequence Number=SeqID_107885
  Homolog annotation: Hit_ID=Q2R3D9; Match level="QueryCoverage=10%, HitCoverage=43%, E-value=6e-11, Identity=40%"; Hit description =Expressed protein
MILFLFEYEKRQLHGVFKASCDGAINIVPNAFAKVGKQFPAQVKFDAIWLCKPLPEKLFRDAIRENYFTSNKFNFGLSENQVHELLYLFNERRLEPEASPGRLLSSNEDLKSEWYSLGKVGRSVDHGMCIERLQNEQDVGGSISAIKMPNRQGDSLLYNGEYKYTGLNASDVKQGRTAQFSVDTTTSEYVSDYLGLKDESRFAAYENEDYMDICLRPNFIGGYSKSPSDKIRNHGEGRLSIRDGLMSKSLPETDQRILFSNDIPGLNNSDVNPSGFYSKHILEHNPLVQNRLRPTSTMIHPIQSQILNNTGVTQRDTNSNSNSLLCDPDAPGLNFSRVSSAGINDGSKPIMESTSLSNNYGRKSLSSQPCLIRKELKDTSRWHTAGGDLQNSVFYSSNRDYMPLNTVQNSDQLAAESVVYEACDIPSLSPSIPPPDIGRSSSLHDPFSSLLHIHQSWLGNNFHSTTLQENLSHDITLPKNYDTYTPEISWANEGHFKDGDSLIHEYDIGCGSQNNNSGYPKKKSSVFSRLSFMQDSKQENGNNVRNEGYDFHTSVDAVMERVRLNHNKWMKKRKPKPMHNKAESLKYKTQISSSRKKEGDCFENALTDQTMDLSTATEGNAKETAEETCFVDFKRRSKVRKLSDENEIRSSNESEKNENLVFGQQKKRKLIRPNFSKSITSDDKGIDLSASQNLQVPSSLGSYTVKDVKESCCVFVQTADNIKADAEVRNIISETHSEKSSHARGYACIEGGERAADSALAAFNVKSNAEVQNIHRTHSEDKNNSSRARGYGCGEGGEKAINGALTALNDGSKCLDNISQNVFASASCKDVQNGLCSMDSIKSASLNTGSLRSIRQCQENHAHKIICAGRGINTDKEMPKDCSSSFKDGSEYLKNSGNEKAPIETSCPMKEGLLVMNSIKSASAGKNSLHSICQEHLA

SEQ ID NO: 224664 - protein, 323 aa, Glycine max
  Coding DNA Sequence Number=SeqID_107886
  Gene Ontology: Mol. function=ligase activity
  Homolog annotation: Hit_ID=Q1SKU3; Match level="QueryCoverage=87%, HitCoverage=71%, E-value=7e-28, Identity=28%"; Hit description=AMP -dependent synthetase and ligase
  Subcellular localization annotation: CTP_CleavageSite=95; ConfidenceScore=5.01e-01
MLFTHALPLLISAFDLITATFISGLIILSVLSLCFIFHLRFKSKSITHLQGFNSLWTVRFLLVLFVFLWSITELLRLPFFRRKYLYPFTPSFSISQQADLCKVHIVLSLGFFEPAFLVTLLFLLNASIKTKTPKNNDKWAITSVLLTCLPFATLQALLIFFAPFENRVPAETSVVLNDGYGFETVLCAYPFLSSVLFAVFGVTYSTWFLFSCWRVLSLVINKGLRMRIYVLAWIVLVAIPLQIVALGFSVRWSPHQEVHGVVSLVGFLAVFCCATTGEGILVIKPISDALDAGGNYCVWTPQTRAWQLEETEPAGVVVRLEGG

SEQ ID NO: 224665 - protein, 61 aa, Glycine max
  Coding DNA Sequence Number=SeqID_107887
  Homolog annotation: Hit_ID=Q2MGQ2; Match level="QueryCoverage=41%, HitCoverage=16%, E-value=5e-07, Identity=96%"; Hit description=2-oxo acid dehydrogenase, lipoyl-binding site
MACRQLWASRAASYLRISVFHRSFSNGYVATDQGFKYRSWSRKSVDIADKWQTNVADADQL

SEQ ID NO: 224666 - protein, 109 aa, Glycine max
  Coding DNA Sequence Number=SeqID_107888
MAKDTKFLVPYVEFAPAPVIPHKKVSHPPHLETIAEEEVEEEHDEEILSQLAISFQFFLSRTISHPTGSNCMCICNGLSIKSRQLSQRLLNLNKDDQGLGSRAFGKTTK

SEQ ID NO: 224667 - protein, 61 aa, Glycine max
  Coding DNA Sequence Number=SeqID_107889
MAKGIRKLSSWIEVAPAPIIYPKKPSNTPTLETITEEEEAAAEGFENGDVGGSRCLASNLA

SEQ ID NO: 224668 - protein, 521 aa, Glycine max
  Coding DNA Sequence Number=SeqID_107890
  Gene Ontology: Mol. function=protein phosphatase type 2C activity; Cellular component=nucleus; Biological process=protein amino acid dephosphorylation
  Homolog annotation: Hit_ID=Q1S458; Match level="QueryCoverage=91%, HitCoverage=90%, E-value=1e-180, Identity=69%"; Hit description =Protein phosphatase 2C-like
  Pfam annotation: Domain name=PP2C; Domain location=62-400; Score =82.3; E_value=1.5e-21; Accession=PF00481.12; Description=Protein phosphatase 2C
  Subcellular localization annotation: CTP_CleavageSite=36; ConfidenceScore=5.67e-01
MGSCFSAESRSPPCNSPNSSSFRKRKSNSKKRLGSRASSFEYWRNEPLHRIPGRIFLNGSSQVASLFTQQGKKGTNQDAMVVWENFCSREDTIFCGVFDGHGPYGHMVAKRVRDSLPLKLNAHWEQSASGEEVLKEISVNTAGSMNSEEAAFASADDESRVSVDAEETEKHPEIFQTLKESFLKAFKVMDRELKMHQSIDCFCSGTTAVTLVKQGRDLIIGNVGDSRAVLGTREKDNSLVAIQLTVDLKPNLPEMSHKRDIRTGRERILTLSWLGDGQIFMSVVLAEEERIRKCKGRVFALQDEPEVARVWLPNNDSPGLAMARAFGDFCLKDFGLISVPEVSYRRVTEKDEFVVMATDGIWDVLSNKEVVDIVAAAPRRALAARALVESAVRSWRYKYPTSKVDDCAVVCLFLDSDSDSHKVCSASNVIKSKEQPSSGIQVHNGDSGDVPAPTGLARSGTCRENNEDNNNNSEEESKEEEIDTDAEIEWSALEGVSRVNTLLNLPRFEPDKEDKGMRKHK

SEQ ID NO: 224669 - protein, 166 aa, Glycine max
  Coding DNA Sequence Number=SeqID_107891
  Homolog annotation: Hit_ID=Q5N7G7; Match level="QueryCoverage=28%, HitCoverage=23%, E-value=2e-08, Identity=57%"; Hit description =Prolyl 4-hydroxylase alpha subunit-like
  Pfam annotation: Domain name=DUF584; Domain location=29-166; Score =149.7; E_value=7.7e-42; Accession=PF04520.4; Description=Protein of unknown function, DUF584
MASRKGFLSKVSSMFASSSTDLEPKSTDGDLELDEADVFNWNMSNDNNNKNTVTESKKRPRSGKKKKVEGGGGKVNPVASSSMPVAIPDWSKILKEDFKEHEKRDFVSDDDDDHDDDRREPVPPHEYLARTREASHSVQEGKGRTLKGRDLRSVRNSIWKKLGFED

SEQ ID NO: 224670 - protein, 105 aa, Glycine max
  Coding DNA Sequence Number=SeqID_107892
MGVWDKMIEELREKGYGEWKGACEIKIKCFLGVQQECRVREGCETNQRHKGYKIRMSFFSLWPCRGKAKTKEIRETWTRVLGELDLRLPFPAPFRLGTTEVWSSS

SEQ ID NO: 224671 - protein, 537 aa, Glycine max
  Coding DNA Sequence Number=SeqID_107893
  Gene Ontology: Mol. function=glutamine-fructose-6-phosphate transaminase (isomerizing) activity; Cellular component=cytoplasm; Biological process=carbohydrate biosynthetic process
  Homolog annotation: Hit_ID=Q9LIP9; Match level="QueryCoverage=95%, HitCoverage=75%, E-value=0.0, Identity=85%"; Hit description =Glutamine-fructose-6-phosphate transaminase 2
  Pfam annotation: Domain name=SIS; Domain location=216-348; Score =138.4; E_value=1.9e-38; Accession=PF01380.12; Description=SIS domain
  Pfam annotation: Domain name=SIS; Domain location=388-523; Score =84.5; E_value=3.2e-22; Accession=PF01380.12; Description=SIS domain
  Pfam module annotation: Pfam domain module=SIS::SIS; Domain location =216-348::388-523
MGVNNIMILGDLSLKYISNYLAGGQVVTFSQVVLEVMRHLEGAYALIFKSLHYPNELIACKRGSPLLLGVKELTENKENSSAFEDNKFLSKDGKPRELFLSSDANAVVEHTKKVLVIEDGEVVHLKDGGVSILKYENDMGEHGASLSRAFSVRRALSVLEMEVEQINKGNYEHYMQKEIHEQPESLTTTMRGRLIHRGSNKSKSVLLGGLKDHLKTIRRSRRILFIGCGTSYNAALAARPILEELSGVPVTMEIASDLLDREGPIYREDTAVFVSQSGETADTLLALQYALDNGALCVGITNTVGSAIARNTHCGVHINAGAEIGVASTKAYTSQIVVMVMLALAIGGDTISNQARREAIIDGLFDLPNKVREVLKLDQEMKDLAKQLIAEQSLLVFGRGYNYATALEGALKVKEVALMHSEGMLAGEMKHGPLALVDENLPIAVVATRDACFSKQQSVIQQLNARRGRLIVMCSKGDAASVCPNESCRVIEVPQVEDCLQPVINVVPLQLLAYHLTVLRGHNVDQPRNLAKSVTTQ

SEQ ID NO: 224672 - protein, 194 aa, Glycine max
  Coding DNA Sequence Number=SeqID_107894
  Gene Ontology: Mol. function=glutamine-fructose-6-phosphate transaminase (isomerizing) activity; Cellular component=cytoplasm; Biological process=carbohydrate biosynthetic process
  Homolog annotation: Hit_ID=Q9LIP9; Match level="QueryCoverage=82%, HitCoverage=23%, E-value=1e-71, Identity=81%"; Hit description =Glutamine-fructose-6-phosphate transaminase 2
  Pfam annotation: Domain name=GATase_2; Domain location=2-194; Score =42.5; E_value=3.2e-14; Accession=PF00310.11; Description=Glutamine amidotransferases class-II
MCGIFAYLNYDVNRDRRYILQVLFNGLSRLEYRGYDSAGIAIDDSNFSPLVFRQEGNIESLVKSVYQEVGETELNLGECFGTHAGIAHTRWATHGEPAPRNSHPQTSGPGNEFLVVHNGVITNYEVLKETLLRHGFTFESETDTEVIPKLAKFVYDKANEAAVASQAVELKCDAMLMYIVKSCISGKREEWGWR

SEQ ID NO: 224673 - protein, 467 aa, Glycine max
  Coding DNA Sequence Number=SeqID_107895
  Gene Ontology: Mol. function=nucleotide binding; Cellular component =chloroplast; Biological process=cellular protein metabolic process
  Homolog annotation: Hit_ID=Q2MGR4; Match level="QueryCoverage=84%, HitCoverage=70%, E-value=1e-163, Identity=77%"; Hit description =GroEL-like chaperone, ATPase
  Pfam annotation: Domain name=Cpn60_TCP1; Domain location=72-466; Score=183.3; E_value=5.8e-52; Accession=PF00118.14; Description=TCP -1cpn60 chaperonin family
  Subcellular localization annotation: CTP_CleavageSite=48; ConfidenceScore=5.31e-01
MARTNDIANKIVVRRFWFTTSISNAKPPPFRWNQTVAFGVRKTPRFVVCAGPKKILFGKECREALQAGIDKLADAVSLTVGPKGRNVILSESGNLKVINDGVTIARSIELSDAIENAGAILIQEVASKMNELAGDGTSTAIILARAMIKSGLLAVAFGANPISLKKGMEKTVKELVKFLKERSVPVEGREHIKAVASISAGNDEYVGNLIAEAMDKIGSDGVISIESSSSSETSVIIEEGMKFNKGYMSPHFITNQEKSIVEFDWVKVLVTDQKISNVKEIVPLLEKAMQLNAPLLIIAEDITKQVLETLVVNKMQGLLRVAVVKCPGFGGAKKALLQDIALMTDLGLTLDCATSDQLGTALKVRITCNETTIIADPSLKAEIQARISQIKKDLSETDNANLSRKLSERIAKLSGGVAVIKVPNSVNMSGAVCILVAFVLYFANVTLSSLTLGFYWIIVLFIAFNLT

SEQ ID NO: 224674 - protein, 142 aa, Glycine max
  Coding DNA Sequence Number=SeqID_107896
  Gene Ontology: Mol. function=lipoic acid binding; Cellular component =glycine cleavage complex; Biological process=glycine catabolic process
  Homolog annotation: Hit_ID=Q2MGQ2; Match level="QueryCoverage=88%, HitCoverage=100%, E-value=2e-53, Identity=83%"; Hit description=2 -oxo acid dehydrogenase, lipoyl-binding site
  Pfam annotation: Domain name=GCV_H; Domain location=31-137; Score =128.8; E_value=1.5e-35; Accession=PF01597.9; Description=Glycine cleavage H-protein
MACRQLWASRAASYLRISVFHRGFSNVIKDFKYVDSHEWVKVDGNYATIGITDHAQDHLGDVVYVELPEVGAAVTQGGSFGAVESVKATSDINSPISGKVVEVNEALNSSPALNNTPSSVKKKIPSTDGLAKIFQHSPISMV

SEQ ID NO: 224675 - protein, 78 aa, Glycine max
  Coding DNA Sequence Number=SeqID_107897
  Subcellular localization annotation: CTP_CleavageSite=25; ConfidenceScore=5.22e-01
MCRSLLSPPPSSSGTMSLWPRSTPPSKMIWQTRVVQHDLVVYSNYDRVGKRNMTILGGGQCYLVHGVTGVKNCSVGIL

SEQ ID NO: 224676 - protein, 210 aa, Glycine max
  Coding DNA Sequence Number=SeqID_107898
  Gene Ontology: Mol. function=protein serine/threonine kinase activity; Cellular component=cytoplasm; Biological process=protein amino acid phosphorylation
  Homolog annotation: Hit_ID=Q8RY07; Match level="QueryCoverage=98%, HitCoverage=32%, E-value=4e-75, Identity=70%"; Hit description =Serine/threonine protein kinase pk23
MQINASMILLAVLTMLHLKCSIDLIVLKETYGVLGPFWARTESGIFRSVLRANPNFDDSPWPSISPEAKDFVKRLLNKDHRKRMTAAQALAHPWLRNEKNAIPLDILIYKLVKSYVRASPLRRAALKVVICYASIRTNAYYILPSFAGGRSLAKALNEDELIYLRAQFNLLEPKDGCISLENFRVALMKNTTDAMKESRVPEILNLLSPF

SEQ ID NO: 224677 - protein, 102 aa, Glycine max
  Coding DNA Sequence Number=SeqID_107899
  Homolog annotation: Hit_ID=Q1SFP1; Match level="QueryCoverage=49%, HitCoverage=46%, E-value=7e-19, Identity=86%"; Hit description=Auxin responsive SAUR protein
MVVVLTMVERFVPINQALDGAKVLHVARNGYGAFLIEAILLFSFFEQLHEQWVVHILLLLMLVVVVKVKVRNVQMKTHVMMMLVVAAVMMLLIMMMIAKDPH

SEQ ID NO: 224678 - protein, 844 aa, Glycine max
  Coding DNA Sequence Number=SeqID_107900
  Homolog annotation: Hit_ID=Q9FJC2; Match level="QueryCoverage=81%, HitCoverage=87%, E-value=1e-131, Identity=43%"; Hit description =Arabidopsis thaliana genomic DNA, chromosome 5, P1 clone:MNC6
MEATAAVAAAATAAAVRGASLQMPPPSRKEWRAVAEHHHSARNPDDEELDNAKLGQSDERTIYEVQQGREPLDVDFCSITVDGAVDNDILQQQLHNVVRQRQELLQMEIELKAQMIARTEIMEMQSTFDAQLKDHVNNASKLQEQLCEREHTIHELERKMEEKDRELHSIKLDNEAAWAKQDLLREQNKELATFRCLGFGSGLLYMLNRNRVAQETIMFKDEQFREAQAWIARVREMDVFQSTTNQTLQAELRERTEQYNQLWMGFQRQFAEMERVHLHAIQQLQLELADARERSGTFNDDSRMSQINSKNNVTQFGQENGSQFDLNGSNASGGNNGLLPNESTDNGPPFASTGNASIQTEHVAGVPIAPSSLIVPPSYLPHGQVTALHPFVMHQQGVPNSVASHVGHFHPVQSMSPVHQWQNQQSVSEGSQVPVQEHPSPSQTDQNLMRSDAKFSYEMSVNGQTLHRDYLDAHIQQGEEAQTVISSGTSETQVSQSVDKTQFVASQQDQSMQQISSQFSEALRLNSFEPNGEHKEQNSVPLSNNEPDVQVLLAEQATSAVNASSVTSHSVNHNEMIQSNSTDSVLSEVFTSSGSTASTIAKTSETALLDEKSLLACIVRTIPAGGRIRISSTLPNRLGKMLAPLHWHDYKRKYGKLDDFVASHPELFLIEGDYIQLREGAQKMVAATAAVAKVAAAAAASTPYSSYMSTVAVTPMAQTHRMKKAPSIDSKNIKSEYAVISSNPGDDPLKMSVMQHQQTSAFNVAGGLSNVKILSKSKDPREMDGPESRVVQSPVQLPVGNGGSIDRSSMSSAQISGSANGRLVSSFASKQQTRATGAVYPSRR

SEQ ID NO: 224679 - protein, 173 aa, Glycine max
  Coding DNA Sequence Number=SeqID_107901
MEGMSVSGMVIHNGMTKKNINELNKCQAKLQHNLTFLAKLADAGSQTPTPTPLPAPTPSQVSQQAIMQQGQGMQQPQVANQPQPDLSALNLPLEMNDQQQLQQHQHLAMSLQMNEQNYQLPHFLYQQQIIPGSMGGFPVANSGLYQASQTRLSNLSETPSSYQTGSDSGPGWS

SEQ ID NO: 224680 - protein, 182 aa, Glycine max
  Coding DNA Sequence Number=SeqID_107902
  Homolog annotation: Hit_ID=Q5S2C4-2; Match level="QueryCoverage=90%, HitCoverage=11%, E-value=9e-62, Identity=69%"; Hit description =Isoform 2 of Q5S2C4
MAKSRQKFSNQDSSLSPTAARSREWDGPSRWTDYLGPEMASPLSSSSSRNIYHDGQSQGTTPAQSHKGINMQWVVQLTEVAEGLMAKMYRLNQLLDYPDPINHVFSEGFWKAGVFPNHPRICVLLSKKFPEHFSKLQLERIDKIAWDSLQDHAELHLQSLEPWVQEERLKIVKEKAEACSKV

SEQ ID NO: 224681 - protein, 128 aa, Glycine max
  Coding DNA Sequence Number=SeqID_107903
  Gene Ontology: Mol. function=protein serine/threonine kinase activity; Cellular component=calcium- and calmodulin-dependent protein kinase complex; Biological process=protein amino acid phosphorylation
  Homolog annotation: Hit_ID=Q8RY07; Match level="QueryCoverage=93%, HitCoverage=20%, E-value=2e-54, Identity=85%"; Hit description =Serine/threonine protein kinase pk23
  Pfam annotation: Domain name=Pkinase; Domain location=2-125; Score= -49.3; E_value=1.3e-05; Accession=PF00069.15; Description=Protein kinase domain
  Pfam annotation: Domain name=Pkinase_Tyr; Domain location=1-128; Score=-154.6; E_value=0.0055; Accession=PF07714.7; Description =Protein tyrosine kinase
  Pfam module annotation: Pfam domain module=Pkinase::Pkinase_Tyr; Domain location=2-125::1-128
MEFDDSMMTSAIAIEDVRREVKMLKALSGHKNLVKFYDAFEDVNNVYIVMELCEGGELLDRILDRGGRYPEDDAKAILVQILDVVAFCHLQGVVHRDLKPENFLFVSKEEDAVMKVIDFGLSDFVRPG

SEQ ID NO: 224682 - protein, 204 aa, Glycine max
  Coding DNA Sequence Number=SeqID_107904
  Gene Ontology: Mol. function=protein serine/threonine kinase activity; Biological process=protein amino acid phosphorylation
  Homolog annotation: Hit_ID=Q9SG12; Match level="QueryCoverage=89%, HitCoverage=30%, E-value=9e-38, Identity=47%"; Hit description =Putative calcium dependent protein kinase; 28698-25746
  Subcellular localization annotation: CTP_CleavageSite=97; ConfidenceScore=5.13e-01
MGHCCSKNIAVNNETLPSDHAPKPPHYAAATVAVASPPPSGSSISAATPGRNTPAQSFSMSPFPSPLPAGVAPSPAKTPGRKFRWPLPPPSPAKPIMAALLRRQGKAKPKEGPIPEEQGEGGGGGEGERSLDKSFGYGKNFGAKFELGKEVGRGHFGHTCWAKGKKGDLKGQSVAVKIISKAKLVLVPERKMPWRPVFWKNLWN

SEQ ID NO: 224683 - protein, 52 aa, Glycine max
  Coding DNA Sequence Number=SeqID_107905
MEEMKTDGGDEELDSSPVIGVSGQNINTDLLGAVTLLNPTLLHGDVPNCNSD

SEQ ID NO: 224684 - protein, 719 aa, Glycine max
  Coding DNA Sequence Number=SeqID_107906
  Gene Ontology: Mol. function=protein binding; Cellular component =integral to membrane; Biological process=central nervous system development
  Homolog annotation: Hit_ID=Q5S2C4-2; Match level="QueryCoverage=99%, HitCoverage=52%, E-value=0.0, Identity=71%"; Hit description=Isoform 2 of Q5S2C4
MFGPEGRPQHCCAWLGIASSFPECASSIVPEEVTKIGRDAVLYVESLIESIMGGLEGLINILDSEGGFGALENQLLPEQAASYLNQTSRVSIPSYKSPKGTAGFPLPGHESFPENNGSIKMLEAAMQRLTNLCSVLNDMEPICVLNHVFVLREYMRECILGNFRRRLLGVLKTDNDLQRPTVLESLIKRHISIVHLAEQHISMDITQGIREVLLSEAFSGPVSSLHLFEKPTDQHTGSATESVCNWYIENIIKDVSGAGILFVPIHKCFRSTRPVGGYFAESVTDLRELQAFVRIFGGYGVDRLDRMLKEHTAALLNCIDTSLRSNRDVLEAVATSLHAGDRIEREASVKQIVDLETVIGFCVQAGLALAFDRLLAEASGAILEEGAPLIHSLLDGVIKHLPDGVPEKEEIRRMRTVANTVGVVNDHDSVWVRSILEEVGGASDGSWGLLPYLFATFMTSNIWSTTAFNVDTEGFSNNIHCLARCISAVIAGSEFVRLEREHQHRQSLTNGHASEGMDPELSSHMSAEASIKSTLQLFVKLSADIILDSWSETHRSHLVAQLIFLDQLCEISPYLPRSSLETHVPYAILRSVYSQYYADTQSTPLAILNASPRHSPAVLLAHASPVLRHHRGGDSPQYYGHESGYFKGSSSHNQEHLYDDIGSLRSMDNKQRNVRRSGPLDYSASRSRVKSVEGSTSGSTGPSPLPRFAVSRSGPLAYK

SEQ ID NO: 224685 - protein, 57 aa, Glycine max
  Coding DNA Sequence Number=SeqID_107907
MDQQMEAKIPGRSFQKGSMNLPPKGTYRMEIMTTKMHCFKHHKSKYILVIQGCDEIM

SEQ ID NO: 224686 - protein, 54 aa, Glycine max
  Coding DNA Sequence Number=SeqID_107908
MGCVIGVRLASFFTGAAAASFLGLYSLHNDYKLAHLYYIQRCFCSSNHVISESR

SEQ ID NO: 224687 - protein, 132 aa, Glycine max
  Coding DNA Sequence Number=SeqID_107909
  Gene Ontology: Mol. function=transferase activity; Cellular component= membrane
  Homolog annotation: Hit_ID=Q2MGQ8; Match level="QueryCoverage=91%, HitCoverage=25%, E-value=5e-55, Identity=85%"; Hit description =Exostosin-like
  Pfam annotation: Domain name=Exostosin; Domain location=2-126; Score=- 27.5; E_value=1.5e-07; Accession=PF03016.6; Description=Exostosin family
MLLFLVGGKIRDLLFQILENEKDVIIKHGAQSRESRRAASHGMHTSKFCLHPAGDTPSACRLFDAIVSLCIPVIVSDNIELPFEDTIDYRKIAVFVETSSAIKPGHLLSKLRAVTPDRVLEYQKKLKEPVAQ

SEQ ID NO: 224688 - protein, 228 aa, Glycine max
  Coding DNA Sequence Number=SeqID_107910
  Homolog annotation: Hit_ID=Q47522; Match level="QueryCoverage=20%, HitCoverage=59%, E-value=1e-21, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGNARVFPVTTLNSIHSISAGLDYPGIGPLHAHTIATGRAVSIAVTDEEALQAALELSQLEGIIPALESAHALYALNKLELKKEDIKLIDTVDLEGGPVGKPVVPAALMNRPTRGERRFAYWALAECILAYYVGTDEGVSEVLHVAGEKRLH

SEQ ID NO: 224689 - protein, 427 aa, Glycine max
  Coding DNA Sequence Number=SeqID_107911
  Homolog annotation: Hit_ID=Q1H1J6; Match level="QueryCoverage=47%, HitCoverage=37%, E-value=3e-71, Identity=59%"; Hit description =Putative beta (1-6) glucan synthase
KELQLAVQQANQYPNTVRGLVVGNEVLLRGEQSEPKMHEYLQWAKANTKAPITYADVWEFWLKHPTLEQDVDFVTVHILPYWEDKPVAIEQAVAHTASVMGHLGTVFKKPILIGETGWPSQGRQRFWSKPSTINQALYMRGFLNAAQQNHWQYNVIEAVDQPWKRELEGTVGGYWGVLDTDLQPKFSLQGSMAERSDGFKPYLVALVLAVLGAAWGQYTQLSARYKVLLALTGLAAGLHAYLQVDYVHMAARNTGEYVMLGGLVVLGWALAWLQLRQWLGLNVYTCIEQSLLRLLALAFLLTSAGLAINGRYLDFPLILVCLPLVLITISLISSTKIEQSAAAFNQAGFWLTAVMCVMAANMAVAVAMMEPGNIMAWWWCGACGLALLVLPVRSLQLGPLHFGLWALTNRALPLINVKPTVNGFAYT

SEQ ID NO: 224690 - protein, 200 aa, Glycine max
  Coding DNA Sequence Number=SeqID_107912
  Gene Ontology: Mol. function=protein dimerization activity; Biological process=protein amino acid phosphorylation
  Homolog annotation: Hit_ID=Q9C761; Match level="QueryCoverage=88%, HitCoverage=26%, E-value=9e-07, Identity=31%"; Hit description =Transposase, putative
  Pfam annotation: Domain name=zf-BED; Domain location=34-82; Score =32.6; E_value=1.4e-06; Accession=PF02892.5; Description=BED zinc finger
EVEVDENTISPNEIEEDELNECERANKRAKNLSFGVWNYFEKPVKHPDGKLRAKCKYLKRDLVGGGSLSGTSTLIFHMNRCQKKPHSIAESNVGKLVLDHTGRSTIIYQKVLDEKISMMIIDHDVAFSFVEYKRFRELILYLFPEAKLPFRRVATLNVNKLYDNDKLKLKHMCGLLVLQRIILHQLHIMLIKIGSCKTKY

SEQ ID NO: 224691 - protein, 166 aa, Glycine max
  Coding DNA Sequence Number=SeqID_107913
MTPKSLAFYKENADKDDDRKTIIYNLMCEKAKIWINILSKSVFHKASSKNTHCDLHKFMLFHLIENLSFDLPHTIYTNILRNLKGLGVLDNIYYVALMNKLLWFQGVYFVFNKMDEDSKHTLIVKGSVLAKQQNFSKINLKVLKVDLEQSLKEALEVDIEAIKKRK

SEQ ID NO: 224692 - protein, 410 aa, Glycine max
  Coding DNA Sequence Number=SeqID_107914
  Gene Ontology: Mol. function=monooxygenase activity; Cellular component=membrane; Biological process=electron transport
  Homolog annotation: Hit_ID=Q1SYG3; Match level="QueryCoverage=100%, HitCoverage=81%, E-value=1e-142, Identity=62%"; Hit description=E -class P450, group I
  Pfam annotation: Domain name=p450; Domain location=32-410; Score =128.2; E_value=2.3e-35; Accession=PF00067.12; Description=Cytochrome P450
MESWFIILVSLSVCVFIRTIFFSLHNKTITTPPGPTHIPIISNILWLRKTLKLEPILRTLHAKYGPMVTLRIGSRPAIFIADRTLAHQALIQNGSFFSDRPKGLATGKILNSNQHSISSASYGPTWRALRRNLASEMLHPSRARSFSGIRKWVLHTLLTRLKSDSQSNYSVKVVNHFQYAMFCLLVFMCFGERLDDGIVRDIERVQRQMLLRLSRFNVLNFWPRVTRVLCRKRWEELLRFRKEQEDVLVPLIRAKKEKRDKDNEGSLNDDVVVSYVDTLLDLQLPEEKRKLNEGELVTLCNEFLNAGTDTTSTALQWIMANLVKYPHVQEKVVDEIREVVGEREEREVKEEDLQKLPYLKAVILEGLRRHPPGHFVLPHAVTEDVILKDYLVPKNGTVNFMVAEIGLDPK

SEQ ID NO: 224693 - protein, 71 aa, Glycine max
  Coding DNA Sequence Number=SeqID_107915
MVSLDSTTFFSQNLGCYGFLVDELSMSSEGANQLRSVGLVVSMDDGDFHGWDSFTDRGVCRGHVRGNKASV

SEQ ID NO: 224694 - protein, 117 aa, Glycine max
  Coding DNA Sequence Number=SeqID_107916
  Subcellular localization annotation: CTP_CleavageSite=37; ConfidenceScore=5.62e-01
MPQMDCAHNHSASRKARGKHCSSVNSSLKGSLMKLSRCNGEGGKSSLRVGVDLQSGMRGVSSVDSSSDEEEVGSSLFLVKEMTHSLFPIFGLSLVVLVLTPQGMDEGRTNARGLVVG

SEQ ID NO: 224695 - protein, 60 aa, Glycine max
  Coding DNA Sequence Number=SeqID_107917
MYPSKEIIMFEPSRINMEEVPEESDGEVKCTWRRGIRLIKKRFNNVQDLVTLSGGLYFKE

SEQ ID NO: 224696 - protein, 208 aa, Glycine max
  Coding DNA Sequence Number=SeqID_107918
  Gene Ontology: Mol. function=RNA-directed DNA polymerase activity; Cellular component=exocyst; Biological process=RNA-dependent DNA replication
  Homolog annotation: Hit_ID=Q1S6N2; Match level="QueryCoverage=66%, HitCoverage=46%, E-value=5e-29, Identity=42%"; Hit description=RNA -directed DNA polymerase
MNEITDQSQSASLENWYLTHSVLVVKEVIDEAKREKKKCPFFKVNYEKTYDSINWDILIYMLRRMGFCEEWVGWIRCCLESSSILVLVNESPIGEFKVQRGLRQGGKFVHFFFNIEAEGLCGMMKQVIEKKLYASYLAGKLKIEGSMLVRLDWCFGEQLGGTCGVSDSKIWNLMMFLVLLSGKELWSEVFDGFCTCRHARKTSHVLII

SEQ ID NO: 224697 - protein, 1281 aa, Glycine max
  Coding DNA Sequence Number=SeqID_107919
  Gene Ontology: Mol. function=transporter activity; Cellular component= membrane; Biological process=transport
  Homolog annotation: Hit_ID=Q6Q2C1; Match level="QueryCoverage=99%, HitCoverage=99%, E-value=0.0, Identity=50%"; Hit description =Ethylene signaling protein
  Pfam annotation: Domain name=Nramp; Domain location=39-392; Score =2.7; E_value=1e-14; Accession=PF01566.9; Description=Natural resistance-associated macrophage protein
MEAGTLSPNHPPCFLRQSLPAVAPMLLISTGYVDPGKWVATVEGGARFGFDLMAVMLIFNFAAIFCQYISARIGAITGKSLAQICSDEYDTWTCMLLGVQTELSVIMLDLNMILGMAQGLNLIFGWDLFTCVFLTATGAVFHILLSVLLDIEKAKILGPFVAGFVLLAFILGLLINQPEIPFSMNGIPTRLSGESAFVLMSLLGANLVPHNFYLHSSIVQWHQGLTSISKNALCHNHFLAILCVSSGLYLVNNMLMTASANEFYSTDPVLLTFQDALSPMEQVLRSPIALLGFLLILFLANQTTALTWSLGGEVVVRNFLKLDIPGWLHYATIRVIAVLPALYCVWSSGAEGMYQLLLSTQVLVALQLPSFVIPLFRVATSRSIMGVHKISQFLELLASIIFIGMLGLNIVFVVEMIFGNSDWASDLRWNVGSGVSVSYLVLLTAAITSLCLMLWLAATPLRSASVQLDAQTWNWDMPETLPTPPVVGEELYLTEKKCHEDVSKHVEEHTPAVAKSLDYSDVSLPSFHPDLPESLMEPEPHVNAVRDNYSLISTSTSELEAVYAVVNETSDSCLEDTKTITMETNAERDDDDSWETEEPSGVVSASVPSSTSDGPASFRSLNGKSDEGGNSCGSLSRIEGLGRAARRQLATVLNEFWGQLYDLHGQVTQEAKAGKIDLLLGVGVDSRPTSSLQKVDACGKDYSEYLVSVRGRASDALMNSASYDSSKQPMMQSNSESYGLQRSSSSMWANPIQLLDAYVQNSSHNLLDSGERRYSSVRNLHSSEAWDYQPATIHGYQTASYLSRLGKDRNSANLNCQVDLSSLKSPSIVNTKYRDSLAFALGKRLQSGSGVGQPPGFPNVAVSRDSQLQSERFYYDLCSSGSADNTVNSVNTKKYHSLPDISGYSIPHRAGYVSDKNAPRDGSVGYGSFASRTCYDQSLYLNSGSRTGGHLAFNELPLSEVYNKALSSQLSSGFDTGSLRSRLPYEQFGVAEKIPNVAMEAVGNRPNAIAQETTSFVDIEGKLLQSIRLCIVKLLKLDGSDWLFRQNGGADEDLIDSVAAREKLFYEIETREMNQVIHMDEAHYFPSDRKFGSSMKSNGAYSSGFSVSSVPNCGQGCIWKTDLIISFGVWCIHSILNLSIVESRPELWGKYTYVLNRLQGIIDPAFLKPRSPLAPCFCLQVQQKLSPHLSNGILPPTTTKPGQGKCTTASTLLELIKEVELAISGRKGRTGTAAGDVAFPMGKENLASVLKRYKRRLSNKPVGTNGGTGSRKIPTLAPYNQ

SEQ ID NO: 224698 - protein, 1090 aa, Glycine max
  Coding DNA Sequence Number=SeqID_107920
  Gene Ontology: Mol. function=protein serine/threonine kinase activity; Cellular component=integral to membrane; Biological process=protein amino acid phosphorylation
  Homolog annotation: Hit_ID=Q6Z8S8; Match level="QueryCoverage=97%, HitCoverage=97%, E-value=0.0, Identity=55%"; Hit description =Putative receptor protein kinase
  Pfam annotation: Domain name=LRRNT_2; Domain location=35-75; Score =63.1; E_value=9.3e-16; Accession=PF08263.3; Description=Leucine rich repeat N-terminal domain
  Pfam annotation: Domain name=LRR_1; Domain location=103-125; Score =12.4; E_value=1.4; Accession=PF00560.23; Description=Leucine Rich Repeat
  Pfam annotation: Domain name=LRR_1; Domain location=127-149; Score =11.8; E_value=1.7; Accession=PF00560.23; Description=Leucine Rich Repeat
  Pfam annotation: Domain name=LRR_1; Domain location=151-173; Score =12.7; E_value=1.2; Accession=PF00560.23; Description=Leucine Rich Repeat
  Pfam annotation: Domain name=LRR_1; Domain location=175-197; Score =15.1; E_value=0.26; Accession=PF00560.23; Description=Leucine Rich Repeat
  Pfam annotation: Domain name=LRR_1; Domain location=199-222; Score =4.9; E_value=35; Accession=PF00560.23; Description=Leucine Rich Repeat
  Pfam annotation: Domain name=LRR_1; Domain location=224-246; Score =6.6; E_value=16; Accession=PF00560.23; Description=Leucine Rich Repeat
  Pfam annotation: Domain name=LRR_1; Domain location=248-270; Score =2.5; E_value=96; Accession=PF00560.23; Description=Leucine Rich Repeat
  Pfam annotation: Domain name=LRR_1; Domain location=272-294; Score =14.6; E_value=0.36; Accession=PF00560.23; Description=Leucine Rich Repeat
  Pfam annotation: Domain name=LRR_1; Domain location=296-318; Score =11.4; E_value=2.1; Accession=PF00560.23; Description=Leucine Rich Repeat
  Pfam annotation: Domain name=LRR_1; Domain location=320-342; Score =16.6; E_value=0.087; Accession=PF00560.23; Description=Leucine Rich Repeat
  Pfam annotation: Domain name=LRR_1; Domain location=344-366; Score =15.5; E_value=0.19; Accession=PF00560.23; Description=Leucine Rich Repeat
  Pfam annotation: Domain name=LRR_1; Domain location=368-390; Score =13.1; E_value=0.99; Accession=PF00560.23; Description=Leucine Rich Repeat
  Pfam annotation: Domain name=LRR_1; Domain location=392-414; Score =3.9; E_value=52; Accession=PF00560.23; Description=Leucine Rich Repeat
  Pfam annotation: Domain name=LRR_1; Domain location=416-438; Score =14.5; E_value=0.4; Accession=PF00560.23; Description=Leucine Rich Repeat
  Pfam annotation: Domain name=LRR_1; Domain location=440-462; Score =9.8; E_value=4.2; Accession=PF00560.23; Description=Leucine Rich Repeat
  Pfam annotation: Domain name=LRR_1; Domain location=464-486; Score =15.0; E_value=0.28; Accession=PF00560.23; Description=Leucine Rich Repeat
  Pfam annotation: Domain name=LRR_1; Domain location=488-510; Score =10.7; E_value=2.8; Accession=PF00560.23; Description=Leucine Rich Repeat
  Pfam annotation: Domain name=LRR_1; Domain location=512-531; Score =12.2; E_value=1.5; Accession=PF00560.23; Description=Leucine Rich Repeat
  Pfam annotation: Domain name=LRR_1; Domain location=534-556; Score =13.8; E_value=0.63; Accession=PF00560.23; Description=Leucine Rich Repeat
  Pfam annotation: Domain name=LRR_1; Domain location=558-581; Score =15.8; E_value=0.16; Accession=PF00560.23; Description=Leucine Rich Repeat
  Pfam annotation: Domain name=LRR_1; Domain location=582-604; Score =10.6; E_value=2.9; Accession=PF00560.23; Description=Leucine Rich Repeat
  Pfam annotation: Domain name=LRR_1; Domain location=607-629; Score =10.0; E_value=3.9; Accession=PF00560.23; Description=Leucine Rich Repeat
  Pfam annotation: Domain name=LRR_1; Domain location=631-652; Score =12.2; E_value=1.5; Accession=PF00560.23; Description=Leucine Rich Repeat
  Pfam annotation: Domain name=LRR_1; Domain location=654-677; Score =13.3; E_value=0.88; Accession=PF00560.23; Description=Leucine Rich Repeat
  Pfam annotation: Domain name=LRR_1; Domain location=79-101; Score =4.0; E_value=52; Accession=PF00560.23; Description=Leucine Rich Repeat
  Pfam annotation: Domain name=Pkinase; Domain location=765-1040; Score= 113.2; E_value=7.5e-31; Accession=PF00069.15; Description=Protein kinase domain
  Pfam annotation: Domain name=Pkinase_Tyr; Domain location=765-1040; Score=47.3; E_value=2.3e-15; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::Pkinase::Pkinase _Tyr; Domain location=35-75::103-125::127-149::151-173::175-197::199 -222::224-246::248-270::272-294::296-318::320-342::344-366::368 -390::392-414::416-438:...
  Pfam module annotation: Domain location=:440-462::464-486::488 -510::512-531::534-556::558-581::582-604::607-629::631-652::654 -677::79-101::765-1040::765-1040
MPGSLRNLSLSPKIFSFTLLLSLNSLLFFPCCYSLDEQGQALIAWKNSLNITSDVLASWNPSASSPCNWFGVYCNSQGEVIEISLKSVNLQGSLPSNFQPLRSLKILVLSSTNLTGSIPKEIGDYVELIFVDLSGNSLFGEIPEEICSLRKLQSLSLHTNFLQGNIPSNIGNLTSLVNLTLYDNHLSGEIPKSIGSLRKLQVFRAGGNKNLKGEIPWEIGSCTNLVMLGLAETSISGSLPYSIKMLKNIKTIAIYTTLLSGPIPEEIGNCSELQNLYLHQNSISGSIPSQIGELSKLKSLLLWQNNIVGTIPEELGSCTEIKVIDLSENLLTGSIPRSFGNLSNLQELQLSVNQLSGIIPPEISNCTSLNQLELDNNALSGEIPDLIGNMKDLTLFFAWKNKLTGNIPDSLSECQELEAIDLSYNNLIGPIPKQLFGLRNLTKLLLLSNDLSGFIPPDIGNCTSLYRLRLNHNRLAGHIPPEIGNLKSLNFMDLSSNHLYGEIPPTLSGCQNLEFLDLHSNSLSGSVSDSLPKSLQLIDLSDNRLTGALSHTIGSLVELTKLNLGNNQLSGRIPSEILSCSKLQLLDLGSNSFNGEIPNEVGLIPSLAISLNLSCNQFSGKIPPQLSSLTKLGVLDLSHNKLSGNLDALSDLENLVSLNVSFNGLSGELPNTLFFHNLPLSNLAENQGLYIAGGVVTPGDKGHARSAMKFIMSILLSTSAVLVLLTIYVLVRTHMASKVLMENETWEMTLYQKLDFSIDDIVMNLTSANVIGTGSSGVVYKVTIPNGETLAVKKMWSSEESGAFNSEIQTLGSIRHKNIIRLLGWGSNKNLKLLFYDYLPNGSLSSLLYGSGKGKAEWETRYDVILGVAHALAYLHHDCLPAIIHGDVKAMNVLLGPGYQPYLADFGLARTATENGDNTDSKPLQRHYLAGSYGYMAPEHASLQPITEKSDVYSFGMVLLEVLTGRHPLDPTLPRGAHLVQWVRNHLSSKGDPSDILDTKLRGRADPTMHEMLQTLAVSFLCVSNKADERPTMKDVVAMLKEIRPLETSRADPNVLKGGLTAHSSPPPPKNVVSHGSSTCSYNFSDNSIN

SEQ ID NO: 224699 - protein, 123 aa, Glycine max
  Coding DNA Sequence Number=SeqID_107921
  Homolog annotation: Hit_ID=Q9FKU4; Match level="QueryCoverage=61%, HitCoverage=33%, E-value=5e-30, Identity=80%"; Hit description =Genomic DNA, chromosome 5, P1 clone:MDA7
  Pfam annotation: Domain name=SFT2; Domain location=1-84; Score=22.0; E_value=1.4e-06; Accession=PF07770.3; Description=SFT2-like protein
MVVMPQKFALCFTLGCGFIIGSFFALKGPKNQLAHMLSMERLPFTLAFLGSMIGTIYVSMVLHSYILSVVFSVVQVGTGCWEGYQTRAEAQHSIVHHNMGLHEQKDLCENVSVVLQDAVNGAV

SEQ ID NO: 224700 - protein, 89 aa, Glycine max
  Coding DNA Sequence Number=SeqID_107922
MHSKETLDVIAVKNLDKLPMTHNLRIGGLVSECLWKQLMSQIQPRVTMGGGEDNATKNQKAPFKGAHPTDPSRGQMEERTRGPNRGEYM

SEQ ID NO: 224701 - protein, 94 aa, Glycine max
  Coding DNA Sequence Number=SeqID_107923
MQGWFSGQSSEEEAKPASSLLADWNSYASAQSSEDSSAFPFDIESAVRSANDTVSGTFSVENDIMFVWFCRVNPRSVPEKLRVGNIGHILGLFR

SEQ ID NO: 224702 - protein, 154 aa, Glycine max
  Coding DNA Sequence Number=SeqID_107924
  Subcellular localization annotation: CTP_CleavageSite=39; ConfidenceScore=5.07e-01
MATGDFLHYKVASPSFKFMGLLVGINPRLSSRLVEDWFSGSSVEYKGTTFGMGFLKARRLIGSIGTRPGWFETYIQRKLFAWEEEQLTILLTQLNGVNLVHDRNDCWIWKLEVEKADKTWIGKIPKRTTTHTCGRVMLPLRYWSFHGDCFWTDS

SEQ ID NO: 224703 - protein, 175 aa, Glycine max
  Coding DNA Sequence Number=SeqID_107925
  Gene Ontology: Mol. function=peptidyl-prolyl cis-trans isomerase activity; Biological process=protein folding
  Homolog annotation: Hit_ID=Q6H725; Match level="QueryCoverage=44%, HitCoverage=36%, E-value=1e-17, Identity=59%"; Hit description =Immunophilin / FKBP-type peptidyl-prolyl cis-trans isomerase-like protein
MTCWGGQLMPSPELCMEDANLNYAESNRVSILTVDKFSRRMVLQFMGINHMLCYASPALAAPIMPDMKEPEVIRTLKLPSGVRVQEGEGPEAHDGDLVTFNCVCRRANGYFVFSTVDQFNGESNPVILPLDENQIKIFLRPCHILSTLLNNFKVVILIVGFQSMVILVKQKKRNM

SEQ ID NO: 224704 - protein, 88 aa, Glycine max
  Coding DNA Sequence Number=SeqID_107926
  Gene Ontology: Mol. function=peptidyl-prolyl cis-trans isomerase activity; Biological process=protein folding
  Homolog annotation: Hit_ID=Q6H725; Match level="QueryCoverage=71%, HitCoverage=30%, E-value=2e-23, Identity=81%"; Hit description =Immunophilin / FKBP-type peptidyl-prolyl cis-trans isomerase-like protein
  Pfam annotation: Domain name=FKBP_C; Domain location=4-75; Score= -0.5; E_value=0.0044; Accession=PF00254.18; Description=FKBP-type peptidyl-prolyl cis-trans i
MSMDACETSMLMLLMIVGLKEVLTGMKVGGKRRALIPPSVGYVNENLQPIPEEFGPRRSLFSHAQEPLVFEVQLLKILRPPPPPAAFN

SEQ ID NO: 224705 - protein, 280 aa, Glycine max
  Coding DNA Sequence Number=SeqID_107927
  Gene Ontology: Mol. function=calcium ion binding; Cellular component =membrane; Biological process=abscisic acid mediated signaling
  Homolog annotation: Hit_ID=Q008R7; Match level="QueryCoverage=74%, HitCoverage=91%, E-value=1e-105, Identity=93%"; Hit description =Calcineurin B-like protein 2-2
  Pfam annotation: Domain name=efhand; Domain location=123-151; Score =16.9; E_value=0.072; Accession=PF00036.22; Description=EF hand
  Pfam annotation: Domain name=efhand; Domain location=167-195; Score =27.7; E_value=4e-05; Accession=PF00036.22; Description=EF hand
  Pfam annotation: Domain name=efhand; Domain location=86-114; Score =24.8; E_value=0.00032; Accession=PF00036.22; Description=EF hand
  Pfam module annotation: Pfam domain module=efhand::efhand::efhand; Domain location=123-151::167-195::86-114
MLRCLEGLKPLFASILRCCDLDIYNQPRGLEDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKITLGSPKKDAYIYANRVQGHHHNIPELCISFTSRRYLKIISPMASSFGLHGHFCTKKGMADSLAFTLHLLYL

SEQ ID NO: 224706 - protein, 71 aa, Glycine max
  Coding DNA Sequence Number=SeqID_107928
MPKRVGRKIKPWRQKIGQQKREKKECEEEFVEVRWMIATNVSVKVTKVIWSMTDRVQPTRTSDNIFLYQMV

SEQ ID NO: 224707 - protein, 1295 aa, Glycine max
  Coding DNA Sequence Number=SeqID_107929
  Gene Ontology: Mol. function=transcription regulator activity; Cellular component=chromatin; Biological process=regulation of transcription, DNA-dependent
  Homolog annotation: Hit_ID=O48579; Match level="QueryCoverage=43%, HitCoverage=28%, E-value=1e-34, Identity=23%"; Hit description=Mi-2 autoantigen-like protein
  Pfam annotation: Domain name=SNF2_N; Domain location=140-411; Score= -74.1; E_value=0.00038; Accession=PF00176.13; Description=SNF2 family N-terminal domain
EYFVTYHGLAHAHNRWIPESKLLLEAPKLLAKFKRKLQEVSMKIISSFDAKLPGYHQVEKRLEYTPPGLGYDNATWELDDASFLTSPEGRKVIDDYESRRKRAERLSKNHFEANEERKASFSELSVLPTGDSPGFYNQHLTYVNKLRMCWHKGQSALIVDDQIDQERVMKVILFILSLNCNVRRPFLIISTSAALSVWETEFLRLAPSANLVVYKGDRDARSSIRALEFFNEHGGILFQILLSSSHIIVKDLHELRCITWEAIIIDECQQSRISGHLDDIKILKAEMRLLLVSGQIKEDQADYIKLLSLLKSGQHGSSIAQVETYFSASSTISNLKSQLEKYVVFKCKSGSTRFVEYWVPACLSHLQLEQYCSMLLSNLMLLCSGQKSDSVDALHDLIISIRKDSASSLSLKKLQSTCGSGSIGDILDDVLCQRFGKDCYVRYDRGYTPKSKQAALDTFNDGESGKFVFLMENRACLSSVKLSSVDTVILFDSDLEPQNDLRGLQRMSISSQFKQITVFRLYSFFTVEEKILMLAKEGIALDSNVRLLSQSICPTLLKWGASYLFNKLDDLHASVVSTPDTVDMSLLCDTTSELSSQLVCGADDTDCHGWSFISRIQQNGGEYARDVLLPGERIMKSGGEPCGFSWSDLEGRHPKWKFLPVSSQRIRNTVKHFDYGLRESECEKYTFIEKRTASKDNVDPKRRKVSKDNADPEWSKWTMNKVDPKRRKVSNDVVDSKGREASRNIVDSKYWKTRLKSKKNTRHPLTNETTGKIATNMQFSEKKNPPDIRNLPKPDISACLLEHEIDMKDSLALAKLYLNFDCKEEEATDVYSELWKHVKDFSNCVQNGLCVEKCNRSGASDSNMPELNDLAEEEKQKDFLGTCVSKLVKSVTNELNLQMKSPTTVVSQDLSCTHEICLSPNTPGSFPVEGDAISMESGSEDDRVNAITLITAEDSSVDHGSNDVNPVTGSLERQSPIRSTDITQSDGNVFEDPQILVNKVVAIDNGMNMSTHSAQLDSVEADAGTSASTAVPEVRRWYSVMSPVCDESTALKFPETTLPYMQPSDSNLWPLPQMAMSAIPSFPENNAASTVMPLDDIFRHSGEDHRYIHEAEVILEAPKDLNSSFVSPVIPQPFTSVPMNENATHAPHGITIPGFMNSDYSEAHSVTSEVSHLAYTDPLLGEMSIIENMNEEAFIDLLPIEMERIEKEKEEAFKIHEQKILQLQSDYEKEVEKLSVKYKMLLQNVNTEVALKRTELETQCELVLRNKVLAQVWTHNLDSCEGDVVQCSEQGTDHE

SEQ ID NO: 224708 - protein, 102 aa, Glycine max
  Coding DNA Sequence Number=SeqID_107930
STTQVDVPSTCTTKDVPSNVLRQSSQAVKPLKLCEWGYKIILRREKGDTRIQAVSPLFFWKREKRDTKRIQAEEEEEVQRDSEINVEKLLVKVVSVVQMQIK

SEQ ID NO: 224709 - protein, 92 aa, Glycine max
  Coding DNA Sequence Number=SeqID_107931
MTLDRECSVRENLLADECATIAYHDSGRVNSGGGQGKELGNAKGGRGRHSRYTRKVAGVGIPDSALRLNCEVFGSRRSYTSQSGSYGVIVDE

SEQ ID NO: 224710 - protein, 63 aa, Glycine max
  Coding DNA Sequence Number=SeqID_107932
  Subcellular localization annotation: CTP_CleavageSite=48; ConfidenceScore=5.51e-01
MCGKGASSLPKKNSKTSTSLPSRTLARWRHHSKGQDFGYVAVVGTTTRESTSASFCGGQGNTM

SEQ ID NO: 224711 - protein, 37 aa, Glycine max
  Coding DNA Sequence Number=SeqID_107933
MEVDEFVPSFLTPRILPLTVVASICYQCTNSSSKYPT

SEQ ID NO: 224712 - protein, 63 aa, Glycine max
  Coding DNA Sequence Number=SeqID_107934
MSSRRHPIALAIVSLDNATFIPKTLDAIVFLLINSTCLLKMVVISMLGIISIAGLFEEAIAES

SEQ ID NO: 224713 - protein, 138 aa, Glycine max
  Coding DNA Sequence Number=SeqID_107935
  Gene Ontology: Mol. function=oxidoreductase activity; Cellular component=membrane; Biological process=electron transport
  Homolog annotation: Hit_ID=Q2LAK3; Match level="QueryCoverage=66%, HitCoverage=25%, E-value=2e-46, Identity=91%"; Hit description =Cytochrome P450 monooxygenase CYP89H3
MGWDPKVWEDPMAFKPERFMNEEGFDITGSKEIKMMPFGAGRRICPGYNLALLHLEYFAANLVWNFEWKVPEGGNVDLSEKQEFTVVMKNALLCLSMRGWEWYIIGMDRYFFPVNFYMNHPRRFSPAIGISQQGNIVA

SEQ ID NO: 224714 - protein, 111 aa, Glycine max
  Coding DNA Sequence Number=SeqID_107936
MALEELKVIQLQQSNSAYAQPNYGFIWIFSNFWEPYMLVINYNSEHEQHNSLLEHHSDPSFDEHASGHHHSDIACSKRTKLLERLKRWVDAGSEKPRVRHSISKGAEEHYT

SEQ ID NO: 224715 - protein, 747 aa, Glycine max
  Coding DNA Sequence Number=SeqID_107937
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=95%, HitCoverage=96%, E-value=1e-167, Identity=45%"; Hit description =Protein kinase; Type I EGF
  Pfam annotation: Domain name=EGF_CA; Domain location=294-336; Score =33.9; E_value=5.7e-07; Accession=PF07645.6; Description=Calcium binding EGF domain
  Pfam annotation: Domain name=Pkinase; Domain location=416-698; Score =157.9; E_value=2.6e-44; Accession=PF00069.15; Description=Protein kinase domain
  Pfam annotation: Domain name=Pkinase_Tyr; Domain location=416-686; Score=129.8; E_value=7.5e-36; Accession=PF07714.7; Description =Protein tyrosine kinase
  Pfam module annotation: Pfam domain module=EGF_CA::Pkinase::Pkinase _Tyr; Domain location=294-336::416-698::416-686
MCRVLMLALALVVVIVAIAPHQTLSAPLNRTLPGCKSTCGNVEIPYPFGIGNSSTPDQRPCFLKPVFNLACNNSTLKWGTVTVLNISVPAHQVDVLQLVSWFCNSEDYWETWLTTGISRISRKENKFITVGCDSYGNLNSVYNDKTYTTGCLTRCYGNALVIDDGTCSGIGCCQVDIPPRMTNITIKAFAFTTSRRNISINNASVISNSTCSYSFVVKNGFYNFSTTHLKSFPNKTLPLVLDWTVGNKSCDDSKSRGDYACKENSYCDDKDSDYGYRCMCRDGYEGNPYLGCIDIDECKTGHHTCVSEKYCLNTNGSHKCFCPKGQSGNGTKEEGCHKKDVVTKVVIGVAAGTIILVVGTTLLYLIYQKRRLNKLREKYFQQNGGSILLQNLSTRENSSQIQIFTEEQLKKATNNFDESLIIGKGGFGTVYKGHLADNRIVAIKKSKIVDKSQNEQFANEVIVLSQINHRNVVKLLGCCLETEVPLLVYEFVNHGTLFDFIHTERNINDATWKTRVRIAAEAAGALSYLHSEASIPIIHRDVKTANILLDNTYTAKVSDFGASRFVPLDQTEIATMVQGTFGYLDPEYMRTSQLTEKSDVYSFGVVLVELLTVEKPYSFGKPEEKRSLTNHFLSCLKEGRLSDVVQVGIMNEENKKEIMEFSILAAKCLRLNGEERPSMKEVAMELEGMRLTEKHPWINTFQNPEEAHLLQKGSSSVCEPGDSSSHQYTIGYDSINDHVQIAFDDGR

SEQ ID NO: 224716 - protein, 168 aa, Glycine max
  Coding DNA Sequence Number=SeqID_107938
MVWYARITRSVSEGFQSFTNLTVTEIGTWNSLCGNRNISLLRSDLSDVVAVIMAPFSGDEMTPFFGFLGAVAALVFSCNSIPNFSIRSILGVSSWGGAASEISGIGVPPLTEAKAAPEPVNRNGEILLHVGSNAASGETDLLATLGEKIMYEYWIFLRPIIDPGEANS

SEQ ID NO: 224717 - protein, 218 aa, Glycine max
  Coding DNA Sequence Number=SeqID_107939
  Homolog annotation: Hit_ID=Q2LAK3; Match level="QueryCoverage=19%, HitCoverage=14%, E-value=9e-08, Identity=59%"; Hit description =Cytochrome P450 monooxygenase CYP89H3
MFMMKVWDENGLVMMCWPNRVDIMTCEIGITFIAPSFVMLFVMFVMVLYCLCIVGNLRPFFVKKVIRINNPQRQQVCVVEDPPTATKELNEEQQQPPVEGVTDIEGFPGEPHDTSVLRYFKNHIALRVWNGEERPKLKLSSHGRKMTKFERLALEIEGLVAASRLSLLIALKHMNTSKQNMAYSKFDFRLMSRVLRTHLRVPEKNYTQEEWSILEAFE

SEQ ID NO: 224718 - protein, 60 aa, Glycine max
  Coding DNA Sequence Number=SeqID_107940
  Homolog annotation: Hit_ID=Q2MGR2; Match level="QueryCoverage=72%, HitCoverage=22%, E-value=9e-09, Identity=64%"; Hit description=SGS; HSP20-like chaperone
LSSEEASAQIPAPISTGTKVAPSPALKYAALASFSWDQDSDKVKRRNKAICEGRPAMAVP

SEQ ID NO: 224719 - protein, 217 aa, Glycine max
  Coding DNA Sequence Number=SeqID_107941
MALSSAFHERLHHMDRTRIQRLSLLQAEKELQGNKYRVLASMLANIRATEQRCSWLDQKIASQHFKLLALKSQIENLEANHESLSLELRSMQNEVEELEELRVKRDCFYDAKWIEMKEFKEIADRFVVKCKVEVQSLRNRVNELRSSFVELRSSSGDSCNLEIAAAEMRRLELLAEKESVCRNIDYNQQVKAQLQKQLRSILITQTQDKGLEVKSNG

SEQ ID NO: 224720 - protein, 108 aa, Glycine max
  Coding DNA Sequence Number=SeqID_107942
MGKRKERRRLAALGNAGRRVKLDLFAEPSGELGGSTLHGDAGGDTDSQHRDGSPNSPSSSGQQPQNPLLLLGQYSDDEGDAGSSKGLNDANVQSPMLNEEGLMICNNL

SEQ ID NO: 224721 - protein, 233 aa, Glycine max
  Coding DNA Sequence Number=SeqID_107943
MNLVPFLSNNRLGMKASGISASQPYLFLLGLFEPKGFLLKKGWQNDVMGFCKGFTIPVGETPYVVIPISYIALCMSVKTFTYHVCFAITIGETHFTHPVPSSRDTMAMHAHPAWVSPMEFDLDGIETFLQNEFTSSRVILQTLQPLLLKRLRKWVACVSPIVLAKHMWTGSIRQCILRNQWWMVDGKMSRCMHETCMPRMECVSPVVMAKHIWHNDFFFVDMNSDGTLMGMAV

SEQ ID NO: 224722 - protein, 257 aa, Glycine max
  Coding DNA Sequence Number=SeqID_107944
  Gene Ontology: Mol. function=adenosine kinase activity; Cellular component=nucleus; Biological process=purine ribonucleoside salvage
  Homolog annotation: Hit_ID=Q1RYR5; Match level="QueryCoverage=100%, HitCoverage=68%, E-value=1e-109, Identity=75%"; Hit description =Adenosine kinase
MVSEGILLGIGNPLLDISAVVDQDFFKKYDITSNNAILAEDKHTPMAKLGYCSIGAFGTILHLEFGVSTRFEELVEKYNVEYIAGGATQNSIKVAQWMLQVPGATSYMGGIGKDKFGEEMKKNSRLAGVNVHYYEDETTPTGTCAVCIVGDDRSLVANLAAANCYKSDHLKRPENWALVEKAKYIYIAGFFLTVSPDSIQLVAEHAAANNKIFSMNLSAPFICEFFRDVQEKALPYTDFVFGYETEARTFSKVHGWE

SEQ ID NO: 224723 - protein, 163 aa, Glycine max
  Coding DNA Sequence Number=SeqID_107945
MRKHHEPLELFVARSRGLRLVGAFLSLKEEGEHHCCSWKGATRWPHSDHWALTYCCHLAWNFLFSFVYCSCCVESLVVIRDGDWGSDVQRVKFDGNHVFRCAHVTRHTIYKGGCYYCCENFVVVTFRHDDEVGIAELLRHGGVSKEGEEYFFLLGSVDIVIYD

SEQ ID NO: 224724 - protein, 43 aa, Glycine max
  Coding DNA Sequence Number=SeqID_107946
MILSRGERLNEGGATEDGGRSWRIQGVRKKVAGSMGVGGCFTR

SEQ ID NO: 224725 - protein, 96 aa, Glycine max
  Coding DNA Sequence Number=SeqID_107947
  Gene Ontology: Mol. function=catalytic activity; Biological process =metabolic process
  Homolog annotation: Hit_ID=Q9SJK4; Match level="QueryCoverage=95%, HitCoverage=72%, E-value=1e-22, Identity=57%"; Hit description =Putative auxin-induced protein
  Pfam annotation: Domain name=Auxin_inducible; Domain location=1-96; Score=75.5; E_value=1.7e-19; Accession=PF02519.5; Description=Auxin responsive protein
MGSRVIHCAAYSYCCEWEQWSSMHEDEGDSIPNDVPKGHLVVYVGEHHKRYVIKITLLNHPLFKTLLDQAKDEYDFIADSKLYIPCTEHLFLTVLR

SEQ ID NO: 224726 - protein, 58 aa, Glycine max
  Coding DNA Sequence Number=SeqID_107948
  Subcellular localization annotation: CTP_CleavageSite=23; ConfidenceScore=5.07e-01
MSIATFLRLSYFHPNLTLRKRLNGSKGSVFLCNSQGRCLMIDLSKFLKFRPHNLGRKR

SEQ ID NO: 224727 - protein, 157 aa, Glycine max
  Coding DNA Sequence Number=SeqID_107949
  Subcellular localization annotation: CTP_CleavageSite=48; ConfidenceScore=5.18e-01
MTEAKMLTTTSKGCSSSRHDHRQRNLLCRDVKNRSPIIFRSRSRPGLQAGSEFSCTGIWVFLPCQYGAPPPDSCKKTGCATPVLVPAKVIHALNLNIDELNVVGQPCFSSFFGVDYDALLARRNALLLLQKLSMWREEAENFEALRLPQEWTYKLLR

SEQ ID NO: 224728 - protein, 79 aa, Glycine max
  Coding DNA Sequence Number=SeqID_107950
MTARKWRESESGGRSMVCVGMENGRCHCSLCECCHGLYLVSLFAVKDQEGRRWREWKMKRTKEVLGFVSENESKSESNK

SEQ ID NO: 224729 - protein, 85 aa, Glycine max
  Coding DNA Sequence Number=SeqID_107951
GHVSLGRIEGLRNRWDIWPTTEKSRWKGKSDGKKANINNPKSSVESVNYHHSKLKGNYNDVVGTSQEDGGNRNLDGKFKHRVVHA

SEQ ID NO: 224730 - protein, 104 aa, Glycine max
  Coding DNA Sequence Number=SeqID_107952
HRGVKLGAAVQHDASSSGENEGFRRVFYDGVDQQSNTTRVRQSHEKGLAMMKTTTMPMRLCTSTTPFWVFVNSRTRSRIPSLPRLARVCAKSDESTPFLILLPI

SEQ ID NO: 224731 - protein, 140 aa, Glycine max
  Coding DNA Sequence Number=SeqID_107953
  Homolog annotation: Hit_ID=Q9SJK5; Match level="QueryCoverage=61%, HitCoverage=36%, E-value=2e-23, Identity=63%"; Hit description =Translin-like protein
  Subcellular localization annotation: CTP_CleavageSite=54; ConfidenceScore=5.69e-01
MQYMKPAFRNAAFYCHAFSRSLTLNSNPLHLVSPFGRPQTFRLAPPISCFSSLMASSLEKQFDDFRVQFEESGTLRERIRSVVSEIESSTRLIYVTLLLVHQSRPTPELLEKAKSQVNVLKKQYKQLAEVVGGYPGQYYR

SEQ ID NO: 224732 - protein, 96 aa, Glycine max
  Coding DNA Sequence Number=SeqID_107954
MAEVHGRVAPSSGYSSPDHLGTMDTIPISLDTRNEGFYGGKSKYLQEELGKTMHIIPLSLGARDEGYYVYGGKSKYLQKEHSRTMHIVPLSLSARN

SEQ ID NO: 224733 - protein, 281 aa, Glycine max
  Coding DNA Sequence Number=SeqID_107955
  Gene Ontology: Mol. function=protein kinase activity; Cellular component=cytoplasm; Biological process=protein amino acid phosphorylation
  Homolog annotation: Hit_ID=Q9LZF8; Match level="QueryCoverage=100%, HitCoverage=65%, E-value=1e-105, Identity=68%"; Hit description =Protein kinase-like
  Pfam annotation: Domain name=Pkinase; Domain location=88-281; Score =19.2; E_value=1e-09; Accession=PF00069.15; Description=Protein kinase domain
  Pfam annotation: Domain name=Pkinase_Tyr; Domain location=88-281; Score=-6.7; E_value=4.7e-12; Accession=PF07714.7; Description =Protein tyrosine kinase
  Pfam module annotation: Pfam domain module=Pkinase::Pkinase_Tyr; Domain location=88-281::88-281
MKCFPFSYGEKKDEPKGLQLQSTSGRSDNSMCVEAEVRRSGSELNSQDVSDNGSSESQRRNAIPSLSQRPSNLRVFTVSELKSATKNFSRSVMIGEGGFGCVYLGLIRSAEDSSRRIEVAVKQLSKRGMQGHREWVTEVNVLGIVEHPNLVKLVGYCADDDERGIQRLLIYEYMPNRSVEHHLSHRSETPLPWTRRLKIARDAARGLTYLHEEMDFQIIFRDFKSSNILLDEQWNAKLSDFGLARLGPSDGLTHVSTAVVGTMGYAAPEYVQTGRLTSKND

SEQ ID NO: 224734 - protein, 414 aa, Glycine max
  Coding DNA Sequence Number=SeqID_107956
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9C8R3; Match level="QueryCoverage=84%, HitCoverage=93%, E-value=1e-136, Identity=66%"; Hit description=Beta- 1,3-glucanase, putative; 75043-73120
  Pfam annotation: Domain name=Glyco_hydro_17; Domain location=32-350; Score=355.2; E_value=1.1e-103; Accession=PF00332.9; Description =Glycosyl hydrolases family 17
MATFIRRIAISYILVTLFFSSDIGFFGRVASFGINYGQVANNLPPPDKVLELFSNLKVTKTRIYDTNPQILTAFAKSNVEVIVTVENNMLSQLNDPQQALQWVSGHIKPYLPDTKITGIQVGNELYTNGDKTLIQYLVPAVVNIHNALVQLGLDSNIHVSTPSSLEVLQESYPPSAGSFKSEISGIMSQFLNFLATTKAPFWINAYPYFAYKDDPNRIPLDYVLFNPNEGMVDPYTNLHYDNMLYAQVDAVSFAIAKLGFSGIEVRVSETGWPSQGDPNEIGASVQNAQTYNRNLLRRQMANEGTPFSPRMRLEAYIFALFNEDMKSGATSERNYGLFQPDETMAYNVGLAAFADSSTSSTSISLTSSATKIKGSFTVLKDGAIWVFSLLKGIFFAGFKLETSLWSIPVHIFKP

SEQ ID NO: 224735 - protein, 122 aa, Glycine max
  Coding DNA Sequence Number=SeqID_107957
  Gene Ontology: Cellular component=mitochondrion
MTAFYLQFGGCDVYNPKDSKVITLNHPVTASKRGKIDVLKSAREAVQFGLTGSALGALFTAGYAWKYSKSLHGAGLSFLAGGIFGWTFGHEIANHTLQLYRVDTLAAEAKFLDWWNKKTGGY

SEQ ID NO: 224736 - protein, 53 aa, Glycine max
  Coding DNA Sequence Number=SeqID_107958
MVVLPLLKDLSSFAPSDVKTNIRSLGQIRDCEEDLVNVSKEEVESLLFMSQPS

SEQ ID NO: 224737 - protein, 123 aa, Glycine max
  Coding DNA Sequence Number=SeqID_107959
MLHQHNVFAQSFRMDNERDTNGRIYNLPTVSKVDALIVGDEDISLNMGIILETQSENADDSEMQCKDEVKQYLDCRCWQVRKQDYTIGRLNWVPPTIGGLFYLRMILFVAKGPCSFKDIRIVS

SEQ ID NO: 224738 - protein, 145 aa, Glycine max
  Coding DNA Sequence Number=SeqID_107960
MHTTCTNNNNNEIIICLNLEQENKEFDVFLKNLATQDSSPQPPKVIAPTMDEILVVLAPTDEVLVAPAFAPQRVLDPFPVSAPAPKRVYTYVNFVPIPPTCTAQVPAPQRVLASQVPTKSSEETFNNIAFEQIYVLSSYPHNLLP

SEQ ID NO: 224739 - protein, 156 aa, Glycine max
  Coding DNA Sequence Number=SeqID_107961
  Gene Ontology: Mol. function=protein serine/threonine kinase activity; Cellular component=cytoplasm; Biological process=protein amino acid phosphorylation
  Homolog annotation: Hit_ID=Q8LKU7; Match level="QueryCoverage=95%, HitCoverage=17%, E-value=7e-65, Identity=80%"; Hit description =Putative serine/ threonine kinase
  Pfam annotation: Domain name=Pkinase; Domain location=3-153; Score =30.6; E_value=2.2e-10; Accession=PF00069.15; Description=Protein kinase domain
  Pfam annotation: Domain name=Pkinase_Tyr; Domain location=3-154; Score=-55.1; E_value=4.3e-09; Accession=PF07714.7; Description =Protein tyrosine kinase
  Pfam module annotation: Pfam domain module=Pkinase::Pkinase_Tyr; Domain location=3-153::3-154
MAGKGSYGAVYKARDLRTSEMVAIKVISLSEGEEGYEEIRGEIEMLQQCNHPNVVRYLASYQGEEYLWIVMEYCGGGSVADLMSVTDEPLDEGQIAYICREALKGLDYLHSIFKVHRDIKGGNILLTEQGDVKLGDFGVAAQLTRTMSKRNTVFDA

SEQ ID NO: 224740 - protein, 107 aa, Glycine max
  Coding DNA Sequence Number=SeqID_107962
MVGGGHWRMEEQMGSSTNNGWEWKLTWRRSLFDAEVEMADNFLGEISQQQVDSSREDTWIWKPETCGYYSTKSGYNLIWGETMGASLNSDFQDLWKLKIPAKAAVFA

SEQ ID NO: 224741 - protein, 193 aa, Glycine max
  Coding DNA Sequence Number=SeqID_107963
  Gene Ontology: Mol. function=peptidase activity
  Homolog annotation: Hit_ID=Q10AA4; Match level="QueryCoverage=94%, HitCoverage=57%, E-value=5e-09, Identity=29%"; Hit description=OTU -like cysteine protease family protein, putative, expressed
MALYEHSDVFQWGLNLLDGDPAYSPGYNSNIIQKDDNECNNEETDGMITRKLQEEFSQLEIAEYSGYLQGGEQQFHVPDTQPAYDWNSSSMVNYCSEGYDYAQEGIGNGEPSSSCSRPCETEEYSLELTDNYPLDDEVGRRLSQMIPIHIFVSSTCLTKLGKILNRLQLYDFVEHKVQGDGNCQAGGWLAQGQ

SEQ ID NO: 224742 - protein, 53 aa, Glycine max
  Coding DNA Sequence Number=SeqID_107964
MPDLPFQVGDLAESRCFEKVVIVVHGLDASDSKRYGGESNTYSFFLTQQILIL

SEQ ID NO: 224743 - protein, 134 aa, Glycine max
  Coding DNA Sequence Number=SeqID_107965
  Gene Ontology: Mol. function=microtubule binding; Cellular component =cortical microtubule, transverse to long axis; Biological process =positive regulation of microtubule polymerization
  Homolog annotation: Hit_ID=Q6ASW5; Match level="QueryCoverage=97%, HitCoverage=17%, E-value=7e-20, Identity=43%"; Hit description =Putative microtubule-associated protein
MQLKDVVAKLFELWNLMDSSKEERNCFMKITSIVETSESEITERSVISTEMIEKASAEVDRLAKLKASRMKELVFKKRSELEEICRLTHIEPDPSTVAEKASALIDSGMFLCINRLLTYNLLVAYVSERLSSAT

SEQ ID NO: 224744 - protein, 106 aa, Glycine max
  Coding DNA Sequence Number=SeqID_107966
MNKSSQADSSLRKRNTPYLHFAPNKFLKTQNSETPKKEKDLKFYEQSSASRASADTSAMSPNGQHCYQKYETLFQRGKEKREKQRTKKEDNAFLGYGGLMLKCAKM

SEQ ID NO: 224745 - protein, 87 aa, Glycine max
  Coding DNA Sequence Number=SeqID_107967
  Subcellular localization annotation: CTP_CleavageSite=25; ConfidenceScore=5.25e-01
MFSSSPPFPSSSSPSVTMLHEQAAPAVASWSSSSAAQHFPTSVLLQEQRDEYKPLLHVHNKEVQFLFIYQLLHCWACLNANNKGLFG

SEQ ID NO: 224746 - protein, 127 aa, Glycine max
  Coding DNA Sequence Number=SeqID_107968
MTDVVPDVTTSRFRTCRLYLTPLFTTFSPNHYPCNLYLRATLRYENPSHSLSNTLPCLQINQRHTRDCSLNKRDQLYTLEINSTHSGPTLDVRVTSRWLTKHSSPKTHKITLQSRTWYRTRAAFMFI

SEQ ID NO: 224747 - protein, 185 aa, Glycine max
  Coding DNA Sequence Number=SeqID_107969
MSDLTLACTDTPLKCGVAHYSLTCTRFISAQLFDNDDLRGAMETIVQNPQLNSTEFYVVTDLIPQPQPSSPQPSCPPLQLPPPQQLSYNNIDLNNPVSSYNNLESQDPFDMYTSYTQLLSENDYFFHAQQTSFDQQNHLSSLFTSPSQLPQTQTSNQDEHPIANEDPIIRFHNENMDDSSEDEDQ

SEQ ID NO: 224748 - protein, 832 aa, Glycine max
  Coding DNA Sequence Number=SeqID_107970
  Gene Ontology: Mol. function=nucleoside-triphosphatase activity; Cellular component=nucleus; Biological process=protein transport
  Homolog annotation: Hit_ID=Q9LZF6; Match level="QueryCoverage=99%, HitCoverage=100%, E-value=0.0, Identity=84%"; Hit description=Cell division control protein 48 homolog E
  Pfam annotation: Domain name=AAA; Domain location=268-452; Score =330.8; E_value=2.4e-96; Accession=PF00004.19; Description=ATPase family associated with various cellular activities (AAA)
  Pfam annotation: Domain name=AAA; Domain location=541-728; Score =340.5; E_value=2.8e-99; Accession=PF00004.19; Description=ATPase family associated with various cellular activities (AAA)
  Pfam annotation: Domain name=AAA_2; Domain location=264-393; Score= -23.6; E_value=0.00056; Accession=PF07724.4; Description=ATPase family associated with various
  Pfam annotation: Domain name=AAA_5; Domain location=268-400; Score =11.7; E_value=0.00023; Accession=PF07728.4; Description=ATPase family associated with various
  Pfam annotation: Domain name=Arch_ATPase; Domain location=245-410; Score=-96.1; E_value=0.06; Accession=PF01637.9; Description=Archaeal ATPase
  Pfam annotation: Domain name=CDC48_2; Domain location=147-220; Score =4.3; E_value=0.085; Accession=PF02933.7; Description=Cell division protein 48 (CDC48), dom
  Pfam annotation: Domain name=CDC48_N; Domain location=27-137; Score =103.9; E_value=4.7e-28; Accession=PF02359.8; Description=Cell division protein 48 (CDC48), N-t
  Pfam annotation: Domain name=ResIII; Domain location=249-380; Score= -39.4; E_value=0.093; Accession=PF04851.6; Description=Type III restriction enzyme, res subunit
  Pfam annotation: Domain name=Sigma54_activat; Domain location=234 -396; Score=-175.0; E_value=0.0063; Accession=PF00158.16; Description= Sigma-54 interaction domain
  Pfam annotation: Domain name=Vps4_C; Domain location=741-798; Score= -18.8; E_value=0.099; Accession=PF09336.1; Description=Vps4 C terminal oligomerisation domain
  Pfam module annotation: Pfam domain module=AAA::AAA::AAA_2::AAA _5::Arch_ATPase::CDC48_2::CDC48_N::ResIII::Sigma54_activat::Vps4_C; Domain location=268-452::541-728::264-393::268-400::245-410::147 -220::27-137::249-380::234-396::741-798
MASQPESSDAKGTKRDFSTAILERKKAPNRLVVDEAVNDDNSVVALHPDTMEKLQLFRGDTILIKCLLANIVFPLLLRMMVIRVWAQEKGKKRKDTICIALADETCEEPKIRMNKVVRNNLRVRLGDVVSVHQCPDVKYGKRVHILPVDDTIEGVTGNLFDAYLKPYFLEAYRPVRKGDLFLVRGGMRSVEFKVIETDPSEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLEKIAKDTHGYVGADLAALCTEAALQCIREKMDVIDLEDETIDAEILNSMAVTNEHFQTALGSSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRKRDNPEAMEEDDVEDEIAEIKAAHFEESMKYARRSVSDADIRKYQAFAQTLQQSRGFGSEFRFADSTSAGGTAAASDPFSSAGGADEDDLYN

SEQ ID NO: 224749 - protein, 449 aa, Glycine max
  Coding DNA Sequence Number=SeqID_107971
  Gene Ontology: Mol. function=protein serine/threonine kinase activity; Biological process=protein amino acid phosphorylation
  Homolog annotation: Hit_ID=Q1PF03; Match level="QueryCoverage=92%, HitCoverage=55%, E-value=2e-64, Identity=37%"; Hit description =Protein kinase family protein
MNRRGNEAIICNINSSSASSQSYQLDNNIKDLFLTFHCYCRRKEIQCLDVLLEDTDVVKAITEYVSYAAIENLVVGATSRHGFIRFKSSASSSISKGAPDFCNVSVISKGKVSSVRKATRPTSHTSPLLSHIHDLNNRGKNQHEISSRPMNLGDRTSIKPHGWLDESIKSPFVRGRGMDGMSCMDFPESDTDISFVSSERPSSGRSSSVYDYIDVGRTSRVSTNSDRSFGSTRLGALKFNNPNSPDTSFSHESSATSFSYSLQSEDEAAEADMRRLKLQLKQTIKMYSTACRQALASQQKLMELTHLRLEEEKKIQEARLAQEAAMAIAEKEKARCRVAMETAEASKKIAEVETHRRAGVEVKALKEVEEKRKLLDNLALTDVRYRRYCVEEIEAATNYFSELQRIGEGGYGPVYKCYLDHTPVAVKVLRPDAAQGKSQFQQEVINQWA

SEQ ID NO: 224750 - protein, 134 aa, Glycine max
  Coding DNA Sequence Number=SeqID_107972
  Homolog annotation: Hit_ID=Q2QNG6; Match level="QueryCoverage=77%, HitCoverage=71%, E-value=1e-14, Identity=43%"; Hit description =Expressed protein
MGLALTVGFLGLLILFHAAYSTIQCILKLIIKLVLLFECWGSWISNLGLIFVADRGVLKITEEEFSGLPFEVVIELFLGLLLCFWTALTAPGKFLSIHPHSEENRGGEWYSRGINFGIISFGRLSFITLGNIAD

SEQ ID NO: 224751 - protein, 166 aa, Glycine max
  Coding DNA Sequence Number=SeqID_107973
  Homolog annotation: Hit_ID=Q2HRX8; Match level="QueryCoverage=71%, HitCoverage=19%, E-value=3e-11, Identity=32%"; Hit description=IMP dehydrogenase/GMP reductase
  Pfam annotation: Domain name=DUF1723; Domain location=89-138; Score =45.5; E_value=1.9e-10; Accession=PF08330.1; Description=Protein of unknown function (DUF1723)
MQRATAAVVGDARHVDDAAEEVFQHAKEAGVDAQDFPGGPHDTLVMAAYADHVVVIVLNGEERPELKLSSHGRKVQKFESHLIACSLDTGDQGLISTFVERWHKETSNFHLLVGEVTITLDDVTSLLHLSIISAFHDFDTFHVDEAVLMLMELLEVTGDKARAETI

SEQ ID NO: 224752 - protein, 268 aa, Glycine max
  Coding DNA Sequence Number=SeqID_107974
  Gene Ontology: Mol. function=protein serine/threonine kinase activity; Cellular component=ubiquitin ligase complex; Biological process=protein amino acid phosphorylation
  Homolog annotation: Hit_ID=Q1S3M6; Match level="QueryCoverage=84%, HitCoverage=28%, E-value=5e-95, Identity=73%"; Hit description =Protein kinase; UspA
  Pfam annotation: Domain name=Pkinase; Domain location=2-204; Score= -23.6; E_value=3.7e-07; Accession=PF00069.15; Description=Protein kinase domain
  Pfam annotation: Domain name=Pkinase_Tyr; Domain location=1-208; Score=-89.3; E_value=5.5e-07; Accession=PF07714.7; Description =Protein tyrosine kinase
  Pfam module annotation: Pfam domain module=Pkinase::Pkinase_Tyr; Domain location=2-204::1-208
MVLLLGACPEYGILIYEYMANGSLEDCLFKKKNKRVLSWQLRFRIAAEIGTGLLFLHQAKPEPLVHRDLKPGNILLDQNYVSKISDVGLARLVPAVAENVTQCCMTSAAGTFCYIDPEYQQTGMLGVKSDVYSLGIIFLQLLTGRAPIGLAHHAEESIEKDTFVEMLDPSVTDWPLEQALCLAKIAVKCAELRRKDRPDLAKLVLPELDKLRDFAEQNMTMTMPIILGCTAPSPSHSEASMQQDVISDLQLAHSESSSAPSTPTEGKP

SEQ ID NO: 224753 - protein, 146 aa, Glycine max
  Coding DNA Sequence Number=SeqID_107975
  Gene Ontology: Mol. function=nucleic acid binding; Biological process= DNA integration
  Pfam annotation: Domain name=zf-CCHC; Domain location=35-52; Score =3.2; E_value=0.29; Accession=PF00098.13; Description=Zinc knuckle
  Pfam annotation: Domain name=zf-CCHC; Domain location=56-73; Score =5.1; E_value=0.14; Accession=PF00098.13; Description=Zinc knuckle
  Pfam module annotation: Pfam domain module=zf-CCHC::zf-CCHC; Domain location=35-52::56-73
MREEWSIEYAFQVKAENSRGGKYRNNYKNKEDSSPACSHCKKTNHSQQKCRWRPDVKCKKCGNLQHMELVCKSPPNEVKIVTKQYEEDLLVIACLTTSNTSTNFWLIDSGCTNHRINDQELFKKLDRTFISKVKFGNGEFILVNGK

SEQ ID NO: 224754 - protein, 107 aa, Glycine max
  Coding DNA Sequence Number=SeqID_107976
  Homolog annotation: Hit_ID=Q8S8L5; Match level="QueryCoverage=62%, HitCoverage=55%, E-value=2e-15, Identity=60%"; Hit description =Expressed protein
  Pfam annotation: Domain name=Auxin_inducible; Domain location=2-102; Score=47.7; E_value=3.9e-11; Accession=PF02519.5; Description=Auxin responsive protein
MLGSCVKKLQKSVSLLFVHSNEDQLEAAATLVPEDVMEGHFAVLAIKGEETRRFVVKLDYLADPMFMELLNQAREEYGFKQKGALAVPCRPQELQNVLDGPRAKAER

SEQ ID NO: 224755 - protein, 77 aa, Glycine max
  Coding DNA Sequence Number=SeqID_107977
MDYAHPKGTSAAIQQIKVFLTVFVHPAYVGAKIFPPNSQIRGMQKWLKLCRWEDNHYAFMKGRIYGQQSKLKATATG

SEQ ID NO: 224756 - protein, 77 aa, Glycine max
  Coding DNA Sequence Number=SeqID_107978
  Subcellular localization annotation: CTP_CleavageSite=35; ConfidenceScore=5.26e-01
MAARPSELRLSPKVISSPRQAGSFTLKSFSGREPKASLGKLGSRKLKEKTLLPPLFGIFRILDQNIERFFILCGNWG

SEQ ID NO: 224757 - protein, 57 aa, Glycine max
  Coding DNA Sequence Number=SeqID_107979
MALASTKNSLDHCRLKNIINKLGTRRNDVSNLPRDFKVFHEILSSHSLSHSLHLASD

SEQ ID NO: 224758 - protein, 349 aa, Glycine max
  Coding DNA Sequence Number=SeqID_107980
  Gene Ontology: Mol. function=DNA binding; Biological process=DNA integration
  Homolog annotation: Hit_ID=Q8H897; Match level="QueryCoverage=56%, HitCoverage=20%, E-value=8e-09, Identity=28%"; Hit description =Putative retroelement
  Pfam annotation: Domain name=Transposase_23; Domain location=138-208; Score=-1.2; E_value=0.0015; Accession=PF03017.5; Description =TNP1ENSPM transposase
MARTKKTGQMTSKATKKIVEKIDSLEEQASQGSFVTHGRQDVLTIAIGRPEHPGRVRATRADVTIKQYFGPAPRTSRTSSYMAPEDLEQLTQQIRDQLEESIIEKGLALPPEPKVGPSVVCVSTKESCVDPLGNDPDTGDSNKCGLYVEENPSRLVALGRLYEGSITVHNIPLLHDQVKVSVEEVRDANAPIPVPTEEVKLMWQALNTFLAWPTHLVKRLSEQVMWDAIVFGVFNENFPLYIKHEDLSEIAHGGQCLSISVIQLWILYMTETSMRAGNVDVYGFKKTTVHPEIWAIALKSKSYIKNWMQNSKRDVYLGAYLNGIITYIGLQCNAHWQMVVILPKENVVI

SEQ ID NO: 224759 - protein, 71 aa, Glycine max
  Coding DNA Sequence Number=SeqID_107981
  Gene Ontology: Mol. function=sequence-specific DNA binding; Cellular component=nucleus; Biological process=regulation of transcription, DNA-dependent
  Homolog annotation: Hit_ID=Q3Y4G8; Match level="QueryCoverage=84%, HitCoverage=23%, E-value=5e-14, Identity=63%"; Hit description=MADS -box protein
LEEINSRNHYRQSWEAGDQSMPYGGGGPENSHSHSHSQGFFQPLECNPTLHIGYNAVASDQITATTQPQQP

SEQ ID NO: 224760 - protein, 79 aa, Glycine max
  Coding DNA Sequence Number=SeqID_107982
  Gene Ontology: Mol. function=sequence-specific DNA binding; Cellular component=nucleus; Biological process=regulation of transcription, DNA-dependent
  Homolog annotation: Hit_ID=Q400I4; Match level="QueryCoverage=76%, HitCoverage=29%, E-value=4e-27, Identity=100%"; Hit description=AGL2- like MADS box transcription factor
  Pfam annotation: Domain name=SRF-TF; Domain location=9-59; Score =121.8; E_value=2e-33; Accession=PF00319.9; Description=SRF-type transcription factor (DNA-binding and dimerisation domain)
MGRGRVELKRIENKINRQVTFAKRRNGLLKKAYELSVLCDAEVALIIFSNRGKLYEFCSSSRDGRFIRSSNMAHDLVNI

SEQ ID NO: 224761 - protein, 279 aa, Glycine max
  Coding DNA Sequence Number=SeqID_107983
  Gene Ontology: Mol. function=DNA binding; Cellular component=nucleus; Biological process=regulation of transcription, DNA-dependent
  Homolog annotation: Hit_ID=Q9LRU5; Match level="QueryCoverage=76%, HitCoverage=73%, E-value=2e-46, Identity=47%"; Hit description=MYB -related transcription factor-like protein
  Pfam annotation: Domain name=Myb_DNA-binding; Domain location=16-63; Score=44.3; E_value=4.3e-10; Accession=PF00249.21; Description=Myb -like DNA-binding domain
  Pfam annotation: Domain name=Myb_DNA-binding; Domain location=69-114; Score=36.1; E_value=1.2e-07; Accession=PF00249.21; Description=Myb -like DNA-binding domain
  Pfam module annotation: Pfam domain module=Myb_DNA-binding::Myb_DNA -binding; Domain location=16-63::69-114
MVAMKGSLATQKEWRKGPWIGEEDKLLCEYVSLHGEGRWSSVAKLTGLNRSGKSCRLRWVNYLRPGLKKAQLTPREEEMIIELHAILGNKWSTIAKYLPGRTDNEIKNYWRTHSGKRERSKHNKKLQRPKVKNVLKQLKQKQQHEQQPQEYDIKSSMSHEETENETKSFHTQNNNQQEILEMGFMYPTTIEHQYTVPSMHDGFSSTWQDTLADDGSWFSLWDFDEPQGFSDYVDQFGKCAMPNQTSFGAGGDYSMQNHVKTSCFVDTYDSLFYGKDMFV

SEQ ID NO: 224762 - protein, 258 aa, Glycine max
  Coding DNA Sequence Number=SeqID_107984
  Gene Ontology: Mol. function=DNA binding; Cellular component=nucleus; Biological process=regulation of transcription, DNA-dependent
  Homolog annotation: Hit_ID=Q9LRU5; Match level="QueryCoverage=78%, HitCoverage=72%, E-value=6e-50, Identity=47%"; Hit description=MYB -related transcription factor-like protein
  Pfam annotation: Domain name=Myb_DNA-binding; Domain location=16-63; Score=38.1; E_value=2.9e-08; Accession=PF00249.21; Description=Myb -like DNA-binding domain
  Pfam annotation: Domain name=Myb_DNA-binding; Domain location=69-114; Score=37.2; E_value=5.7e-08; Accession=PF00249.21; Description=Myb -like DNA-binding domain
  Pfam module annotation: Pfam domain module=Myb_DNA-binding::Myb_DNA -binding; Domain location=16-63::69-114
MEAMMGSLATEKEWRKGPWTGEEDKLLSEYVCFNGEGRWSSVAQCTGLKRNGKSCRLRWVNYLRPGLKRGQLTPIEVGIIIELHAIFGNKWSTIAKYLPGRTDNDIKNYWRTHFEKSGKSKHKKLEMQKAKVLKQLKQKQQPQEYDVKSIKSHEETKNETKSYETENNKQKEVDFMCPTMEHQYIVPSMHEGFSSTWPDTVLGDDGSWFSLWDFDDEPQCSADYVNQFSESVVPNQATFGVGEDSMQNHDKIFYFDDI

SEQ ID NO: 224763 - protein, 74 aa, Glycine max
  Coding DNA Sequence Number=SeqID_107985
  Subcellular localization annotation: CTP_CleavageSite=52; ConfidenceScore=5.71e-01
MKYMQFQLSLAHQWAKHPSTAKRNFSVLSVTEKSGRASTSRSCAKHKISALSAAVVFSQAQRTTGAKLKSTYSF

SEQ ID NO: 224764 - protein, 79 aa, Glycine max
  Coding DNA Sequence Number=SeqID_107986
MEKEMITMIVDTLPVFYYEKMVGYMPSCFVGLVFAGDRIEVGLKSGKFDYAASMNSGDRRPRANGGNKKEGETHVLVVY

SEQ ID NO: 224765 - protein, 129 aa, Glycine max
  Coding DNA Sequence Number=SeqID_107987
MVEREKFDHIEETLWAIEGGGNYAFADMVELCLVPDVIIPPKFKVPNFNKYKGTTCPENHLKMYNKKMGAYSKNEKLLMHFFQESLTVAAVTWYTNLEPSWVHSWKDLMVAFIRQYQYNFDMALDRMQL

SEQ ID NO: 224766 - protein, 78 aa, Glycine max
  Coding DNA Sequence Number=SeqID_107988
MTGEWISPHIWIVLLKRQLSCINQALYLMLDGHTLLYKIPRNTTLIGASCIGIVPSGERGLIDLPGVHHNHLVVDQRW

SEQ ID NO: 224767 - protein, 41 aa, Glycine max
  Coding DNA Sequence Number=SeqID_107989
MELWKKKVRWVALQAWQISKGVSAKENKAISDILLDMAHML

SEQ ID NO: 224768 - protein, 110 aa, Glycine max
  Coding DNA Sequence Number=SeqID_107990
  Gene Ontology: Mol. function=oxidoreductase activity, acting on CH-OH group of donors; Biological process=electron transport
  Homolog annotation: Hit_ID=Q6K9N5; Match level="QueryCoverage=96%, HitCoverage=17%, E-value=3e-09, Identity=43%"; Hit description =Putative alcohol oxidase
MEGRESRHPLLRGGRKREEKSYKHVLSTTQMHVMAAICDALIPSLPLNKDTSQDQALSDFYNTSASQQPFPDEAARSGVVGELGSVDVVFQIGDAVDLWKTLLGLEAAFR

SEQ ID NO: 224769 - protein, 170 aa, Glycine max
  Coding DNA Sequence Number=SeqID_107991
MRPLLQRLVNPLQSSSFIPRRGTSDNAIVLKEIIHSMSKSKKKKGDVVFKLDLEKGSLLEVVDEGLCGSRTFHINNNGRWISHLFFVDDVLLFAKANPSQVRLSLVQDVWDDGHWDISSLFTNIPHDTVEKLNRLRIWLHSNSSDIIVWKGSISETTCYGFLNLASSIQD

SEQ ID NO: 224770 - protein, 463 aa, Glycine max
  Coding DNA Sequence Number=SeqID_107992
  Gene Ontology: Mol. function=protein serine/threonine kinase activity; Cellular component=plasmodesma; Biological process=protein amino acid phosphorylation
  Homolog annotation: Hit_ID=Q8LPJ1; Match level="QueryCoverage=82%, HitCoverage=80%, E-value=1e-178, Identity=80%"; Hit description =Protein kinase ADK1-like protein
  Pfam annotation: Domain name=Pkinase; Domain location=9-278; Score =140.4; E_value=5e-39; Accession=PF00069.15; Description=Protein kinase domain
  Pfam annotation: Domain name=Pkinase_Tyr; Domain location=9-273; Score=-131.7; E_value=0.00022; Accession=PF07714.7; Description =Protein tyrosine kinase
  Pfam module annotation: Pfam domain module=Pkinase::Pkinase_Tyr; Domain location=9-278::9-273
MDHVIGGKFKLGRKIGSGSFGELYIAVNIQTGEEVAVKLEPVKTKHPQLHYESKLYMLLQGGTGIPHLKWFGVEGDYNVMAIDLLGPSLEDLFNYCNRKLTLKTVLMLADQLINRVEYMHSRGFLHRDIKPDNFLMGLGRKANQVYIIDYGLAKKYRDLQTHRHIPYRENKNLTGTARYASVNTHLGIEQSRRDDLESLGYVLMYFLRGSLPWQGLKAGTKKQKYDKISEKKMSTSLEGLCKSYPSEFVSYFQYCRTLRFEDKPDYSYLKRLFRDLFIREGYQFDYVFDWTILKYPQIGGSSSRGRHESGKAAMHAGPSVQKPEKVSVGKEIREKFSGAVEAFSRRNPTSPSPRGDHSKRRSFEEVAVHKDVYHDQEKGRNSSRYGSSSRRPIISSSTRPSSSGDHTDSRTGRLTSSGSRQSATHRNIQPMHETKQPTYTRSGSTRGNRDDPLRSFELLSIRK

SEQ ID NO: 224771 - protein, 233 aa, Glycine max
  Coding DNA Sequence Number=SeqID_107993
  Homolog annotation: Hit_ID=Q71KW4; Match level="QueryCoverage=91%, HitCoverage=95%, E-value=8e-18, Identity=29%"; Hit description =Desiccation-associated protein
  Pfam annotation: Domain name=PBD; Domain location=31-132; Score=35.2; E_value=2.3e-07; Accession=PF00786.18; Description=P21-Rho-binding domain
MSNNNKVKGLLKGLRFISQIFDTDEKDSEIQISNPTDVRHVGHIGLDGHDGPSENDPSWMNEFKPDDSVQRTSQDSNEFPKSSKRQTKSMGNIRESHAKEKSDRRPRPHKKSSKTNSDQNDSCNGDTDSLQQQQGNDFPPKKSRPKMSKDGSNNVGGDSSKTRSKPHHHHHHHSRNSYSNNNQEGHARHSSKTRTTHGSFEEDAHSRNKHGSFEEEEQFQRRSCENILKSYPN

SEQ ID NO: 224772 - protein, 90 aa, Glycine max
  Coding DNA Sequence Number=SeqID_107994
  Homolog annotation: Hit_ID=Q6K950; Match level="QueryCoverage=35%, HitCoverage=12%, E-value=1e-09, Identity=90%"; Hit description =Nucleolar RNA-binding Nop10p-like protein
MAQSLDTRHQHYFYITQYFGGGCWVGNNPKRFFRRTLCLEYLSSGENRAAVQENQVLGSFQWKPQYGGTGLNGITLVMAQIDGGVMYARG

SEQ ID NO: 224773 - protein, 85 aa, Glycine max
  Coding DNA Sequence Number=SeqID_107995
  Pfam annotation: Domain name=Mito_carr; Domain location=7-68; Score =9.0; E_value=0.00053; Accession=PF00153.17; Description =Mitochondrial carrier protein
MVLMEMSALQIPGSANQYDSVLHAFYKISKNEGLKGLGLILRLIMYMSQGSLFFASYEFFKRTFSLEASHPIDLCIQDNDENVEE

SEQ ID NO: 224774 - protein, 133 aa, Glycine max
  Coding DNA Sequence Number=SeqID_107996
  Gene Ontology: Mol. function=protein serine/threonine kinase activity; Cellular component=phragmoplast; Biological process =protein amino acid phosphorylation
  Homolog annotation: Hit_ID=Q9LW99; Match level="QueryCoverage=100%, HitCoverage=23%, E-value=2e-53, Identity=78%"; Hit description =Protein kinase MK6
MDSARSWLQKFQPRDKLRASTRNKDDTNGTNEIPNVPMDDTSLSNVTKQKVTAAKQYIENHYKEQMKSLQERKERRTILEKKLADADVSEEDQNNLLKFLEKKETEYMRLQRHKMGVDDFELLTMIGKGAFGE

SEQ ID NO: 224775 - protein, 72 aa, Glycine max
  Coding DNA Sequence Number=SeqID_107997
  Homolog annotation: Hit_ID=Q6K950; Match level="QueryCoverage=43%, HitCoverage=12%, E-value=1e-09, Identity=84%"; Hit description =Nucleolar RNA-binding Nop10p-like protein
  Pfam annotation: Domain name=Nop10p; Domain location=3-41; Score=5.4; E_value=0.0086; Accession=PF04135.3; Description=Nucleolar RNA -binding protein, Nop10p family
MYLQFYINDNGDKVYTTKKESPVGLPTQSAHPGNATVPGIRLYYWYCSGNKPKAHDNIYFPSPAYSIPLSPP

SEQ ID NO: 224776 - protein, 37 aa, Glycine max
  Coding DNA Sequence Number=SeqID_107998
MSETERENVVKCELCQKGQKVNPKTPNGQSELSTDQT

SEQ ID NO: 224777 - protein, 129 aa, Glycine max
  Coding DNA Sequence Number=SeqID_107999
  Gene Ontology: Cellular component=nucleus; Biological process =regulation of transcription, DNA-dependent
  Homolog annotation: Hit_ID=Q9FT54; Match level="QueryCoverage=79%, HitCoverage=23%, E-value=3e-16, Identity=47%"; Hit description =Transcription factor GTE6
METFGASISEARDAATANSNGENEIEGFKQRVDEIISKVDKASLTTGIRKEWLEQKVHDIENFYSSMNKNQTSTPKGNSAAKDKDKEKHVPSIKKQQQDASRREAAASKRMQDLMRQFGTILRQATIFH

SEQ ID NO: 224778 - protein, 66 aa, Glycine max
  Coding DNA Sequence Number=SeqID_108000
MDERVLLCSAPLDCVLSELLSRSAYYSVLIALSEILSLSVFCFCFDRLALVTRLAWELSLALNALA

SEQ ID NO: 224779 - protein, 131 aa, Glycine max
  Coding DNA Sequence Number=SeqID_108001
  Gene Ontology: Mol. function=DNA binding; Cellular component=nucleus; Biological process=regulation of transcription, DNA-dependent
  Homolog annotation: Hit_ID=Q5VPG9; Match level="QueryCoverage=93%, HitCoverage=34%, E-value=7e-28, Identity=52%"; Hit description=DNA -binding bromodomain-containing protein-like
  Pfam annotation: Domain name=Bromodomain; Domain location=1-51; Score= -15.9; E_value=0.061; Accession=PF00439.15; Description=Bromodomain
MDFSTIKNQMEAKDGTGYKHVREICADVRLVFKNAMKYNDERSDVHVMAKTLLSKFEEKWLQLLPKVTEEETRREEEEAEAQLALQVAQEAAQAKMARDLSNELYEVDVILEELREMVVKRFRLAVASNVS

SEQ ID NO: 224780 - protein, 106 aa, Glycine max
  Coding DNA Sequence Number=SeqID_108002
  Subcellular localization annotation: CTP_CleavageSite=76; ConfidenceScore=5.30e-01
MAALHATPSAFMHVITKKLSEKTIFYRVNGLSLLSKFHKKLISNTVLLNLTNALVSSSDTSNGVSLANITPIVNVMSENVDSNNFSYGGGRGRGGDGADGGCGQDM

SEQ ID NO: 224781 - protein, 573 aa, Glycine max
  Coding DNA Sequence Number=SeqID_108003
  Gene Ontology: Mol. function=dolichyl-diphosphooligosaccharide -protein glycotransferase activity; Cellular component=oligosaccharyl transferase complex; Biological process=protein amino acid N-linked glycosylation via asparagine
  Homolog annotation: Hit_ID=Q5N7W3; Match level="QueryCoverage=97%, HitCoverage=73%, E-value=1e-153, Identity=52%"; Hit description =Putative ribophorin II
  Pfam annotation: Domain name=Ribophorin_II; Domain location=1-567; Score=475.3; E_value=7.4e-140; Accession=PF05817.4; Description =Ribophorin II (RPN2)
ALSQSDGRWRYSSNNPESSTYAAGLALEALAGVISLASSEIDQSRESWHFYRYLISVPFCQVNTVKNDILKLFDSIEKYDDGTFYFDEKFVGGREHQGSLSTTSSVVRGVTAFAAVTSGKINLPGDKILGLANFFLGIGIPGDAKDFFNQVESLALLENNKQGFDPIGTVTSCNGLFIIQKRSAQAPVKIQCCFLVLNYTWENMTNFYFQMNQVRVNTVLGSAAPPLTVKLVQAFRSNAKDSAIESKELQYDQNNGIHFLEAFPDNVDVGTYVFVFEIALHDSAGEKVYATGGQIHVPIYVTGIIKVSNAEIAVLDSDLGSVETQKTLDLAGNDDVSLSANHLQKLRFSFQLTTPHGHAFKPHQAFFKLKHETKHEHIFVVGNTGRKFEIILDFLGLVEKFYYLSGRYDIELTVGDTVMENSFLRLLGEVDLDLPEAPEKAARLPPLPVDPYSRYGPKAEIAHLFRAPEKRPPQELSLTFLGLILLPFIGFLVGLLRLGVNLKNFPSSAVPATYAFLFHLGIAAVLLLYVLFWLKLDLFTTLKTVGFLGAFLLFVGHRILSHLASTSSKLKSA

SEQ ID NO: 224782 - protein, 152 aa, Glycine max
  Coding DNA Sequence Number=SeqID_108004
MAAMNAIPGNLPVFDGKGYEDWCVKMDAILGFQELDEIVRDGFQEPPKNASAECWISLAVTFWSTFSLYKYVQRESGLPESAPDRHWMYPLLELIHKRCILMQAPLELVGLGSSSSMDSFASWKMNGSGMEKEEGEETPLQGEDESRRSSPP

SEQ ID NO: 224783 - protein, 65 aa, Glycine max
  Coding DNA Sequence Number=SeqID_108005
  Homolog annotation: Hit_ID=Q5N8X8; Match level="QueryCoverage=57%, HitCoverage=13%, E-value=4e-08, Identity=71%"; Hit description =Putative transcription initiation factor IIF beta subunit
  Subcellular localization annotation: CTP_CleavageSite=54; ConfidenceScore=5.04e-01
MPTTVLSTTTTTTMLLPFHRSLSMHKLWKRRKLQLKQGIRREQEETMERWKRLCSSYLNGSQIGV

SEQ ID NO: 224784 - protein, 116 aa, Glycine max
  Coding DNA Sequence Number=SeqID_108006
MKKMNNTLLFSGFGKPENFRKHFAKEEEEEEEVQRDSKVVKEYVEKLFVKVVKDCSESTTLRSAPPSRLARLKTTVAFSALISRLAHDLDIDALPDSSVVLSALKLCLAVDARLAH

SEQ ID NO: 224785 - protein, 229 aa, Glycine max
  Coding DNA Sequence Number=SeqID_108007
  Gene Ontology: Mol. function=protein binding; Cellular component =membrane; Biological process=defense response
  Homolog annotation: Hit_ID=Q1SW19; Match level="QueryCoverage=100%, HitCoverage=23%, E-value=4e-67, Identity=57%"; Hit description =Disease resistance protein
  Pfam annotation: Domain name=NB-ARC; Domain location=2-207; Score =40.3; E_value=7.4e-13; Accession=PF00931.13; Description=NB-ARC domain
MDKASLIHEVRNHLSCNRYVVVFDDVWNENFWEEMKFALVDVENGSRIIITTRHREVAESCRTSSLVQVHELQPLTDDKSFELFCKTAFRSELDGHCPHNLKGISTEIVKKCEGLPLAIVATGGLLSRKSRDAREWQRFSENLSSELGKHPKLTPVTKILGLSYYDLPYHLKPCFLYFGIYPEDYEVECGRLILQWVAEGFVKSDEAAQTLEEVAEKYLNELIQSRLVQ

SEQ ID NO: 224786 - protein, 52 aa, Glycine max
  Coding DNA Sequence Number=SeqID_108008
MHVHRCCPVSRRTGEELVDTTPSQRPKVRAGTGPVIDRSSSYVQLKTLKKRY

SEQ ID NO: 224787 - protein, 127 aa, Glycine max
  Coding DNA Sequence Number=SeqID_108009
MSKTCGFGMTGPLDESISCFLIRVDPWVLVPIIFRGLHVLAIRGLHVLAIRGLHALTSRGLPVLALRGLHALILVTLTVERTTRPRHQRAARPHLQRTTRPRLERATRPSPWVLVTLTVEWTTRPSP

SEQ ID NO: 224788 - protein, 112 aa, Glycine max
  Coding DNA Sequence Number=SeqID_108010
  Gene Ontology: Mol. function=GTP binding; Cellular component=nucleus; Biological process=small GTPase mediated signal transduction
  Homolog annotation: Hit_ID=Q8LIM1; Match level="QueryCoverage=66%, HitCoverage=11%, E-value=1e-23, Identity=70%"; Hit description =Putative GTP binding protein
MVGVTKDYAKLLKYGDSLYRCKCLKVAALGSMCIVIKRVGASLAYLEQVRQHMARLPSIDPNMTPLELVGLGSSSSMDSFASWKMNGSEMEKEEREETPLQGEDESRRSSPP

SEQ ID NO: 224789 - protein, 137 aa, Glycine max
  Coding DNA Sequence Number=SeqID_108011
  Gene Ontology: Mol. function=transition metal ion binding; Biological process=proteolysis
MVHLIVHLVREIKCCGPVYLRWMYTVECYMKILKGYTKNLHRPEASIVERYITEEAIEFCSEYIEKAKPVGLPESCHDDRVGDLKKLAYQNDPFIMAEQAKQVFYVQDPCDERWFVVLHGKTIGVNVEDDDSYMDTY

SEQ ID NO: 224790 - protein, 109 aa, Glycine max
  Coding DNA Sequence Number=SeqID_108012
MTHGRVSTSQTLMDPLLPPPSQSIFVMQSYPLRALDRRLQEDWTRDAREGPRILMSIMTSFEAQNFVLLSLSLFLHSSSSTFKLLSMASYGGECWNPASALDRASSIKR

SEQ ID NO: 224791 - protein, 58 aa, Glycine max
  Coding DNA Sequence Number=SeqID_108013
MYRSHMVGAFLQNNVTLTGLPMILPSKSDPIYQCVMIRWMVIENLMLKDVGTQCSHRM

SEQ ID NO: 224792 - protein, 682 aa, Glycine max
  Coding DNA Sequence Number=SeqID_108014
  Gene Ontology: Mol. function=DNA photolyase activity; Cellular component=nucleus; Biological process=DNA repair
  Homolog annotation: Hit_ID=Q6EAN1; Match level="QueryCoverage=99%, HitCoverage=100%, E-value=0.0, Identity=81%"; Hit description=Mutant cryptochrome 1-1 protein
  Pfam annotation: Domain name=DNA_photolyase; Domain location=6-177; Score=271.5; E_value=1.6e-78; Accession=PF00875.8; Description=DNA photolyase
  Pfam annotation: Domain name=FAD_binding_7; Domain location=208-486; Score=526.0; E_value=4e-155; Accession=PF03441.4; Description=FAD binding domain of DNA photolyase
  Pfam module annotation: Pfam domain module=DNA_photolyase::FAD _binding_7; Domain location=6-177::208-486
MSGGGCSSIVWFRRDLRIEDNPALTAGVRAGAVVAVFIWAPEEEGQYYPGRVSRWWLKNSLAHLDSSLRNLGTPLITKRSTDTLSSLFEVVKSTGATQLFFNHLYDPLSLVRDHRAKEVLTAQGITVRSFNADLLYEPWDVNDAHGRPFTTFAAFWERCLSMPYDPESPLLPPKRIIPGDASRCPSDTLLFEDELEKASNALLARAWSPGWSNANKALTTFINGPLIEYSKNRRKADSATTSLLSPHLHFGELSVKKVFHLVRIKQVLWANEGNKAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGSLPDGREIDRIDNPQFEGYKFDPNGEYVRRWLPELSRLPTEWIHHPWNAPESVLQAAGIELGSNYPLPIVGIDAAKNRLLEALSKMWQQEAASRAAMENGTEEGLGDSSESVPAAFPQDTRMEETHEPVRNNPLPIARRYQDQMVPSITSSLLRVEEEETSSDLRNSAEESSRAEVPVTANAQQNAGVALNERMLQTTNRNTQTQYNTTMDLRNVADDSAVESSSGTRRERDGGLVPVWSPPASSYSEQFVGDENGITSSSSYLQRHPQSHQMLNWKQLPQTG

SEQ ID NO: 224793 - protein, 121 aa, Glycine max
  Coding DNA Sequence Number=SeqID_108015
MVIPSKFKVSEFDKYMGTTCPKNHLKMYCWKMGAYAKDEKLLMHFFQEMFAGERIEVGLRRGKFDCLTLTSKKPRANGQNEEEGGTHVVTVIPTWPSFPPSQQCHYSANIIPSHYPPPNHP

SEQ ID NO: 224794 - protein, 189 aa, Glycine max
  Coding DNA Sequence Number=SeqID_108016
  Gene Ontology: Mol. function=structural molecule activity; Cellular component=intermediate filament; Biological process=homophilic cell adhesion
  Homolog annotation: Hit_ID=UPI0000DBF0F4; Match level="QueryCoverage =91%, HitCoverage=74%, E-value=2e-22, Identity=45%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
MRSPLKESISCFLIRGLKVLAFRGLKVLAFRGLNVLAFRGLKVLAFRGLKVLSFRGLKVLAFRGLKVLAFRGLNVLAFRGLNVLAFRGLNVLAFRGLKVLAFRGLKVLTFRGLKVLAFRGLKVLSLRGLNVLAFRGLNVLTFRGIKVLAFRGLKVLSFRGLKVLTFRRLKVLAFIGLKVLAFVGLKVLT

SEQ ID NO: 224795 - protein, 307 aa, Glycine max
  Coding DNA Sequence Number=SeqID_108017
  Gene Ontology: Mol. function=drug transporter activity; Cellular component=membrane; Biological process=multidrug transport
  Homolog annotation: Hit_ID=Q6I630; Match level="QueryCoverage=99%, HitCoverage=75%, E-value=1e-97, Identity=55%"; Hit description =Putative MATE efflux protein
  Pfam annotation: Domain name=MatE; Domain location=1-113; Score=2.4; E_value=0.0014; Accession=PF01554.9; Description=MatE
  Pfam annotation: Domain name=MatE; Domain location=174-306; Score =50.9; E_value=4.2e-12; Accession=PF01554.9; Description=MatE
  Pfam module annotation: Pfam domain module=MatE::MatE; Domain location=1-113::174-306
MASGLETICGQAYGAQQHKKIGVQTYTAIFALTFVCLPFTFLWINMEKILVFIGQDPLIAKEAGKFIIWLIPALFAYAILQPLVRYFQMQSLLLPMLMTSCVTLCVHIPLCWVLVFKTRLNNVGGALAMSISTWSNVIFLGLYMRYSPRCAKTRAPISMELFQGLREFFRFAIPSAVMICLEWWSFELIILLSGLLLNPQLETSVLSICLNTTSILYAIPFGIGAAASTRISNELGAGNPHGACVSVLAAISFAIIETTVVSGTLFACRHVFGYVFSNEKEVVDYVTVMAPLVCISVILDNIQGVLA

SEQ ID NO: 224796 - protein, 51 aa, Glycine max
  Coding DNA Sequence Number=SeqID_108018
MYEKSEVVVLAGAEMGRGAQEEGVAVELVVFKVEVVLLEKGVVAKGVLEME

SEQ ID NO: 224797 - protein, 389 aa, Glycine max
  Coding DNA Sequence Number=SeqID_108019
  Gene Ontology: Mol. function=binding; Cellular component =mitochondrial inner membrane; Biological process=transport
  Homolog annotation: Hit_ID=Q9LV81; Match level="QueryCoverage=98%, HitCoverage=93%, E-value=1e-122, Identity=59%"; Hit description =Mitochondrial carrier protein-like
  Pfam annotation: Domain name=Mito_carr; Domain location=187-276; Score=92.5; E_value=1.3e-24; Accession=PF00153.17; Description =Mitochondrial carrier protein
  Pfam annotation: Domain name=Mito_carr; Domain location=301-389; Score=83.3; E_value=7.7e-22; Accession=PF00153.17; Description =Mitochondrial carrier protein
  Pfam annotation: Domain name=Mito_carr; Domain location=94-181; Score= 89.2; E_value=1.3e-23; Accession=PF00153.17; Description =Mitochondrial carrier protein
  Pfam module annotation: Pfam domain module=Mito_carr::Mito_carr::Mito_ carr; Domain location=187-276::301-389::94-181
  Subcellular localization annotation: CTP_CleavageSite=54; ConfidenceScore=5.43e-01
MAMQAGLFLDPKIPDSFVRSISFKIHATPFSESNPRRQRRRVPAACFLSVSLPSANLVTEPKLQNGEHVSDQETTSNGVVQQREVRVRGGNAVNTTKHLWAGAIAAMVSRTCVAPLERLKLEYIVRGEKRNIFELISKIASSQGLRGFWKGNLVNILRTAPFKAVNFCAYDTYRKQLLRFSGNEETTNFERFIAGAAAGITATIICLPLDTIRTKLVAPGGEALGGVIGAFRYMIQTEGFFSLYKGLVPSIISMAPSGAVFYGVYDILKSAYLHSPEGMKRIQNMHKQDRELSAFDQLELGPVRTLLNGAIAGACAEAATYPFEVVRRQLQLQVQATKLSSFATFAKIVEQGGIPALYAGLIPSLLQVLPSASISFFVYEFMKIVLKVE

SEQ ID NO: 224798 - protein, 130 aa, Glycine max
  Coding DNA Sequence Number=SeqID_108020
  Gene Ontology: Mol. function=protein kinase activity; Biological process=protein amino acid phosphorylation
  Homolog annotation: Hit_ID=Q1W203; Match level="QueryCoverage=89%, HitCoverage=28%, E-value=4e-27, Identity=52%"; Hit description=NAK -type protein kinase
MKCFYYFRDKSRSSKQRSAPELKEQEKLEFSGPERVTKSSCSSTSPRGIPELYEEKGHNLRDFSFTELKRATSDFSRLLKIGEGGFGSVFKGTIKPADGNRNSVLVAIKRLNKNALQRAFRVPWSPFPDE

SEQ ID NO: 224799 - protein, 50 aa, Glycine max
  Coding DNA Sequence Number=SeqID_108021
VKKRLSHEVQKVTIKLSSAIGLSMHPPLSAASAHLAQRRIWQNISIKAAC

SEQ ID NO: 224800 - protein, 292 aa, Glycine max
  Coding DNA Sequence Number=SeqID_108022
  Homolog annotation: Hit_ID=Q47522; Match level="QueryCoverage=17%, HitCoverage=64%, E-value=1e-23, Identity=100%"; Hit description=LacZ protein
MCPVIGFGPWLGLGKPLVEILPPGQLRGFCPLLAWLGSTVLGYGPVLSFGLVGPLLPPVISFVARILPTLACAPLAKSVPRWILPAARWELRFKASRRANPPHEGHQRHVPLGGRGPLLLVGKRTAGARVASSPDSDLEAFSHNPTHGSFAPLAFQPSAMTNCANQRVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 224801 - protein, 283 aa, Glycine max
  Coding DNA Sequence Number=SeqID_108023
  Gene Ontology: Mol. function=DNA binding; Biological process=DNA integration
  Homolog annotation: Hit_ID=Q1T192; Match level="QueryCoverage=55%, HitCoverage=30%, E-value=2e-19, Identity=32%"; Hit description =Polynucleotidyl transferase, Ribonuclease H fold
MELSNKKGSPRVNLGIVLLHTCNSPWVARTGDLVGGHPFRFLLFSGHNFLDFYGGSLECFLDDSLEVPTLLGIGRLREQVCSGVSLPGKVVHFEAFKIVNKSLHDLIVLEQHCFLGLVYVGNLSFDKGDIVRAFEDDSCLASLYVRCPIHVEVAPFYRPGHHPSYKFRLSQNLLDGALLGVIEYAASEIDRELGYFWPWSTQIGGVAMVFLKVKKEEPGHWSDCPSLVRQCIFQGWLQFPEFPKDFFQVRHVIGYALRLDDHVERHNLAEIDNFSDEYHLLLV

SEQ ID NO: 224802 - protein, 95 aa, Glycine max
  Coding DNA Sequence Number=SeqID_108024
MKLRGKGGVESIVSLKTDLTCRHDDKCGIFDSRKQDLVEVEVLSPIWWGFLLLCGASPLMLVRSMFDLTLVEGLANQSKGRSHDLQSFSFDSYEE

SEQ ID NO: 224803 - protein, 381 aa, Glycine max
  Coding DNA Sequence Number=SeqID_108025
  Gene Ontology: Mol. function=RNA-directed DNA polymerase activity; Biological process=RNA-dependent DNA replication
MDELREGYIQIEEMSRFRNKVRQEAFNLEVTIKLPPMKPPRLGLDTTKYCRYHHGIGHNTEDYWALKDMIEELIWARYLAQFVKRSDNHQARVRPGGHQEEQHRNHEANRRRDKVEDRGQFSQSQKHHLHAIQDIDINFVDEPLQRSLPPITFTDRDFKGDPVVVSTIIENFMVSKVSPDIIHPYVGPLLGFVGERVETKGYMDLMITFGQGQKTLNELGAIVSMSHLKIKFPTLTREIVTVEPTKPHPTVAKGTQVMSIDEGSPIKALTVYQASLDDEFNIDPSDETSDRDPSKSSSSCSSNLYSGSNDAKLPKKKWTNSSTLTSSEVRYSTWLANVVMVKKANDKWRMCIDYDDLNRACPKYAYPLPSIDRLINGAFRF

SEQ ID NO: 224804 - protein, 225 aa, Glycine max
  Coding DNA Sequence Number=SeqID_108026
MGVERPLVHVPDAQKDLIWEDIQAEFDILEASSKRTKKKILQTVGERWRKFKLDLTSKRALAQGKEDDDDKVCKKYDISKEKWNQFCQSCRDPSWESITKKVTRLLMLSFSQIQSQGIIPPIEPKVALFGARVNTKGSYVHPSGQDPDTTASDMHGLYGSTIVHHVPLGNDLVMVGVEEVRDADAHIPIPTEELMQVAWDATMFGVYNDNVPLYLKHEDLGEIAH

SEQ ID NO: 224805 - protein, 61 aa, Glycine max
  Coding DNA Sequence Number=SeqID_108027
  Pfam annotation: Domain name=LRR_1; Domain location=33-54; Score=8.6; E_value=7; Accession=PF00560.23; Description=Leucine Rich Repeat
  Pfam annotation: Domain name=LRR_1; Domain location=9-31; Score=9.2; E_value=5.3; Accession=PF00560.23; Description=Leucine Rich Repeat
  Pfam module annotation: Pfam domain module=LRR_1::LRR_1; Domain location=33-54::9-31
MAGTPQLTSALKLDVSNNHLEGNLLNEFANLNNLTVMDLRNNRFTGGLTLMPPLHKTLLSG

SEQ ID NO: 224806 - protein, 304 aa, Glycine max
  Coding DNA Sequence Number=SeqID_108028
  Gene Ontology: Mol. function=transcription regulator activity; Cellular component=nucleus; Biological process=regulation of transcription
  Homolog annotation: Hit_ID=Q1PF17; Match level="QueryCoverage=48%, HitCoverage=51%, E-value=1e-28, Identity=46%"; Hit description=Basic helix-loop-helix family protein
  Pfam annotation: Domain name=HLH; Domain location=147-196; Score =42.4; E_value=1.6e-09; Accession=PF00010.16; Description=Helix-loop -helix DNA-binding domain
MEESPERWLRFLEMDECNLFGHMHSLVEVFKGENLVQQEKSCKSHPCDSNITKESTTILLRNPINDSSSLEKNPGFDNRSSLKQHASQDEPLFSSSSMPYTLSFEDSTAVPYVLNKTCQCYHGENSKETQEEPKNNRKSKRGRSSSEIQDHIMSERKRRENIAKLFIALSAVIPVLKKTDKASVLKTAIDYVKYLQKRVKDLEEESKKRKVEYAVCFKTNKYNIGTVVDDSDIPINIRPKIEARVSGKDALIKVMCEKRKDIVAKILGKLAALNLSIVCCNVLPFANSALNITCIAQGQIYVPF

SEQ ID NO: 224807 - protein, 96 aa, Glycine max
  Coding DNA Sequence Number=SeqID_108029
MEASLKSEVFCSSFMHFLSSFWWSYLPGNSFLACKLDIKSEVFWSSFMHFFPAFGRAIYQVINAECSMVLYLLRFFALFFIQVVPKAIFCPFEVVV

SEQ ID NO: 224808 - protein, 80 aa, Glycine max
  Coding DNA Sequence Number=SeqID_108030
MTWKFKCTFKEFFQRRFLEEEVCIPKFDGVPFNSIDEEDNASLIASFWKRKSRKRCGIVMEINVRDWMDTISTSRNFGML

SEQ ID NO: 224809 - protein, 185 aa, Glycine max
  Coding DNA Sequence Number=SeqID_108031
  Gene Ontology: Mol. function=unspecific monooxygenase activity
  Homolog annotation: Hit_ID=O04892; Match level="QueryCoverage=88%, HitCoverage=41%, E-value=4e-12, Identity=44%"; Hit description =Cytochrome P450 like_TBP
RGGRCKTQGASPGGAVVGADLGGTGEARLIALCARTPKGNRPAHPGNGSAGGRVQRLEEHRTSRGVRQGKSAKWIRNLGKRIGSEGWARGSQSRTRRLSVGMLELLPRRERVVACRSGDGLGTGPSGPLSPGVEQSTQNCALNVKVKKIQPSAGKRRDETTAKGTGLAESAGKEDPVELDSSPTL

SEQ ID NO: 224810 - protein, 41 aa, Glycine max
  Coding DNA Sequence Number=SeqID_108032
MVNPRTFFGFYCKDWGTCSDLRFVPITHIQVSNLGNQIELP

SEQ ID NO: 224811 - protein, 138 aa, Glycine max
  Coding DNA Sequence Number=SeqID_108033
MGIKHFEVVKQRSHADKQWYLDEIREDVGLNEGERDLRIEVQQKVWEVATCLHVREVWGDDLKKVKEEVSILFLNRFLEGEDGGTSLDGVDFNLISHEDNLLLSSRFEELEVNEAIWDCRVSKSLGSYGFKFNFIKKF

SEQ ID NO: 224812 - protein, 189 aa, Glycine max
  Coding DNA Sequence Number=SeqID_108034
MDEPWLKWVSILDTNDYHLSTECDMNSVEEPLEGENSVDPGELSWENHSPNSYLTKERTTLLSNSSSLEEINTSFDMTSLKQHASPQKPKSCILSFEDSTSVPITSKKTCQLYHGEHSKETQEELPNRKPLKRDTSFDHIMAERKRRENISRLFIALSALIPGLKKYPSFKVILFETMSDTKYEYHFTF

SEQ ID NO: 224813 - protein, 128 aa, Glycine max
  Coding DNA Sequence Number=SeqID_108035
  Gene Ontology: Mol. function=transcription regulator activity; Cellular component=nucleus; Biological process=regulation of transcription
  Homolog annotation: Hit_ID=Q1PF17; Match level="QueryCoverage=99%, HitCoverage=44%, E-value=2e-18, Identity=40%"; Hit description=Basic helix-loop-helix family protein
MDKASVLYNAIEHVKYLQQRVKDLEKDNKKRKTESVGCFKINKTNVADNVWACDDKPIKICPKVEARVSGKDVVIRVTCEKQKNILPKLLAKLEAHNLSIVCSNVLPFGNSALSITSIAKEKDNTSLK

SEQ ID NO: 224814 - protein, 178 aa, Glycine max
  Coding DNA Sequence Number=SeqID_108036
  Gene Ontology: Mol. function=4 iron, 4 sulfur cluster binding; Cellular component=integral to membrane; Biological process=electron transport
  Homolog annotation: Hit_ID=Q19KB4; Match level="QueryCoverage=90%, HitCoverage=61%, E-value=2e-45, Identity=94%"; Hit description=PSI P700 apoprotein A2
MMSCLLWYSGETILIEPIFAQWIQSAHGKTSYGYDILISSTNSPAYNAGRSIWLPGWLNAVNENSNSLFLTIGPGDFLVHHAIALGLHTTTLILVKGALDARGSNLSVWAWMFLFGHLVWATGFMFLISWRGYWQELIETLAWAHERTPLANLIRWRDKPVALSHCASKIGWTSPTFP

SEQ ID NO: 224815 - protein, 90 aa, Glycine max
  Coding DNA Sequence Number=SeqID_108037
  Subcellular localization annotation: CTP_CleavageSite=29; ConfidenceScore=5.46e-01
MWRKSKRGVFAQSQSGPLGPSRSFLQKAVASGGSNLARLGKLGGKLLPYFAINRGRSEEEKGSAFLALLSLSKLLRKIIFVKKIQAEVLP

SEQ ID NO: 224816 - protein, 248 aa, Glycine max
  Coding DNA Sequence Number=SeqID_108038
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=54%, E-value=1e-124, Identity=81%"; Hit description =Photosystem II P680 chlorophyll A apoprotein
  Pfam annotation: Domain name=PSII; Domain location=1-242; Score =184.5; E_value=2.6e-52; Accession=PF00421.9; Description=Photosystem II protein
LRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFVRRMPTFFETFPVVLVDGDGIVRADVPFRRAESKYSVEQVGVIVEFYGGELNGVSYSDPATSEGLVTFGQASFALLFFFGHIWHGARTLFRDVFAGIDPDLDAQVEFGAFQKLGDPTTKKQ

SEQ ID NO: 224817 - protein, 88 aa, Glycine max
  Coding DNA Sequence Number=SeqID_108039
  Gene Ontology: Mol. function=protein serine/threonine kinase activity; Biological process=protein amino acid phosphorylation
  Homolog annotation: Hit_ID=Q53KU9; Match level="QueryCoverage=67%, HitCoverage=7%, E-value=2e-20, Identity=76%"; Hit description =Probable protein kinase [imported]-Arabidopsis thaliana
YNIVKSLASALLYLHEEWDEQVIHRNITSSAVTLEPNMTPRLGSFALAEFLSRNEHGHHVINNTSNMRLWILIQVRSCGFKAVAPKTR

SEQ ID NO: 224818 - protein, 284 aa, Glycine max
  Coding DNA Sequence Number=SeqID_108040
  Gene Ontology: Mol. function=DNA binding
  Homolog annotation: Hit_ID=Q1S0F5; Match level="QueryCoverage=58%, HitCoverage=32%, E-value=5e-22, Identity=38%"; Hit description=IMP dehydrogenase/GMP reductase
GKWASFIDTLALLIFGGILFPNVDGLVDLAMIDAFLAYRDHKERPVVAMLADLYDTFDRRCEKSSMRIVCCTPALYVWLVLHLFRQEMRHACPLESHRSCTKKGGANWDQLLANKEGASVNWFPRWKEGRIGVLISCGGFPNVPLMGTRGCISYNPVLAIRQLGYPMRGGTSRGRAHACHVTRGINNGPVGGYRKWLKAHMQGLDWLPSLRIAKREEVEVPEEDEEVQALRAELEQAQTVKERARKEEHGREKFRGALWGSNSELKLRREERDQSRAHGMVLKE

SEQ ID NO: 224819 - protein, 60 aa, Glycine max
  Coding DNA Sequence Number=SeqID_108041
MVSEMSNKDGTPRLLSSDTASLLDRVELGVLGSAKIATTIYVRDRERERGDKGEMRRQEL

SEQ ID NO: 224820 - protein, 324 aa, Glycine max
  Coding DNA Sequence Number=SeqID_108042
  Gene Ontology: Mol. function=6-carboxyhexanoate-CoA ligase activity; Cellular component=intracellular; Biological process=metabolic process
  Homolog annotation: Hit_ID=Q46SD8; Match level="QueryCoverage=94%, HitCoverage=43%, E-value=3e-74, Identity=51%"; Hit description=CoA -binding
  Pfam annotation: Domain name=ATP-grasp_2; Domain location=102-303; Score=-111.0; E_value=0.0014; Accession=PF08442.1; Description=ATP -grasp domain
RDGYDALVAIKGSSAVAQLKDLANALRDALDPGANPVVTYISPHSPRAAESISRQGIAAFQSPESVSAAQMAMLRVHAPARPPAADSTAPSPAPVSCPEHGSLDEAQAKALFARFGVPGVREIAVRSPAEAVEAARQLGPRVVLKLLSGDILHKSEVGGVAVNLTPDEIGPRLRRMAADVQRHTGRVAEAFLVQEMVAGAAEVILGFHRDPLGTAILLGMGGVVAELIRDTTLLLLPEDGAALTAWQVEAALRRLKTWPLLDGYRGRDRADVPALVDAVLAFARMAQALGERLVEAEINPLFVRPLGQGVRAADAIAIIGAVAA

SEQ ID NO: 224821 - protein, 293 aa, Glycine max
  Coding DNA Sequence Number=SeqID_108043
  Gene Ontology: Mol. function=sodium:dicarboxylate symporter activity; Cellular component=membrane; Biological process=dicarboxylic acid transport
  Homolog annotation: Hit_ID=Q2R3B7; Match level="QueryCoverage=83%, HitCoverage=45%, E-value=4e-17, Identity=29%"; Hit description =Expressed protein
  Subcellular localization annotation: CTP_CleavageSite=49; ConfidenceScore=5.07e-01
MAPFLKNSPSRPTFLSRISLSDIWRPASRKYCRNDTWKMLKTSISILFSQSVLQEPAFEELILLYTKEVEETNAKDKAEVPSLQLKIYERIPIPDLPLSIFIRIFLQMTLNFFQVRLDVATILGLLAYFINYKFENVLSSPSAILLDVVAVSALIIYGSRVVLGYKQTWDRYQLLVNKTLYEKTLASGFGSVHFLLDASEQQQYKEAILAYAILLKAEKSQVISRQSVGEKCERFMYEVFKVKVEMPIDKALNTLLRLGLATESSIDGRRGLLAMPCPKAYEALKERWNSLLS

SEQ ID NO: 224822 - protein, 560 aa, Glycine max
  Coding DNA Sequence Number=SeqID_108044
  Homolog annotation: Hit_ID=Q10JE0; Match level="QueryCoverage=74%, HitCoverage=76%, E-value=7e-73, Identity=42%"; Hit description =Expressed protein
MEGGEGGEGLNQAVQQQLNLKQVKTRAISLFKAISRILEDFEAYGRTNSTPKWQDILGQYSMVNLELFNIVDDIKKVSKAFLVHPKNVNADNATILPVMLSSKLLPEMETDDTAKRDQLLLGMQNLPIPTQIEKLKARLDLISAACEGAEKVLADTRKAYCFGTRQGPAAIAPATLDKGQAAKIQEQENLLRSAVNAGDGLRIPGDQRHITPAQPPLHLADALPVVIANDPTTAQPQPQLSANTMGMPAQNSLLQASSATVSQLLGRSAASPSAATTTTTSFDNITASPIPYANSPRSSTNIMNSPSPQQQQTQQQPPVLQQQQQRQKFMQLPQQQQQHQILAQQQQFRQSAMQGLGQLHGQHQMQFSQPLGHQQFQGRQLPSGHVQHGIGQSQLNQGNQMTRLSQFSGPANSALFSAAQTTPNTQMFVLLERVVMQPVFNMGGGNPGGMMPIQQQQQQQQQQQHGSQAFGSMANAQNLQSGIRGRLSSDGEEGTSEKGGEVVEDTEKEYVRLPGPKLMGRGEGGVGGDEIIRRGLNFPARFWYSSSEALPFAVTWSCTH

SEQ ID NO: 224823 - protein, 79 aa, Glycine max
  Coding DNA Sequence Number=SeqID_108045
MRINEGARCLVVGGASWVCGKLGVAGCSLDSWLGATDLLVDRGAEVWWSARQGGMWPLLCFGQEDEGLRIGLIRKPHTD

SEQ ID NO: 224824 - protein, 458 aa, Glycine max
  Coding DNA Sequence Number=SeqID_108046
  Pfam annotation: Domain name=Condensation; Domain location=14-277; Score=-119.1; E_value=0.041; Accession=PF00668.10; Description =Condensation domain
  Subcellular localization annotation: CTP_CleavageSite=46; ConfidenceScore=5.38e-01
MSYCWQIHTLASKALVPIPQSQSQSLFFPYSHSHSSICVGLSRRVPCSRLQEMSVVESSSQYQYQQQQQQSTTTDYYPSVRDDEEGEGISKIRVPRQKHIPVSKSQLLDAIILSIQDDIDAHHFRLLTSCLDSILHAEHKTILEEMRSDYQLTDSLQQLVSNPNVKEEGNLYDYQPALDLTALLRSLDIPTKKDYDTGSRVTIATRFQRAFMQLLSNAQFEELSARDLMLTSALNTDYLLTLPIYVDWKRAYESNAIIFRRGYATEKQKGLLIVEKLDYLQSKFLRRTFFAISEPLTKLGTWISELYENACQKHEVQNWTERLRLWLKELSLFQKSLLYNDPASDEQIGVDQVPNAELPIWLAAQRAVARYEGILSPVGPRGRLLRRLLSWIGLIPPMPETPFEVHNDNNAPEPYLSLLARLDAALIIKRNKLIWTPYMTVLGPLKLTLKSQQVLNEQ

SEQ ID NO: 224825 - protein, 67 aa, Glycine max
  Coding DNA Sequence Number=SeqID_108047
METSRKYNKFNVTQKRMYPAVRRGIIKGPTSLALSHGWDQVQAHSLHVLDLLPHIPKIEKVKNNVKN

SEQ ID NO: 224826 - protein, 127 aa, Glycine max
  Coding DNA Sequence Number=SeqID_108048
MVRIRGLGRALGRVSDRVPVTVANAEPVVPAVEADVVADEPMAAIDEHEGFLGGPIDPSVLTEYVKHVAANVWTRKATTFGGINIIVIVVLLFFLDASPPVQEEKVVVVIVVGEMKEGMRVNEYGRE

SEQ ID NO: 224827 - protein, 148 aa, Glycine max
  Coding DNA Sequence Number=SeqID_108049
  Gene Ontology: Mol. function=DNA binding; Biological process=DNA integration
MAHTTCDPLKLKHLLQKFKFCEVGPMVYARENQSPLYLSSESIFHERTKYIEVDYRFIKEKIPLGIIRTSMNLSDQLANIFTKSIFHERTKYIEVDCRFIKEKIPLGIIRTSSMNLRDQLANIFTKSLPGPWIAYIYNKLDAYDLYCH

SEQ ID NO: 224828 - protein, 482 aa, Glycine max
  Coding DNA Sequence Number=SeqID_108050
  Gene Ontology: Mol. function=ubiquitin thiolesterase activity; Cellular component=intracellular; Biological process=ubiquitin -dependent protein catabolic process
  Homolog annotation: Hit_ID=Q1RWR6; Match level="QueryCoverage=99%, HitCoverage=100%, E-value=1e-114, Identity=47%"; Hit description =Pentaxin
MGSRFPSHQLSNGLYVSGRPEQPKERTPTMSSVAMPYTGGDIKKSGELGKMFDIPMAMDASKSRKSGQLNNAPSRTGSFAGAAASHSGPILPNSTPRSIYTTSGNISSGGSMTTASVSMKKTNSGPLNKHGEPVKKSSGPQSGGVTRQNSGPIPPVLPTTGLITSGPLNSSGAPRKVSGPLEFTGSMKSPSSVTHNPAMTTLSLDDEYSFRRNFPKPILWSVILIFIMGFIAGAFILGAVHNVILLVVVVVLFGAVAALFTWNSCCGRTAIVGFISRYPDAELRTAKNGQFVKVSGVVTCGNVPLESSFQKVPRCVYTSTSLFEYRGWDSKAANPKHRRFTWGLRAAERHVVDFYISDFQSGLRALVKTGYGARVTPYVDDSIVIDVNPDNKDMSPEFLRWLRERNLSSDDRLMRLKEGYIKEGSTVSVMGVVQRNDNVLMIVPPPEPLTTGCQWAKCIFPASLEGIILRCEDTSKIDVIPV

SEQ ID NO: 224829 - protein, 329 aa, Glycine max
  Coding DNA Sequence Number=SeqID_108051
  Gene Ontology: Mol. function=metal ion binding; Biological process =metal ion transport
  Homolog annotation: Hit_ID=Q9LZF1; Match level="QueryCoverage=59%, HitCoverage=57%, E-value=1e-44, Identity=46%"; Hit description =Farnesylated protein-like
  Pfam annotation: Domain name=HMA; Domain location=131-193; Score =41.2; E_value=3.5e-09; Accession=PF00403.16; Description=Heavy-metal- associated domain
  Pfam annotation: Domain name=HMA; Domain location=29-91; Score=59.4; E_value=1.2e-14; Accession=PF00403.16; Description=Heavy-metal -associated domain
  Pfam module annotation: Pfam domain module=HMA::HMA; Domain location =131-193::29-91
MGEKKEAAKNEGDKKPESGAKQNDGRLPVVLKLDMHCEGCVKKIKRAVRHFDGVEDVKTDLSSKKLTVIGKVDPAKVRDKLAEKTKKKVELISPQPKKDSAGDKPPEEKKSEEKKPEDKKAEEKTPKESTVVLKIRLHCEGCIQKIRKIILKTKGVESVNIEGGKDLVSVKGTMDVKEIVPYLNEKLKRNVEVVPPKKEGGDKKENNKKEGGGGGGAEGAAKVEVNKMEHYGYAYPAPHMYWHGHGGYAPGESSSSSSSSNNSYEVEVQSGYSYSNQGYDGNYVNYPYQHGYNDNYMAMAQPPPPFYLNPHHPPPQMFSDENPNACSVM

SEQ ID NO: 224830 - protein, 491 aa, Glycine max
  Coding DNA Sequence Number=SeqID_108052
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=97%, HitCoverage=43%, E-value=0.0, Identity=76%"; Hit description =Putative calcium-transporting ATPase 9, plasma membrane-type (EC 3.6.3.8) (Ca(2+)-ATPase isoform 9)
  Pfam annotation: Domain name=Hydrolase; Domain location=32-283; Score= 33.7; E_value=6.5e-07; Accession=PF00702.16; Description=haloacid dehalogenase-like hydrolase
MEVMTRTSGVDGGEAEVSGSPTEKAILSWAVKLGMNFDLIRSNSTILHVFPFNSEKKRGGLALKLPDSAVHIHWKGAAEIVLGKCTQYLDSDGHLKSIEEEKVFFKNAIEDMAAQSLRCVAIAYRSYDLDKIPSNEEELDQWCLPEHELVLLAIVGIKDPCRPGVKDAVKVCTEAGVKVRMVTGDNLQTAKAIALECGILMSTEDAVEPNIIEGKTFRELSEKEREQVAKKITVMGRSSPTDKLLIVQALRTGGEVVAVTGDGTNDAPALHEADIGLSMGIQGTEVAKESSDIIILDDNFASVVKVLAGLRLIRVVRWGRSVYANIQKFIQFQLTVNVAALVINVVAAISSGDVPLNAVQLLWVNLIMDTLGALALATEPPTDNLMHRSPVGRREPLITNVMWRNLIVQALYQVIVLLVLNFGGESILRNNQDSIAHTIQVKNTLIFNAFVFCQIFNEFNARKPEEMNVFRGVTKNRLFMGIVGMTFVLQV

SEQ ID NO: 224831 - protein, 57 aa, Glycine max
  Coding DNA Sequence Number=SeqID_108053
MEGTLIKSQGSENESHSCTCGMEVTDLPLALRCNGNKVSNLLRTQILRKGVAGAVPN

SEQ ID NO: 224832 - protein, 471 aa, Glycine max
  Coding DNA Sequence Number=SeqID_108054
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=87%, HitCoverage=45%, E-value=1e-127, Identity=55%"; Hit description =Putative calcium-transporting ATPase 9, plasma membrane-type (EC 3.6.3.8) (Ca(2+)-ATPase isoform 9)
  Pfam annotation: Domain name=E1-E2_ATPase; Domain location=214-428; Score=47.3; E_value=5.5e-12; Accession=PF00122.10; Description=E1-E2 ATPase
MASTSRGSTSSSNGLLTVTIAGSSSSHSDDPTTNDSDNDEDELLVDPNDPFDITHTKNAPPESLKRWRQAAFVLNASRRFRYTLDLKKEEEKEQKKSMIRSHAQVIRAALLFRLAGERELVTSSAAVASPSPVGEYAVGLEQLVSMTKNQNISALQQYGGASLSNLLKSIPDKGINGDDADLSKRKNAFGTNTYPRKKGRSFWLIRIPEDGGQEAVSDYRQSLQFQNLNAEKQNIKLEVIRGGRTIQISIFDIVVGDLVPLKIGDQVPADGVVITGHSLAIDESSMTGESKIDQKTPFLMSGCKVADGIGAMLVTGVGINTEWGLLMASISEDTGEETPLQVRLNGVATFIGIVGLTVAVCVLAVLLGRYFSGHSKDLDGKVQFVAGETSISKAVDGSLAGNNCGGCSARRSTFSSYLNVRRLSACETMGSATTICSDKTGTLTLNQVGSVARGLDSPRGAMAIIYIYAYE

SEQ ID NO: 224833 - protein, 433 aa, Glycine max
  Coding DNA Sequence Number=SeqID_108055
  Gene Ontology: Mol. function=carboxy-cis,cis-muconate cyclase activity; Cellular component=cytoplasm; Biological process =carbohydrate metabolic process
  Homolog annotation: Hit_ID=Q2XGM8; Match level="QueryCoverage=87%, HitCoverage=96%, E-value=6e-63, Identity=38%"; Hit description =Hypothetical protein precursor
  Pfam annotation: Domain name=Cytochrom_D1; Domain location=60-402; Score=-158.5; E_value=0.067; Accession=PF02239.7; Description =Cytochrome D1 heme domain
  Pfam annotation: Domain name=SGL; Domain location=124-365; Score= -93.4; E_value=0.0021; Accession=PF08450.2; Description=SMP -30GluconolaconaseLRE-like region
  Pfam module annotation: Pfam domain module=Cytochrom_D1::SGL; Domain location=60-402::124-365
MSGYPKPATGGLATNLTVAISLALLTLAGSAMAQNTEHHQTALVGTWTSIPDAPAVQKPDRPSEGLYRMQVNSDGTLKPLEVIRMKSPSWIVKSRDGRFAYTTNEENAGAVTALAIDKQGAVRVLNQVDSHGEQPTHATLSPDGKFLFVANYSVAKGGAGVTVFPIASDGKLGEQVQHFAFSEGSGVVKDRQDGGHAHSTTFTHDGRYLYAADLGDDKLHAYRYHADRREPLQADTSRDVSFAPGAGPRHMVFSADGKHAYVITEMAGEIVVFRVTDDRLERQAQVALNTQNSSAACKSGGGIILSPQGKFLIAANRGSDNHLLVFKIAADGSLTDPQRYAADGIEPRALAFDNSGKHLYVTNVFTNTITLFDFDAHSGKLSARGVAAKLATPTDINSSTNCPFTHPVRVTAHRLPPWPTARFPAKPETSGRD

SEQ ID NO: 224834 - protein, 234 aa, Glycine max
  Coding DNA Sequence Number=SeqID_108056
  Gene Ontology: Mol. function=inositol or phosphatidylinositol phosphatase activity; Cellular component=integral to membrane; Biological process=carbohydrate metabolic process
  Homolog annotation: Hit_ID=Q0MII4; Match level="QueryCoverage=86%, HitCoverage=76%, E-value=5e-76, Identity=66%"; Hit description =Inositol-1(Or 4)-monophosphatase
  Pfam annotation: Domain name=Inositol_P; Domain location=1-208; Score= 124.1; E_value=3.9e-34; Accession=PF00459.15; Description=Inositol monophosphatase family
MIDQQIRASFPDDGFLGEEYGLQPGTSGYTWVVDPIDGTSPFLNGMPNWCVSVAVLHDGVPVIGVIFAPTYQECYVAALGQGATLNGRRLQVDPSRTLQNHVTGFGANSYVSPEEVGRLLASLLAAGGNFIRIGSGALMLAWVAAGRVVGYFEPYMHAWDCLAGYCLVKEAGGWYHPFNTEGDRLLKGAQVLAVAPGAQAELRADCPAFKWCISRPRGVFRVAIHGDLTTLALS

SEQ ID NO: 224835 - protein, 188 aa, Glycine max
  Coding DNA Sequence Number=SeqID_108057
  Gene Ontology: Mol. function=lysine permease activity; Cellular component=membrane; Biological process=amino acid transport
  Homolog annotation: Hit_ID=Q4K7X2; Match level="QueryCoverage=98%, HitCoverage=84%, E-value=5e-51, Identity=57%"; Hit description =Transporter, LysE family
  Pfam annotation: Domain name=LysE; Domain location=2-181; Score=75.7; E_value=1.5e-19; Accession=PF01810.9; Description=LysE type translocator
MLTLAMQRGYLHGFWLGMGTCVGDLIYALLAMAGMAVILQFTPVRWLLWIGGGILLLWFAAKMLYAALAKKIDIPTAETQPYRSLLREFRRGIVLAMSSPTAILWFASVGGALIARIGHSDAAATSWFLSGFFLAGVVWTCVICLIGSMGGKLLGERLLKYSYLASALIFCYFAVYVIWSGYREFVAV

SEQ ID NO: 224836 - protein, 144 aa, Glycine max
  Coding DNA Sequence Number=SeqID_108058
MVSTRGLGRDLSHVTGRGVGRGDRDDFDDALQHRWPTASTRRQRVPVTTVHNEPVVPVAEADGASIEANVYADEPMAGGDVQDTGADISADTGAQAAEDEPKGFSGGPSDPSVLIGYADHIAGNIWMGEEHPELKLSSHGEEGP

SEQ ID NO: 224837 - protein, 135 aa, Glycine max
  Coding DNA Sequence Number=SeqID_108059
MMSLSQMQSQFQSQMQSQGLALPPKLEVGPSASHVSTKENCVDPLENDPDMGDSKKCGFYIEENPPHLVSLGRLYEGSTTIHNMPLHHDQLKVGVDEVKDANAPVPIPTDEEVVGPAKPADRPDYEVDDPLYLMT

SEQ ID NO: 224838 - protein, 66 aa, Glycine max
  Coding DNA Sequence Number=SeqID_108060
MGGYSADKDSVDDTVCKKYDIGKEKWTQFFQIRKDPSWEYVRKKAQVIQKQNIAPQVLSLGGYEFR

SEQ ID NO: 224839 - protein, 198 aa, Glycine max
  Coding DNA Sequence Number=SeqID_108061
GISARQRDSKVSMTDLVSAEDDAFSSYRQLKVYTDNHSGISARQRDSKVSMTDLVSAEDDVAEDDVSLYVLTGFSSYRQQKVYTDNHSGISARQRDSKVSMTHLVSVEDDGAEDDISLCVLSGFSSYRQQKVYTDNHSGISARQRDSKVRVTDLVSAEDDGAEDDISLCVLSGFSSYRQQKVYTDNHSGISARQRDSK

SEQ ID NO: 224840 - protein, 215 aa, Glycine max
  Coding DNA Sequence Number=SeqID_108062
  Homolog annotation: Hit_ID=Q6WAU0; Match level="QueryCoverage=31%, HitCoverage=19%, E-value=9e-16, Identity=52%"; Hit description=(+) -pulegone reductase
MLEVLIDNKLEPYLLPVVPEEIKVEAFTVYDYYHLYPKFLDIVLPYIREGKITYVEDIAKGLKNDPATPEAMFKGRSAGKQERSQRTVERVHLLKVLETRKSALQKSKAWHLLVLLLLCWVPHPSTYGLDNLAYAIFCYMSGMHAQNSGIFGEENMKLDNGLKLKLLKRCPIAQTWRWKKLMILSSLIKFLFMPSKSHSLSSLIGWYFSLSPSFE

SEQ ID NO: 224841 - protein, 116 aa, Glycine max
  Coding DNA Sequence Number=SeqID_108063
MVLQEAECEVAPLLKLVLHSVHVVHLDDAVAAEGVVDGVVQPNEKVDLAEIRIENETMREAAMEERYGERLKIWLVAHIWRRRLAATLAIFKKRCLAIRSLQQILKPRSHWKLANF

SEQ ID NO: 224842 - protein, 214 aa, Glycine max
  Coding DNA Sequence Number=SeqID_108064
  Gene Ontology: Mol. function=chitin binding; Cellular component =extracellular region; Biological process=chitin metabolic process
  Homolog annotation: Hit_ID=UPI000044A8F0; Match level="QueryCoverage =81%, HitCoverage=99%, E-value=5e-22, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAIRGLHALAFVGLHALTFRGLHTLIFRGLYVLPLRGLHVLAFGGLHALTFRGLHALTFRALHVLAIRGLHVLAIRGLHVLAFRGLHALVLRGLHVLANRGLHVLTFRGPHVLTFRGLDVLAVEGLHALVLRGLHVLANRGLDVLTFRGPHVLTFRGLDVIAFRRLHALSFRGLDTLATLGNNKLGGKRAETDSVPFIIQEQRVEWNNKLG

SEQ ID NO: 224843 - protein, 65 aa, Glycine max
  Coding DNA Sequence Number=SeqID_108065
  Gene Ontology: Mol. function=dihydroneopterin triphosphate pyrophosphohydrolase activity; Cellular component=cytosol
  Homolog annotation: Hit_ID=Q9CA40; Match level="QueryCoverage=62%, HitCoverage=27%, E-value=2e-10, Identity=58%"; Hit description=Nudix hydrolase 1
MEVRGGRARARRVPSRNRDVEEQVPQNLEPTKCDGWDWYEWDHLPHPLVGPLEKMVKGAFDPFPI

SEQ ID NO: 224844 - protein, 271 aa, Glycine max
  Coding DNA Sequence Number=SeqID_108066
  Homolog annotation: Hit_ID=Q2QLN3; Match level="QueryCoverage=31%, HitCoverage=21%, E-value=1e-20, Identity=53%"; Hit description =Expressed protein
MDFDKTDVKNCTAEATAVVEAATTTSEFISAAIKKHSTTDYSVNTLVEALMLCFRAKDTIENKALEEIGGTQLFMLNEEGLSLFSSSRWALYQLPKVVRLRNKLWWFLPWHLKHIPAGLLIGISLITLSFKNLSLNFQFHQLFLPSLSPHSDPILISALNNQTKVTIHSILRPTKAAMHDMTEEELLWRASMVPMIKELPYNHTPKVAFMFLTKGFVLLAPLWERFFKGNEAFYSIYVHSLPSFNDTVSQTSVFHGRRIRKVTACVFLLPN

SEQ ID NO: 224845 - protein, 47 aa, Glycine max
  Coding DNA Sequence Number=SeqID_108067
  Gene Ontology: Mol. function=DNA-directed RNA polymerase activity; Cellular component=DNA-directed RNA polymerase II, core complex; Biological process=transcription
  Homolog annotation: Hit_ID=Q9FLM8; Match level="QueryCoverage=91%, HitCoverage=86%, E-value=1e-15, Identity=81%"; Hit description =Similarity to metallothionein-I gene transcription activator
  Pfam annotation: Domain name=DNA_RNApol_7kD; Domain location=10-41; Score=82.2; E_value=1.6e-21; Accession=PF03604.4; Description=DNA directed RNA polymerase, 7 kDa subunit
  Pfam annotation: Domain name=PhnA_Zn_Ribbon; Domain location=9-37; Score=8.4; E_value=0.078; Accession=PF08274.2; Description=PhnA Zinc- Ribbon
  Pfam module annotation: Pfam domain module=DNA_RNApol_7kD::PhnA_Zn _Ribbon; Domain location=10-41::9-37
MDPQPELASYICGDCGMENTLKPSDVIQCRECGYRILYKKRTRRSKL

SEQ ID NO: 224846 - protein, 96 aa, Glycine max
  Coding DNA Sequence Number=SeqID_108068
MSWLFKSNHPDPKSSNLHDYTIIHSSSPPQAVADCHCIKDDNAESKEPFSQNALMMVFYVGRSLKSSWTMSYLWEWRYAAKRALRERTMQIWAPKS

SEQ ID NO: 224847 - protein, 79 aa, Glycine max
  Coding DNA Sequence Number=SeqID_108069
MGISGKKRNIGSKGLSKEIIQGRLIWLEAYKNKMPKLSANMHGKQEVSTRVKPRLLCKQSMGQNTPNKIDDDGSNSHYG

SEQ ID NO: 224848 - protein, 221 aa, Glycine max
  Coding DNA Sequence Number=SeqID_108070
  Gene Ontology: Mol. function=nucleic acid binding; Biological process= DNA integration
NVEDYLDWEMKVEQFFACHHIREERKVPLATLSFQGYALYWWTSLVREQRIHGDPLVEYWNDLKSALRKRHIPSYYERELMDKLQRLRQGTGLVEGSFMMMNQEISMMPKVQVIDSRLQDHDPRIQSKIQDSREEIKKQQVKTSYRIRYILCDTSRGYIYLGCNTENKRGYISCASVQVEGTSTWLFKENKGGYIPCGSLLVKDFTSLLEISRTGGCLGTG

SEQ ID NO: 224849 - protein, 42 aa, Glycine max
  Coding DNA Sequence Number=SeqID_108071
MSEIGRFGGLGMEERRKEEGPAQGFMENVIFIKQDTWPSVLL

SEQ ID NO: 224850 - protein, 74 aa, Glycine max
  Coding DNA Sequence Number=SeqID_108072
SARIIYCLPTLCVWLCHILNSSGDHSLLGCDPRLTTSRGRANSNRPIWAFQDALQKAVPSGGSTLARLGELGGK

SEQ ID NO: 224851 - protein, 237 aa, Glycine max
  Coding DNA Sequence Number=SeqID_108073
  Gene Ontology: Mol. function=DNA binding
  Homolog annotation: Hit_ID=Q1STZ2; Match level="QueryCoverage=94%, HitCoverage=59%, E-value=3e-24, Identity=31%"; Hit description=IMP dehydrogenase/GMP reductase
MGQLQRQAFRKAYGKIWDLARVEVSMEPIASLSQYYDRPLRCFTFEDFQLVPTVKEFEEILGCPLGGRKPYLFSGFYPSMTRVAKVVKISAQELNQANGLSFIDILALLIFGVVLFPNKEGLVDLAVIDAFLAFHHGKESPVDAILAMYDTFDRGGEKSGARIVCCALALYVWLVSHLFLQEGRKNRDSIFIRRMCKGSLDGTRGCINYNPVLAIRQLGYLMRGVPSDESITPFIAR

SEQ ID NO: 224852 - protein, 52 aa, Glycine max
  Coding DNA Sequence Number=SeqID_108074
MRGITQAGKEWLGLPNKEGPQNKAQSNTHAERALRAKPMIQQKHALSLQYAR

SEQ ID NO: 224853 - protein, 160 aa, Glycine max
  Coding DNA Sequence Number=SeqID_108075
MALLKDHLCLINPKIRTMCCCRDAWLHLGNCIWKKGGLTAAKNSVGLALDKVSIKVIPFTIIEVSYVRFQTIQTTTLRLRNGGSLNAVKVIPLIEVRYMRFQTLQTTTLRLRNGGSLNAVKVIPFRILQVRYMRFRTLQATTLRCVCLEEMLMGTSQVTL

SEQ ID NO: 224854 - protein, 39 aa, Glycine max
  Coding DNA Sequence Number=SeqID_108076
MMRTASQKWGYIRIMAGTIFGGILGFYVMHRLETNYKVY

SEQ ID NO: 224855 - protein, 93 aa, Glycine max
  Coding DNA Sequence Number=SeqID_108077
MSLSSWQNKLNRCFMLKILLMKGGQWFYKEKSLVSMLKMMIQPLIIVTLFSLLTCLRHMATPPSSPPPKSTPSPSTRKRTRKATQLKSLFVIP

SEQ ID NO: 224856 - protein, 65 aa, Glycine max
  Coding DNA Sequence Number=SeqID_108078
MVKEWDFQSSNPSRRNIKGIVVFNQQTEAGAVKAIDEGAFGCSGGGEGAENRGDGKMKSHERMEE

SEQ ID NO: 224857 - protein, 72 aa, Glycine max
  Coding DNA Sequence Number=SeqID_108079
MKKLMQNSQRDVYLGAYLNSALKGFKDIQGSKSKAIAKCIAAKCNKQKGSTECGSYMMHWMSTIVLGGFKDI

SEQ ID NO: 224858 - protein, 62 aa, Glycine max
  Coding DNA Sequence Number=SeqID_108080
MMIENFRSWEQMSSSRCLGEKSFVGAANPTVIDFATYDIEEKAQASYDMLDFVRKDVSRRYG

SEQ ID NO: 224859 - protein, 62 aa, Glycine max
  Coding DNA Sequence Number=SeqID_108081
MAVTGGRGWWRRRFVMLDSLRKNFAHPGELAQLRLTYASSGRIPTPTYFISYVKISSSRCYF

SEQ ID NO: 224860 - protein, 135 aa, Glycine max
  Coding DNA Sequence Number=SeqID_108082
MERGSQTKLVDVEMGDRLEDMIHDLGQEPFQQAHALIQQGNDINVYLGPLMEDLTKLWDEGVELLDGVIDTLLNIQGKTKDGFNTRQDLAEMGLGSSSSMDSFASWKMNGSGMEKEEREETPLQGEDESRRSSPP

SEQ ID NO: 224861 - protein, 198 aa, Glycine max
  Coding DNA Sequence Number=SeqID_108083
MAIYELDPDVVCWGLHLLDDCTLSHHYSPSIVTQYDPDLSQVEYVTEGFCQHQYVDSDEAVAQAYQEELWQLVSMVASGNDNFGESHNMKEVGNYGPTPSERKNGVHENNVCGSSSGSVEVPTTSTSDDFWDSLEISDESLDGEVGKRLNQMVPIPAMRLVVHFPLWFLFLQFSTNKFKGNETPESVSGRQVFKIKTV

SEQ ID NO: 224862 - protein, 424 aa, Glycine max
  Coding DNA Sequence Number=SeqID_108084
  Homolog annotation: Hit_ID=Q1T493; Match level="QueryCoverage=86%, HitCoverage=78%, E-value=9e-29, Identity=25%"; Hit description =Nucleic acid-binding, OB-fold, subgroup
MAHSPDKIKNIDGSKETLKLAVRITDLWPLCCNFNGIQGDEIHVVCKQDQLKSRKMDLKENCTYVMHNFKMIKNNGSGFADVVAGQFEPGLLVDVIGVVEEVVFHHVSGKGRRVVFKLKDLSQQFLSCTLWDDYCLQFLKFLDDHEGHGPITVLLTHGRIKEAQGSYPPSVNNSFKASKLVINQPVMEIQEFNEWLVELGTQARSVFKFHGEGSSQVSGSIQLSSKESFFGKVKEVVCVTVGTITRIVMDNHSWCYTTCIQCHKKSDAEMAPFTCACGKYNKEVVLRYRLEVMINHRDESTKFLLWDCECTELIVQSADAVNRLKIEDGDVDLNASPEALDKLLGYVLAFKIKVQPKFRNSTVLKCSTDSSLINAVMDMLADAEQSMSVTADHDPLFRLPLTPTKRQAFQDCDDEAGSSQISPA

SEQ ID NO: 224863 - protein, 156 aa, Glycine max
  Coding DNA Sequence Number=SeqID_108085
  Gene Ontology: Mol. function=RNA-directed DNA polymerase activity; Biological process=RNA-dependent DNA replication
  Pfam annotation: Domain name=rve; Domain location=9-119; Score=-14.2; E_value=0.091; Accession=PF00665.16; Description=Integrase core domain
MEMPQNNMLVVEMFDMWGIDFMGPFLKSFGNEYILVVVDYMSKREKAVALPINDSLVVTQKLATPYHPQTSGQVELSNSELKIILEKTVSASRKDWAIKLDDALWAYRTTFKTLIELEHKACWALKFLNFNPKLEAYENAKIYKEKTKRWHDARIR

SEQ ID NO: 224864 - protein, 62 aa, Glycine max
  Coding DNA Sequence Number=SeqID_108086
  Subcellular localization annotation: CTP_CleavageSite=44; ConfidenceScore=5.43e-01
MPTSSRQLGSSSPKSYSLHPAAVILLPQTMFVIITGNSLSVSTRNSHLGNHAEFIETTRLCM

SEQ ID NO: 224865 - protein, 52 aa, Glycine max
  Coding DNA Sequence Number=SeqID_108087
MSISRMIAQLTSMKMSCQSINLNDVHDENGHLRLEVLGIILDGSAHSTSVRQ

SEQ ID NO: 224866 - protein, 128 aa, Glycine max
  Coding DNA Sequence Number=SeqID_108088
MGFPLPRVTYLAENLSGQGSKKSKVVSQWGLLSREPDLDIWDKTNSCVKVSVSGRTSILFHKVRSTMMIWKQRAKLVMATARWALKHPVHGIVILRLGIYTNRPNETKIMFFHQFNEFIHSYLGYSGK

SEQ ID NO: 224867 - protein, 289 aa, Glycine max
  Coding DNA Sequence Number=SeqID_108089
MKVMQKSSLAGRQSQNLEIGDNNKHYRLNWRNNADITSFYFTHFPDEANEELLWRHFKNWGDVREVYIAKRLNKDGRRYGFMRFKGVSDAKGLEKKNPIRRKYTDEASKPCGITTGALRRSYVDVMTKGGGGCPGDQRADEAQTPTILINPDEGGEYWCNETWVGMLKKVMEVETLEDRITWELGYNVRTKFLGDDMVLLPGMSDDKAQLLIQSETESDDSLFYSLEKRDVAAIGDVLESDDDTEDPRRLDRARVLVRTPVPPLIRSEVIVRVGELEYRVWIVEETGFE

SEQ ID NO: 224868 - protein, 180 aa, Glycine max
  Coding DNA Sequence Number=SeqID_108090
MLMSPSARMPSYGGAPGWGCCTPIQEQPTHEVNYMGNQPVNNFNAGGFSGFQHGQQYNQQQGQWRNHPGNQFNRDQGGPSTRLQQLGPSIYDHTTKLEETLAQFMQVSMSNQKSIEFAIKNLEVQVGQLAKQLADRSSSSFIANTEKNPMEECKAMMTRSKKAIHVDESEAEKKMEEHKK

SEQ ID NO: 224869 - protein, 109 aa, Glycine max
  Coding DNA Sequence Number=SeqID_108091
KYCTQRQAQGDAPQATGAPPPPHQAGQAGAFDMEQYLRHLVRQQAANHRAHTSSGQRLHGPEIGPRPKRERRPQKLLAMENRPTRTRRWPICLTSWEGVEIRDWEIPRF

SEQ ID NO: 224870 - protein, 49 aa, Glycine max
  Coding DNA Sequence Number=SeqID_108092
MWNGSIAHVLGEGQVKLELSSENFHVLHGVYHISDIRKNLATFVMACLS

SEQ ID NO: 224871 - protein, 88 aa, Glycine max
  Coding DNA Sequence Number=SeqID_108093
MLQPCGIGTGLKEHSNWVTPKTYTLKSSLGPLPPDSAYNTSNVTSRVNHTVIHKQNSFTIPHLIVSQSTITCLHVSHKLTHVQLCTYT

SEQ ID NO: 224872 - protein, 48 aa, Glycine max
  Coding DNA Sequence Number=SeqID_108094
MAKVHLIAMPYACDILQDVPSQVDGRKIKLPIVIQCTFKWYTVTGQLG

SEQ ID NO: 224873 - protein, 84 aa, Glycine max
  Coding DNA Sequence Number=SeqID_108095
  Homolog annotation: Hit_ID=Q9XIE6; Match level="QueryCoverage=73%, HitCoverage=6%, E-value=4e-16, Identity=60%"; Hit description =Putative phospholipid-transporting ATPase 3
MFCKIKSGSLYPGKSCRLETLSRLSRMHFLASTNADGVCYIEIRTALEKTWDYATPEKASEFKVTVTFRVCLDEEILRISNFSI

SEQ ID NO: 224874 - protein, 396 aa, Glycine max
  Coding DNA Sequence Number=SeqID_108096
  Gene Ontology: Mol. function=exonuclease activity; Cellular component= chromosome; Biological process=DNA metabolic process
  Homolog annotation: Hit_ID=UPI00005F80EF; Match level="QueryCoverage =99%, HitCoverage=37%, E-value=2e-60, Identity=35%"; Hit description =COG0419: ATPase involved in DNA repair
QFAAFLNADANDRAELLEELTGTEIYGRLSEQVFESHKQAKTDLDGLHQRASGIELLNDEQRHSLTEQLTALSAQESALGKQTQQQQQALSWLQQWQRLQQQQNEGQRRLETAQREQTEAAPQLQRLALSEPAEKLRPLRGERDRCRAELQTIQQQAAQLTQQQEQHSAQLAPLQQAVEKARLAQQAHAEHMRQQQQLIDDQVAPLDHQIAQLQSTQAERRQAGDAAAQQCAKQKTTLEQLTAERSQLTAQAAQHQQRLNALTEALAVQQQQQQALAAQTPLAPLRQRLSALADLRPTRQQLFTLASLSQQVVKRLEQQRQELNIGQNELTQLEPQLELIRQQFKQQKAHQADVEKTYALEQRIVGLEAERARLQPGAPCPLCGSCEHPAVEQYQE

SEQ ID NO: 224875 - protein, 53 aa, Glycine max
  Coding DNA Sequence Number=SeqID_108097
MMQGSSTHAAESKRMLRDEKMERFGCKVSDSGLAPLPVLSALPMIVKQNDVGA

SEQ ID NO: 224876 - protein, 250 aa, Glycine max
  Coding DNA Sequence Number=SeqID_108098
  Pfam annotation: Domain name=F-box; Domain location=95-142; Score =38.9; E_value=1.8e-08; Accession=PF00646.23; Description=F-box domain
  Pfam annotation: Domain name=WD40; Domain location=182-220; Score =25.7; E_value=0.00017; Accession=PF00400.22; Description=WD domain, G-beta repeat
  Pfam module annotation: Pfam domain module=F-box::WD40; Domain location=95-142::182-220
MAFECPNGAEVSQSLAHFVANPGIGIVESNLQLCPKSFTEGIATSKFVPDTKPESGKGVKLKGASKINSKKGIKAPVSALNQSSIPGDVVFNCGLSITDLPPALISEILNCLDPKDLGVVSCVSPILQRVASEHHAWKQFYCERWGLPAASLAVGSGVVDDDKSWRELFVEREFRSKTFMGQYSIDVLYGHTEAVRTIFLLASAKLIFTSGYDSVVRMWDMENGLSIASSRPLGCTIRAVAADRKLLVAG

SEQ ID NO: 224877 - protein, 262 aa, Glycine max
  Coding DNA Sequence Number=SeqID_108099
EFDEFKVELERRNLHKRLTNLQDGSIDVVVVKEFYANLYTTEDQAPKQARVREHLIKIDADSLNEFLHIPVVLEEEESLPTNSRFCRLRSNPQEIEAKLYIPRKGFILNAEGQPWKLLRKDLTTLAQTWSVFSYSNLAPTSHTSDLNMDKARLVYGLVTHVDMNIGALISSQISAIAQSNSSRLGFPALIIALCRARGVTFGSLTYESLSPTINLAYIKKNCWNMDDLTVNFRGARKARARPAYAPSSSTPPAPPGLSAQDF

SEQ ID NO: 224878 - protein, 252 aa, Glycine max
  Coding DNA Sequence Number=SeqID_108100
  Gene Ontology: Mol. function=nucleic acid binding; Biological process= DNA integration
MKVALSVKNKTAFIDGTLSKPEEKAPTYAAWTCANNIVISWLYNSVSKEIITSILFVNTTKEIWDDLKTRFSRKNGPRIFQLKCQLMPLQQGTNDISMYYTKLKSIWEELAGYKPTFPCTCGGVQQLQTHNESKVTPAVFIGYPHGYKGYKLLDLTTLQTFISRDPHANSRVPNSRSFCTMSFDRDSIEYDIISVGVDPADLSTAIRLKQMCRQRNTDLSVCVLEKGMIWLPSHVLDEAYDSKIHIQIQILK

SEQ ID NO: 224879 - protein, 192 aa, Glycine max
  Coding DNA Sequence Number=SeqID_108101
  Homolog annotation: Hit_ID=Q8RYE6; Match level="QueryCoverage=39%, HitCoverage=40%, E-value=3e-07, Identity=37%"; Hit description =Expressed protein
MSSKPSNIVVQRNHQRKEKDTMMSLDHSKLKRELSNLSNEAYHVESSSIPFVWESQPGTPKVRFKENSLPPLTPPPSYFQNATKKATTKAKNKNSPKSSFLQTLFPKRATRKGGVPPQTGSQNIWSYSSNSPSSSSSSSSSSLSFSSPRPTSYSVPSSPMIHSRKGEEDEDLYEAHSCLFSMVVVNNVWLVG

SEQ ID NO: 224880 - protein, 99 aa, Glycine max
  Coding DNA Sequence Number=SeqID_108102
  Homolog annotation: Hit_ID=Q2QYM8; Match level="QueryCoverage=92%, HitCoverage=88%, E-value=6e-13, Identity=45%"; Hit description =Expressed protein
MCPLRFILIFLSATLAGFLVLRNLRSQPHTTDVTELEDANSENEHTTLTSDAASPSLNHANATSKVWGALLSGFWTFLDMASGRYLWKHLVSSSSTKPE

SEQ ID NO: 224881 - protein, 452 aa, Glycine max
  Coding DNA Sequence Number=SeqID_108103
  Gene Ontology: Mol. function=protein serine/threonine kinase activity; Cellular component=cytoplasm; Biological process=protein amino acid phosphorylation
  Homolog annotation: Hit_ID=Q8H2C2; Match level="QueryCoverage=95%, HitCoverage=94%, E-value=1e-164, Identity=66%"; Hit description =Serine/threonine kinase
  Pfam annotation: Domain name=NAF; Domain location=304-363; Score =105.8; E_value=1.3e-28; Accession=PF03822.5; Description=NAF domain
  Pfam annotation: Domain name=Pkinase; Domain location=4-258; Score =333.1; E_value=4.9e-97; Accession=PF00069.15; Description=Protein kinase domain
  Pfam annotation: Domain name=Pkinase_Tyr; Domain location=4-256; Score=48.6; E_value=1.9e-15; Accession=PF07714.7; Description =Protein tyrosine kinase
  Pfam module annotation: Pfam domain module=NAF::Pkinase::Pkinase_Tyr; Domain location=304-363::4-258::4-256
MQKYELGRLLGQGTFAKVYYARSTITNQSVAVKVIDKDKVIKNGQADHIKREISVMRLIKHPNVIELFEVMATKSKIYFVMEYAKGGELFKKVAKGKLKEEVAHKYFRQLVSAVDFCHSRGVYHRDIKPENILLDENENLKVSDFRLSALAESKRQDGLLHTTCGTPAYVAPEVIKRKGYDGAKADIWSCGVVLFVLLAGYFPFHDPNMMEMYRKISKAEFKCPSWFPQGVQRLLRKMLDPNPETRISIDKVKQCSWFRKGPNGRQKTQEGENLCVSPSVTNHSEQCGDESDDLAAEAREEQVVPVSINAFDIISLSPGFNLCGFFEDSIQKREARFTSRQPASVIISRLEEIAKQMRMKIKKRAAGLLKLEGLHEGRKGILSIDTEIFEVTPLLHLVEVKKSNGDTLEYEKILKEDIRPALKDVVWVWQGDQQEQSQQLEQQKQQQQLPQS

SEQ ID NO: 224882 - protein, 102 aa, Glycine max
  Coding DNA Sequence Number=SeqID_108104
  Gene Ontology: Mol. function=transition metal ion binding; Biological process=cytoskeleton organization and biogenesis
  Pfam annotation: Domain name=Transposase_21; Domain location=1-102; Score=3.5; E_value=6.6e-15; Accession=PF02992.5; Description =Transposase family tnp2
PRQPRNDIDVYLSPLIEELTKLWDEGVAVFDGYRNETFKLRAMLFCTINDFPTYENLSGYNVKGHCACPICEEDTSYVQLKHGRKIVYTWHRHFLKPYHPYR

SEQ ID NO: 224883 - protein, 320 aa, Glycine max
  Coding DNA Sequence Number=SeqID_108105
MIVYNLMCEQAKILANILNKSVLHKAGSKTTLSDLHKFFLFHLMENLPFDFPYTIYINILRNLKGLGGLNIIYYASLINMMLWEQSMYQVFNKMDDDSKHTLIAKGLVVAKKLKFSKTNLKDTKVALEHSEKDAPQVDLIAINKRKQKGLAKAIADEDQGVNNFGISKNGQKIMAEKQKKNKTRKHSQKEEEEEDKMKKRHEQSTASIPVHLVAGTSILQRLKDLSKIDEKDEGFVQVYFHKRKSCSLAFSCPHKESRKFNQLQNQENLSFRLQYQGISRQGLLKPILRLVKRSGQSASQGTNVGQMASVILRRGELISH

SEQ ID NO: 224884 - protein, 35 aa, Glycine max
  Coding DNA Sequence Number=SeqID_108106
MSYTGSLSAPLHLTKRTASVHPLSEKGKVKPKLTN

SEQ ID NO: 224885 - protein, 80 aa, Glycine max
  Coding DNA Sequence Number=SeqID_108107
  Gene Ontology: Mol. function=oxidoreductase activity; Cellular component=vacuole; Biological process=response to oxidative stress
  Homolog annotation: Hit_ID=Q9XFL4; Match level="QueryCoverage=61%, HitCoverage=15%, E-value=1e-17, Identity=84%"; Hit description =Peroxidase 3
  Subcellular localization annotation: CTP_CleavageSite=50; ConfidenceScore=5.14e-01
MALSSSSSSTSIFALALFTLLLIGSSSAQLSENFYDSKCPKVFYAVKSVLQSALAKEPRQGASIVRLFFHDCFVNVNYYS

SEQ ID NO: 224886 - protein, 381 aa, Glycine max
  Coding DNA Sequence Number=SeqID_108108
  Homolog annotation: Hit_ID=Q9FBS5; Match level="QueryCoverage=35%, HitCoverage=32%, E-value=4e-23, Identity=46%"; Hit description =Putative secreted sugar-binding protein
ALQLHADAGHVVLAVDRVLVGERARRRPLVLGEVDELGGELGRRRDGLHHIGCVPGGEQAGDGSLDALGARVLDDDVDLGVRLLEGGDEVVPELLREVRGDVDEHADGDVLRGVTAVCGSGRAAGEGEGGDRRDADKGENSGLDHRAAAGAVGGHGVAIRAGGGAVALRAGDRLTGVVGADGQPRPLVAADHVDERHRGLHEHALGERSVVGHGVQVPVGTVVPHQSRRQPHLREGVVHVCRHLVARGEQHRPQAGAQRAQFVELDRVVIDPAGVGEDLEERRLVGPRDEGVGVFGGVRQPDGRAERVLGVIGEDHVDSLLRSRVASSFMSTVANDRPVRAGVGLGLPLAVAAAFAFGSSGAWARGLIDAGWTPGAAVTVR

SEQ ID NO: 224887 - protein, 114 aa, Glycine max
  Coding DNA Sequence Number=SeqID_108109
MDCKGLVDQALGGKSNMTKCVIFSSLLHLLYSSIVHVFQSKDGDYQTWKVVEPVDLYEEGWNIQLLAQYLLEWMLDKIVAYLVPNQQNRRDKPIWGPSPDGCFYAKTTYIVLAS

SEQ ID NO: 224888 - protein, 210 aa, Glycine max
  Coding DNA Sequence Number=SeqID_108110
  Gene Ontology: Mol. function=aminoacyl-tRNA ligase activity; Cellular component=membrane fraction; Biological process=tRNA aminoacylation for protein translation
  Homolog annotation: Hit_ID=Q9M876; Match level="QueryCoverage=73%, HitCoverage=27%, E-value=1e-39, Identity=57%"; Hit description =Putative tyrosyl-tRNA synthetase
  Subcellular localization annotation: CTP_CleavageSite=72; ConfidenceScore=5.86e-01
MASISAPTRTLLFTHSTKRFFRPFKPSSSPFPLQCTTKTTCSTLQQQQQPRRNNNYNVIGILEERGLVESITSDALRSACLTPAPLKVYCGFDPTAESLHLGNLLGLIVLSWFRCCGHRAVALIGGATALVGDPSGKSLERPELDAETLERNQLGISNTIHQILGRAQDSNLVGPNSNSDSNSDSNSSVVILNNYDWWKEFSLLDFLKRV

SEQ ID NO: 224889 - protein, 812 aa, Glycine max
  Coding DNA Sequence Number=SeqID_108111
  Gene Ontology: Mol. function=ubiquitin-protein ligase activity; Cellular component=ubiquitin ligase complex; Biological process =protein ubiquitination
  Homolog annotation: Hit_ID=Q84TU4; Match level="QueryCoverage=94%, HitCoverage=99%, E-value=0.0, Identity=56%"; Hit description=Arm repeat-containing protein
  Pfam annotation: Domain name=Arm; Domain location=558-598; Score =40.8; E_value=4.7e-09; Accession=PF00514.13; Description =Armadillobeta-catenin-like repeat
  Pfam annotation: Domain name=Arm; Domain location=599-639; Score =37.0; E_value=6.7e-08; Accession=PF00514.13; Description =Armadillobeta-catenin-like repeat
  Pfam annotation: Domain name=Arm; Domain location=640-680; Score =37.1; E_value=5.9e-08; Accession=PF00514.13; Description =Armadillobeta-catenin-like repeat
  Pfam annotation: Domain name=Arm; Domain location=681-720; Score =22.4; E_value=0.0016; Accession=PF00514.13; Description =Armadillobeta-catenin-like repeat
  Pfam annotation: Domain name=Arm; Domain location=721-761; Score =30.0; E_value=8.3e-06; Accession=PF00514.13; Description =Armadillobeta-catenin-like repeat
  Pfam annotation: Domain name=Arm; Domain location=763-803; Score =12.6; E_value=0.33; Accession=PF00514.13; Description=Armadillobeta -catenin-like repeat
  Pfam annotation: Domain name=U-box; Domain location=261-334; Score =91.2; E_value=3.2e-24; Accession=PF04564.6; Description=U-box domain
  Pfam module annotation: Pfam domain module=Arm::Arm::Arm::Arm::Arm::Ar m::U-box; Domain location=558-598::599-639::640-680::681-720::721 -761::763-803::261-334
  Subcellular localization annotation: CTP_CleavageSite=51; ConfidenceScore=5.22e-01
MQKHDSPVGYVSDLKILFIVKVSSLISLAYSRSWSSASSSGVMEISLLKVLSDAISSFSHLSFSERMKSEPVSKYYQKAEKMLKLLKPIIDTTVFSDLASNKLLSKLFEELSLAVDELRELSLNWHPLSSIRNVIQVDPLISTIQDLGLSILQQLKASPQSLLDNLRDEASSTIKKAIMEQLEGVGPSTEVLENIAENLGLRSNQEALIEAVALDKLKENAEQLENAVEVEFIDQMISVVNRMHEHLVMLKQAQSSIPVLVPADFCCPLSLELMMDPVIVASGQTYERAFIKNWIDLGLTVCPKTRQTLVHTNLIPNYTVKALIANWCESNDVKLVDPMKSKSLNQSSPFHGSMESGLIKDLPEIHQERTSTLHSSSTPSGSLNGMVNEQHVNLERISSTGSDDESASSDEGSVDSVDQSLMSPSTRESSNALSSEQSQTDVRTTSHNNTPLLSTSSVHSQDASGELNSGPDAVAMPTRHREPEFSPQLAVPRSRSQTLWQRSSEWLVPRVVSNPIETRADLSAAETQVRKLLEQLKSDSVDSKREATAELRLLAKENMDNRIVISNCGAISLIVDLLQSTDTRIQENSVTTLLNLSINDNNKAAIANSGAIEPLIHVLQTGSPEAKENSAATLFSLSVTEENKIRIGRSGAIRPLVDLLGNGTPRGKKDAATALFNLSLFHENKDRIVQAGAVKNLVELMDPAAGMVDKAVAVLANLATIPEGKTAIGQQGGIPVLVEVIELGSARGKENAAAALLHLCSDNHRYLNMVLQEGAVPPLVALSQSGTPRAKEKALALLNQFRSQRHGSAGRA

SEQ ID NO: 224890 - protein, 130 aa, Glycine max
  Coding DNA Sequence Number=SeqID_108112
MTPRGFTQGVVLGDGGGQMKGYCSRAVRSNHQLSSKVGSVLAKLSCTRLDDDELSARYKGFQEKKKDLTNKVEGIAVERGKLTKVVVDLEVWLKELESRLKESELRATKEMEAIKELEEELTMYKKEVVE

SEQ ID NO: 224891 - protein, 183 aa, Glycine max
  Coding DNA Sequence Number=SeqID_108113
  Gene Ontology: Mol. function=calcium ion binding; Cellular component =mitochondrion; Biological process=protein amino acid phosphorylation
  Homolog annotation: Hit_ID=Q1RSC2; Match level="QueryCoverage=99%, HitCoverage=83%, E-value=8e-26, Identity=33%"; Hit description =Pentatricopeptide repeat
  Pfam annotation: Domain name=PPR; Domain location=11-45; Score=28.3; E_value=2.8e-05; Accession=PF01535.11; Description=PPR repeat
  Pfam annotation: Domain name=PPR; Domain location=118-152; Score =15.2; E_value=0.12; Accession=PF01535.11; Description=PPR repeat
  Pfam module annotation: Pfam domain module=PPR::PPR; Domain location =11-45::118-152
MELTRIEPNLFTLSILINCFCYFGQMDLAFSLLGEILKLRLSPNYHNLEYTYENGLCKTKRVNDALNLFEEMHPDTVTYSSLIENQGESLICFMQKWPSYRAVALFNKMKDQACLNVRRYAVMINELCKEGLLDEALVLQSRMEDNGRISDAVTFEIVICAFFEEDENDKAEKLRKMIARGLL

SEQ ID NO: 224892 - protein, 152 aa, Glycine max
  Coding DNA Sequence Number=SeqID_108114
  Gene Ontology: Mol. function=aminoacyl-tRNA ligase activity; Biological process=tRNA aminoacylation for protein translation
  Homolog annotation: Hit_ID=Q9M876; Match level="QueryCoverage=88%, HitCoverage=26%, E-value=3e-45, Identity=66%"; Hit description =Putative tyrosyl-tRNA synthetase
  Pfam annotation: Domain name=S4; Domain location=72-119; Score=38.5; E_value=2.3e-08; Accession=PF01479.15; Description=S4 domain
MGKPGYVPNTAQRRLAEEVTRFVHGEDGLAEALKATEALRPGSETKLDWKTIEGIAEDVPCCSLAYDAVLNLSLVDLLVSSGLFESKSAARRLLKQGGLYLNNNRVDNEGKRIEAADIVDGKVLLLSAGKKNKVLIIEVKFQFCLENSTKNN

SEQ ID NO: 224893 - protein, 238 aa, Glycine max
  Coding DNA Sequence Number=SeqID_108115
  Homolog annotation: Hit_ID=Q8L5T5; Match level="QueryCoverage=61%, HitCoverage=66%, E-value=6e-51, Identity=70%"; Hit description=LOB domain-containing protein 15
  Pfam annotation: Domain name=DUF260; Domain location=46-146; Score =236.7; E_value=4.9e-68; Accession=PF03195.5; Description=Protein of unknown function DUF260
MFGHPETDRLDEIITKVRAEGEASCQMGRKHFYGPTPGTTLNTVTPCAACKLLRRRCAEECPFSPYFSPHEPQKFAAVHKVFGASNVSKMLMEVPEGQRADAANSLVYEANLRIRDPVYGCMGAISALQQQVQRLQVELNATRAEILKYKYREAAYAISIAAIPADSSQGLSQPQIQPHPPPPPPKPLPSPPPPKPLPSPSILLSSLSSSSASSVYTPPKSTMSLGSISTTENVPYFV

SEQ ID NO: 224894 - protein, 355 aa, Glycine max
  Coding DNA Sequence Number=SeqID_108116
  Gene Ontology: Mol. function=metal ion binding; Cellular component =intracellular; Biological process=protein kinase C activation
  Homolog annotation: Hit_ID=Q5SMW8; Match level="QueryCoverage=98%, HitCoverage=92%, E-value=1e-105, Identity=38%"; Hit description =Pentatricopeptide (PPR) repeat-containing protein-like
  Pfam annotation: Domain name=PPR; Domain location=131-165; Score=4.5; E_value=2.2; Accession=PF01535.11; Description=PPR repeat
  Pfam annotation: Domain name=PPR; Domain location=198-232; Score =34.7; E_value=3.2e-07; Accession=PF01535.11; Description=PPR repeat
  Pfam annotation: Domain name=PPR; Domain location=233-267; Score =14.2; E_value=0.16; Accession=PF01535.11; Description=PPR repeat
  Pfam annotation: Domain name=PPR; Domain location=269-302; Score =13.3; E_value=0.2; Accession=PF01535.11; Description=PPR repeat
  Pfam annotation: Domain name=PPR; Domain location=96-130; Score=34.5; E_value=3.7e-07; Accession=PF01535.11; Description=PPR repeat
  Pfam module annotation: Pfam domain module=PPR::PPR::PPR::PPR::PPR; Domain location=131-165::198-232::233-267::269-302::96-130
MIVGYSQRGYPHLALELFKDKKWSGILPNSVTVSSLLSSCAQLGNSVMGKLLHGLAVKCGLDDHPVRNALVDMYAKCGVVSDARCVFEAMLEKDVVSWNSIISGFVQSGEAYEALNLFRRMGLELFSPDAVTVVGILSACASLGMLHLGCSVHGLALKDGLVVSSIYVGTALLNFYAKCGDARAARMVFDSMGEKNAVTWGAMIGGYGMQGDGNGSLTLFRDMLEELVEPNEVVFTTILAACSHSGMVGEGSRLFNLMCGELNFVPSMKHYACMVDMLARAGNLEEALDFIERMPVQPSVSVFGAFLHGCGLHSRFELGGAAIKKMLELHPDEACYYVLVSNLYASDGRWGMVKQ

SEQ ID NO: 224895 - protein, 100 aa, Glycine max
  Coding DNA Sequence Number=SeqID_108117
APSEEGIAPFIARGFSDLNAKMLQRVRKAWNAVQRNDKELRGSNNGVIGGFQEKFKAITIRVRKECHKLRDGRVETGKYDIRGQVKGLSKVKEELDQIVE

SEQ ID NO: 224896 - protein, 67 aa, Glycine max
  Coding DNA Sequence Number=SeqID_108118
MNGKSGAWTSFVCMTFTPLTKNYYIEHELWFKLKPEIITWLDFVQCPKVQDEKIEDLDMDLMESAMV

SEQ ID NO: 224897 - protein, 125 aa, Glycine max
  Coding DNA Sequence Number=SeqID_108119
  Subcellular localization annotation: CTP_CleavageSite=28; ConfidenceScore=5.07e-01
MLLSSNVIYSCVRVVMLVRTIRTRLFTAARMKSCPGMHSSCVIASLSGCARTVGPPPISGGGPGTVWIWSPLKVRTHSPLKARACSPLKFKTCRLSKARECSPMMARTCNPLKVRACPPLKMGNM

SEQ ID NO: 224898 - protein, 270 aa, Glycine max
  Coding DNA Sequence Number=SeqID_108120
  Gene Ontology: Mol. function=methylated-DNA-[protein]-cysteine S -methyltransferase activity; Cellular component=intracellular; Biological process=regulation of transcription, DNA-dependent
  Homolog annotation: Hit_ID=UPI00005F97C4; Match level="QueryCoverage =98%, HitCoverage=73%, E-value=2e-92, Identity=63%"; Hit description =COG2169: Adenosine deaminase
  Pfam annotation: Domain name=DNA_binding_1; Domain location=187-270; Score=151.0; E_value=3.1e-42; Accession=PF01035.11; Description=6-O -methylguanine DNA methyltransfera
  Pfam annotation: Domain name=HTH_AraC; Domain location=56-101; Score =16.3; E_value=0.034; Accession=PF00165.13; Description=Bacterial regulatory helix-turn-helix proteins, araC family
  Pfam annotation: Domain name=HTH_AraC; Domain location=7-52; Score =36.4; E_value=1e-07; Accession=PF00165.13; Description=Bacterial regulatory helix-turn-helix proteins, araC family
  Pfam annotation: Domain name=Methyltransf_1N; Domain location=107 -185; Score=12.6; E_value=0.053; Accession=PF02870.6; Description=6-O- methylguanine DNA methyltransferase, ribonuclease-like domain
  Pfam module annotation: Pfam domain module=DNA_binding_1::HTH _AraC::HTH_AraC::Methyltransf_1N; Domain location=187-270::56-101::7 -52::107-185
HARQIAEACRYIERAEKAPSLQTLARHVGLSQYHFHRLFKAITGLTPKGYADAQRSQRLRTGLTQQETVTDAIFDAGYGANGRFYQQANAALGMTPKAYRAGGKGMRIHFAVGRCSLGEILAAQSEVGICAILLGDDAQRLVQDLQDKFPNAELIGGDAQYEALMAQVVGLIEAPENGLALPLDIRGTAFQQRVWRALQAIPVGETVSYADIARRIGAPKAVRAVAGACAANVLAVAIPCHRVVRNDGALSGYRWGVERKQALLEKEAQR

SEQ ID NO: 224899 - protein, 49 aa, Glycine max
  Coding DNA Sequence Number=SeqID_108121
MESQITKGKFTYLILGCLAAAFSVCPELGKGRRSVGRDPSLYLRPSLST

SEQ ID NO: 224900 - protein, 81 aa, Glycine max
  Coding DNA Sequence Number=SeqID_108122
MATQWWRSAVGLLQMRFVPDLDPCASQSRFMPGLYHALHVVELHHQNNVAMEEAPRVDHGGAFEGRDSGHDNAVEGPGQTA

SEQ ID NO: 224901 - protein, 90 aa, Glycine max
  Coding DNA Sequence Number=SeqID_108123
MIRIRGALHSTNVEYRFFHPRFSLHVCNLILTLLSSSIDFPIIVTRSSHPDVPSLVAMQPLLVFAVCWHWYLATIWSDGSVWHLLHLLGF

SEQ ID NO: 224902 - protein, 274 aa, Glycine max
  Coding DNA Sequence Number=SeqID_108124
  Gene Ontology: Mol. function=hydrolase activity; Biological process =intracellular signaling cascade
  Homolog annotation: Hit_ID=Q1T1F7; Match level="QueryCoverage=90%, HitCoverage=60%, E-value=2e-23, Identity=26%"; Hit description=IMP dehydrogenase/GMP reductase
  Pfam annotation: Domain name=DUF1723; Domain location=115-164; Score =54.2; E_value=4.3e-13; Accession=PF08330.1; Description=Protein of unknown function (DUF1723)
MVRTRGLGRALGCAVGKVMGRRGESDDDVPQRRRPTASARDADVEGFPSGSHDTSVLSDFENHIALSVWNGEERLELKLSFHGRKMTKFGKPAAEIEGLVVASGLGPLIACSLDTSDHGLMSAFVEHWHKETRSFHLPVGEVTITLDDVASLLHFLVLGAFHSFEQLHVDDAVEILVELLEVSAADARAETIQCHGSYVQLSWLRELYELKIEALFLDALSNLTQSAGYAWGAAALVHMYDNLNDVSKSTARQLAGYITLLQCWIYEHFPSVGK

SEQ ID NO: 224903 - protein, 2303 aa, Glycine max
  Coding DNA Sequence Number=SeqID_108125
  Gene Ontology: Mol. function=protein-tyrosine kinase activity; Biological process=protein amino acid phosphorylation
  Homolog annotation: Hit_ID=Q1SP36; Match level="QueryCoverage=51%, HitCoverage=83%, E-value=0.0, Identity=50%"; Hit description =Octicosapeptide/Phox/Bem1p; Protein kinase
  Pfam annotation: Domain name=PB1; Domain location=216-305; Score =91.8; E_value=2.1e-24; Accession=PF00564.15; Description=PB1 domain
  Pfam annotation: Domain name=Pkinase; Domain location=1131-1356; Score=-73.9; E_value=0.00037; Accession=PF00069.15; Description =Protein kinase domain
  Pfam annotation: Domain name=Pkinase_Tyr; Domain location=1131-1326; Score=-50.7; E_value=2.3e-09; Accession=PF07714.7; Description =Protein tyrosine kinase
  Pfam annotation: Domain name=rve; Domain location=2072-2211; Score= -5.9; E_value=0.019; Accession=PF00665.16; Description=Integrase core domain
  Pfam annotation: Domain name=zf-H2C2; Domain location=2013-2054; Score=7.7; E_value=0.034; Accession=PF09337.1; Description=His(2) -Cys(2) zinc finger
  Pfam module annotation: Pfam domain module=PB1::Pkinase::Pkinase _Tyr::RVT_1::rve::zf-H2C2; Domain location=216-305::1131-1356::1131 -1326::1613-1826::2072-2211::2013-2054
MAFEQNSVPVARVAEEPLVLPATTAAVAGAVPIFYPASVADAGLVGVGYGNVASVGGGGGAATWCVRPAVPVHNHNHSVNPAVGFSHAPSFTNRVATAAGGSNGVDVSGSFVAASHGYPMNLGSNWVATSNGNGLDSSNSSNSISNINGNGSGLQGNVKAISNASDHVGGVGVGSISNTPASQRTDLVSEEGGDDSVSGQKMKLMCSYGGKILPRPSDGMLRYVGGHTRIISVRRDVSFNDLVQKMVGTFGQAVVIKYQLPDEDLDALVSVSCPDDLENMMEEYERLIERCPDGSPKLRVFLFCAAELDPSGMVQFVNLDDGGMKYVEAVNGITDGIGGKLTRKASYTSAASTQNSDLSGVDALDSSNAARGDVSGVHVPLSGTLSPEGIVVASRDTAAANSVVSEPGVSYTDASVVSLGIRAVNSGPTHTPPVQNEVEFEKSVSVNFSHPQFGVQQLGSEIPPSAPLQTFVDTHQEVMNHADYVQLPPHMGFPNPQLLGKPCSIYSQQFHDNTSRFGSHHVIPAVQMTMTQPFSHAGVRPSVIQPQTFMQPQQNRLDQYNDDNTSGLRIHQLPAEQSYNAYPVQVPFGGNYGWVHVPLAEHVIFPDAFVPQQPVMIPEKVQRVEDCYMCQKKLPHSHSDPVVQDLRNSCAGTIPDSVPSFYSVPMGENSRAQATNMVLVTAPMKEDNIEQAVETRPKVISKLDTPAGVPSTDTTGLSLESEGEKVFIQKLDWSDHPRNAVVQEAVVRTGEKQSPTDGLMGTSPLSYQDDVARQHIVPVENWAKEDALVAKPVNNDIPFVGGTSVENSDCMVQQCPTEYTNELASTISKADAVENWISQDLLKPIDGRLDNPKIGNPENFLNNDKFDYSTQHAVEKKGVVSDNNHGKSKLTTGANQINMMDMLPSSTVEYNEVTQPPVWGIPGSNPQSKSGNLHKDDAVLSSVPPSVRLGDVQDSSNSLFSNQDLWNIHSTYFPPPRPNKVALKKETYSNKDQLCEIPGNSGEQNLESQIDNGLYQTFKQNLTLEEAKSAKVSSEDRQLQAVAEGLAASVLHSSTSSNLDLHARDVSHHEDTGNEDVQNNQTDIQHNDKTQEAGFTGGFVEDLKSKLPEKANFGFPVSDVGALQVIKNCDLEELIELGSGTFGTVYHGKWRGTDVAIKRINDRCFAGKPSEQERLAIKLADLHHPNVVAFYGVVLDGPGGSVATVTEYMVNGSLRNALQKNGRNLDKRKRLLIAMDVAFGMEDKSLDLEGRPKDWRVYVRRKGPQFFNGVIGDTLAEFRKSVKKVELLMFDRDNLSGWIVCAEVYFQVQGTHPNVKVNLAQLVTFLERLTVIQQAGSVEEYIREFERLTAQHASVGSPATLAHDELVRVVELELQERQGSWAGFWATSRAWRQWIGPGKPGRRSGSEYGRTPSNRGVNAKNGFKSEPNADPHRSNADLHPHLSYVELTEWKTKGLCYKCGSPFHPNPNLQCLDRQLRVMLVEEGEENKDGNLVTETDETDAEEEDSECNMLFLVVQLNFVSHRLVKAMGWLVKTTKTLNTKLGYGYKARAQGMCHGVKLGIGSLAFRVDTVLFYLERIDLILGIAWLAPLGKMMIDWGELVMLIKVDDKWVIIQGEGTQVTLPNPKKEEKLSSSIMATQEQELKALLGSFSKVFREPHGLPPRRCKEHAINLVKAQGLVNVRPYRHPHHHKDEIEKQMTLGGSVDYCALNKVTIPDKFPIPVFEELLDELHGAQFYSKLDLKFGYHQVRVKKAMSTKQHFAHMMATTNTWTVLVFFDDILVYNMSWEDRMTHLREVLIILQQHQLVVNQKKCTFVQQEVKYLGHIISARGVAVDPNKVKSVREWPMPQNTKGVRGFLGQTGYYRKFIQDYGKRAKPLTELTKKGGFKWNSQAKGAKALEERNLAKSAYEKELMAVALAIQHWRPYLLGRKFVVQTEQKSLRQLLLHRITTMDQQNWAATLLGMYGVAELHSLVHQAQWEDIQEAMREVHFDEKEVSVVIYFLLISLRCLKSFHETPQGGHSGYYRTYRRLVANLFWFGMKQSVQQFVMGCDTCQRQNYLAAAPGGLLQPLNIPEQIWEEISMDFITGLPKSKGYEAILVVVDRLSKYNHFIPLKHPYSARVLAEIFAKEVVHLHGVPASVLSDEDPIFVRTTPFEVVYGRKPPVLNRFLPGEVRVEAVRRELQDRDEALKQLKYQLQRAPNRKKDQADCKRKDRQFALGEWVFLKLRPHGQLTVGAHINPKLAPHYYGPFKVLEKVGAAAYRLSESARIHSVFHVSLLKKAVGDYNVEETLPFPWSWLVTMQQ

SEQ ID NO: 224904 - protein, 115 aa, Glycine max
  Coding DNA Sequence Number=SeqID_108126
  Subcellular localization annotation: CTP_CleavageSite=38; ConfidenceScore=5.37e-01
MAPRKLSIKRSRKDARPKGLVPLPSSIAIVSGALSTCSVSKPSRDGPSTERDASSSGTMSTQFDPDIVLEFYANAWPTEEGVRDMRSWVRGQWIPFDADALSQFLGYPLMLEEGQ

SEQ ID NO: 224905 - protein, 111 aa, Glycine max
  Coding DNA Sequence Number=SeqID_108127
  Pfam annotation: Domain name=GRP; Domain location=37-87; Score=-30.3; E_value=0.096; Accession=PF07172.2; Description=Glycine rich protein family
MMKRLDKLFMILIMWSWHSDYDHVCDQIFFGDHIPSMNNLVTRLLHVSTLVNGENAAATVEISAMVASHGWGRGGHCNRGGGRGGRGGNVPGVLRIQIFEVQRTYGFLIQP

SEQ ID NO: 224906 - protein, 73 aa, Glycine max
  Coding DNA Sequence Number=SeqID_108128
  Homolog annotation: Hit_ID=Q9LZ20; Match level="QueryCoverage=55%, HitCoverage=7%, E-value=3e-08, Identity=65%"; Hit description=Amino acid transport-like protein
MQSINFLLCQYLLAKMMRVMSKMTATATKSISLKPLGRDRTVRRHLAEEIPIVVPRYAIKPLATMALESTDQR

SEQ ID NO: 224907 - protein, 43 aa, Glycine max
  Coding DNA Sequence Number=SeqID_108129
GRILLGHGQKSRRVDGRSQPRYLGMEANGGQGHGRPLSLPGAR

SEQ ID NO: 224908 - protein, 312 aa, Glycine max
  Coding DNA Sequence Number=SeqID_108130
  Gene Ontology: Mol. function=hydrolase activity; Cellular component =cytosol; Biological process=metabolic process
  Homolog annotation: Hit_ID=UPI00005F7685; Match level="QueryCoverage =97%, HitCoverage=97%, E-value=7e-99, Identity=58%"; Hit description =COG1957: Inosine-uridine nucleoside N-ribohydrolase
  Pfam annotation: Domain name=IU_nuc_hydro; Domain location=1-306; Score=103.7; E_value=5.4e-28; Accession=PF01156.9; Description =Inosine-uridine preferring nucleoside hydrolase
MRLIIDCDPGNGVPGANVDDGLALALALAAKPQLQLELISIVAGNTPREVGFAVATDLLAQSGYQVPVALGAARALSEPPEPWRAHLDRPIADPKLAALWRDLPAPSLANAPAPDAAIAIGELICRHPGEITLAAIGPLTNVAHAMQLYPQMAQAVKEIVIMGGVFNVEGYIKDTNFGLDPEAARLVLNSGAAITLAPLDVTTQTMLTQADLAALTQPDTPLCRYLRATTQPWIDYSRHTRRLPGCWIHDALVIAWLLAPQLVTTEISRRWRPDSLRLTVGMPAPQGKPVRVMQQVDNARLLALIGATLARG

SEQ ID NO: 224909 - protein, 349 aa, Glycine max
  Coding DNA Sequence Number=SeqID_108131
  Gene Ontology: Mol. function=transcription factor activity; Cellular component=intracellular; Biological process=regulation of transcription, DNA-dependent
  Homolog annotation: Hit_ID=UPI00005F8B80; Match level="QueryCoverage =80%, HitCoverage=82%, E-value=1e-113, Identity=71%"; Hit description= COG1609: Transcriptional regulators
MQLGGRGAGGQHGDGPLGHGVDRLLDRAERRHAEFGLLCAVKTDQRQIVRRAQPMLRQRRQAAERLLLVGGENGARARALHQALGGLVTALAGVRRFENPRVAWRDARLQQRIAPAVQAILRVEHGQRTDKNADVAIAVLQQMAGRLASGVALVDADGANAGLAVDGVYHHAGSAGSADQIEPRVAIDAGVQQAIDLAAQQVVDKLILALTIVAGIAQQQHAAAAEGFLLQRPRQGGEERVGNIRHHQPVGLRAAGGQRPRDVVRPVAGLLDRRQHAQPGGFRHRARAVVDHVADHGDGGARYAGHVGAGNASRGVIIQIEILFAFSLRGILRQIEIAAAGFGSKEGGD

SEQ ID NO: 224910 - protein, 57 aa, Glycine max
  Coding DNA Sequence Number=SeqID_108132
  Gene Ontology: Mol. function=oxidoreductase activity; Cellular component=integral to membrane; Biological process=histidine catabolic process
  Homolog annotation: Hit_ID=Q3E504; Match level="QueryCoverage=98%, HitCoverage=16%, E-value=4e-21, Identity=75%"; Hit description=Zinc -containing alcohol dehydrogenase superfamily
MMRALYYERFGETPVVASLPDPEPTDGGVVIEVKATGLCRSDWHGWMGHDPDIRLPH

SEQ ID NO: 224911 - protein, 79 aa, Glycine max
  Coding DNA Sequence Number=SeqID_108133
MLTSSEKVQMTTLVSACQSDLGSLNDEVQITIWRLHMLPDSRRVSSSIVNGFFFLGDPTIPSSKDRDGNSHPGSRFMVV

SEQ ID NO: 224912 - protein, 129 aa, Glycine max
  Coding DNA Sequence Number=SeqID_108134
MALVMDPLLGRIASIGVLESEDRARVSDKCVVPAESNGNGGKGCRIKGFWPLMLTAPPSRDLGPKGEGEKESYMEFSASDEDCGDEREERGPLLKKQSFMVNQRLFKGVLMITKDDDKGDDKNLKEQLK

SEQ ID NO: 224913 - protein, 408 aa, Glycine max
  Coding DNA Sequence Number=SeqID_108135
  Homolog annotation: Hit_ID=Q0LU97; Match level="QueryCoverage=71%, HitCoverage=56%, E-value=2e-12, Identity=25%"; Hit description =Tetratricopeptide TPR_4 precursor
AGSGPPLPAARSGSTAGRCADPADPGLGGTVREPTSARHEALVQALKHADAPLPVDRHAINYLQFRLRDQPQQRMELLQALFDNGWKSGGLEPTGLWLALATLQADNGRGDDIPATLARITGPAEIIRLRSDKRFDRYVDRADARFDPVQAAQKHLDELRVSGLLDRALDARMAEFSSTLLMLDRNEEVLALTDGMASAAAEGESPSAAEAEWVAWLLNSRLTALRRLGRTDDALAAAKLAARIGALGPDGAEHQFNVGFVFSSLGRMQDAATAVNDMPGLAGYGKAAQALLQFVAARERGDAKAEQAARAAILAQGDDARLFQREMLLDEGNLDGAAAVLIEQLRSPVERGETLASLQDMRTYPSLPGDVKIDAAWRALKQRADVQAEVARLGRIERYELVSTSTSR

SEQ ID NO: 224914 - protein, 50 aa, Glycine max
  Coding DNA Sequence Number=SeqID_108136
GQSWLSRSWKGLPTEGSDWWTILTNKDAEVGGHVRAQANHTGMRGIQSLY

SEQ ID NO: 224915 - protein, 112 aa, Glycine max
  Coding DNA Sequence Number=SeqID_108137
  Subcellular localization annotation: CTP_CleavageSite=42; ConfidenceScore=5.35e-01
MTCGVTLWLPAPFVNRGKNEPVGAQRLTSSPAPFFILTREVRDSESSGRRRYLMVIRAFRQPRGTNLMVFTLIVQKHSSPTTCEILLCWPGTIKCNGEGKCRGCPTFSFSRH

SEQ ID NO: 224916 - protein, 135 aa, Glycine max
  Coding DNA Sequence Number=SeqID_108138
MQPTHLNGINSCPSMIGERAMHCSTEWPGVPPWYAQVMLGLHDFGKGDWVNFGAFLGGGFLVVSEPTPRWALLAGRGWAGAKACGGPLYVDAGAFGWAGAELGDSGVEVTAWASPSFLFAPAIPVLLLLEPAGEM

SEQ ID NO: 224917 - protein, 187 aa, Glycine max
  Coding DNA Sequence Number=SeqID_108139
  Homolog annotation: Hit_ID=Q10RG3; Match level="QueryCoverage=82%, HitCoverage=82%, E-value=3e-08, Identity=31%"; Hit description =Expressed protein
METLVVVAQHRNQCYTRPKPQGHAEFGSSSHSRDFRAINCRSFQTGYGVLPTPLKRPKTPLTPSNPNKTRCKTTPSSAPVPINHKKEKKGFNVVPNGGILLSELWAGPTYSSSPPPSSLPIPKFSVRPKRSVSLDLPGSCREVEMPLRANSAPSSPRGEHSPCARDGLFDSATNTLRRILNLNLDDE

SEQ ID NO: 224918 - protein, 158 aa, Glycine max
  Coding DNA Sequence Number=SeqID_108140
  Gene Ontology: Mol. function=RNA-directed DNA polymerase activity; Biological process=RNA-dependent DNA replication
FKEQGSMQVLLDEVQFKSINDEDNNMLTQIFSKEETKNVIWDLNVITAISEFHGHGRLPRGTDASFLMLTLKKDNPQDLGEFRPIFLIGCFPMKEFIVQRGLRQGDMLAPFLFLVVVGGLSGKGKLRVSLLQYVEDDMRDTLILKATPRYFELAFRLK

SEQ ID NO: 224919 - protein, 480 aa, Glycine max
  Coding DNA Sequence Number=SeqID_108141
  Gene Ontology: Mol. function=RNA-directed DNA polymerase activity; Cellular component=intracellular; Biological process=RNA-dependent DNA replication
MEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASIRTFNDLGEAFIRQYKYNLDMAPDRDQLRAMTQKERETFKEYAQRWREVAAQIVPPLEEREMTKIFLKTLSQFYYEKMVASAPTDFTEMVNMGVRLEEGVREGRLTAESTPAASNAKKFGGHFAKKKDQEVGMVAHGKPQQNFTPYRQVANVASTIPNPSYHQQRPHYPYPYPPQQYPPQQYPPQQYPPQPYPPQQYPPQQYHQPQYPQKQQNRPQTPQQPYHSQNRQKTTFDPIPMKYADLLPALLAKNLVQVRTPPRTPDVLPPWFRHDLTCAFHQGAPGHDVENCYVLKNEVQKLVRANLLSFKDQNPNVQANPLPNHGPAVNMIQDCDEDGVILNVQHVRTPLVPIHIKMCEAALFDHDHAACEICPVNVKGCPK

SEQ ID NO: 224920 - protein, 304 aa, Glycine max
  Coding DNA Sequence Number=SeqID_108142
  Homolog annotation: Hit_ID=Q47522; Match level="QueryCoverage=19%, HitCoverage=77%, E-value=5e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDAQVVEGVGAVVVRGGTVGAAIVPLRQRRIFIGVALDVGIRHGELGLAAAAPVSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 224921 - protein, 73 aa, Glycine max
  Coding DNA Sequence Number=SeqID_108143
  Gene Ontology: Mol. function=RNA-directed DNA polymerase activity; Biological process=RNA-dependent DNA replication
MERGATEGKGRGCMYTIVAKLLVRRLKNVFPRLIDEKQSAFLGGWNILHSVLVANEAVEEAKRRKKCLIFECC

SEQ ID NO: 224922 - protein, 160 aa, Glycine max
  Coding DNA Sequence Number=SeqID_108144
  Gene Ontology: Mol. function=nucleic acid binding; Biological process= DNA integration
  Homolog annotation: Hit_ID=Q1SPP8; Match level="QueryCoverage=90%, HitCoverage=8%, E-value=1e-24, Identity=40%"; Hit description =Integrase, catalytic region; Zinc finger, CCHC-type; Peptidase aspartic, catalytic
MKFPEPLGQMLKDKEEYTKVHSYRSAKQKWDKLALTYEGSPQVKCNKLNLLTYKYELFTMEDGEDIQAIFGRFQTILIELCCLNRIFVNYDNIDKILRSLSRKWRPQVIPLKTMKNLDSMSIEELIGTLKIQEQELQQDERFKKGKSLALTIQKAKASSI

SEQ ID NO: 224923 - protein, 87 aa, Glycine max
  Coding DNA Sequence Number=SeqID_108145
MNQRLVGWKQKLLSRTGHKTLRLPKIQGGLDVRSRRETNVALLARLNAPPRLAGKLKLSTKKDHEETQKHAKLVTASLSPDIAMISA

SEQ ID NO: 224924 - protein, 235 aa, Glycine max
  Coding DNA Sequence Number=SeqID_108146
MRRQRRRRSPKGKKCLSFFHYVQKWSPTIVVGIRLTWVRCFGIRLNVWGEKCFSLVAQICGKYMKIGVETDSLQRMESTHLLIQTPFTKQVDFCQSIKINGTVYQRNQLDGEESTLGNNLGMETHSSQSEYSLESHGQGVEKVEETHMVVCCAKLYTDGEESGFCPLNNKYEDMADNEKMEGQTCVEGELGEGKGEGQMHSVGVEKEFDGVVVRKQLFEVNTTLEKGYPQQSFVS

SEQ ID NO: 224925 - protein, 171 aa, Glycine max
  Coding DNA Sequence Number=SeqID_108147
MVASDHDILRDQAYTPTKKSPLEFTSQDAMLAQNKLLAKTLEILITTLSNLPQQLHVVHPSPSAVMHIRGCNIFGGAYELGLCMAQDDASNEVKYMANQNRQGFHQGGPPGYHRGGNFSQGQAKQMVERPTRTFVANTEKNPKEECKEVVTRSQKKDDVEEEKRAKGVLEK

SEQ ID NO: 224926 - protein, 140 aa, Glycine max
  Coding DNA Sequence Number=SeqID_108148
  Gene Ontology: Mol. function=RNA-directed DNA polymerase activity; Cellular component=chromatin; Biological process=chromatin assembly or disassembly
MYLSRLIDYYYTIQYRSGKANRAIDALSRITKNSPSTFLMLLMTHFAFSDQLKSELFTHPKLIVLQQDIQDNPAGHSDYTLSYGLILHKGRIWLPDGLNFIRSLLVEFHTSPTGGHMGIKKTMARLGDNFIWPSIREDVR

SEQ ID NO: 224927 - protein, 109 aa, Glycine max
  Coding DNA Sequence Number=SeqID_108149
  Pfam annotation: Domain name=BRF1; Domain location=28-108; Score= -4.6; E_value=0.0013; Accession=PF07741.3; Description=Brf1-like TBP -binding domain
MHLGANVEHEATKDGKYDDSHREDESETLSDIDDEEVDDLYIHDEEGKHIKKMLWEIANREYLEEQAAKEAAAAANKKAFEAKFENCSEDILAARDFAASSTEAVAKSR

SEQ ID NO: 224928 - protein, 152 aa, Glycine max
  Coding DNA Sequence Number=SeqID_108150
MAQLETSQHSPTSSTMKQHTVIPLSNSCHMKLEVPHLDGSNPLGWIFKITQFYEYYATPDLECLIIASFYMEGPALAWYQWMLCNGQISSCPGLLQALEARFAPSQYEDPTRTLFKLIQHRMVNEYLSKFETLANCIVGLLSPFFAQLFYFK

SEQ ID NO: 224929 - protein, 1079 aa, Glycine max
  Coding DNA Sequence Number=SeqID_108151
  Gene Ontology: Mol. function=nucleic acid binding; Cellular component= intracellular; Biological process=DNA integration
  Pfam annotation: Domain name=RVP; Domain location=314-421; Score= -13.8; E_value=0.088; Accession=PF00077.10; Description=Retroviral aspartyl protease
  Pfam annotation: Domain name=rve; Domain location=524-686; Score =168.2; E_value=2.1e-47; Accession=PF00665.16; Description=Integrase core domain
  Pfam annotation: Domain name=zf-CCHC; Domain location=276-293; Score =24.3; E_value=9.9e-05; Accession=PF00098.13; Description=Zinc knuckle
  Pfam module annotation: Pfam domain module=RVP::RVT_2::rve::zf-CCHC; Domain location=314-421::795-1004::524-686::276-293
MAGSLSKIIPDMSKIEPLDGSNYKRWSKKLLILFEALEVDYVLFEDPPADVNASESSTPETPATPVVTPLPAETKKADEKAKKKYEKDNKTARGHLLTHMADNLFDLFINQKSAKTIWDTLLKRYGDDDAGRKKYVVGNWLRFQMMDDKPIMEQIHEYENLVGDILNEGMKMCEILQANVLLEKFPPSWSDYRNQLKHKKRDLSLQELINHMKTEEANRLKDKHVLHSVNSVNANVVEFADQHRSKGKEKRFQKKGQKKTHTNINKGDNKIQKRKGECYVCGKTGHKAYECKLRKGQQSNNSKPAAPHAPQAHLAENEEVIAAVVVEANMVDNKVDWILDTGASKYLCANKELFHQSEDADDGECVFMGNSATAGVLGKGKILLKLTSRKTLSLSDVLYVPSLRRNLISGSCLNRAGLKLVFEADKVVITKNGNFVGKGYLADGLFVLNTIPNTSNAISSVGSVYIAEYVNLWHGRLGHVNVNSIKKLRNMNLINVLDINNFSKCPICEEAKYAKKPFKPVKNRTTELLELIHTDLADFKNTVSRGGKAYFITFIDDFSRYAKVYLLRTKDEAEEMFLKYKAEVENQLDRKIKRLRSDRGGEYGTIFLKIFCEKNGIIHETSAPYTPQQNGIAERKNRTIKEMMNAMLLSSGMSTQMWGEAILSACYILNRVPHKRLDKTPYELWKGFAPNLNFLKVWGCLAKVALPDFKRTNVVPLHLRTSSSVTNEQVNEPRRSKRKRIESSFGPDFVTAFVVENNDVDKINDVFVSTFLIEEDPKNYNEAVTSIDANFWKEAINSELDSIMSNHTWDLVDLPKGSKPIRCKWIFRKKLRTDGTIDKFKARLVVVGYTQKKEIDYFDTYSPVTKISTIRSLVALAAIHGLIVHQMDVKTAFLNGDLREEIYVEQPEGYVIQGQENKVWSVMFLMNCTRPDIAYAVSRLSRYTHNPGGGAISWKSSKQTCIARSTMESEFIALDLAGQEVEWLRNLLADVPLWGKRSIPVSLHCDSEVAIGIAKNNVYNGKRRHICIRHSSVKELLKNGVISLQFVRSENNLADPFTKGLTKKVVLESSRGMGLKPLC

SEQ ID NO: 224930 - protein, 201 aa, Glycine max
  Coding DNA Sequence Number=SeqID_108152
  Gene Ontology: Mol. function=ribonuclease H activity
  Homolog annotation: Hit_ID=Q1S4N4; Match level="QueryCoverage=25%, HitCoverage=14%, E-value=8e-10, Identity=50%"; Hit description =Ribonuclease H
MCLGGLILLLGLSLLPPKSIASGLSLSLILVLKAGPGSGIYLSLKTSNTSYGFPSMGSYPLPFLDFLVMLQLKVHHNGVDTDAWLRDNSQSGHGTLFAVNIWMISRQRNLEIFKQNSGLYWLPGSIAFHPLSTIITSIRQLLRRNWVAPLQHTYREGNQCVDWLAKRGSSSDVSFMIWDVCPSQFSACLLVDSICIHTDRS

SEQ ID NO: 224931 - protein, 77 aa, Glycine max
  Coding DNA Sequence Number=SeqID_108153
  Gene Ontology: Mol. function=chromatin binding; Cellular component =chromatin; Biological process=chromatin assembly or disassembly
  Homolog annotation: Hit_ID=Q947Y6; Match level="QueryCoverage=95%, HitCoverage=6%, E-value=5e-11, Identity=54%"; Hit description =Putative retroelement
MTTPDAFISKVNGREESGRSKTGAEPHQWCNNGSISVNESSIESDEAQETAQGSRGLWNRPLLNGLNFIRKRLHPLR

SEQ ID NO: 224932 - protein, 203 aa, Glycine max
  Coding DNA Sequence Number=SeqID_108154
  Homolog annotation: Hit_ID=Q2QN86; Match level="QueryCoverage=49%, HitCoverage=54%, E-value=9e-20, Identity=57%"; Hit description =Expressed protein
  Pfam annotation: Domain name=DUF1118; Domain location=1-144; Score =142.6; E_value=1.1e-39; Accession=PF06549.3; Description=Protein of unknown function (DUF1118)
MQNSTVFPLGEQPRSSPATATPPIKLLTRMEQLKLLSKAEKAGLLSAAEKFGFSLSTIERLGLLSKAEELGVLSAATDPGTPGTLLTLSLGLLILGPLFVYLVPEDNLGEVGLQVVVALAGVIGGSAGLLGPESTFLCYLTKALLPLECLIKDFCYTYVVTTNSAYGFYNRFLARTKEERCVRPLAANIKLVHFNILHIDSPN

SEQ ID NO: 224933 - protein, 271 aa, Glycine max
  Coding DNA Sequence Number=SeqID_108155
  Gene Ontology: Mol. function=RNA-directed DNA polymerase activity; Cellular component=chromatin; Biological process=chromatin assembly or disassembly
  Pfam annotation: Domain name=zf-H2C2; Domain location=8-45; Score =5.6; E_value=0.066; Accession=PF09337.1; Description=His(2)-Cys(2) zinc finger
MEYHSTPTGDHIGVAKTLAHLTENFYWPSLRKDVERFVASFVDCQHTKYETKKVVGLLCPLSIPCRPWEDLSLDFITGLPAYHDYTTILVVVDRFSKGIHLGMLPNHHTSHSMVILFMDIVIKLHGMPRSLTDCQTEVLNRVIEQYLRAFVHKKPSSWASPYEITFCKKPFNFPQYIAGTSQVDVVDELLTNREAIFAKFKKKLLKAREWQGLPSDDTSWEDWDQLRAVYNLEENVLLEGKMDDNNQKIQAPSGAGPKRRIITPTYLKDFV

SEQ ID NO: 224934 - protein, 100 aa, Glycine max
  Coding DNA Sequence Number=SeqID_108156
MEVLTVTHHDIQRKSCASGEAQLLHQWFLHRSRSLRETNSSGDKRLRGMELGDFRGVGNNGIKGDEGTTKRGEGDGLGLILPHIFEGLELHGGSSESTQR

SEQ ID NO: 224935 - protein, 104 aa, Glycine max
  Coding DNA Sequence Number=SeqID_108157
MAESTRSLVSSDKLEDVIVKLTSHHLSLSETFHNMTLKLDELIHKLHTPKSSSPSPSSSTAMPSPASSPTPHRMKLDVPQFEGTDPLGWIFKINQFFVYHATPE

SEQ ID NO: 224936 - protein, 70 aa, Glycine max
  Coding DNA Sequence Number=SeqID_108158
MDRPKRLSPREITSGVATNIYSRVMLEKPKRMKVLANVAPCGVCRPWIFFINGVLCFLKFNGSGMDKEKR

SEQ ID NO: 224937 - protein, 62 aa, Glycine max
  Coding DNA Sequence Number=SeqID_108159
MSSFALEIASGISKMFAQKKVTLSPVRHKIVILDEVDRNLIRLAMPKLMEADVQFAVFTGRV

SEQ ID NO: 224938 - protein, 190 aa, Glycine max
  Coding DNA Sequence Number=SeqID_108160
MGELDQLEKRLRDIEGGEDYAFANLEELFLVPNIITPPKFKVSDFDKYKGITCPKNHLQMYCWKVGAYAKDEKLLIHFSQESLTGTIVTRQCQWMQSYPPRALDRRLQEDWAKDAREGPRVLMSLRTSVATYPSAGGRRVTRGMRVPQKEYARSRHQRLFEENVGKTGKDAIYELLSERLGSCIYARGRY

SEQ ID NO: 224939 - protein, 133 aa, Glycine max
  Coding DNA Sequence Number=SeqID_108161
IAPTRHPVDLEKSNRALGFPALVTGLYQSYRVPVPPPPRQGHVIIGIAPARHPVDPKKSNRVLELSSSNYGSLQAQGETPQQPGDGRQRATDAPPSPLEFTSAHPQKGLSIAYTTWPTNRRPSPKPKDAPSCS

SEQ ID NO: 224940 - protein, 139 aa, Glycine max
  Coding DNA Sequence Number=SeqID_108162
MATAEALERETKKARKEEHDQNKDELKACLRSKRNLSQQLSETKGNMWAIIDECKEKLNLAATHEQRLEDEYAKISAEREARERVIDSLHQEATMWMDQFALTLNRSQELPRLLAKAKAMADTYSAPKKFMGFSAIVSI

SEQ ID NO: 224941 - protein, 66 aa, Glycine max
  Coding DNA Sequence Number=SeqID_108163
MAVCGGYWWLWVMEKKEGEEMTFFQSYLDYKAQNAQVTNVLENGNVAHTPDILSQIPTVRSWTSVL

SEQ ID NO: 224942 - protein, 130 aa, Glycine max
  Coding DNA Sequence Number=SeqID_108164
MKRKQARKEASERERREEEERLIDPEEQRQMQLLEQQEAERMQRDMILFQEREKEWMDTVIARKQQQQQHQQQREEEDEDDEFDCVEEEGPPEIIWQGNEIIFKKKQLRVIKLIDTVDLEGGPGTSFCSL

SEQ ID NO: 224943 - protein, 152 aa, Glycine max
  Coding DNA Sequence Number=SeqID_108165
MEEGVHHHDEPWKRSLEGCFNGEKERGRESERGEHEIEGIKEGEKWNFEAHENPRAFPWISGPIYLESLSNAIGGPCMAPPPLVLPRRSCHMASETPVAVACCPSAYVVREAQGALTRSAWESEGAALASKSSEGLEAQMGLAFEGRIWRKW

SEQ ID NO: 224944 - protein, 142 aa, Glycine max
  Coding DNA Sequence Number=SeqID_108166
MDRGMTLTDAPRSSMAFSNLLFPIMQGGNGRGIRGCYSEWRLLSLAEIAYSGWSFASLTLLRKVEEEPQLLVVFVVVVAVVATYPSAGGRRETRGMRVPRKEYARSRHQRLFEENVGKTGKDAIYELLSERFGSCIYARGRY

SEQ ID NO: 224945 - protein, 87 aa, Glycine max
  Coding DNA Sequence Number=SeqID_108167
MPANKATALGSYHFTPFEHFLPFIAFILCTVLQSPCIACIFAPSLHSYSTAQGPKWRGEKPLLFLEIANEHAKHHAALSESSFLLNI

SEQ ID NO: 224946 - protein, 216 aa, Glycine max
  Coding DNA Sequence Number=SeqID_108168
  Homolog annotation: Hit_ID=Q1SWX1; Match level="QueryCoverage=66%, HitCoverage=31%, E-value=7e-15, Identity=34%"; Hit description=IMP dehydrogenase/GMP reductase
MGQLQRQAFRKAYGKIWDLARVEVSMEPIASLSQYYDQPLRCFTFEDFQLVPTVKEFEEILGCPLGGRKPYLFSGFYPSTTRVAKYQGSVWRKGQRPWKIKANGLSFIDILALLIFGVVLFPNMEGLVDLAAIDAFLAFHHGKESPVVAILAMYDTPVYPLQGHRSCVEKGKANWDQLLASMEGRLLIGSLARRKDRIRILSSCEGCPNCSLDGNN

SEQ ID NO: 224947 - protein, 380 aa, Glycine max
  Coding DNA Sequence Number=SeqID_108169
  Gene Ontology: Mol. function=thioredoxin-disulfide reductase activity; Cellular component=cytoplasm; Biological process=removal of superoxide radicals
  Homolog annotation: Hit_ID=Q39242; Match level="QueryCoverage=81%, HitCoverage=80%, E-value=1e-145, Identity=81%"; Hit description =Thioredoxin reductase 2
  Pfam annotation: Domain name=Pyr_redox; Domain location=199-295; Score=97.4; E_value=4.4e-26; Accession=PF00070.17; Description =Pyridine nucleotide-disulphide oxidor
  Pfam annotation: Domain name=Pyr_redox_2; Domain location=48-340; Score=149.8; E_value=7e-42; Accession=PF07992.4; Description =Pyridine nucleotide-disulphide oxidor
  Pfam module annotation: Pfam domain module=Pyr_redox::Pyr_redox_2; Domain location=199-295::48-340
MKFRICPNHHNWKNLFTKVRNLISVGRASSSSAAAANAMGDVQIHKTKLCIIGSGPSAHTAAVYAARAELKPILFEGWMANDIAPGGQLTTTTDVENFPGFPDGILGGELMERCRSQSLRFGTEIHTETVSKVDFSNRPFRVFTDSRTVEAESVIVATGAVAKRLPFPGSGDGPEGYWNRGISACAVCDGAAPIFRNKPLAVIGGGDSAMEEATFLTKYGSEVYIIHRRDTFRASKIMQSKVMNNSKIKVIWNSVVVEAFGGGDNKRVLGGLKVKNVVTQEVSELKVSGLFFAIGHEPATKFLDGQLELDSDGYIVTKPGTTKTSVEGVFAAGDVQDKKYRQAITAAGTERSTGVVSVSDTNTDACRTPNTTRGWGVRAS

SEQ ID NO: 224948 - protein, 120 aa, Glycine max
  Coding DNA Sequence Number=SeqID_108170
MCHPTAYVCVYYNIQICNTNEGTTFISNNTKNFYDDADVRQMLNIFYNNPLLPFVELFAIICDNNNLPSNQYESTSNLEDLSDEYESCWVKNHGSDTDSSSRPEGSNMSSSHETIFKRDW

SEQ ID NO: 224949 - protein, 146 aa, Glycine max
  Coding DNA Sequence Number=SeqID_108171
MGNQQRQGYTKGGFSGFQQEKNPKEECKAVMTRSKRFVEAEVEDSIVSKKKAAEKKGIDEKKDDVRSESNQEKQKQIMVKKKELNDQEKENENEKIEKDEKNKNEERSRSEQAREKKREKVVNEGAEVSYLWYPPRRRRIAISRDF

SEQ ID NO: 224950 - protein, 59 aa, Glycine max
  Coding DNA Sequence Number=SeqID_108172
MGLFLNRFNAGNSISLVFSNFSSVSRSLHCADRQLKEHEDGNKKLMKNTIAHINCRRLT

SEQ ID NO: 224951 - protein, 47 aa, Glycine max
  Coding DNA Sequence Number=SeqID_108173
MNGNMRQPSDEVPPPFTSTAKGSNSLIPAAMGINDDLQTKDLEEERY

SEQ ID NO: 224952 - protein, 101 aa, Glycine max
  Coding DNA Sequence Number=SeqID_108174
MSQVTVLVAGSDGLIRGGPVFVSTTSKHDTHNMASEEYPTENDEQVPLFLFEDQAERMADVVDQIYKATLKELNNQTNIYIYIYIYIYVTPSGDRCHQIKN

SEQ ID NO: 224953 - protein, 62 aa, Glycine max
  Coding DNA Sequence Number=SeqID_108175
MIEREKEKNENEKSKGIVASLSFVEVADHEMEGGGVVEGKTKVLYFVSISNFKAYCSKYVKV

SEQ ID NO: 224954 - protein, 567 aa, Glycine max
  Coding DNA Sequence Number=SeqID_108176
  Gene Ontology: Mol. function=protein binding; Cellular component =intracellular; Biological process=small GTPase mediated signal transduction
  Homolog annotation: Hit_ID=Q8RX50; Match level="QueryCoverage=96%, HitCoverage=98%, E-value=0.0, Identity=62%"; Hit description=PSR9
  Pfam annotation: Domain name=LRR_1; Domain location=260-281; Score =13.5; E_value=0.76; Accession=PF00560.23; Description=Leucine Rich Repeat
  Pfam annotation: Domain name=LRR_1; Domain location=283-304; Score =17.1; E_value=0.066; Accession=PF00560.23; Description=Leucine Rich Repeat
  Pfam annotation: Domain name=LRR_1; Domain location=306-327; Score =18.4; E_value=0.026; Accession=PF00560.23; Description=Leucine Rich Repeat
  Pfam annotation: Domain name=LRR_1; Domain location=329-350; Score =17.3; E_value=0.055; Accession=PF00560.23; Description=Leucine Rich Repeat
  Pfam annotation: Domain name=LRR_1; Domain location=352-373; Score =7.7; E_value=10; Accession=PF00560.23; Description=Leucine Rich Repeat
  Pfam annotation: Domain name=LRR_1; Domain location=375-396; Score =10.6; E_value=3; Accession=PF00560.23; Description=Leucine Rich Repeat
  Pfam annotation: Domain name=LRR_1; Domain location=398-419; Score =10.4; E_value=3.3; Accession=PF00560.23; Description=Leucine Rich Repeat
  Pfam annotation: Domain name=LRR_1; Domain location=421-442; Score =13.3; E_value=0.9; Accession=PF00560.23; Description=Leucine Rich Repeat
  Pfam annotation: Domain name=LRR_1; Domain location=469-490; Score =15.4; E_value=0.21; Accession=PF00560.23; Description=Leucine Rich Repeat
  Pfam annotation: Domain name=LRR_1; Domain location=492-513; Score =1.6; E_value=1.4e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=260 -281::283-304::306-327::329-350::352-373::375-396::398-419::421 -442::469-490::492-513
MECLNSVEEVVEEIMRIHRSLPARPGIDEVEVARGLIGNVEKEDQARLQAIARQSKGVHVPQELFMVLQEMQRNFLYHQSKDQIREAVKLLDLDNVHSLFDELIQRASKCVASPSSKTSYSNANGSASSVSTSLSKNSVSVGGFDKPPLAPAATTSRKFHAEKERSELVTRDDSYVKKSKSSFYSNGYGIEPTIPSKSSILDSSLKPTTTAGQDGDKLSLIKLASLIEVSAKKGTRDLKLQNKLMDQVDWLPDSIGKLSSLVTLDLSENRIVALPATIGGLSSLTRLDLHSNRITELPDSVGNLLSLVYLDLRGNQLTLLPASFSRLVRLEELDLSSNQLSALPDTIGSLVRLKILNVETNDIEELPHSVGSCSSLRELRIDYNRLKALPEAVGKIQSLEILSVRYNNIKQLPTTMSSLTNLKELNVSFNELESVPESLCFATSLVKMNIGNNFADMRSLPRSIGNLELLEELDISNNQIRVLPESFRMLTQLRILRAEENPLEVPPREIADKGAQAVVQYMAELVEKREKKDVKAQPLKQKKSWAQICFFSKSNKRKRDGVDYVKT

SEQ ID NO: 224955 - protein, 41 aa, Glycine max
  Coding DNA Sequence Number=SeqID_108177
MRMKRGTRPKVYPAGIVTTQANVITLFCDGNGSRAVALAVP

SEQ ID NO: 224956 - protein, 52 aa, Glycine max
  Coding DNA Sequence Number=SeqID_108178
MADGGRPKFHHINMPLRPTTLPWWASLHKLLMPIGKKSAMALPFNNISHKQI

SEQ ID NO: 224957 - protein, 78 aa, Glycine max
  Coding DNA Sequence Number=SeqID_108179
MILMDVTTILQIIGINEATASLWKICCMVGGGLAGSELEALPPLGGGGFVGQRAFWIVTFFAGSMDICAIHLQLAYIC

SEQ ID NO: 224958 - protein, 80 aa, Glycine max
  Coding DNA Sequence Number=SeqID_108180
MIRRLLKKRILEYRLMLHKWIYTSHLLLKNELQEKGRGSRNLNAKVVVKRKSTITEVENEIEKMVGEGKERAKAVRAFDV

SEQ ID NO: 224959 - protein, 56 aa, Glycine max
  Coding DNA Sequence Number=SeqID_108181
MHEGMHMTQMQSRNAGSQGIVPFLDTTSRGSKGPQQGIKTEPVCDAYAKDAIRECT

SEQ ID NO: 224960 - protein, 255 aa, Glycine max
  Coding DNA Sequence Number=SeqID_108182
  Gene Ontology: Mol. function=binding; Cellular component=membrane; Biological process=transport
  Homolog annotation: Hit_ID=Q1SZM9; Match level="QueryCoverage=100%, HitCoverage=76%, E-value=5e-97, Identity=71%"; Hit description =Mitochondrial substrate carrier
  Pfam annotation: Domain name=Mito_carr; Domain location=13-101; Score= 75.8; E_value=1.4e-19; Accession=PF00153.17; Description =Mitochondrial carrier protein
MEGRICEELTPRYYALCAIGGMLSAGTTHLAITPFDVLKVNMQVHPIKYYSISSCFTTLLREQGPSVLWKGWTGKFFGYGAQGGCRFGLYDASAEVFANVALCPFEAVKVRVQAQTCFAKGLYDGFPKLYASEGTRGVGKREIILPSVRELRPLGIGRCKPSKFCKLGTVSRGEIPYLSDKIPVSMVMFSTFEHSVDFLYRNVVKRKKEDCSIGQQLGVTCLAGYAAGSVGSFISNPADNIVSSLYNRKADSLAL

SEQ ID NO: 224961 - protein, 184 aa, Glycine max
  Coding DNA Sequence Number=SeqID_108183
MGSRMKTAVFEEQTNKALKKWHMDAKKKKKKHVGTVTLGKSSARIMDGSPIGNSSTVHSSSVPTLHRFKTTGHSTTYEDQDHDHDHEYESDDVELFPVSSQTTSFIVRVDRGDQQQQAEEEHRQHSEGETNSSSEVWKTVFGLGLLLNLSARILESTSKITLERCVEKITGQLGRGPKLQQEQI

SEQ ID NO: 224962 - protein, 741 aa, Glycine max
  Coding DNA Sequence Number=SeqID_108184
  Gene Ontology: Mol. function=sugar porter activity; Cellular component=integral to membrane; Biological process=carbohydrate transport
  Homolog annotation: Hit_ID=Q1SZN1; Match level="QueryCoverage=99%, HitCoverage=99%, E-value=0.0, Identity=71%"; Hit description=Sugar transporter superfamily; Major facilitator superfamily MFS_1
  Pfam annotation: Domain name=MFS_1; Domain location=11-683; Score =109.8; E_value=8e-30; Accession=PF07690.6; Description=Major Facilitator Superfamily
  Pfam annotation: Domain name=Sugar_tr; Domain location=6-724; Score =125.2; E_value=1.8e-34; Accession=PF00083.14; Description=Sugar (and other) transporter
  Pfam module annotation: Pfam domain module=MFS_1::Sugar_tr; Domain location=11-683::6-724
MMEVVIVAIAATLGNLLMGWDSSTIAAGMTYIKKEFVLDATLEGLIVSMSFITGTIVTLFSGTVSDLVGRRPMLITSSIMFFLSGLVMLWAPNVVIVLLARIIDGVAIALAVTLTPLYISEVAPADIRGQLNTLTQFACSGGMFFAYILVFSMSLSDSPSWRLMLGVIFIPAIAYFLLAVFYLPESPRWLVSKGRLLEAEIVLKRLRGTEDVSGELALLVEGLSPGGEATSIEEYVVAPASELLVNQEAGKDYIKLYGPNDEGVTMVAQPVNGQGSMISRSMLSQQGSFGTLTGGGLKDPIVTLFGSLHENTLPESGGSHSMLLHNANSIFSIGETASPFGTNDNLHALLMPLQGGAGEKDRAYGSKDMLGMRSNSSLRSNSSLVHGNAVDAPKNTNIGGGWQLVYKSADGAGGGKREGLQRVYLHAETAAVSHSQHVSFVSTSGYDIPIDGGEAYQAAALVSQSVLGTHDMLHLPEVAAQGPKWRALLEPGVKRALIVGVGLQILQQLKLRIFTMETCTYTLASSSAAGINGFLYYAPQILEQAGVGALLSNLGLSSASASFLVNIITTFCMLPCIALAVRLMDISGRRSIMLYTVPILIVCLLILVIKQFFQINSVVDAAITAISVVVYESVFCMGLGVIPNIICAEIFPTSVRGICISLTSLTYWGCTLIVTLIFPYLLQLLGLTGVFGLFVVGCIISWIFVYLKVPETKGMPLEVIIEFFAIGAKPGTDPAALGIKG

SEQ ID NO: 224963 - protein, 226 aa, Glycine max
  Coding DNA Sequence Number=SeqID_108185
  Gene Ontology: Mol. function=zinc ion binding; Cellular component =integral to membrane; Biological process=ubiquitin cycle
  Homolog annotation: Hit_ID=Q1SZN2; Match level="QueryCoverage=80%, HitCoverage=85%, E-value=4e-64, Identity=65%"; Hit description=Zinc finger, RING-type; RINGv
  Pfam annotation: Domain name=zf-C3HC4; Domain location=105-146; Score= 36.0; E_value=1.3e-07; Accession=PF00097.15; Description=Zinc finger, C3HC4 type (RING finger)
MTRAFRILNSADNATAVAAAAPPPEAVALESDFVVILAALLCALICVVGLVAVARCAWLRRGSGAGNSPRQALANKGLKKKVLQSLPKFAYVDSNPSKWLATSECAICLAEFAAGDEIRVLPQCGHGFHVPCIDTWLGSHSSCPSCRQVLAVARCQKCGRFPATGAGASRTPATEPELKSREDNNAASYSNNNINNNSDRGGSNSNSNCNMEHHHHSHHVNSGFLP

SEQ ID NO: 224964 - protein, 89 aa, Glycine max
  Coding DNA Sequence Number=SeqID_108186
MAREDTCEPTEKARCGIATIAFPPLGSKTGQGPKLPQTRPSFFRSGQDFCKIYLVLKGTKDFMRIMDKQSEIGCRRRTAAFGDHNPVTM

SEQ ID NO: 224965 - protein, 379 aa, Glycine max
  Coding DNA Sequence Number=SeqID_108187
  Gene Ontology: Mol. function=calmodulin binding; Cellular component =integral to membrane; Biological process=cell death
  Homolog annotation: Hit_ID=Q1SZN5; Match level="QueryCoverage=100%, HitCoverage=64%, E-value=1e-149, Identity=71%"; Hit description=Mlo -related protein
  Pfam annotation: Domain name=Mlo; Domain location=9-379; Score=616.4; E_value=2.4e-182; Accession=PF03094.6; Description=Mlo family
MAAGGSRSGSRDLDQTPTWAVAAVCTVFILISIALEKSLHKVGTWLVQKHKTALLEALEKVKAELMILGFISLLLTFGQSYIVRICIPEKLADIMLPCPYKEAKKASDSEEEHRRKLLSYERRYLAADTASFKCSREISKLKTVAYQGHEPLLSVNGLHQLHILIFFLAVIHVFYSAITMMLGRLKIRGWKAWEAETSTHNYEFANAASRFRFTHETSFVRAHTSFLTRIPIFFYIRCFFRQFYRSVNKTDYLTLRNGFITVHLAPGSKYNFQKFIKRSLEDDFKVVVGVSPILWASVVVYLLININGWRTTIWAALIPVVLILAVGTKLQAILAKMALEITERHAVVQGMPLVQGSDKYFWFGQPQLVLHVIHFALFQ

SEQ ID NO: 224966 - protein, 438 aa, Glycine max
  Coding DNA Sequence Number=SeqID_108188
  Homolog annotation: Hit_ID=Q1RYA6; Match level="QueryCoverage=47%, HitCoverage=59%, E-value=6e-44, Identity=45%"; Hit description =Diacylglycerol acyltransferase
  Pfam annotation: Domain name=DAGAT; Domain location=56-292; Score= -21.8; E_value=3.2e-12; Accession=PF03982.3; Description =Diacylglycerol acyltransferase
MAAEPASDGGAEAEKLVSRREEFVDSSNLFSAILAMALWLYSLQHRPGPLRRVFPSSLQIDLGFRFSLCLYGASYQPKKFICKHACNYFPITLHVEDMKAFDPNRAYEFSLISHWNTVYLYLLGRSSFIVTTVCPTCSFWVFYTPFLRHTWTWLGLTPATKKIFISLLASGHSCILIPGGVQEAFLMQRGTEIAFLKARRGFVRITMVKGRPLVPVFCFGQFEAVPSHQYCRNADQSHMQSTAASPQSFQALLTGFEAQTWTPVKCCWRALWDMMNSTGSQILSFQEMIVLVLVCMIPQFNILYLFGRILYCLYLLCLAPVIPATHVNSPTALSSYVNWHSNFLQSNVYKWWKPGGKFFLKFARAIPGAAVKLCLGDLLVMGSNPETASLHMQGYGCVQHPSPIPSHSEKPLGNGLFLISAVFTSKVAKVSSKRNESN

SEQ ID NO: 224967 - protein, 711 aa, Glycine max
  Coding DNA Sequence Number=SeqID_108189
  Gene Ontology: Mol. function=zinc ion binding; Cellular component =nucleus; Biological process=transcription
  Homolog annotation: Hit_ID=Q9ZVC9; Match level="QueryCoverage=84%, HitCoverage=70%, E-value=1e-149, Identity=44%"; Hit description =Mutator-like transposase
  Pfam annotation: Domain name=FAR1; Domain location=83-299; Score =352.3; E_value=7.8e-103; Accession=PF03101.5; Description=FAR1 family
MEFEPLSLSDEVIEFDMIGLGDDAAIDTEHPVEDDEDLVNIDNSPATAFTVLAAGLGPHIAGGDTNLEPCQGMEFESEEAAKAFYNSYARRVGFSTRVSMSRRSRRDGSIIQRSFVCAKEGFRVEREKHLVDGRVKRPRAETRVGCKAMLVVKIQDSGRWVVSSFLKEHNHELVPPDKVHCLRSHRHVSGPAKSLIDTLQGAGIGPSGIMSALIKEYGAISNIGFTERDCRNYMRSSRQRTLGGDTQILLDYLKSKQAENPSFFYAVQLQGDEDHCMSNIFWVDSKARTNYTYFGDTVTFDTAYRSNRYRLPFAPFTGVNHHGQPVLFGCALLINESEASFVWLFKTWLEAMTGQPPVSITTDHDRVIRAAINNVFPGTRHRFCKWHVFKECQEMLSHVLSEHLNFEADLHKCVNLTESIEEFESCWSSLIDRYDLKEHEWLKAIYGDRRQWVPVYLRDTFFAEMSITQRSDSINSYFDGYINASTTLQLFVKQYEKALESRYEKEVKADYDTINTTPVLKTPSPLEKQAAEVYTRRLFIKFQEELVETLTFLANKVDEKEIITVYRVAKYGEMHRAYFVRFNSFEMKATCTCQMIAKSGAILDERTTNLSTRAQESLTIRYNNLRHKALKYADEGINSPKVYDVALSALLEAASKVALATKNGGRQTILNGTCEEDLHQSNEATTSCSDSPIGSQQSSYKLQRWFLKGSS

SEQ ID NO: 224968 - protein, 55 aa, Glycine max
  Coding DNA Sequence Number=SeqID_108190
MAYGFGDFHCQMTTGHGEKIKQWVNEWEASCGRISVDSLHKGLSFTPIFFLYLIC

SEQ ID NO: 224969 - protein, 112 aa, Glycine max
  Coding DNA Sequence Number=SeqID_108191
AVRSIVMVGCDPKGTFSVGAKLSRSRIFFGFLSDSPYEVLDPYPCQEVFVSLSFELSVVVGDDSIWEVVLGDKVVRRSAWNVCKLLTSSASLGKVEGVYPKCWLVVAKERPL

SEQ ID NO: 224970 - protein, 170 aa, Glycine max
  Coding DNA Sequence Number=SeqID_108192
MVKRCTDEHNFSQHVVGLSASALQKVQNVHNLSLRATGLDRLWMAKGARMNVICLRLSSGSPPLDDERCRITIICLCVPSNSIVSGWRKNDHNLSLRASGLDRLWMVKRRADDYNFTPHVIGLAASALQKVQNDHNLSLRAIGLDRLSMAKRCANDHNLSLHVNGLAASG

SEQ ID NO: 224971 - protein, 67 aa, Glycine max
  Coding DNA Sequence Number=SeqID_108193
MTREKSMFQCLTPYHGGTITFRGNKKGRIIDIVDMVYPSTRISVSFYVRMGLPYSLLREKATSTGKD

SEQ ID NO: 224972 - protein, 157 aa, Glycine max
  Coding DNA Sequence Number=SeqID_108194
MGRMKYNKIMFNMKNNLNGKEHTSQERKDIELVDEEEAQIGADRSSATSNKSEIYNEEAWNAAQKHKPKRVESVNADAEAFDVIPSGSSNNNHDNSLHNTKRGTNNNLKVVHSGTKECKIASNKRDLFLGFSEHQERLCKKLALEEGRIYAANEQLS

SEQ ID NO: 224973 - protein, 86 aa, Glycine max
  Coding DNA Sequence Number=SeqID_108195
CTLYGGAHGSGLCIPTKETSHEVNYMGNQPGQNFNAVQGGPPNRPQQQGPSLSERTTKLEETLAQFMQVSLTNHKSTESAIKNLEV

SEQ ID NO: 224974 - protein, 183 aa, Glycine max
  Coding DNA Sequence Number=SeqID_108196
MGAYVKDEKLLMHFFQESLTGAAITWFTNLESSWIRSWKDLMVAFIRKYQYNSNMAPDRMQDLAAQVVPPMMEREMITMIVDTLLVFYYKKMVGIKVGLRRGKFNYAASTSDDNRKTETGGAKKKGGDAYVVTTAPTWSSFQQTPHNPTVDFHRLTKTIFGLSEPSAEHNTPRLSARKNLEEG

SEQ ID NO: 224975 - protein, 552 aa, Glycine max
  Coding DNA Sequence Number=SeqID_108197
  Gene Ontology: Mol. function=DNA binding; Cellular component =intracellular; Biological process=regulation of transcription
  Homolog annotation: Hit_ID=Q69XV5; Match level="QueryCoverage=83%, HitCoverage=91%, E-value=1e-117, Identity=51%"; Hit description=DNA -binding protein-like
  Pfam annotation: Domain name=ARID; Domain location=229-337; Score =46.3; E_value=1e-10; Accession=PF01388.11; Description=ARIDBRIGHT DNA binding domain
MSDAKENEEAGQGVPSVVEENQQLVDAEVQDQPEAASAPVPVEETSNHVEIGSDHVENTKEEPPAEDKNVELEVVSEGIPQDVQNTLLSVPVEADAQILDRTESEEAEASGAKVEADELPQNNKEAENNDDIHQKSNGDVEMAVEVKPEDCGMADSKACDNGDPVLASHNEPATPQPAPADTNTEIMNVLEVENKVDEKQVAEPADNGNSNSKHMLFLDADHSYDGNESGTEEEQSAFMKELENFFRERSMEFKPPKFYGEGLNCLKLWRAVTRLGGYDKVTSCKLWRQVGESFKPPKTCTTVSWTFRGFYEKALLDYERHKIQGGELNVPVASHPEPINIENQASASGRARRDAAARAMQGWHSQRLLGNGEVSDPIIKDRNSVSVQKREKQLKSINIHKRKKPSSPYMDNAVKAARSKPSKPQLDTTVIDIGPPADWVKVNVQKTKDCFEVYALVPGLLREEHIIFAISLLPLRGSCNMGEAKVMVVRVQSDPAGRLVISGEPEHPNNPWGVTPFKKVVSLPSRIDPHQTSAVVTLHGQLFVRVPFEHAE

SEQ ID NO: 224976 - protein, 181 aa, Glycine max
  Coding DNA Sequence Number=SeqID_108198
MIPTRLVVGALEESGDPNGEKAERGPGAIMSSGFGGLGLEGMVGMSEPAAGVGKTPPGEGSSGAMSGDSSWKGDSEEGDGGGSVNVAGEDESVGTLGIGSCEYDERRGRWRMWAFSGKKDAKALNRRGLKICRFPSSLSHLQPKTRWGQMGHHVARFHWMMIRELSFFTLRKRQRLGKVSM

SEQ ID NO: 224977 - protein, 999 aa, Glycine max
  Coding DNA Sequence Number=SeqID_108199
  Gene Ontology: Mol. function=protein serine/threonine kinase activity; Cellular component=nucleus; Biological process=protein amino acid phosphorylation
  Homolog annotation: Hit_ID=Q5NAR7; Match level="QueryCoverage=98%, HitCoverage=71%, E-value=0.0, Identity=59%"; Hit description =Putative FUSED serine/threonine kinase
  Pfam annotation: Domain name=HEAT; Domain location=634-670; Score =15.7; E_value=0.17; Accession=PF02985.12; Description=HEAT repeat
  Pfam annotation: Domain name=HEAT; Domain location=831-868; Score =1.8; E_value=26; Accession=PF02985.12; Description=HEAT repeat
  Pfam annotation: Domain name=Pkinase; Domain location=5-245; Score =233.9; E_value=3.4e-67; Accession=PF00069.15; Description=Protein kinase domain
  Pfam annotation: Domain name=Pkinase_Tyr; Domain location=5-243; Score=67.4; E_value=4.5e-17; Accession=PF07714.7; Description =Protein tyrosine kinase
  Pfam module annotation: Pfam domain module=HEAT::HEAT::Pkinase::Pkinas e_Tyr; Domain location=634-670::831-868::5-245::5-243
MHTQTVYKGRKKKTIEYFAIKSVDKSQKTKVLEEVRILHTLDHANVLKFYDWYETSAHLWLVLEYCVGGDLLSILRQDSQLPEDSVHGFAYNLVKALQFLHSNEIIYCDLKPSNILLDENGCAKLCDFGLARKLKDISKAPSSSLPRAKRGTPSYMAPELFEDGGVHSYASDFWALGCVLYECYAGRPPFVGREFTQLVKSIISDPTPPLPGNPSRPFVNLINSLLVKDPAERIQWPELCGHAFWRTKFTLLPLPAQPAFDDMIELHAKPCLSERNGDKSSHNRTPTKYREKDVKGALRKDENSVLGSRGIETPARATPIGHRTQTKGSGRIHEVKQKDNSNISKGVNLLRLSRIAKTNLQRENEKENYRRPLPNNSENDSEVKIENTDMELDFNENTEDDAHEETDGTEQTTPVPDEKTDNHFLNQGKAEEIENNTHQLDTPSVVHPPVSDDPRSFDHESTPDLPDISAISPSVSPQVKKHRTKEDAGSGLDFDSSRLSNNLSQVLWHPSDLSVRPVMPSRKIDKASEVIPSLPFEALQASDFVKMPKEKLEAIHNRILSILNGNTSIGEKQNVIRYLEMLSSNADAANILTNGPIMLMLVKLQRQSKASALRVQLASLIGLLIRHSTFVDDSLASSGILGALTDGLRDRQEKVRRFSMAALGELLFYISTQNADCRDNNQLESPSKDNRTTHGWQVPNSLISLVSSMLRKGEDDITQLYALRTIENICSQGGSWVGRLSSQYVISNLCYIYRASGKQESMRLTAGSCLVRLVRFNPPSIQLVIEKLSFKDLASALVKGSPREQQISLNLLNMAMLGSHMFTNIGRCLVSLAEDKNLIPSLLGLVEQGSEVLRGKALVLVALLCKHGRRWLPHFFCSQKLLSVVDRLGKEKDAYVRQCLDAFVHIVASSIPGLLDIITGDVQQMMGGRRQGHISALTSRSAPKTSIHLFPVVLHLLGTSTFKHKVVTPQVLRQLANLIKLVETPFQVCATQPLYLLSF

SEQ ID NO: 224978 - protein, 61 aa, Glycine max
  Coding DNA Sequence Number=SeqID_108200
MDFEICPIMQKNVVELCSRFLMCAEKCLCIAGYGKGTSSKIFKAIQRSTNQNEESVTGVYE

SEQ ID NO: 224979 - protein, 316 aa, Glycine max
  Coding DNA Sequence Number=SeqID_108201
  Gene Ontology: Mol. function=kinase activity; Biological process=D -ribose metabolic process
  Homolog annotation: Hit_ID=UPI00005F80AD; Match level="QueryCoverage =99%, HitCoverage=49%, E-value=1e-123, Identity=64%"; Hit description= COG0524: Sugar kinases, ribokinase family
MPTKVELDDYLSRADAVPRPDIDARLNHLHRVTSRRQPWPELCIFAFDHRKQLADLALETGRDPACIPELKLLLLAAAEAAGTEAGLDRRSGILADGTYGQRSLNAITGKGWWIGRPIELPSSRPLRLEHGNIGSQLIDWPLEHVVKCLVFYHPDDPAALRAEQDALLLEVWHACNKSGHELLLEVILPENGPDKDERHYHTMLEHFYQLGIQPDWWKLPPLASAQWERISALIEREDPWCRGILLLGLDAPSDRLRSGFAEAAGHPMIKGFAVGRTIFGQPSRRWMQGELDDAALIDEVKRNYLRLIGYWREARG

SEQ ID NO: 224980 - protein, 206 aa, Glycine max
  Coding DNA Sequence Number=SeqID_108202
  Gene Ontology: Mol. function=ribonuclease H activity; Cellular component=intracellular; Biological process=DNA integration
MMQEMCEDSKVQHHNSTPYRPKMNGAVEAANKNIKKIVQKMIVSYKDWHEMLPFALHEYRTSVQTSTGVPPYSLVYGMEAVLPFEVEVPSQKIIAESGLEELEWAQARYDQLNLIEGKRLTAMSHGRLYQQRIKNAFDKKVRPHKFNEGDLVLKKISHAVKDNRGKWAPNYEGPFVVKRAFYGGALVLTNMDGEELPSSVNSDVVK

SEQ ID NO: 224981 - protein, 71 aa, Glycine max
  Coding DNA Sequence Number=SeqID_108203
MKNDEERWKTFTDLLTAALRNNLSLDFLHGNNFFHPKQLKCIAKGVRNIWNSLPSPIYRKRGEEVAAQLAQ

SEQ ID NO: 224982 - protein, 107 aa, Glycine max
  Coding DNA Sequence Number=SeqID_108204
MRGYLMVIRTFCHARASEPVDTQRLTSSSAPFVDQGQASPLTRRDKRRLLHLLSSRDGESDDMRGYLMVICTFCQQQASEPVDTQRLTSSSAPFVNQRQASPLTHRD

SEQ ID NO: 224983 - protein, 415 aa, Glycine max
  Coding DNA Sequence Number=SeqID_108205
  Gene Ontology: Mol. function=transcription factor activity; Biological process=regulation of transcription, DNA-dependent
  Homolog annotation: Hit_ID=O06466; Match level="QueryCoverage=60%, HitCoverage=79%, E-value=8e-94, Identity=70%"; Hit description =Oxidative stress transcriptional regulator
RPSRALPTGASTETFLHRRGFAGEDQGQNVLLARHFIFALHARMHHDDAFGNLVRCQHGGTVEFFSKRERGRRLAQRRGFEHGVQAVHVEGGNGDRRRQAAGGTHGEAPWLKAMQKAAPAGAACLYCGDKCGRNRLLPIPGRYCGGSAVQRGAGQGGSVAGGVDRLQGEQRLRQALELVGQLHKEVVHGRAAAPDHGDAAAGTAFAGEIEQADVVRARDRRLHRQARQQSDADVGGNHLPQRLQAGGAELGLLVGTEQAADFQCLVAQAMPVFQQQQLLRGQFLHVQVFATGQRVAPGNSQQERLLEQEFGVQLVVDHRQGQQRSIEFAFAQAVEQHIALFLDQQQFQLREAIADARDHMRQQVRAQGREDPQAHRTGFRVAAASRRFLQLFHFGHDHPRPRGSLLAGRGQHHLA

SEQ ID NO: 224984 - protein, 239 aa, Glycine max
  Coding DNA Sequence Number=SeqID_108206
  Gene Ontology: Mol. function=oxidoreductase activity; Cellular component=membrane fraction; Biological process=glycolysis
  Homolog annotation: Hit_ID=Q1GZJ6; Match level="QueryCoverage=99%, HitCoverage=27%, E-value=1e-102, Identity=75%"; Hit description=2 -oxo-acid dehydrogenase E1 component, homodimeric type
MSATIPNCISYDPTFAYELAVIIQEGMRRMVQNQEDVYYYITLMNENYSHPAMPEGSAEGILKGMYSFSKSKAKGPKVQLMGSGVILREVIAAAELLEKDWGVSADVWSVTSFTELRRDGIDAERHNLLNPEAKPRLSYVAQALAKAEGPVIASTDYMRSFADQIHNYVPNRFVALGTDGYGRSDSREALRSFFEVDRYYVVLAALKALADDGKLPASKATEAIKKYNIDITRANPATI

SEQ ID NO: 224985 - protein, 157 aa, Glycine max
  Coding DNA Sequence Number=SeqID_108207
MTLLLSNILPSDRNANLPLQKYQLVCVVPTWGSHPQETPSGPGKVQQGPGVSSSGYGPLSVLQGARTPPARSRHHRDRDCKTPSGPEEVQQGLGIVKALITGLCQFYGVPVTSSKGIRPPTNRAFIKKYCAPDRRRAIHHSSIGMVGSGKQTHRHHL

SEQ ID NO: 224986 - protein, 173 aa, Glycine max
  Coding DNA Sequence Number=SeqID_108208
  Gene Ontology: Mol. function=transcription factor activity; Biological process=regulation of transcription, DNA-dependent
  Homolog annotation: Hit_ID=Q46MP9; Match level="QueryCoverage=98%, HitCoverage=56%, E-value=2e-66, Identity=72%"; Hit description =Regulatory protein, LysR:LysR, substrate-binding
  Pfam annotation: Domain name=HTH_1; Domain location=14-73; Score =57.1; E_value=5.9e-14; Accession=PF00126.17; Description=Bacterial regulatory helix-turn-helix protein, lysR family
MKKKALAQVTDFDLKLLRVFKTVSECGSFSAAESLLGITRSAISLHMSDLEKRLGMRLCQRGRAGFALTEEGREILRHSETMMAAVEDFRQQVNQMHQQLRGEFNIGIINNLVTQPRMRLTHALAALRESGAGIRINISMLTAADIERGLLEGRLHVGALPMAAPVSGLAYAQ

SEQ ID NO: 224987 - protein, 122 aa, Glycine max
  Coding DNA Sequence Number=SeqID_108209
MDLSNVFMSNLLKVEASSPKSNALANPLSHTISFKRPNWGICLGFYLLAECVNHLTKLEKRRVSLSLTLAIIQYDAILGAFLGKTPRENYKQLDLNPELGLDLKRADNFILSNLILSRFYFI

SEQ ID NO: 224988 - protein, 93 aa, Glycine max
  Coding DNA Sequence Number=SeqID_108210
MEEFEAQVDWLGGQPSSSRGGGASAAQEPDTEEPPTPTPSPAAVEEKTTPDQTPQPSPTPTHIPEDAAPVAKPEQLIQDSSVAPALDLNEDQP

SEQ ID NO: 224989 - protein, 76 aa, Glycine max
  Coding DNA Sequence Number=SeqID_108211
MECNIYGVKIKSDGPVERGAGSGIYVSVGGINGVCMGGLNLSWVKESEWAPRALHRAVIRAGKPSLEESCWAMSVI

SEQ ID NO: 224990 - protein, 389 aa, Glycine max
  Coding DNA Sequence Number=SeqID_108212
  Gene Ontology: Mol. function=ubiquitin thiolesterase activity; Cellular component=intracellular; Biological process=ubiquitin -dependent protein catabolic process
  Homolog annotation: Hit_ID=Q5VPU9; Match level="QueryCoverage=88%, HitCoverage=86%, E-value=8e-53, Identity=33%"; Hit description =Carboxyl-terminal peptidase-like
  Pfam annotation: Domain name=DUF239; Domain location=156-346; Score =208.2; E_value=1.9e-59; Accession=PF03080.5; Description=Arabidopsis proteins of unknown function
MINTLLLVMCLVTSGARHKVHGTQNVLQEDLELERQLELLNKPPIKSIHTNLGYIVDCIDINKQPAFDHPLLKNHKLQRKPSFQKSIGKTSVKKSPTRPLLVLQKDQCPTGTVPIRRTTKDDLIREKSFLNYHIMTQDIPGVHIAEVSLSSLYGPYYGVIGSNNVFNPRVSRKDQVSSSHLWVQNGPVEAANKIAAGWHVAPQLYGDDKTYIYSAWTSDNFERTGCYNIRCSGFVQISKVNYLGTHVNNYSTYGGTQLEFIISITQDPVTKNWWLNMANINIGYFPAALFSNMTSADQVGWGGRTRTPPNTPSPPMGSGHFPDHTFHHACYFTFVSFQNEATRNYGIGPHGAQTFSDRSDCFGVRYLGYIAEEVGYSLQFGGPGGSCGN

SEQ ID NO: 224991 - protein, 124 aa, Glycine max
  Coding DNA Sequence Number=SeqID_108213
MDEEAYLVICEPLIMLCAHVGKLLDSRPTPPECKEEEERKRHRRKGSLYFVHSYPSMVCSLSRHYSSYVHHYTQVLEVGLLFAPYFLLVEHGTRVFATPVRPSTYHITSSKKLIKQEFNPFIGS

SEQ ID NO: 224992 - protein, 267 aa, Glycine max
  Coding DNA Sequence Number=SeqID_108214
  Homolog annotation: Hit_ID=O21999; Match level="QueryCoverage=36%, HitCoverage=53%, E-value=6e-19, Identity=57%"; Hit description=LacZ -alpha
DLPSQWLLFLSAVPPVQLLTGWCVTAKAPPDISAGKCSGRVPFAIQAAQLLGRAIGAGLFAITPAGERGMCCKAIKLGNARVFPVTTLNSITYPLNSRTSPVSLYPRKISTRSPRLMRFSSSNLWLYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 224993 - protein, 179 aa, Glycine max
  Coding DNA Sequence Number=SeqID_108215
MALKFGPYSDSLCKKLPTTLDMLGARAVKFIQMEEITKFRKKMRGKSSRKPIGREVKIKSSHSLGKSKANMPPQSKFSDYTLLIESQGRVLEEACSNKTPSLNELGAIILNSHLAMKFPSEDGKIIIAKANQMTISECYAGSLRITKRKKVAESKVQLVVCTPLNNNVGEAEIDPREAH

SEQ ID NO: 224994 - protein, 66 aa, Glycine max
  Coding DNA Sequence Number=SeqID_108216
YKDKVKGSRDPEKALKTKLASAENSTKALQEEVECLNKEFTLFKVDTEKAKEKLKSCLCEIGSPRS

SEQ ID NO: 224995 - protein, 71 aa, Glycine max
  Coding DNA Sequence Number=SeqID_108217
MNNQVEYEAILAGLRLAKEVGAKYFKCWSDFKLVTGQLNGDYWTKDPQMTRGRTPIQMRLHNPSVEVLTRD

SEQ ID NO: 224996 - protein, 158 aa, Glycine max
  Coding DNA Sequence Number=SeqID_108218
  Gene Ontology: Mol. function=oxidoreductase activity; Cellular component=cytosol; Biological process=metabolic process
  Homolog annotation: Hit_ID=Q1SMR0; Match level="QueryCoverage=87%, HitCoverage=44%, E-value=2e-55, Identity=75%"; Hit description=Short- chain dehydrogenase/reductase SDR
  Pfam annotation: Domain name=adh_short; Domain location=6-149; Score =17.6; E_value=3.8e-07; Accession=PF00106.15; Description=short chain dehydrogenase
WWSKETVAVVTGGNRRIGYEICRQLATHGLAVILTSRDVGAGVDSIKALQEGGLSVVYHQLDVVDYSSINQFVEWSWENYGDLDILVNNAGVNFNLGSDNSVENARKVIETNYYGTKRMTEAVIPLMKPSLIGARIVNVSSRLGRLNGRRNILDSFPC

SEQ ID NO: 224997 - protein, 135 aa, Glycine max
  Coding DNA Sequence Number=SeqID_108219
MLQCEGFSSKLIYDFEIPNGENFLNWVANMILKFHDDPTVNGFEIVVFLRQVWWAAGKRKGFERRRGKTKMRPKRRQLTEHNYLYLGFLNLFTKNWDVTSVNRVQLMNIVDQFITANNQVPKNYSSDDYSLRSHL

SEQ ID NO: 224998 - protein, 85 aa, Glycine max
  Coding DNA Sequence Number=SeqID_108220
MCAFRVLCDEFFITPIAPKFIHHYNVKVNKKGGYAILCQTILLDKFDWQFIKKAQAKKVQSNKAKGQTQVLKMKGLQKGQEWSQC

SEQ ID NO: 224999 - protein, 55 aa, Glycine max
  Coding DNA Sequence Number=SeqID_108221
MAASPTKKAMDEVPNHDSQDGMPVPPAKHALNYQEAWAGILDKARHGGMHKRGPN

SEQ ID NO: 225000 - protein, 76 aa, Glycine max
  Coding DNA Sequence Number=SeqID_108222
MASAITWAMCTFIRVRMAYTNWHLGRERSELWLLGKTLLSSSVIHIWVKVVMLVRMIRTRLPAAVRAKSCPDMHSS

SEQ ID NO: 225001 - protein, 51 aa, Glycine max
  Coding DNA Sequence Number=SeqID_108223
MDENHHGSLFLKSAKAKRVRGLNVLGKDKAGERESGEKKGLRLQYEIACPL

SEQ ID NO: 225002 - protein, 80 aa, Glycine max
  Coding DNA Sequence Number=SeqID_108224
MWKRAMNEEMQSMLINDVLELVGFLENYKAIGLYIQQPEGFHTGGSENLVYKLKRSIHGLKLLDSGDRLSMDQCPKNDIQ

SEQ ID NO: 225003 - protein, 79 aa, Glycine max
  Coding DNA Sequence Number=SeqID_108225
  Subcellular localization annotation: CTP_CleavageSite=6; ConfidenceScore=5.02e-01
MAFLMTSMLKRSKLNLTSKFLLKAKVSDFIYNSSWNLAAVWNVSFSKLMEAIKAMLIPIVPIHDKLMWLGSHDGNLSFK

SEQ ID NO: 225004 - protein, 76 aa, Glycine max
  Coding DNA Sequence Number=SeqID_108226
TGFVVDLGMAFVDNWAVGKEETHIDPFTGKDQILKALKVLHLWAYSLKDLCPFLHMFCSCILSEDIILTLPNEGNH

SEQ ID NO: 225005 - protein, 1200 aa, Glycine max
  Coding DNA Sequence Number=SeqID_108227
  Gene Ontology: Mol. function=motor activity; Cellular component =myosin complex; Biological process=signal transduction
  Homolog annotation: Hit_ID=Q9SKB0; Match level="QueryCoverage=95%, HitCoverage=72%, E-value=0.0, Identity=60%"; Hit description =Putative unconventional myosin
  Pfam annotation: Domain name=DIL; Domain location=970-1077; Score =195.9; E_value=9.4e-56; Accession=PF01843.9; Description=DIL domain
  Pfam annotation: Domain name=IQ; Domain location=267-287; Score=24.8; E_value=0.00031; Accession=PF00612.17; Description=IQ calmodulin -binding motif
  Pfam annotation: Domain name=IQ; Domain location=357-377; Score=21.4; E_value=0.0033; Accession=PF00612.17; Description=IQ calmodulin -binding motif
  Pfam annotation: Domain name=IQ; Domain location=380-400; Score=21.3; E_value=0.0034; Accession=PF00612.17; Description=IQ calmodulin -binding motif
  Pfam annotation: Domain name=IQ; Domain location=405-425; Score=16.6; E_value=0.09; Accession=PF00612.17; Description=IQ calmodulin-binding motif
  Pfam annotation: Domain name=IQ; Domain location=428-448; Score=25.3; E_value=0.00022; Accession=PF00612.17; Description=IQ calmodulin -binding motif
  Pfam annotation: Domain name=Myosin_head; Domain location=1-251; Score=-197.2; E_value=2.3e-08; Accession=PF00063.11; Description =Myosin head (motor domain)
  Pfam annotation: Domain name=Pox_A_type_inc; Domain location=494-516; Score=3.1; E_value=29; Accession=PF04508.3; Description=Viral A-type inclusion protein repeat
  Pfam annotation: Domain name=Pox_A_type_inc; Domain location=558-580; Score=11.9; E_value=1.5; Accession=PF04508.3; Description=Viral A -type inclusion protein repeat
  Pfam annotation: Domain name=Pox_A_type_inc; Domain location=634-656; Score=2.0; E_value=41; Accession=PF04508.3; Description=Viral A-type inclusion protein repeat
  Pfam module annotation: Pfam domain module=DIL::IQ::IQ::IQ::IQ::IQ::My osin_head::Pox_A_type_inc::Pox_A_type_inc::Pox_A_type_inc; Domain location=970-1077::267-287::357-377::380-400::405-425::428-448::1 -251::494-516::558-580::634-656
MEQEEYTKEEINWSYVEFVDNQDVLDLIEKKPGGIIALLDEACMFPKSTHETFAQKMYQTYKGHKRFSKPKLSRTNFTINHYAGDVTYQADYFLDKNKDYVVAEHQALLCASKCPFVANIFPPLPEETSKQSKFSSIGSQFKQQLQSLMETLNTTEPHYIRCVKPNTVLQPGIFENFNVLNQLRCGGVLEAIRISCAGYPTKRTFEEFLDRFGMLAPDVLDGSDEKKASMAICDKMGLKGYQMGKTKVFLRAGQMAELDARRAEVLAKAAKLIQRQIRTHLARKEFITLRKTTIHIQKIWRGHISSPKRLTFLVMSFFFFSASLLWFCSGKNRSYYFAGFTFSAKLARKLYEHMRREAASIRIQKHVRAHRARINYTTLQASAIVIQSGLRALAARNEYRYRRRTKASTKIQTQWRRAQALSDYKQQKKATVTLQCLWRAKVARKELRKLRMAARETGALKEAKDKLEKRVEELTWRIDIEKHMRTDLEEAKGQEIAKLQNALQEMKAQLDEAHAAIIHEREAAKIAIEQAPPVIKEVPVVDETKLELLTNKNEELETEVEELKKKIKEFEESYSEIENENQARLKEAEEAQLKATQLQETIERLELSLSNLESENQVLCQKALEEPKNEELFEEIKILKDQIANLQSENESLRSQAAAAALEQKVHPEKIEPDQEVAVVEKMQVKPRVIADNTTAQIKNLDNGNPTEEEWHARKEPRAPIFLLTKQRSLTDRQQESHDALLKCLTEDKRFEKNRPAVACIVYKSLLHWRSLEAEKTHIFDKITHAFRSSIESQEGIHDLAYWLSTTSTLLFYLQCTMKASNTTKAVSRNRNSPATLFGKMAQGLRSSSLGLGISSGYSGMVDKTNDQSKVEAKYPAILFKQHLTAYVEKIYGMIRDSLKKEISPFLNLCIQAPRSIRTRSIRGSSRNIHSNIVAKQQTLHMYWKGIVDKLDTALHILSDNYVPPIIARKIFSQVFSFMNVQLFNSLLLRRECCSFSNGEYLKAGLHELELWCLKATDQFAGSSWAELKHIRQAVGFLVLHQKTQKSLEEITNELCPVLSIPQIYRIGTMFWDDKYGAHGLSAEVISRMRVIMTEDSINIHNSSFLLEVDSSIPFLMEEMFQSMSDIRLSDMDVDPPPILRQSHSFNGSEYLEGYPGFTQKLILGTTCKRKKFVWRDCQEYLQTVYIEKYVSPRGSNAAG

SEQ ID NO: 225006 - protein, 54 aa, Glycine max
  Coding DNA Sequence Number=SeqID_108228
MKRQRLKALNEIGGGMKGDEGKDRVEQGGLVKAWLLGNDVVFVSDGVCNDVVVW

SEQ ID NO: 225007 - protein, 44 aa, Glycine max
  Coding DNA Sequence Number=SeqID_108229
MEQRIGKQRSAKERTNIEEKCFIKCRWFVTWSDTMTQQYKSHIV

SEQ ID NO: 225008 - protein, 477 aa, Glycine max
  Coding DNA Sequence Number=SeqID_108230
  Gene Ontology: Mol. function=motor activity; Cellular component =myosin complex; Biological process=protein amino acid phosphorylation
  Homolog annotation: Hit_ID=Q1SU59; Match level="QueryCoverage=99%, HitCoverage=92%, E-value=0.0, Identity=91%"; Hit description=Myosin head, motor region; AAA ATPase; Myosin, N-terminal, SH3- like
  Pfam annotation: Domain name=Myosin_N; Domain location=10-51; Score =40.1; E_value=7.8e-09; Accession=PF02736.9; Description=Myosin N -terminal SH3-like domain
  Pfam annotation: Domain name=Myosin_head; Domain location=64-477; Score=272.5; E_value=8.3e-79; Accession=PF00063.11; Description =Myosin head (motor domain)
  Pfam module annotation: Pfam domain module=Myosin_N::Myosin_head; Domain location=10-51::64-477
MGTPVNIIVGSQVWVEDPEDAWIDGEVTQINGKNVTIITTNGKTVVAEISSIYPKDTEAPPAGVDDMTKLAYLHEPGVLHNLATRFSLNEIYTYTGNILIAVNPFRRLPHLYDIHMMEQYKGAAFGELSPHLFAVADTCYRAMINENGSQSILVSGESGAGKTETTKMLMRYLAFMGGRSATEGRTVEQQVLEVYAVIFSLLQSNPVLEAFGNAKTVKNNNSSRFGKFVEIQFDKNGKISGAAIRTYLLERSRVCQVSDPERNYHCFYMLCAAPPEDVKKYKLGDPRQFHYLNQSNCYQVSNVDDAKEYLEIKNAMDIVGISQEEQDAIFRVVAAILHLGNIDFVKGKEVDSSKLKDDKSLFHLRTAAELFMCDAKALEDSLCERVIVTPDGNITKPLDPDAAALSRDALAKTVYSKLFDWLVDKINSSIGQDSNAVSIIGVLDIYGFESFKINSFEQLCINLTNEKLQQHFNQARL

SEQ ID NO: 225009 - protein, 304 aa, Glycine max
  Coding DNA Sequence Number=SeqID_108231
  Homolog annotation: Hit_ID=Q1SKD7; Match level="QueryCoverage=57%, HitCoverage=42%, E-value=3e-09, Identity=28%"; Hit description =Ankyrin
MDGSIDVAIVKEFYTNLYDLEDKSPKQVRVRGHLIKFDEDTLNTFLRTPMIIEKGENLPTYSRFYRLRQDPQELAARLCIPGKGFELNADGLPLKILQKNLTMLAQTWSVLSFSNLAPSSHTSDITLDKAKLIYGIIQKMDVNLGYIISTQISMIAQHDSSRMGFLALITALCKARGVTSDSLTFESLSPAINLAYGPRKTKRKRSEAPPSYGLPTPAPSTSTAASSTPASSLPAPASAAVASSLPAPALAPSTSTTALFAPASSTPLPVPAPVPSGPSTVSSDTLLAMLQSLHKGQIIIMQCL

SEQ ID NO: 225010 - protein, 320 aa, Glycine max
  Coding DNA Sequence Number=SeqID_108232
  Gene Ontology: Mol. function=DNA binding
  Homolog annotation: Hit_ID=Q1SDS1; Match level="QueryCoverage=52%, HitCoverage=30%, E-value=3e-24, Identity=41%"; Hit description=IMP dehydrogenase/GMP reductase
AKWTPFIDILALLIFGGVLFPNVDGLVDLAAIDAFLAYHNHKESSVVAMLADLYDTFDRRCEKSNTRIVCCTPALYVWLVSHLFRQEVRHACPLESHRSCTEKGGANWDQLLASKEGASVNWFPRWKDGRTGVLVSCKGFPNVPLMGTRGCISYNPVLAIRQLGYPMRGAPLEDELMPVISQGFNKTNVETLQKWLKAHVQGFDWLPSLRTAKREEVEAPEEDEEENTELRDVNVAITKALEQEPKRACREEHGRNKFRGALWGSNNELKLRREERDQSRTNMLAIITKYQEELNLVVAHEQKVADEYAKCTRKRRLEEG

SEQ ID NO: 225011 - protein, 284 aa, Glycine max
  Coding DNA Sequence Number=SeqID_108233
  Gene Ontology: Mol. function=RNA-directed DNA polymerase activity; Cellular component=intracellular; Biological process=RNA-dependent DNA replication
  Pfam annotation: Domain name=rve; Domain location=1-150; Score=108.7; E_value=1.7e-29; Accession=PF00665.16; Description=Integrase core domain
MWGIDMIGRIEPKASNGHRFILVAIDYFTKWVEAASYANVTKQVVVRFIKNQIICRYGVPNRIITDNGTNLNNKMMKDLCEEFKIEHHNSSPYRPQMNGAVEAANKNIKKIVQKMVVTYKDWHEMLPYALHGYRTSVRTSTGATPFSLVYGMEAVLPVEVEIPSMRVLMEAQLSEAEWCQSRYDQLNLIEEKRMKALCHGQLYQQRMKQAFDKKVRPRVFQEGDLVLKKVLSFQPDSRGKWTPNYEGPYVVKRTFSGGALTLTTMDGDELPRPVNADAVKKYFV

SEQ ID NO: 225012 - protein, 101 aa, Glycine max
  Coding DNA Sequence Number=SeqID_108234
MPAKDLPHTQLQCRRRIYRTRNYNAGDGIASNLKTWKEFEVAKSQMRIGEGSSGYLRIVGVIRLRFRVGEADGDESEGRAATMFEREKRVVSVCGEWSNGE

SEQ ID NO: 225013 - protein, 62 aa, Glycine max
  Coding DNA Sequence Number=SeqID_108235
  Homolog annotation: Hit_ID=Q93XE2; Match level="QueryCoverage=71%, HitCoverage=13%, E-value=6e-16, Identity=88%"; Hit description =Nuclear matrix protein 1
MASRQMEEIRKKLADLNYPRANAPAQSLLFAGMERYALLEWLFFRDPSSYLCNVRSLWHWGT

SEQ ID NO: 225014 - protein, 70 aa, Glycine max
  Coding DNA Sequence Number=SeqID_108236
MVLKGTHYLPIITIVKETCRKVAIFFTKRRMEAHAMITFGQEFGELVYKCLDDTVVKICHSSCSILRSPK

SEQ ID NO: 225015 - protein, 60 aa, Glycine max
  Coding DNA Sequence Number=SeqID_108237
MQEVAESQGEEEENKDASAAAGLLKKLTVGEDKLEDKEPPEKATDTNVKGCWHVYKRLVT

SEQ ID NO: 225016 - protein, 280 aa, Glycine max
  Coding DNA Sequence Number=SeqID_108238
KKIPSHARTSPAPETDAVNVEKQGEGQGIGSSSPHGSSQKSSSEENFSDEEAIEEAEAGGSDIYPASSTSKLSASIGIAEDTFIQMQDEDPAAALRLLLNTSQANTSSEKIPGASSSSDAEINSSIRQDCLLLKLSMEYTREDVLKSIEENPSAAFGHLNFLKKLHNPLTSDEILGKVIQIESIIDQFASTVQKKRENGARLDAQKQAHILLLEKARAAQHEVERLTKEAKEGSSEIKACDDNISSWEATITDLLSQVDDLRQKIVTEQAQTQGTPGEGR

SEQ ID NO: 225017 - protein, 176 aa, Glycine max
  Coding DNA Sequence Number=SeqID_108239
  Homolog annotation: Hit_ID=P92985; Match level="QueryCoverage=40%, HitCoverage=32%, E-value=1e-19, Identity=66%"; Hit description=Ran -binding protein 1 homolog c
  Pfam annotation: Domain name=Ran_BP1; Domain location=100-176; Score =1.2; E_value=8.5e-08; Accession=PF00638.9; Description=RanBP1 domain
MIRKLFMDQVGPQVNFLDLRVKLIRKSFTDQLDPNQQYNSALSLTISHALTALLAASLRINQQHQWPPPSHHNDDDDHVPAEDEDTGAQVAPIVKLEEVAVSTGEEEEDPILDLKANLYRFDNEGNEWKERGGGNVKLLKHKVSGKVRLVMRQSKTLSRSAPIILVLCIAFYLFSF

SEQ ID NO: 225018 - protein, 46 aa, Glycine max
  Coding DNA Sequence Number=SeqID_108240
MGDRHLSGYGGHWVCADILVDGGGVWLGCNLSSSLSLLQQNFLDFL

SEQ ID NO: 225019 - protein, 337 aa, Glycine max
  Coding DNA Sequence Number=SeqID_108241
  Gene Ontology: Mol. function=3-hydroxyacyl-CoA dehydrogenase activity; Cellular component=fatty acid beta-oxidation multienzyme complex; Biological process=fatty acid catabolic process
  Homolog annotation: Hit_ID=Q8ZAN0; Match level="QueryCoverage=44%, HitCoverage=20%, E-value=8e-67, Identity=82%"; Hit description=Fatty oxidation complex alpha subunit [Includes: Enoyl-CoA hydratase (EC 4.2.1.17); ...
  Homolog annotation: Hit description=Delta(3)-cis-Delta(2)-trans-enoyl- CoA isomerase (EC 5.3.3.8); 3-hydroxyacyl-CoA dehydrogenase (EC 1.1.1.35); 3- hydroxybutyryl-CoA epimerase (EC 5.1.2.3)]
  Pfam annotation: Domain name=ECH; Domain location=204-337; Score =158.6; E_value=1.6e-44; Accession=PF00378.10; Description=Enoyl-CoA hydrataseisomerase family
MACHRQLLRFAHTGQLVIGFDAAMIMQEVDDALGIDPLAADAQLGGAGRYRPDIGHIVALCRQQLSDIVSVFQADDLDILGPEAVRQWLDVVPVIDWRVEPQFGFIHAIDPQPAVGHLGHWHPGFKLGIHLKRIVMIVKKYALRYARDTGFSVNPWTCLRCRESGGSVAQPRGGCRAARAVIAETDMLYQGDTLSVHWLDDGIAELVFDAPGSVNKLDTKTVAALGEALSVLEQQSTLRGLLLSSAKPAFIVGADITEFLSLFDAPAEQLSQWLTFANSIFNRLEDLPVPTIAAIDGYALGGGCECVLATDFRVATPTARIGLPETKLGIMPGFGGS

SEQ ID NO: 225020 - protein, 166 aa, Glycine max
  Coding DNA Sequence Number=SeqID_108242
MDFTKIVEISSGLLEYWTLSLLRLLRPQGPTEAYSTSAAPHLASTSAAPPPARIVAAPSTLPPADFQCFEAMIQSIHQGQIILLQSLQLVAPPNSIPTVEQFNEWVAWPGTQPLQLLRCSGRQRRRGERRCHPLGNKPWKKELHHQDEPWIRSLEGCFNGGKERGR

SEQ ID NO: 225021 - protein, 232 aa, Glycine max
  Coding DNA Sequence Number=SeqID_108243
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q2TSD5; Match level="QueryCoverage=56%, HitCoverage=15%, E-value=3e-51, Identity=72%"; Hit description =Trehalose 6-phosphate synthase
  Pfam annotation: Domain name=Glyco_transf_20; Domain location=1-231; Score=-178.5; E_value=1.2e-05; Accession=PF00982.11; Description =Glycosyltransferase family 20
MQMCWSLTYQNYLYSLENYESRYVFSFVSYSLKGNIKFTRPSGLREYDGDHAVFALSALLGFFVGLLHVREWTAKRENVLGVSCALSELSYHQTSYEPVIIINRHVPLYEKASYYALAECCIINAVRDGMNLVPYEYIVCRQGSLTMDEALDIGSESPLTNALVISEFIACLPSLSGAIRVNPWDINAVADALNLAITMPSGEKQLRHEKHYRYVSSHDVAYLRQTVLCKIL

SEQ ID NO: 225022 - protein, 98 aa, Glycine max
  Coding DNA Sequence Number=SeqID_108244
MGPTPKTIFSHADTAHELYNTHDLTLIKLIPNNVLYCCCSILSISSSSHTFKGGAVEAAGGEGACNSNGNSKTAAFKGGSVEDAVAAFFQSLLLLIQF

SEQ ID NO: 225023 - protein, 137 aa, Glycine max
  Coding DNA Sequence Number=SeqID_108245
MASSSASGLKDLLSPQADSNSMAITKPIMKPFQKLEELEIIRMNYERYLEIKVGKKEMKDNKNNEFTPGKCFPPPISCLKKVKVGKPFKYLAYDKESETYVVEEIKIPEGSLFHATREDERLKLFANFLDEEESQEK

SEQ ID NO: 225024 - protein, 217 aa, Glycine max
  Coding DNA Sequence Number=SeqID_108246
  Homolog annotation: Hit_ID=Q1SH05; Match level="QueryCoverage=36%, HitCoverage=39%, E-value=1e-22, Identity=69%"; Hit description =Adenylate cyclase
MEVEVKMRLANANAHRYVTTLLSPFHVIIHHQQNLFFNGTASKLSVRRIVLWLRFYGYDECCVTSLKARAVLVNGTSKVTMELVEDCKGHGRVKGKSLIAAEWRRRRVERRRHFKEKMSLEEAHHHRKERKRRAQNLVGDDGELIKVDKEALLPRETSSSFWNGFIIGLVIGIEFEFAWGLKRFLRPKALLEAIARSFKEKSSTRRSEVIRKINLKT

SEQ ID NO: 225025 - protein, 87 aa, Glycine max
  Coding DNA Sequence Number=SeqID_108247
  Subcellular localization annotation: CTP_CleavageSite=45; ConfidenceScore=5.26e-01
MSHLIRACVSTSSSTSKLVPNDVVYCCCNILSVSSSSHTFKGGVVEAAGGEGASYCNGTSNAAAFKGGSVEDTVAAFFQSLLLLIQF

SEQ ID NO: 225026 - protein, 91 aa, Glycine max
  Coding DNA Sequence Number=SeqID_108248
RLKADLVLLKERALSIPSWPAPVLSYSIRKLMILEQVTSISNPPEVMLNRKVIKKCHSTIAIDRTFTIALPEWNGSSLLSPNPCAFKNKPI

SEQ ID NO: 225027 - protein, 171 aa, Glycine max
  Coding DNA Sequence Number=SeqID_108249
MSELLKNVLQLSPKVDLCHQAYDDDDYEGSFCDNPLLENTSNESNLASIDSHRKCFPFWFARVGNRQKIVILVTLLVFIIVVAFAVVIWIGLGKNPIDSEVAAQPRSWSDEVEEVRSMSKKGASMEEGVGLQCQRVEVNVKERSKVNKHARVQTKEQAESEGSNKGASRKV

SEQ ID NO: 225028 - protein, 132 aa, Glycine max
  Coding DNA Sequence Number=SeqID_108250
  Subcellular localization annotation: CTP_CleavageSite=50; ConfidenceScore=5.60e-01
MATPPNSPPPPPPSAASQSPSTSKRIGNTTPLRSLATRLVGAESPLVHVDLATGKADGPHSKKLRTYLGIVAHDKVYVTYENWKQVSTAHKDLIWEDIQLTRKVSTTLYAKSTTLARRNEPNFVRAAENLCG

SEQ ID NO: 225029 - protein, 104 aa, Glycine max
  Coding DNA Sequence Number=SeqID_108251
DGVLDHRDGAIRGTPDVTVSGLAVAEDVSVHEEIVENEITVKNVNEFDDDDWNSGTNKLDKGERRWWMALQGAVYGFCMLEPFGMGNGLDRGCCVILLCSLYSM

SEQ ID NO: 225030 - protein, 62 aa, Glycine max
  Coding DNA Sequence Number=SeqID_108252
  Homolog annotation: Hit_ID=Q1SKL1; Match level="QueryCoverage=79%, HitCoverage=15%, E-value=3e-12, Identity=74%"; Hit description=Plant nuclear matrix 1
MEAERIPRSRFKTVNADSHSEIIRVTDEGPSDVSEEPKASAAYISPISLKFKGVLAIHSLTG

SEQ ID NO: 225031 - protein, 145 aa, Glycine max
  Coding DNA Sequence Number=SeqID_108253
  Homolog annotation: Hit_ID=Q1SKL1; Match level="QueryCoverage=68%, HitCoverage=31%, E-value=2e-48, Identity=94%"; Hit description=Plant nuclear matrix 1
  Pfam annotation: Domain name=Plant_NMP1; Domain location=1-145; Score= -28.1; E_value=3.9e-05; Accession=PF06694.2; Description=Plant nuclear matrix protein 1 (NMP1)
MVMYWKLLFNNLFSANITLPDVSELELKFSEQSKILLNLQQKVDDLASKHAYNPDEEYTEVESQLRAHLESFLETARTFNLIYTKEIRPWTHMMEVPQLHGFGPAANRLLEAYKMLLKRYLFTNIELLLLVLADHPYFNMLAVHA

SEQ ID NO: 225032 - protein, 60 aa, Glycine max
  Coding DNA Sequence Number=SeqID_108254
  Homolog annotation: Hit_ID=Q1SKL1; Match level="QueryCoverage=83%, HitCoverage=16%, E-value=3e-19, Identity=90%"; Hit description=Plant nuclear matrix 1
LLGDKSPFSQQNIQGDGLDRDEETGRIQYLAEIAKFLGITTTVDTDAIQLYPSVSIVHTF

SEQ ID NO: 225033 - protein, 83 aa, Glycine max
  Coding DNA Sequence Number=SeqID_108255
NLNEAELKLSLTRGIYGLSFGFKKSRPKSNCRGNPIDTLPSAPALEQEQPIVQDPPAAPVLDLNEHAEDHPQEDWQDLYLFAF

SEQ ID NO: 225034 - protein, 194 aa, Glycine max
  Coding DNA Sequence Number=SeqID_108256
MKPETSLKIKEEVKKQFDAGFLAVTRYPEWVANIVPVPKKDGKVLEFYANAWPTKEGVRDMRSWECEFSQRRNKANGFDEEAIAQLLCTPGQYFTRTAAGSNILPSDHNSNLPLPKCQLVYAILTRMSVHVAQLIVDAIYLFAGMPPTRHPLDLDKSNRALGFPTLIMVLYQSFGVLVTSSKVIQPPITRAFIE

SEQ ID NO: 225035 - protein, 154 aa, Glycine max
  Coding DNA Sequence Number=SeqID_108257
  Gene Ontology: Mol. function=nucleic acid binding
  Homolog annotation: Hit_ID=Q9M406; Match level="QueryCoverage=28%, HitCoverage=15%, E-value=7e-17, Identity=88%"; Hit description=Alpha- tubulin 4
MAKCDPRHGKYMACCLMYRGDVVPKDVNTVVATIKTKRTVTFKDAEAVKKACEDSTTLTINGRRANCNLAFLGAHRPRSSSNVSPPPPQPQGRSNGGIVKNVNNASGPPPAINHVQPYHYPVRTTALPFHNHTLPFYGYAPTYIVTDVNFNYNQ

SEQ ID NO: 225036 - protein, 92 aa, Glycine max
  Coding DNA Sequence Number=SeqID_108258
MANIISPTKVLVRRPCPKELQPTSSIKSEKYGKDWEFLTRFCVSLSTKTSSEVCIFLVLAATRVVAACSFISDTDSAVFVLPLFLKATTDNT

SEQ ID NO: 225037 - protein, 69 aa, Glycine max
  Coding DNA Sequence Number=SeqID_108259
VMLGALALLLVHPTIFGNSIITPVSSSSFIKLVLLVEVKVLPVGGGGCSGWFVIGGTPATRVGVAGFPE

SEQ ID NO: 225038 - protein, 64 aa, Glycine max
  Coding DNA Sequence Number=SeqID_108260
  Homolog annotation: Hit_ID=Q9FLU4; Match level="QueryCoverage=97%, HitCoverage=36%, E-value=2e-17, Identity=70%"; Hit description =Arabidopsis thaliana genomic DNA, chromosome 5, TAC clone:K18P6
MSSSNKQTWVWAHKSKGQEEKTSRRPAIQETKNNSPGLRCGDQEAHMCMVSNRLHVTYKCNKEA

SEQ ID NO: 225039 - protein, 192 aa, Glycine max
  Coding DNA Sequence Number=SeqID_108261
MEYHTEWINIWKNKYSDVLAGQWVEGIVIHTPAYMEWYRKNTTLFLSVAQQLHDPRTTITHNVVGPGVEQIDFQIPHPQSMYSTPSPVHQTFGHTGESITATTHEWLTDLFGVDFNTPNSAASYLATLQQFDAPHSFGEQGQSSSAATTNIENTNIEQQHHHDVGEPVILERRNSRCNRHPPPCGTGHRLGH

SEQ ID NO: 225040 - protein, 135 aa, Glycine max
  Coding DNA Sequence Number=SeqID_108262
MVVVEAIMVLVLVVVAVKAATIMVIAAVADHDGDCNNIHDNCSGNDYDSDAQLGKIQLHKTSPKLVQQPGNNNTRSIVVSYSRNNPSNNVPPPNITQPPNVPRNNAPNVPLPNTRSTRVLRPIENIMPPNVPNNF

SEQ ID NO: 225041 - protein, 113 aa, Glycine max
  Coding DNA Sequence Number=SeqID_108263
MDPGVQIPTPSEGYMHAVTFIGLHVLTFRGLDVLTFRGLHVLAFRGLHTLTFSGLDALTFKGANYASTIRGGGYRAATVHTEARFHPYYCKETSVDHAHQHGHSYTDIDDVAT

SEQ ID NO: 225042 - protein, 121 aa, Glycine max
  Coding DNA Sequence Number=SeqID_108264
  Gene Ontology: Mol. function=protein kinase activity; Biological process=protein amino acid phosphorylation
  Homolog annotation: Hit_ID=Q2QZ78; Match level="QueryCoverage=90%, HitCoverage=19%, E-value=1e-34, Identity=63%"; Hit description=AT hook motif-containing protein, putative
MVASSGIVSLLLPGGRTAHSKFKIPVPVFEDSTCNIHQGTQLAELLNQTNLIIWDEAPMAHKFCFEALDHSLRDIIKHNSKDNTIFGGKVMVFGGDFRKILPVIPRGSRNNSKLLSYLYTF

SEQ ID NO: 225043 - protein, 113 aa, Glycine max
  Coding DNA Sequence Number=SeqID_108265
  Subcellular localization annotation: CTP_CleavageSite=37; ConfidenceScore=5.22e-01
MSSVWVPTILPGAVLQHVLVACLTVVSSDVGGGGHCRCASDGRSSSSKPGSCFIFGTIWMLFPLITEEGTTRFGNAKPIQETVFVVLKMNHVSAGPFLLPAPTNVLAHPHHFG

SEQ ID NO: 225044 - protein, 234 aa, Glycine max
  Coding DNA Sequence Number=SeqID_108266
  Gene Ontology: Mol. function=helicase activity; Biological process =viral genome replication
  Homolog annotation: Hit_ID=Q9LTU4; Match level="QueryCoverage=97%, HitCoverage=17%, E-value=7e-49, Identity=45%"; Hit description =Helicase-like protein
  Pfam annotation: Domain name=DUF889; Domain location=126-234; Score= -34.1; E_value=3.5e-09; Accession=PF05970.5; Description=Eukaryotic protein of unknown function (DUF889)
MAESYEQRDIFNLIINNVNRQAGGMFFLYGYGGTGKTFMWKTLAYALCLIGDIVLTVASSGIALLLLPNGRTAYLKFVIPMPTLENSTCNIHQGTEQAELLKATKLVICDEAPMAHNVPFGGKVIVLGGYFRQILPFIPRGSRSNIVHAAINASYLWDYCTVLKLTKNMCLQSNLTITNAQEIKWFLQWLIDVGDGKLGKGDDGLYDKEIPSELLITNFSDPIEAIVSHTYPDI

SEQ ID NO: 225045 - protein, 74 aa, Glycine max
  Coding DNA Sequence Number=SeqID_108267
MKSVPDVFQKNGNLKLLLTKRVILFIEGVMTNNDGTTGQTVDEIKHYLDVIFEDDDDIDVLLSKPTVKESMFTS

SEQ ID NO: 225046 - protein, 184 aa, Glycine max
  Coding DNA Sequence Number=SeqID_108268
MIDEDGVFEARDTPEELNHVLGKRLAFRFKDLDIAKWISEISPVENFVKNDTIIQRIFAHVTDGENTIECVFYDEYVKVIIELVRDSNVSAPFLAIQHSRLHGCSALTHGETYVETVVNVNNILLDPSLPTMPNSGIRVKPDKAKIVGFMDNNPWWELQNSQQLVKYDDTRHYQTGLGVPLIPG

SEQ ID NO: 225047 - protein, 90 aa, Glycine max
  Coding DNA Sequence Number=SeqID_108269
  Gene Ontology: Mol. function=metal ion transporter activity; Cellular component=integral to membrane; Biological process=metal ion transport
  Homolog annotation: Hit_ID=Q1SX80; Match level="QueryCoverage=60%, HitCoverage=13%, E-value=6e-09, Identity=70%"; Hit description =Zinc/iron permease
MAGRGGEVVRWLRRASSGENHAGGEGLRHNKEVVVGAEEAIVFSDEWKGDSGHGSCSLGTTPTLRLHNTTLKNSFQLTEATDIGTVNIIL

SEQ ID NO: 225048 - protein, 184 aa, Glycine max
  Coding DNA Sequence Number=SeqID_108270
  Gene Ontology: Mol. function=helicase activity
  Homolog annotation: Hit_ID=Q2R1R7; Match level="QueryCoverage=56%, HitCoverage=6%, E-value=2e-22, Identity=46%"; Hit description=AT hook motif-containing protein, putative
MEKVRSNKTISAKSTYEGSSDYSTKNAGYVDLGDPSKTYAYCQAVMCMGRVQLPFLKNPPMLLQQLLSDQESRKSRNFQHNIRAYNMMFAFSSLGAKIDTSVLKGKGQAIYKTHGQSCHLIRSPLRMPGKPPKFAQLYIYDTKNEIQNKIGALSCDTVKWMAIYMKFFKHVQGKMYWIHIWCPS

SEQ ID NO: 225049 - protein, 47 aa, Glycine max
  Coding DNA Sequence Number=SeqID_108271
MAFGGLAAHPGELRLSHEVTGSSRILFRLSNMQLESRNEVERKQMGS

SEQ ID NO: 225050 - protein, 85 aa, Glycine max
  Coding DNA Sequence Number=SeqID_108272
MDAPDLNFQMQCGTYRIQYQGNSPKRVYTTPHLGNHAVFFEATQSCTVTPPGDQPMATRSSLPGDTPPSTKYILLQFILFPVSYE

SEQ ID NO: 225051 - protein, 129 aa, Glycine max
  Coding DNA Sequence Number=SeqID_108273
  Gene Ontology: Mol. function=zinc ion binding; Cellular component =mitochondrion; Biological process=DNA integration
  Subcellular localization annotation: CTP_CleavageSite=36; ConfidenceScore=5.46e-01
MVKAQPIASPMVSKCKFNKTRAYLFSDPTLYRPVVRALQYSTITRPELSFVVNKVCQFMANPLESHWTKGKRILKYLKGSLHHDLLLKAATPRIHIPIKAFCNAEWASNPDDCRSTSRDAIYFGLNLIS

SEQ ID NO: 225052 - protein, 181 aa, Glycine max
  Coding DNA Sequence Number=SeqID_108274
MRHIKHEGHAQTHGPEIYPKAHENPRAFSCISGSIFLESSIQCPCGVGLHQKGLKQGDPLAPFVFFYGGGGALWACEESRRGDSILVRDACCKNFWVIKGILRSFELVLKLFDMIYYASNMVRLIPTFVLVPMDKMRLIGGRMFWILMLIVTPRQITLEREKSRGCAGWVTFWKVFQKASE

SEQ ID NO: 225053 - protein, 126 aa, Glycine max
  Coding DNA Sequence Number=SeqID_108275
MGEDALQISSVKFDQGYQPNPSLTLHDPSNQGNIQTNNFEAKLHGESKVIQRCFDDNNDDKGDDKKLKDQSKNNSSESTTIQEFKIRIKKNSRTQEESLETRIKIQGSRSQESRSRFKNKEKTQSR

SEQ ID NO: 225054 - protein, 192 aa, Glycine max
  Coding DNA Sequence Number=SeqID_108276
  Homolog annotation: Hit_ID=Q9LI74; Match level="QueryCoverage=96%, HitCoverage=18%, E-value=6e-47, Identity=55%"; Hit description =Similarity to pherophorin
MANNTSELERLQNLVKELEDREVKLEGELLEYYGLKEQEADFVELQRQLKIKTVEIDMLKMTINSLQEEREKLQEELAHGASAKRELEAAKGKIKELQRQIQLEANQAKTQLLLLKQKVSGLVSKEEEAAKKDVEIGKKLKALNDLEVEVVELKRENKELQHEKQELTVKLNAAESRITELSNVTEVRVTIE

SEQ ID NO: 225055 - protein, 120 aa, Glycine max
  Coding DNA Sequence Number=SeqID_108277
MRQVVIGTKRLYTRYHLWRWRLPDGGLLFARSRYRSALSVLARLLRRRLDGYEMSAQCKGLQEEKKGLAGKVEGIAVERDELSKVIAYLEAWLKASKSKLEEFELQGPRRGMPTRGLKRS

SEQ ID NO: 225056 - protein, 133 aa, Glycine max
  Coding DNA Sequence Number=SeqID_108278
GGACHPARPGEQGCFLQKQQPSGGRIWKAQDAKYLKAANKGRMSSSNNPRTKLGYDSNDHSLWHKRIAHINMETFFAIRRELGLLDARGARAYEGRLGGNEKPNGHHDGGHVEHEEIMESNAAAVAATSAATE

SEQ ID NO: 225057 - protein, 174 aa, Glycine max
  Coding DNA Sequence Number=SeqID_108279
VAYNKDWKRKLVHCSKEDFLVLDWAESQHFVIVHDDNSRVASMPYFGVIEEIWELNYVKFIVYVFKCKWFDSNIGVRTDETSLCSSKGFDLGGYSGERWRPFKSDLTSMGGCLKEGAGHSKTKYCSSRVVSYRSTDTIVDPPSPIKRHMKWKMACTKKSGQMMSEVAKEIADRI

SEQ ID NO: 225058 - protein, 61 aa, Glycine max
  Coding DNA Sequence Number=SeqID_108280
MHFPPLGRRTREPRLTRPPKGRLRQLATPLGIVFEINETLGLNPGFWVMDLKRENKSSALH

SEQ ID NO: 225059 - protein, 133 aa, Glycine max
  Coding DNA Sequence Number=SeqID_108281
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=97%, HitCoverage=32%, E-value=1e-26, Identity=56%"; Hit description =Receptor protein kinase like protein
RKTQEEVEDWELEYWPHRIGFHEIDAATTGFSEENVVVVGGTRKGMMLTWEERIQVLKNVATGILYLHEGWEVKVLHRDIQANNVLLHKDMNARLGDFGLAHMHDHQGQVVNTTRVIGTLGYIAPEVIQRGTT

SEQ ID NO: 225060 - protein, 114 aa, Glycine max
  Coding DNA Sequence Number=SeqID_108282
MVQGQLHSAVDERLKAKGGYIIEEDPSIRPTMRQVVKILEVEIDSIESDEDNMEMSLLGKIRSATTWSRAECALPYSGYPSFDEVKMFSFNSRTTRSGSSTFPGSESEITSINM

SEQ ID NO: 225061 - protein, 383 aa, Glycine max
  Coding DNA Sequence Number=SeqID_108283
  Homolog annotation: Hit_ID=Q9FME3; Match level="QueryCoverage=49%, HitCoverage=55%, E-value=1e-37, Identity=50%"; Hit description =Arabidopsis thaliana genomic DNA, chromosome 5, P1 clone:MSL3
  Pfam annotation: Domain name=TCP; Domain location=33-252; Score =112.0; E_value=1.7e-30; Accession=PF03634.4; Description=TCP family transcription factor
  Subcellular localization annotation: CTP_CleavageSite=42; ConfidenceScore=5.17e-01
MASSREGRQAKQEGDTTNIDKFSQASSTSRQWSAFRNPRIVRVSRSFGGKDRHSKVCTIRGLRDRRIRLSVPTAIQLYDLQDKLGLSQPSKVIDWLLEATKFDIDKLPPLQFPQGFGQFQHPQTLLPFHDSSAASHQLSLGPFCDASSTFVRDGGIQNLMAKSRYWENIDSMSRLRGNKEAEKGKWIKTSEQENHDQDGVVGGYNSLQVSTQRLFPMRSSSTTTTTTHSLLPGLFNNSMPYNSYNSEPSSLSLSQFGSHGLFPTQQVDPNPSSGNNGVQFQSSFPLPSSGSQLFFGSSSATPSMFTTYAPFIAPSVDTDPRQFNHIQFLNSGSHILPHPPLIPSLHHSFNSHVRPFPEAPFSSKLLDSNSSNRSQENHKGSTS

SEQ ID NO: 225062 - protein, 129 aa, Glycine max
  Coding DNA Sequence Number=SeqID_108284
MERCYNEKEYKSNKTDLTLKLPPCGENVAEERGLRRSSSSSLVVGVANAAQWGPSLGRSCSLPTERQRRRVAALSPQVLAWVAASSAVNVNNTPSSLLKPKALPNSSQDSGLVMKSKERFIFEACMTEK

SEQ ID NO: 225063 - protein, 169 aa, Glycine max
  Coding DNA Sequence Number=SeqID_108285
  Gene Ontology: Mol. function=nucleic acid binding; Cellular component= intracellular; Biological process=transport
  Homolog annotation: Hit_ID=Q10JI3; Match level="QueryCoverage=70%, HitCoverage=42%, E-value=7e-20, Identity=41%"; Hit description =Expressed protein
  Pfam annotation: Domain name=DUF1675; Domain location=35-163; Score= -8.5; E_value=1e-06; Accession=PF07897.2; Description=Protein of unknown function (DUF1675)
MEQNITKAVSVLYHRFLCIAVNTLRGVSYNIPYIGPTHSAEGVASNIQTSTKQENDSMASQKTMAKGISPRPADTKPENPAKKHKLGNYCSLKGDVMEILRRMPSVTTTGDGPNGKRIEGFLYKYRSGQVCIVCVCHGNFLTPAEFVMHAGGKEVANPMKHITVLSNSF

SEQ ID NO: 225064 - protein, 727 aa, Glycine max
  Coding DNA Sequence Number=SeqID_108286
  Gene Ontology: Mol. function=protein binding; Cellular component=cell surface; Biological process=multicellular organismal development
  Homolog annotation: Hit_ID=Q4FX62; Match level="QueryCoverage=76%, HitCoverage=97%, E-value=1e-14, Identity=19%"; Hit description =Proteophosphoglycan 5
  Subcellular localization annotation: CTP_CleavageSite=10; ConfidenceScore=5.05e-01
MESISNSGSSVDMRTSPSTNSGEGEQFNKEKKQVASFSPFSSELKSQDHFDLMPNTTTTTTHPRPFGATSPTRDQTCSQSELHNTHLVAEKGGGRPIDSHVEAHSSNPFGEANPSPMENNTAPTNTKHVGASESEKEHDHTSESAFPADGMLGPHSSLAPSTNESSQGNPFKVPPTSETRKNTNVGEADLVKVDEQFDHGSESHHRLPSPEQGHWSVPSSEAWTHPTNTHGETHVPSSSQQLDPLFTLESAQNQQQADATSKNHAGATTIPTSVEPHHTFSVAGQGHQSKADSNSVTDNKSDSSVLSFSPASESSTQDHKHNSANAATNTHGETHVPSSSQQFDPWFTLESVQNQQEADATSKNHGGATTIPTSVELHHTFSVTEQGYHTKASSNSVTDNKSGSSVSSFSPSSESSTQDHMHNSAIAVTKAPQKRGKDVKFASEFSDDDIPISSYPKHGRQGSDGAGQYSSAGVAPGTSNGSEKQNPSLQVMESPDNPTISSNYRFPSHVFDRHKSKSNTQWSTASNESLFSIQMGNTSFSNDMAWMSKSGDMDRPGDMNSSGAFPPSNQPPFPPQSQPQPQSQPQPPVTKFNDISQCTAKQHEVSRVTEQKAAETMREVIMENSIKRDSVIKGDLIPDRGAAPSNKRSTSNAHSHQSDGSTKSFAFNVLADGDKPLSPKHGEEKRKQQKQPGQLNIRPTPDAAAQNPKSTPNASQNKSWFSCFSCC

SEQ ID NO: 225065 - protein, 116 aa, Glycine max
  Coding DNA Sequence Number=SeqID_108287
  Homolog annotation: Hit_ID=Q1RVB5; Match level="QueryCoverage=41%, HitCoverage=3%, E-value=5e-10, Identity=57%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MASNHLLDVNDLKSLFSKKFDTKDLGPTKKILGMKIHRDMKSRQLWLSHQGYVEKVLDSQQNDPSIVGYVDFDYVDDLDDKRSTIGKIQDATDMLTKATTTDKIQNCLNLLNVAQC

SEQ ID NO: 225066 - protein, 277 aa, Glycine max
  Coding DNA Sequence Number=SeqID_108288
TKERDANKGLEEELTMYMKEAMEQLEKRFQKAVRQAKFFTKDPNLGLFDPFKDVKNDVLLDEKEIVVKEEVVVEEQGAKGKQDLVYVEARLWWSCEIEKWMTQSHLRFDSNLIKVLVTHVMSGDRSSWPMELFSLDGYEKCPRPWTRVIVVAVTEWTKGGSPRVNLEFNELWVRDVFALHFEKPVKLRRGLPRTNLGFCEPVRLTKGGPWDSLRVNLGFCKPFGGSTKELFDLGFGSCALAYVSHTRDGDIVGAFEDDSCPASLYIRRTVNVEALPI

SEQ ID NO: 225067 - protein, 93 aa, Glycine max
  Coding DNA Sequence Number=SeqID_108289
  Subcellular localization annotation: CTP_CleavageSite=76; ConfidenceScore=5.22e-01
MNYPIKQVLRKPKLAGRMVACAKRSSGAKWALWAQHASTAKHSFSALSVTRESGRAQESRLRAKCKISSLSDMFVSCQAQRTIGAKPKSTYSC

SEQ ID NO: 225068 - protein, 209 aa, Glycine max
  Coding DNA Sequence Number=SeqID_108290
MDRFGHIAVQIQNLNPEVALHSMLLNLHPNKFTESLCKNTLVVWTSCANEPRDTSRWKKCLDSGTNEKEAPRPTHINRTKGLSQTRASLSPNSSSKRVTTSTVNRTTILEEAFNLEVSTKLPPTKPPRLGLDATKYYRDFKGINPINQDDHMVVSIIIANFMVSKVLIDQGSSNDILYWKTFQRLEVSPDTVHPHVGPLLGFAGERVET

SEQ ID NO: 225069 - protein, 491 aa, Glycine max
  Coding DNA Sequence Number=SeqID_108291
  Gene Ontology: Mol. function=monodehydroascorbate reductase (NADH) activity; Cellular component=peroxisomal membrane; Biological process=hydrogen peroxide catabolic process
  Homolog annotation: Hit_ID=Q9LK94; Match level="QueryCoverage=90%, HitCoverage=87%, E-value=1e-173, Identity=68%"; Hit description =Probable monodehydroascorbate reductase, cytoplasmic isoform 2
  Pfam annotation: Domain name=Pyr_redox; Domain location=153-272; Score=66.6; E_value=8e-17; Accession=PF00070.17; Description =Pyridine nucleotide-disulphide oxidor
  Pfam annotation: Domain name=Pyr_redox_2; Domain location=21-315; Score=74.0; E_value=4.9e-19; Accession=PF07992.4; Description =Pyridine nucleotide-disulphide oxidor
  Pfam module annotation: Pfam domain module=Pyr_redox::Pyr_redox_2; Domain location=153-272::21-315
MAILQDCVRAQEFNDPSKQQHISLRFCKYILEWVGREMIKIRKLNVTAARLPSFHTCVGANEERLTSKWYKEHGIELVLGTGVKSADVKRKTLLTTTGETISYKILIVATGARALKLEEFGVTGSDAGNVCYLRDIADANRLVDVMQSCPGGNAVVIGGGYIGMECAASLVINKINVTMVFPEEHCMGRLFTSKIANYYEEYYKSRGVNFIKGTVLSSFDFDSNGKPEKKTFYKGKEKWEVDCVRNLLKHVTAVNLRDGSTLSVDMVVVGIGIRPNTGLFEGQLTLEKGGIKVNGMLQSSNSSVYAIGDVAAFPVKAVGETRRLEHVDSARKSARHVVSAIMEPNKTREFDYLPFFYSRIFTLSWQFYGDNVGEVVYYGDMSGSTFGAYWVSKDHLVGAFLEGGTKEEYEAIAKATRLRPVIEDLTELERQGLRFAVTVSEKPMASPPIEVRASDLLLEKPLYAWHATAGVIIAASIAGFAYFYGKKRHRW

SEQ ID NO: 225070 - protein, 169 aa, Glycine max
  Coding DNA Sequence Number=SeqID_108292
  Subcellular localization annotation: CTP_CleavageSite=19; ConfidenceScore=5.26e-01
MRVSKLSMDLGGSPPYRVNVAPLKGIGKTRHRVTSSLVYRLSGFQPKGMSISILWTTKGCPRVVCLAGRWMCERLQSSGVLISICVCHGFWWRIGAFEKGLRLHTSALRIAFVKRTRGGDLQNDGLQCSSKYELGECAKIYKIRKRVYIVCSRCNCIGVVALYWCVLRV

SEQ ID NO: 225071 - protein, 101 aa, Glycine max
  Coding DNA Sequence Number=SeqID_108293
MAEVHWPIMPYASSTEQGGPSLSKDQFEEPIIGLNPPHRLGQGFMAAVAYNGGGGGGSLSFLQRFCHLRNEEDMMIGSLRELGRCQESERNEGYAKKSEKM

SEQ ID NO: 225072 - protein, 99 aa, Glycine max
  Coding DNA Sequence Number=SeqID_108294
  Gene Ontology: Mol. function=nucleic acid binding; Biological process= DNA integration
  Homolog annotation: Hit_ID=Q1S9I4; Match level="QueryCoverage=99%, HitCoverage=12%, E-value=7e-09, Identity=33%"; Hit description =Integrase, catalytic region; Zinc finger, CCHC-type
MNPNELLQDMQKRFTHIVNHLASLGKIFPNEDLINKVLRCLSREWQPKEHEMELMRLNQHEENDKKKKGIALKASSSIQEGSDKEDSNEIDDDLSLFVK

SEQ ID NO: 225073 - protein, 82 aa, Glycine max
  Coding DNA Sequence Number=SeqID_108295
MLQCEGYFSYLRHDIEIPNGESARKWVANMLFKFHDDPTVNESEIVLFLRQVWWPAKKKRGFWEEKEKNENERKKRHHQCEN

SEQ ID NO: 225074 - protein, 112 aa, Glycine max
  Coding DNA Sequence Number=SeqID_108296
MEVTILQKLGPQMNRVTSLLHLLPNTFRTVDVLVTSSFTLTKMSWTIKEHALCPYRTCARARVMGEVKEAHEQMKADMEAMKEQIATMVEAMMSMKRYGSQYGCSCRYQRCC

SEQ ID NO: 225075 - protein, 61 aa, Glycine max
  Coding DNA Sequence Number=SeqID_108297
MDSWPSHLCKKLLHTHSWLLARALQSLYDDDLASVRWESLRSLRLAFPWPSLNVTVGSSRF

SEQ ID NO: 225076 - protein, 193 aa, Glycine max
  Coding DNA Sequence Number=SeqID_108298
  Gene Ontology: Mol. function=transporter activity; Cellular component= integral to membrane; Biological process=auxin mediated signaling pathway
  Homolog annotation: Hit_ID=Q673E8; Match level="QueryCoverage=99%, HitCoverage=35%, E-value=2e-51, Identity=61%"; Hit description =Putative auxin efflux carrier protein 6
YTLLLFLFEYRAATLLIQRQFPGPTAASIAKFDVDGDVISLDGHDMPLRTESETDDHGRIHVRIRRSVSSAPETNSSIGGNTTVVTPRQSNLSNADIFSINTPLHLHEGGGNLAAGASPHLSGYASSDAYSLQPTPRASNFNEMEAGTPVWGRSPVAAGRVCRQSSPVARVLWESPGKCLGDKRQGCKDITMS

SEQ ID NO: 225077 - protein, 144 aa, Glycine max
  Coding DNA Sequence Number=SeqID_108299
  Gene Ontology: Mol. function=transporter activity; Cellular component= integral to membrane; Biological process=auxin mediated signaling pathway
  Homolog annotation: Hit_ID=Q673E8; Match level="QueryCoverage=99%, HitCoverage=27%, E-value=4e-59, Identity=77%"; Hit description =Putative auxin efflux carrier protein 6
  Pfam annotation: Domain name=Mem_trans; Domain location=9-144; Score=- 45.3; E_value=1.6e-05; Accession=PF03547.8; Description=Membrane transport protein
MITGEDLYKVMCAMVPLYFAMLVAYGSVKWCKMFTPDQCSGINRFVAVFAVPILSFHFISMNNPYEMDAKFIVADTLSKLAVLLFLSLWAVFFAGGSLDWLITFFSLATLPNTLVMGIPLLQAMYGDFTQSLMVQLVVLQCTIW

SEQ ID NO: 225078 - protein, 334 aa, Glycine max
  Coding DNA Sequence Number=SeqID_108300
  Gene Ontology: Mol. function=zinc ion binding
  Homolog annotation: Hit_ID=Q1S296; Match level="QueryCoverage=25%, HitCoverage=12%, E-value=4e-11, Identity=41%"; Hit description=Zinc finger, C3HC4 type (RING finger), putative
  Pfam annotation: Domain name=zf-C3HC4; Domain location=263-304; Score= 32.0; E_value=2.1e-06; Accession=PF00097.15; Description=Zinc finger, C3HC4 type (RING finger)
MNRQGDSDGQTNTNNRSNNENQTMPLSPFETLELLPLFPLTPENAGQVEDMPGADDMAPLLGQESTMFRQVGTSVGTPSFNLPQRLNHLEPRQLVSGYEDDNGNEAVVYHLLNDQAGLSTLRASQSQRLNYSGGASSSRTHNYHNQVQVLESGVPPYVQHGPSLSPLPSYPSAEERRRLSSYVQSTLEALRSGPSAVMFDIDFDTMEFRSIDHALVSPYGFQNPEEFDALPQGLTVETIVQHLESETYVIVNKDAPEEDKEKCPICLEEFEEGNLIGKLHSCIHKYHRHCIRQWLLCRNFCPVCKRVGLETNNNVKSEATAAEININENDNDNV

SEQ ID NO: 225079 - protein, 91 aa, Glycine max
  Coding DNA Sequence Number=SeqID_108301
  Subcellular localization annotation: CTP_CleavageSite=50; ConfidenceScore=5.55e-01
MLTREPYFARALFFDLHLSSSSSSPSKVSSSPSKLLLLRRVRDRVNLPPYVGLFGELVLIARTLFVFAARTLPRYVSVCSPFRVLSHAHRV

SEQ ID NO: 225080 - protein, 109 aa, Glycine max
  Coding DNA Sequence Number=SeqID_108302
MSATPSMKPQKRKDGALKKREGGEKSSLHVVSSVREHWGRHSRGRLGETKCKIAVCTVLATRVNSALEDFKIEYGPVSLLLSATMASSLLKARALHPRRVETPTVHHRH

SEQ ID NO: 225081 - protein, 194 aa, Glycine max
  Coding DNA Sequence Number=SeqID_108303
  Homolog annotation: Hit_ID=Q1S8C2; Match level="QueryCoverage=32%, HitCoverage=11%, E-value=1e-08, Identity=50%"; Hit description =Armadillo
  Subcellular localization annotation: CTP_CleavageSite=24; ConfidenceScore=5.08e-01
AKTSIGAKQGRGVITANTGTCVKRAKHAKREHACPSPLQKSLTTAVFVLTTIISLTSLFLLYIKHCNVGNIDDSDEVAFTGASGLRRTLMRAKLEELQNDLITIENYDFGESLSLLQLSMAECHNLCPRCMDMFYNEKLLMHSDLDMATSQKSKINVGDVRLESQPFVDVKLLLSAMTMPSLLTEVGIQGHIQF

SEQ ID NO: 225082 - protein, 227 aa, Glycine max
  Coding DNA Sequence Number=SeqID_108304
MIRQHGHGGLKLNANLSRHMREMKTEKRPITKVRNREGMNKSRARADDQEINRNNDIPSIEGGSLANHSKQQWSKLRSYANVLTTKTKSMGKRGNQRQKQQTSIISHSTMQLNIPVEQMNRFNNTWVGKLRKLDIFDKLEEELMWEAGQEIRPTYMGDDMVLLVGLTDSQVQHMCINEDENGMSLFHSLEKWNPDSSCWTKLDQNRIKTNIQQLDYRTLIPHDNMIN

SEQ ID NO: 225083 - protein, 179 aa, Glycine max
  Coding DNA Sequence Number=SeqID_108305
  Gene Ontology: Mol. function=transition metal ion binding
MGIREQLHSISQGRSVCVGPFFYSGCIWLNEASIVERYVAEEAIEFCSESMKTTKAVGLPQSHHDCRHRGRGTREYNVLTMGQLEVSQAHLYILNNTEEWVNENIGVRQDELGFTLVDLRKVDYKDNPFIMAEQARQVFYIQDPCDLTCSVVLQGRTSGIIHHNDASNLDIGDTHAFSP

SEQ ID NO: 225084 - protein, 129 aa, Glycine max
  Coding DNA Sequence Number=SeqID_108306
  Homolog annotation: Hit_ID=Q9LJR0; Match level="QueryCoverage=83%, HitCoverage=94%, E-value=3e-25, Identity=44%"; Hit description =Arabidopsis thaliana genomic DNA, chromosome 3, TAC clone: K7L4
MVSSIYTFMCVLHSIIALTCGALMIFYSKEISVLGHRSETASKLQGTTPYDQLLIDTSDSFSGLVWMLHISIAVWRFFFERKLGDLAHEWPRHAVGDIALAISWVFFLVNNMAQIGLVNAQILDINGEP

SEQ ID NO: 225085 - protein, 241 aa, Glycine max
  Coding DNA Sequence Number=SeqID_108307
  Gene Ontology: Mol. function=sulfate porter activity; Cellular component=integral to membrane; Biological process=sulfate transport
  Homolog annotation: Hit_ID=Q5VQ79; Match level="QueryCoverage=76%, HitCoverage=29%, E-value=1e-37, Identity=51%"; Hit description =Putative sulfate transporter Sultr3;4
FARIQHDAAKLRTSKDLEADIPCAASTLLQYYRAIGYPAVVASCVDVTTGKSFYGPDDPYAMFVNKDTSKALAKMSKNDDDISPSLDGLSDKEIGVLNDWENKFQAKYIVIARGISYANLANLPAILGLCDSMDLVVGPVSIASLVLGSMLTEEVSPSEQPDPFLQLALTSTFFAGILQAALGILRLGFIIDFLSKAILIGFMAGSAIIVALQQLKGLLGINQTFHQKDGPGSSFEICFSK

SEQ ID NO: 225086 - protein, 164 aa, Glycine max
  Coding DNA Sequence Number=SeqID_108308
  Homolog annotation: Hit_ID=Q9LJR0; Match level="QueryCoverage=70%, HitCoverage=80%, E-value=2e-17, Identity=46%"; Hit description =Arabidopsis thaliana genomic DNA, chromosome 3, TAC clone: K7L4
MQSNISFNPKNAIHVQDPQASSQRRISTLQWKCEASTPLGKETLKVYVLNKSNHQEKESYCEQQQAREGIRGVNQKLIIGCCPLKLACGLGSVAKHRDLFGVEYHQSSTSKSYYGMKNTHKGIYRRNHLSEFTSKAFNCFLTFNSMEPLPSKPTMVVEIPITSF

SEQ ID NO: 225087 - protein, 85 aa, Glycine max
  Coding DNA Sequence Number=SeqID_108309
  Gene Ontology: Mol. function=sugar porter activity
  Homolog annotation: Hit_ID=Q6ZCE6; Match level="QueryCoverage=69%, HitCoverage=17%, E-value=6e-11, Identity=58%"; Hit description =Putative integral membrane protein
MTAKGIDKDDGEGEECRTGRARLATEGDVGEGDKERGKGWEDDEDVDVGVAEEIGVGEDGEVENECGGEEFFGSGEGKGISVKKS

SEQ ID NO: 225088 - protein, 120 aa, Glycine max
  Coding DNA Sequence Number=SeqID_108310
  Subcellular localization annotation: CTP_CleavageSite=65; ConfidenceScore=5.52e-01
MISSGSDSAGGGYNIVHQSPPTTNSVQQLAQTQSQTKENRKVSPKKNILEVVTATERPTTRVRPRARVRVRPGMRARVRPTVIVSTVVQCRESEKGFVGVRLPEARGRRVVSEMSEVQET

SEQ ID NO: 225089 - protein, 248 aa, Glycine max
  Coding DNA Sequence Number=SeqID_108311
MNPQGDSDGQTNTNNKNEMMPHSLFETLELLPLFLLTPKNVGQVEDMPRADDMAPLLGQETTMFRQVGTLVGTPSFNLTQRLNHLELRQLVSGYVDDNVRVRNAQAVVYHLLNDQAGPSTLRPLESQRLNYSGGASSSRTQNYQNQVQVLGSGVPPYVRHGPSLSPLPSYPSAEERIRLSSYEMFEEGNQIGKLHSCINNHHHYIRQWLLYRNFCLVCKRVGLETNNNVKSEATTTDVNINENDNDNA

SEQ ID NO: 225090 - protein, 301 aa, Glycine max
  Coding DNA Sequence Number=SeqID_108312
  Gene Ontology: Mol. function=transcription regulator activity; Cellular component=nucleus; Biological process=regulation of transcription
  Homolog annotation: Hit_ID=Q1SHA2; Match level="QueryCoverage=79%, HitCoverage=72%, E-value=9e-51, Identity=51%"; Hit description=Helix- loop-helix DNA-binding
  Pfam annotation: Domain name=HLH; Domain location=97-146; Score=59.3; E_value=1.2e-14; Accession=PF00010.16; Description=Helix-loop-helix DNA-binding domain
MSSSTQDEISFVLRQFLLRSSVTTHESNDDARNSMSKTALPDGISAYKGSSAANVSSLSVAASENETDDFDCESEEEEVPTPPKSIRSRSSSKRNRAAEVHNLSEKRRRSRINEKLKALQNLIPNSNKTDKASMLDEAIEYLKQLHLKVQMLSMRNGLSLHTMFFQEGLQPLQLSQVPRMDSGEESRLIPSNPTASLPMHQENPMHYLSNLPNKLAMADQQSVPTPSYIINSETSFRLESPIPENIRSFQLRRFPEEHIVIFVVCGLLGRSDEFYGKLITMGVDTGNKYWGLELRVEIRNN

SEQ ID NO: 225091 - protein, 155 aa, Glycine max
  Coding DNA Sequence Number=SeqID_108313
MDFSELIERVNGKLSAWNVRLINKPGWVYPKYICGFVDKTIRSFIWRGSKGKGLYKALKVLGNNFKLKVGNGEKDLWDVWEGNGWNLVKLYTMLPSDIAQAIMSTQQGTHTNGVMVKRGRLGLQALGAGYENYIFMLTFNFSYGKCFILLSQSRV

SEQ ID NO: 225092 - protein, 214 aa, Glycine max
  Coding DNA Sequence Number=SeqID_108314
  Gene Ontology: Mol. function=protein binding; Cellular component =integral to membrane; Biological process=defense response to fungus
  Homolog annotation: Hit_ID=Q1T2W5; Match level="QueryCoverage=99%, HitCoverage=42%, E-value=5e-37, Identity=37%"; Hit description =Leucine-rich repeat
  Pfam annotation: Domain name=LRR_1; Domain location=105-128; Score =10.5; E_value=3.1; Accession=PF00560.23; Description=Leucine Rich Repeat
  Pfam annotation: Domain name=LRR_1; Domain location=129-151; Score =2.9; E_value=81; Accession=PF00560.23; Description=Leucine Rich Repeat
  Pfam annotation: Domain name=LRR_1; Domain location=153-176; Score =15.4; E_value=0.2; Accession=PF00560.23; Description=Leucine Rich Repeat
  Pfam annotation: Domain name=LRR_1; Domain location=178-200; Score =2.2; E_value=1.1e+02; Accession=PF00560.23; Description=Leucine Rich Repeat
  Pfam annotation: Domain name=LRR_1; Domain location=27-49; Score =14.4; E_value=0.41; Accession=PF00560.23; Description=Leucine Rich Repeat
  Pfam annotation: Domain name=LRR_1; Domain location=3-25; Score=16.5; E_value=0.094; Accession=PF00560.23; Description=Leucine Rich Repeat
  Pfam annotation: Domain name=LRR_1; Domain location=56-78; Score=5.6; E_value=25; Accession=PF00560.23; Description=Leucine Rich Repeat
  Pfam annotation: Domain name=LRR_1; Domain location=80-103; Score =13.6; E_value=0.71; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=105-128::129-151::153- 176::178-200::27-49::3-25::56-78::80-103
MNSLEVLYLWGNELQGEIPSFFGNMCALQSLDLSNNKLNGEISSFFQNSSWCNRYIFKGLDLSYNRLTGMLPKSIGLLSELEDLNLAGNSLEGDVNESHLSNFSKLQSLDLSENSLSLKLVPSWVPPFQLKYLGIRSSKLGPTFPSWLKTQSSLYELDISDNGINDSVPDWFWNNLQYMRDLNMSFNYLIGVIPNISVKLPMRPSIILNSNQFE

SEQ ID NO: 225093 - protein, 413 aa, Glycine max
  Coding DNA Sequence Number=SeqID_108315
MALRSANMHSSCFFQILPRAQPRSVALSGWLAKPTGWLSERGTQSPRNYLIKDYQSLLSCGDNHGHPLSMPSRDNQVCWHAETIMVIRFLCLLETVKSVGIWRQSWSSTPFAFQRQSSPLACGDNHGHPHRLPSRDNQVRWHAETIMVIRFRCFQDYYSLFCLPETIKSVGMRRQSWSSTFIVFKTITIFCAFQRKSSPLACGDNHGHPLLLFSRLLPSSKPSRDNRVRWHLETIKSVGIQRQSSLLAFRRRQCLQKATMPSFTFRRRQCLQKATMPSFTFRRRQCLQKATMPSFTFSKTTMSSAIYAFKRRQCLHLHFEHDNVYDLFMLSKGDNAFVYAFEDDNVFISKTSMSFVLVLLRTQRFIAWTSASGRLDACLGELSSPGQGRLLQEEVGSSPGRAAMQPPPLICYK

SEQ ID NO: 225094 - protein, 125 aa, Glycine max
  Coding DNA Sequence Number=SeqID_108316
MEIMKDQMATMMEAMMSMKKMMEGSAAAIATEGGEALGSTGSPHFVQVQNKHSFPLYGLPPNYTPPNVAHTPEENVNNSAPMPIEGQQPQSDHAHVSQPMGGTHEVPQDRTLADFKPPLGCATEG

SEQ ID NO: 225095 - protein, 166 aa, Glycine max
  Coding DNA Sequence Number=SeqID_108317
  Subcellular localization annotation: CTP_CleavageSite=54; ConfidenceScore=5.10e-01
MGLHCYQASQRPSMTTDRPPFLWLHRPSKSLVESPTVAIYPSVRVRKGHNRLAKAFVSKEENKRSRQQHLFEENGVAPAPTYPQIYFNCEQKSFKALDLETMFHFLKSGESYLRRWTLKRLSQRALLRASEGEAHGCAFQRRKDARSRHQRLFVENVGKTEGNRSK

SEQ ID NO: 225096 - protein, 145 aa, Glycine max
  Coding DNA Sequence Number=SeqID_108318
MEKFDHIEERLRAIEGGRDYAFADMEELCLVPGMFIPQKFKESLAGAAITWYTNLESSRVRSWKNLMVAFIRDLAAQIVPPMTEKEMITMIVDTLPVFYYEKLMGYTPSSFADLIFTSERIEVGLRRGKFDYPALMNRKPGIKRE

SEQ ID NO: 225097 - protein, 67 aa, Glycine max
  Coding DNA Sequence Number=SeqID_108319
MRQEAATLEKTPQVTANPPSPVVDLSYPQQAADPSTPVLEMPEDPATPVLRLTTTPPVTHYECPEAY

SEQ ID NO: 225098 - protein, 185 aa, Glycine max
  Coding DNA Sequence Number=SeqID_108320
AELEKVQAVKEKFKSTAIKVRKEYDELKNINIATAEALERETKRARKEEHGRNKFRGALWGNNSELKLRRDERDQSRVEGMILKDELKAYLRSKRSLSQQLRETKGNMLAIIDKYKEELNLAAAHEQRLGDEYAKVSPEKEARERVIDSLHKEAMMWMDRFAFTLNGSQELPQLLAKVKAMADVY

SEQ ID NO: 225099 - protein, 123 aa, Glycine max
  Coding DNA Sequence Number=SeqID_108321
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=30%, E-value=6e-47, Identity=62%"; Hit description =Photosystem II P680 chlorophyll A apoprotein
  Pfam annotation: Domain name=PSII; Domain location=1-123; Score= -201.4; E_value=0.1; Accession=PF00421.9; Description=Photosystem II protein
MALYELAVFDPSDPVLDPMWRQGMFVIPFMTRLGITNSWGGWNITGGTITNPGIWSYEGVAGAHIVFSGLCFLAAIWHWGWLVLGFGAFHVTGLYGPGIWVSDPYGLTGRIQSVNPAWGVEGF

SEQ ID NO: 225100 - protein, 63 aa, Glycine max
  Coding DNA Sequence Number=SeqID_108322
MGFSGSTQHSIKVHNVEWCIAKEVVRLTTVTRWSRDLGMAKGRGNQKNVVVFWLGLVSVGSCD

SEQ ID NO: 225101 - protein, 113 aa, Glycine max
  Coding DNA Sequence Number=SeqID_108323
  Gene Ontology: Mol. function=DNA binding; Cellular component=nucleus; Biological process=regulation of transcription
  Homolog annotation: Hit_ID=Q1RUM7; Match level="QueryCoverage=88%, HitCoverage=41%, E-value=5e-30, Identity=63%"; Hit description =Homeodomain-related
MDVKKGGSLVQMQVKLQKHNEKEMGMRKGPWAVGEDTILFNYIATHGGGLRRSGKSYRLRWLNYLRPDVWHGNVTLQEQILILDFHCRRGNMWSNMSTAARKNRQQNKELLEN

SEQ ID NO: 225102 - protein, 232 aa, Glycine max
  Coding DNA Sequence Number=SeqID_108324
  Gene Ontology: Cellular component=integral to membrane; Biological process=defense response to bacterium
  Homolog annotation: Hit_ID=Q8RZQ8; Match level="QueryCoverage=83%, HitCoverage=77%, E-value=5e-71, Identity=64%"; Hit description =Putative MtN3
  Pfam annotation: Domain name=MtN3_slv; Domain location=112-198; Score= 120.2; E_value=5.8e-33; Accession=PF03083.6; Description=MtN3saliva family
  Pfam annotation: Domain name=MtN3_slv; Domain location=6-95; Score =74.6; E_value=3.2e-19; Accession=PF03083.6; Description=MtN3saliva family
  Pfam module annotation: Pfam domain module=MtN3_slv::MtN3_slv; Domain location=112-198::6-95
  Subcellular localization annotation: CTP_CleavageSite=35; ConfidenceScore=5.06e-01
MDVAHFIFGIFGNASGLFLFLAPIVTFWRIVSNKSTEKFSGVPYPMTLLNCLLSAWYGLPFVSPNNLLVTIINGTGAGIEIIYVFIFIYFAPKKEKTKIIGLFSFVGNARKLFCGFAAAIFSIVMYGSPLSIMRLVIKTKSVEFMPFFLSLFVFLCGTSWFIYGLLGRDPFVAVPNGVGSALGTAQLILYFIYRDNKSDPKKIPRTEEEAMEMGTANKNPISNSNGIQEGRV

SEQ ID NO: 225103 - protein, 193 aa, Glycine max
  Coding DNA Sequence Number=SeqID_108325
MTMRKEEVGIHDSFLHSVKVQQSLLIFGHRGERKKDIVWKVQDIMYCTTTTSDYQEPHHLSQTQNDPYHPQPRPLPSNYLGAPKLPHLPDPPRAVCVTTTDHHHQPSMDLEQKHHNLNSRLVPSLSDFPCAMTAESKSHRYSFICFVLYRDSLLLNSPGESELRSRNPTRKKRLGREEKHMLDEAGEGVPNQR

SEQ ID NO: 225104 - protein, 96 aa, Glycine max
  Coding DNA Sequence Number=SeqID_108326
  Subcellular localization annotation: CTP_CleavageSite=75; ConfidenceScore=5.14e-01
MTLMTLTRLTGPFLDLVKCHGGSILRFHLKGFRCCTNGSFKGVLFINKLGQARRSSPISQPLSRTTLQIRLPLSRNSTRSSPSLLTTSKPLPSETG

SEQ ID NO: 225105 - protein, 98 aa, Glycine max
  Coding DNA Sequence Number=SeqID_108327
MERNIKVLFPPPQPGPSEKISIIHQLRDVKRLIMKDDIIVELPYWPCSCCPPYFPSFIGNLRGCYGGVLEEIIHGPTMKNSVLPNPAVEFPPQRHNFW

SEQ ID NO: 225106 - protein, 336 aa, Glycine max
  Coding DNA Sequence Number=SeqID_108328
MDREQEEMQSLGLFGFLYEEASKITLSWRKILTQITLKLIIPLSFIFLIHIEVSNLFFSKIRSHTKEMHGTNPNPNLPQYVKLSDKISSELITVSTFQIAYFTFLLIISLLSTSSVAYTIASIYTPEDVTFKKVMNVVPMVWKRFMLAFLFALAFFFLYNFGSMIVICLWANTFGIMSGGGAIFDFIGVIYFIGLAHFTVVVQLTIMTDLHDSWETLAMEKNYKLIKEKVVFLIFTIFAQMVNLVSIMVSSSGKMPILKERRASSVNKTAILLSFLLVTCLFLFGFLLHAVIYFVCKSYYHENVDMPALPDNLEVYGGEYVQLEVNDVQQEQDFII

SEQ ID NO: 225107 - protein, 145 aa, Glycine max
  Coding DNA Sequence Number=SeqID_108329
  Homolog annotation: Hit_ID=Q1RW14; Match level="QueryCoverage=94%, HitCoverage=100%, E-value=9e-20, Identity=34%"; Hit description =Plant self-incompatibility S1
  Pfam annotation: Domain name=Self-incomp_S1; Domain location=33-138; Score=82.9; E_value=9.6e-22; Accession=PF05938.2; Description=Plant self-incompatibility protein S1
MLKPLVTIIVFLMVACAQDIYSLSDNTIFDGKKTVRVYNGMNDGILVYLHCRSKDNDLGQHVLAFAEFQKWSFNDNLFGTTLFWCTMNASNVHASFEVYRAKTEEYKCDTQCDRNLKKDGGYFFNQFYGYWEKRLSWHIPKTPSF

SEQ ID NO: 225108 - protein, 149 aa, Glycine max
  Coding DNA Sequence Number=SeqID_108330
MTTKVLFAILYIIEFVYVTVVWQISSVAAALEDYHGFITPEVSLYKSQKSKELIKGKKMVLIFVNILAFHTGGCSCIDIGFVPGDGGARMECESFGRSSIWGSMLLVIVLFVPFLSYHNENIDKSALADRLEGYANNGSPDVQLKQNQV

SEQ ID NO: 225109 - protein, 107 aa, Glycine max
  Coding DNA Sequence Number=SeqID_108331
MAEPSKKRKGTSSRSQRHSEAQETSMPSSIPSGSLFSSEEQRIRYTNLFSSHSIIDPKFIDMEFFSHENFECFQAFEDSNLIPFMSLKLPVYSDLVKAFYSNLEIHE

SEQ ID NO: 225110 - protein, 808 aa, Glycine max
  Coding DNA Sequence Number=SeqID_108332
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=95%, HitCoverage=59%, E-value=1e-165, Identity=45%"; Hit description =Tyrosine protein kinase, active site
  Pfam annotation: Domain name=LRRNT_2; Domain location=34-73; Score =48.4; E_value=2.5e-11; Accession=PF08263.3; Description=Leucine rich repeat N-terminal domain
  Pfam annotation: Domain name=LRR_1; Domain location=102-124; Score =13.9; E_value=0.6; Accession=PF00560.23; Description=Leucine Rich Repeat
  Pfam annotation: Domain name=LRR_1; Domain location=126-148; Score =13.7; E_value=0.65; Accession=PF00560.23; Description=Leucine Rich Repeat
  Pfam annotation: Domain name=LRR_1; Domain location=150-172; Score =15.0; E_value=0.28; Accession=PF00560.23; Description=Leucine Rich Repeat
  Pfam annotation: Domain name=LRR_1; Domain location=174-196; Score =12.0; E_value=1.7; Accession=PF00560.23; Description=Leucine Rich Repeat
  Pfam annotation: Domain name=LRR_1; Domain location=198-220; Score =12.9; E_value=1.1; Accession=PF00560.23; Description=Leucine Rich Repeat
  Pfam annotation: Domain name=LRR_1; Domain location=222-244; Score =12.2; E_value=1.5; Accession=PF00560.23; Description=Leucine Rich Repeat
  Pfam annotation: Domain name=LRR_1; Domain location=245-267; Score =15.5; E_value=0.19; Accession=PF00560.23; Description=Leucine Rich Repeat
  Pfam annotation: Domain name=LRR_1; Domain location=269-291; Score =6.5; E_value=18; Accession=PF00560.23; Description=Leucine Rich Repeat
  Pfam annotation: Domain name=LRR_1; Domain location=293-315; Score =14.8; E_value=0.32; Accession=PF00560.23; Description=Leucine Rich Repeat
  Pfam annotation: Domain name=LRR_1; Domain location=317-339; Score =7.2; E_value=13; Accession=PF00560.23; Description=Leucine Rich Repeat
  Pfam annotation: Domain name=LRR_1; Domain location=341-363; Score =16.1; E_value=0.13; Accession=PF00560.23; Description=Leucine Rich Repeat
  Pfam annotation: Domain name=LRR_1; Domain location=365-387; Score =12.6; E_value=1.3; Accession=PF00560.23; Description=Leucine Rich Repeat
  Pfam annotation: Domain name=LRR_1; Domain location=389-411; Score =12.4; E_value=1.4; Accession=PF00560.23; Description=Leucine Rich Repeat
  Pfam annotation: Domain name=LRR_1; Domain location=413-435; Score =16.0; E_value=0.13; Accession=PF00560.23; Description=Leucine Rich Repeat
  Pfam annotation: Domain name=LRR_1; Domain location=437-459; Score =13.4; E_value=0.84; Accession=PF00560.23; Description=Leucine Rich Repeat
  Pfam annotation: Domain name=LRR_1; Domain location=461-483; Score =12.6; E_value=1.2; Accession=PF00560.23; Description=Leucine Rich Repeat
  Pfam annotation: Domain name=LRR_1; Domain location=485-507; Score =12.8; E_value=1.1; Accession=PF00560.23; Description=Leucine Rich Repeat
  Pfam annotation: Domain name=LRR_1; Domain location=509-531; Score =13.8; E_value=0.64; Accession=PF00560.23; Description=Leucine Rich Repeat
  Pfam annotation: Domain name=LRR_1; Domain location=557-576; Score =6.5; E_value=17; Accession=PF00560.23; Description=Leucine Rich Repeat
  Pfam annotation: Domain name=LRR_1; Domain location=581-603; Score =8.2; E_value=8.2; Accession=PF00560.23; Description=Leucine Rich Repeat
  Pfam annotation: Domain name=LRR_1; Domain location=605-627; Score =10.6; E_value=3; Accession=PF00560.23; Description=Leucine Rich Repeat
  Pfam annotation: Domain name=LRR_1; Domain location=629-651; Score =10.9; E_value=2.6; Accession=PF00560.23; Description=Leucine Rich Repeat
  Pfam annotation: Domain name=LRR_1; Domain location=653-675; Score =15.4; E_value=0.21; Accession=PF00560.23; Description=Leucine Rich Repeat
  Pfam annotation: Domain name=LRR_1; Domain location=677-699; Score =18.5; E_value=0.025; Accession=PF00560.23; Description=Leucine Rich Repeat
  Pfam annotation: Domain name=LRR_1; Domain location=700-722; Score =7.5; E_value=11; Accession=PF00560.23; Description=Leucine Rich Repeat
  Pfam annotation: Domain name=LRR_1; Domain location=724-746; Score =15.0; E_value=0.27; Accession=PF00560.23; Description=Leucine Rich Repeat
  Pfam annotation: Domain name=LRR_1; Domain location=748-770; Score =12.1; E_value=1.6; Accession=PF00560.23; Description=Leucine Rich Repeat
  Pfam annotation: Domain name=LRR_1; Domain location=77-100; Score =0.9; E_value=1.9e+02; Accession=PF00560.23; Description=Leucine Rich Repeat
  Pfam annotation: Domain name=LRR_1; Domain location=772-794; Score =11.6; E_value=1.9; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1; Domain location=34-73::102-124::126-148::150-172::174 -196::198-220::222-244::245-267::269-291::293-315::317-339::341 -363::365-387::389-411::...
  Pfam module annotation: Domain location=413-435::437-459::461 -483::485-507::509-531::557-576::581-603::605-627::629-651::653 -675::677-699::700-722::724-746::748-770::77-100::772-794
MVFIFPTLLSMKLQPLLLLLVMYFCAFAASSSEIASEANALLKWKSSLDNQSHASLSSWSGDNPCTWFGIACDEFNSVSNINLTNVGLRGTLHSLNFSLLPNILTLNMSHNSLNGTIPPQIGSLSNLNTLDLSTNNLFGSIPNTIDNLSKLLFLNLSDNDLSGTIPSEIVHLVGLHTLRIGDNNFTGSLPQEMGRLMNLRILDIPRSNISGTIPISIEKLCNLSHLDVESNDLSGNIPLRIWHMNLKHLSFAGNNFNGSIPKEIVNLRSVETLWLWKSGLSGSIPKEIWMLRNLTWLDMSQSSFSGSIPRDIGKLRNLKILRMWKSGLSGSMPEEIGKLVNLQILDLGNNSLYGFIPPEIGFLKQLGQLDLSDNFLSGEIPSTIGNLSNLYYLYLYKNSLYGSIPDGVGNLHSLSTIQLSGNSLSGAIPASIGNLVHLDSLLLDGNELSGSIPFTIGNLSKLSELFIQSNELTGPIPASIGYLVHLDSLFLDRNELSGSIPFIIGNLSKLSELFIYSNELTGSIPSTIGNLSNGRALLFFGNQLGGKIPIEMNMLTALENLQLADNNFIGHLPQNICIGGTLKYFSAENNNFIGPIPVSWKNCSSLIRVRLQRNQLTGDITDAFGVLPNLDYLELSDNNFYGQLSPNWVKFRSLTSLMISNNNLSGVIPPELAGATKLQRLQLSSNHLTGNIPHDLCNLPLFDLSLDNNNLTGNVPKEIASMQKLQFLKLGSNKLSGLIPKQLGNLLNLLNMSLSQNNFQGNIPSELGKLKFLTSLDLGGNSLRGTIPSMFGELKGLEALNVSHNNLS

SEQ ID NO: 225111 - protein, 157 aa, Glycine max
  Coding DNA Sequence Number=SeqID_108333
MRVSSRAAQGKNRKTEDTIIGASKKYHLGQLKTKIAKLRTQLLESPKVPCTVSSQAAQDKNSKTKDIIIGASKKYHLRQLKTNIAKLRTQLLEPPKALAECPFYVVMTGVACFFLYHLGQLKTKIAKLRTQLLESPKGCYHGDHDEGVKFINIEEEE

SEQ ID NO: 225112 - protein, 161 aa, Glycine max
  Coding DNA Sequence Number=SeqID_108334
  Gene Ontology: Mol. function=isomerase activity
  Homolog annotation: Hit_ID=Q1RZ53; Match level="QueryCoverage=92%, HitCoverage=39%, E-value=8e-17, Identity=36%"; Hit description =Cyclin-like F-box; F-box protein interaction domain
MPGYHLVSSCNGLNCGVSKIPEGYRVCFWNKATRVIYRESPMLSFSQGIGRRTMFGFGYDPSSDKYKVVAIALTMLSLEVSEKTEMKVYGAGDSSWRNLGGFPVLWTLPKVGGVYLSGTLNWVVIMGKETIHSEIVIISVDLEKETCRSLFLPDDFCFFDT

SEQ ID NO: 225113 - protein, 82 aa, Glycine max
  Coding DNA Sequence Number=SeqID_108335
MPISPYRCIGWDRAHKTPSGPDEVQQGPRVSSSGYGPLNGTHKDTQCTRRSPTAPWGFQLWLRASVSPIGCSFPQRGHAIVT

SEQ ID NO: 225114 - protein, 192 aa, Glycine max
  Coding DNA Sequence Number=SeqID_108336
  Gene Ontology: Mol. function=RNA-directed DNA polymerase activity; Biological process=RNA-dependent DNA replication
  Homolog annotation: Hit_ID=Q0ZCD0; Match level="QueryCoverage=94%, HitCoverage=16%, E-value=3e-10, Identity=25%"; Hit description =Integrase
MERSMIDAASGGSLGDMTPAEARNLIEKMASNSQQFNARNDVIVIRGVHEVATNSSSSGETKTLEGKLDVLVNLVTQLAMNKKSALVARLCGLCSSADHHTDLCPFVQQSKAIEQPEAYAANIYNRPPQPQQQNQPQQNNYDLSRNRYNPGWRNHPNLRWLNPSQQQQQQPYFQNVAGPSRLYVPPPIQQQK

SEQ ID NO: 225115 - protein, 116 aa, Glycine max
  Coding DNA Sequence Number=SeqID_108337
MMLLPMIVELIVQSFYTVVGQLGIMSIMSIVVEITWGARYQLLFPLVRVNFELGVIMVIAVSFGKPVVPAALMNRPTRGERRFAYWALAECILAYYVGTDEGVSEVLHVAGEKRLH

SEQ ID NO: 225116 - protein, 130 aa, Glycine max
  Coding DNA Sequence Number=SeqID_108338
MAPKKLSTKRYRRDATGEGSSAASEFDSHRFRSAEHQRRFEAIKGWSFHRERHVQLREDEYMEFQDEIARRRWTPLVTPMAKFDPEIVLECPQPVPGRPANFGGRPVVEAGADHAHQHDYFDPNMDDTAA

SEQ ID NO: 225117 - protein, 160 aa, Glycine max
  Coding DNA Sequence Number=SeqID_108339
MAPTRHPLDPDKSNRALGFPTLITGLYQSYGVPVTPSKAQGDAHQAAGAPPPPRQADPVGSLGVEHYLQHLVRQQAANHCGQVQIHECLYQFSLSQQGQGSTPFVCPTPEQFGAEVAWLGDWPDAQAGEDPAGSPSEEDEFHMDKNMTDLLGFLGGSGAT

SEQ ID NO: 225118 - protein, 345 aa, Glycine max
  Coding DNA Sequence Number=SeqID_108340
  Gene Ontology: Mol. function=carbohydrate binding; Biological process= fructose 2,6-bisphosphate metabolic process
  Homolog annotation: Hit_ID=Q93XR7; Match level="QueryCoverage=100%, HitCoverage=46%, E-value=2e-99, Identity=56%"; Hit description =Fructose-6-phosphate 2-kinase/fructose-2,6-bisphosphatase
MGTGASKDADEGSKEERERLDHAGGQLYVSLKMENHKLTGDLVPHVYGSVPLVGSWDPSKALFMERESGQCGNLALLSHLITESVALGNGFVAFTMRRVSGIEGPSRLLVGGALQEDARLALFRLDSGEVLQYQVFVKADRVSPFDLAASWRAYQDKFRPSSVRWIPDVSINSAPQTGGENSVNLVLTLEINGCSVGLELDLEHYVVPTPATAANSAHVYAANMTENPRSLICGSGSSSYPIKEMQVIVPDPSKMFQSSGMVESKSVGTFSPLQKQESQRGLFVDRGVGSPRLVKSSSSYIFSTDLNLDNETKNSMPAAAGAVAAAAVADQMLGPKEDRHLAIIL

SEQ ID NO: 225119 - protein, 108 aa, Glycine max
  Coding DNA Sequence Number=SeqID_108341
MPFCGRARRGSRVRFPKEERCTESPPTFICGKRRENRRKPVKMKIISSGLVFTFEEGEELATQLAQASKVASSRRARLPTFEEVTKTHGLRKTPPFDFRHITEFSRIA

SEQ ID NO: 225120 - protein, 115 aa, Glycine max
  Coding DNA Sequence Number=SeqID_108342
  Gene Ontology: Mol. function=fructose-2,6-bisphosphate 2-phosphatase activity; Biological process=fructose 2,6-bisphosphate metabolic process
  Homolog annotation: Hit_ID=O64983; Match level="QueryCoverage=78%, HitCoverage=9%, E-value=3e-23, Identity=61%"; Hit description =Fructose-6-phosphate 2-kinase/fructose-2,6-bisphosphatase
MVEKNRHWHKIASKQSADFFRADNPEGVEARNEFNCESVTIDRVKSIACTLGHKVAALAFEDMISWMQEGGQVGIFDATNSSKERRNMLMKLAEGRCKVVKDGTEINNLPGNNMQ

SEQ ID NO: 225121 - protein, 213 aa, Glycine max
  Coding DNA Sequence Number=SeqID_108343
  Gene Ontology: Mol. function=chromatin binding; Cellular component =chromatin; Biological process=chromatin assembly or disassembly
  Homolog annotation: Hit_ID=Q1SAV4; Match level="QueryCoverage=83%, HitCoverage=65%, E-value=4e-23, Identity=32%"; Hit description =Integrase, catalytic region
  Pfam annotation: Domain name=Chromo; Domain location=137-187; Score =10.8; E_value=0.052; Accession=PF00385.14; Description='chromo' (CHRromatin Organisation MOdifier
MWDQVEDEYLVHPKTDGQTECSFLSLTEWSYNIVVHITTGASSFQATYGKAPTSIPQYLECSSQVEVMDELMTTRAQLHSDLLYHLSKAQVAMKWIADSHRHDVVYNVGDWFSSKHGTNPPELHPLPPLHSENHHVVEPLSILDWKWDNDNTPPVQKVLVQWADLAPKDTSWEEWNTLHTSYKLGDKVVLQPNPGRSRPKRVHKTPTYLHNYA

SEQ ID NO: 225122 - protein, 416 aa, Glycine max
  Coding DNA Sequence Number=SeqID_108344
  Gene Ontology: Mol. function=protein serine/threonine kinase activity; Cellular component=chromosome; Biological process=protein amino acid phosphorylation
  Homolog annotation: Hit_ID=Q5NB70; Match level="QueryCoverage=32%, HitCoverage=31%, E-value=2e-62, Identity=82%"; Hit description =Putative dual specificity kinase 1
  Pfam annotation: Domain name=Pkinase; Domain location=9-180; Score= -29.6; E_value=8.5e-07; Accession=PF00069.15; Description=Protein kinase domain
MERVIGGKFKIGRKIGSASNIDTSEIVAIKMLTRIEYMHSKGFLHRDIKPDNFLMGLGRKSNQVYIIDFGLAKRYRDPNTNKHIPYRENKSLTGTARYASCNTHMGIEQSCRDDLESLGYVLMYFLRGSLPWQGLKAATKKEKYDNICEKKLSTTIEPYKFEYNEGMLSIDHVLMPMVYIPFSGVNDSAHVTVTKMLANLERPSARARVQPKPSNVRNLDAKNHTEKHGVNNSPSTSSAIPKSSTENVSKPERPTGTSNLGRVFGSNAQLERGKGSVNDFEDRVSPSASNSICLVHQLENIEENAPADWPASSCPPPDTPTESMEFLARSWSLSAMELSKALHSTNNSISTGIEMPLSCPSGHQFDTKCSTASKDVRTLAVFNLRVIYIRPLALLLATFFLLGNATCKPTIMQKLC

SEQ ID NO: 225123 - protein, 248 aa, Glycine max
  Coding DNA Sequence Number=SeqID_108345
  Gene Ontology: Mol. function=lactoylglutathione lyase activity; Cellular component=cytoplasm; Biological process=carbohydrate metabolic process
  Homolog annotation: Hit_ID=Q6ES23; Match level="QueryCoverage=74%, HitCoverage=93%, E-value=2e-67, Identity=54%"; Hit description =Putative glyoxalase I
  Pfam annotation: Domain name=Glyoxalase; Domain location=117-237; Score=30.0; E_value=8.1e-06; Accession=PF00903.15; Description =GlyoxalaseBleomycin resistance proteinDioxygenase superfamily
  Subcellular localization annotation: CTP_CleavageSite=44; ConfidenceScore=5.30e-01
MASSLMLPAASMLRPCTTLSSSCASSRRLALFHLVSTGGIALPQAQLFGAEKIAQPEKNLFDWVKNDNRRFLHVVYRVGDLEKTIKKKEGRLITREPGPVKDGSAVIALIEDPDGYKFELLERRPTSEPLCQVMLRAAGMKLLRKRDNPEQKYTVAFMGYGPEYMNSVLELTYNYGVTNYDKGNGYAQIAIGTNDVYKTAEAIKLCGRKIIREPGPLPGINTKIVACLDPDGWKLAFVDNVDFLKELE

SEQ ID NO: 225124 - protein, 826 aa, Glycine max
  Coding DNA Sequence Number=SeqID_108346
MPVCRQLDFDNGNRGTPLRVDEDKGMVSDTDHKSDQVIQNPIHRFTPLSLSGRKQLVMRSPDSSRHDGNITQPLVQSGLFVPEVHVAHGATPSSVHISILKMKTLEATPAISVLKEGMDRLKARLSKFSPGFSLSNKKYCEYKHDETRQTPLGEKLFSLTPDSNVYKGLVDGNEHGIQSNKNICKSSQNEETLDAKIDEENLSLISAHVSYNDENPKVVEMGASPSQMTHLTKVVDVDLADRTVEKGKDEILVPSPPIQEVTPQLCSLQDPPSMQDLSPKGNLDGHGLDNSYHSVLQVAQSHLTKSGISISSGKKLQDSPNMQNLSPKSNLDGHDNSYHSVLQVAQSPLTKSGISISSGKKLQDSPNMQNLSTKSNLYGHGLDNSYHSVLQVAQSPLTKSGISISSGKKLQDSPNVQDLSPKSNLDGHGLHNSYHSALQVAQSPLTKSGINISSGKKRKGVEIRSNGDNIDKIGRIGRSPEVHKSGNGDLQLLSEQIGSMRSEREKLGDQTLNDGDLILKKFLARTNQLLPPSVDKLNLRSISRLEDILVHLHKVKKKESLCSEIQSQLKITDPLNILRDKRVAETRTLLYDIAYEKAKLQLLHVKHDKLQQCSVGDMNFPCKQKKVQQVSSGLQECETIKLNSIPSSSKSGAMDTQADDSRWQGKCRVSSQKVLEKKQELEILESKAKSWSEFLHSHCMMEGYQSYTNTIKAVSGYLQQRKSCKSIRQNLKLWEIEDFERKDGCYKVCLNYCGYLTQRFTVNTGQSSIIISNSLNDVNIGKTFPNLDGISAFVFVLHPHTTKKCTGSSIMARETQFGGLQLCVCN

SEQ ID NO: 225125 - protein, 675 aa, Glycine max
  Coding DNA Sequence Number=SeqID_108347
  Gene Ontology: Cellular component=nucleus; Biological process =regulation of transcription, DNA-dependent
  Homolog annotation: Hit_ID=Q6H972; Match level="QueryCoverage=87%, HitCoverage=64%, E-value=1e-141, Identity=71%"; Hit description =SEU3A protein
  Pfam annotation: Domain name=LIM_bind; Domain location=320-667; Score= -192.9; E_value=0.04; Accession=PF01803.7; Description=LIM-domain binding protein
  Subcellular localization annotation: CTP_CleavageSite=85; ConfidenceScore=5.75e-01
MVPPGPPTPIGGAQSVPLSLLRSNSGMLAGQGGGAVPSQTSFPSLVGQRNQFNNMNMLGNMSNVTSLLNQSFPNGIPNSGLGGPGSSQRSGGIDAGAEADPLSGVGNGMNFGNQLQSNLMNPGSSGQGQGPQFSNASGSQMLQDQQHSQQLPQNFQQHSQPSMQQFSGPLNAQQQQQQQQHFQSIRGGMGGVGQVKLEPQVNIDQFGQQQQLPSRNLAQVKLEPQQLQTLRNMAPVKMEPQHNDQQFLHQQQQQQQQQQQQQQQQQLLHMSRQSSQAAAAQMNHLLQQQRLLQYQQHQQQQQQLLKAMPQQRSQLPQQFQQQNMPMRSPVKPAYEPGMCARRLTHYMYQQQHRPDDNNIEFWRKFVSEYFAPNAKKKWCVSMYGNGRQTTGVFPQDVWHCEICNRKPGRGFEATAEVLPRLFKIKYESGTLEELLYVDMPREYHNSSGQIVLDYAKAIQESVFEQLRVVRDGQLRIVFSPDLKICSWEFCARRHEELIPRRLLIPQVSQLGAVAQKYQAITQNATPNLSVPELQNNCNMVVASARQLAKALEVPLVNDLGYTKRYVRCLQISEVVNSMKDLIDYSRETGTGPMDFYNFQTMQNDPHCQMSLCPYDNYVDVQIKHAEYQMLQTRGGGDPSIAGVCPRLVKKASAQPTCLSTRAAKCGGWLGSSCTV

SEQ ID NO: 225126 - protein, 42 aa, Glycine max
  Coding DNA Sequence Number=SeqID_108348
GHSRVTKDHHILNIISDTMHSYIEELLNQCSQNNHYHQFAAA

SEQ ID NO: 225127 - protein, 90 aa, Glycine max
  Coding DNA Sequence Number=SeqID_108349
MKLNWDNIIVDTMLKTKRIGSFKCPYAMLISKILDYFGVDTQDGVFDFVEVDFEIKTKIEKPRKDQVEQLEEAKEKPMSPFKTDDVSKDG

SEQ ID NO: 225128 - protein, 101 aa, Glycine max
  Coding DNA Sequence Number=SeqID_108350
MLTDHLIHKQLQASLLRHQWRKMIEMLTLTADADDARRWTLVRGSWFLLTATRLPSRWFVAEEEDEDGSARKKNGCKENARKKNGFVGGKKKNARKQRLQG

SEQ ID NO: 225129 - protein, 365 aa, Glycine max
  Coding DNA Sequence Number=SeqID_108351
  Homolog annotation: Hit_ID=Q6H972; Match level="QueryCoverage=91%, HitCoverage=35%, E-value=2e-29, Identity=34%"; Hit description=SEU3A protein
MAWEGFWPPYFFSPPFHFPLTKHRKKLERINSLAKFPRRTSGSSGLHSQGQQSEDQLQQQSQPQLPPQHMVPHSSNGDQNSVQTAAMQIASSNGVTSVNNSVNAASASTSTSTIVGLLHQNSMNSRQNSMNSRQNSMNNASSPYGGSSVQIASPGSSGNMPQAQPNASPFQSPTPSSSNIPQTSHPALTSANHMGTANSPANISLQQQQQTSLPAEADPSDAQSSVQKIIHEMMMSSQMNGPGGMAGAGSLGNDMKNVNGILPGSNNTGLNSGSVSGLVGNVAVNSNSGVGVGGYGTIGLGPAGMTNGMRPVMGHNSIMNGRGGMASLARDQVMNHQQDLSSQLLSGLGGVNGFSNLQFDWKPSP

SEQ ID NO: 225130 - protein, 183 aa, Glycine max
  Coding DNA Sequence Number=SeqID_108352
IMIYPGYVPEPGIKYRVFHYGLEFHVGNWSFDKAEWREIDMVNRCWVKFPEPPDSSTLDHNDEDNFQRNLLSIECMKTLNEALHLHHEKRNCPKDGSVLESKEDATEESITSWKISNFSENFDSKVNHKSANDSEEMASVLKDGTGIPSSFMVLFLCAFSVSGEGHDFATVAESASLNILLLF

SEQ ID NO: 225131 - protein, 425 aa, Glycine max
  Coding DNA Sequence Number=SeqID_108353
  Homolog annotation: Hit_ID=Q1T3Y0; Match level="QueryCoverage=17%, HitCoverage=11%, E-value=2e-19, Identity=55%"; Hit description =Targeting for Xklp2
  Pfam annotation: Domain name=TPX2; Domain location=360-413; Score =7.7; E_value=0.093; Accession=PF06886.2; Description=Targeting protein for Xklp2 (TPX2)
  Subcellular localization annotation: CTP_CleavageSite=55; ConfidenceScore=5.09e-01
MYVAEKLNKGDSSACLMQQQPFCYASGFPKEANKSNPNNALGQSVSFGRFMPESLAWEKWSTFSHNRYVEEAERFTRPGSVAQKKAFFEAHYKKLAAQKAAALLEQANSASQTQQEQEEAIVDNTHNLNMTSPKSKLVLLEENAQVFNSEPDATTYNSNSNTDAALPQSDMLGGAQPLIDHQAFVVKLQNQLGKVDNYKEPSEEGTNFDQNILQSTGKKKQAVSSFKLLKVIGTPKFNSTPVKSKSPSHSSKDGIATPMSNNPALTSSKKEGSTSKLPHMSLNFTLVREINKLTVSLVRKFGSTGVGASSSKASKDSSTLIKTTTKASKNESQKHSSLTPLTEAQRSKRKTPIISSPFRLSTEERASIRKKKLEKVCNASESQKVQPHTKFKEKADTKIRKLRQSICFIAGSSPDFYQDREASKK

SEQ ID NO: 225132 - protein, 415 aa, Glycine max
  Coding DNA Sequence Number=SeqID_108354
  Homolog annotation: Hit_ID=Q01G74; Match level="QueryCoverage=100%, HitCoverage=48%, E-value=3e-45, Identity=46%"; Hit description =Homology to unknown gene
MHIDDLRALAPMWLSKTEEVRQDRAHWGVNITGDIYEKGWISEMYGYSFGAAEVGLRHKINDNLMIYPGYAPREGVEPILLHYGLPFRVGNWSFSKADHDEDAIVYNCGQLFPQPPYPREVMQLETDPNLRRGLFLSIECINILNEALLLHHVANGCPKPPWSKYVNFLKSKAFAELTKPKLVTPASLEMMEDTVQEHIDHDTTRPYPKIHTVFSTECTPYFDWQTVGLMHSFHLSGQPGNITRLLSCSDEDLKLYKGHNLAPTHYVPSMSQHPLTGDWYPAINKPAAVLHWLNHANIDAEFIVILDADMIMRGPITPWEFKAARGKPVSTPYDYLIGCDNELAKLHISHPEACDKVGGVIIMHIDDLRKFALLWLHKTEEVRADRAHYARNITGDIYESGWISEMYGYSFGAAE

SEQ ID NO: 225133 - protein, 276 aa, Glycine max
  Coding DNA Sequence Number=SeqID_108355
  Gene Ontology: Mol. function=DNA binding; Cellular component=nucleus; Biological process=regulation of transcription, DNA-dependent
  Homolog annotation: Hit_ID=Q9LY95; Match level="QueryCoverage=98%, HitCoverage=100%, E-value=6e-72, Identity=52%"; Hit description =MYB40-putative transcription factor
  Pfam annotation: Domain name=Myb_DNA-binding; Domain location=14-61; Score=37.4; E_value=4.8e-08; Accession=PF00249.21; Description=Myb -like DNA-binding domain
  Pfam annotation: Domain name=Myb_DNA-binding; Domain location=67-112; Score=47.4; E_value=4.9e-11; Accession=PF00249.21; Description=Myb -like DNA-binding domain
  Pfam module annotation: Pfam domain module=Myb_DNA-binding::Myb_DNA -binding; Domain location=14-61::67-112
MGRQPCCDKVGLKRGPWTIEEDHKLMNFILNNGIHCWRSVPKLAGLLRCGKSCRLRWINYLRPDLKRGGFTEMEEDQIIELHSGLGNRWSKIASHFPGRTDNEIKNHWNTRIKKRLKLLGLDPVTHKPIEQKENTDENTNKTNPHPSIFGGSEENVEIKSLENGGTKEMAKTEGKREENNKVINWDDTSELLNNFEMLCSKLDLGSWMMSQETNTSTNSLCSSSVSMDDTSHLSMDESSYLQENSLQQWVDSMDSILSWDGFNPLDQDILFLENRE

SEQ ID NO: 225134 - protein, 155 aa, Glycine max
  Coding DNA Sequence Number=SeqID_108356
  Homolog annotation: Hit_ID=Q01G74; Match level="QueryCoverage=80%, HitCoverage=22%, E-value=2e-21, Identity=42%"; Hit description =Homology to unknown gene
MEKFSILLLLVMLDQFIFTVEAAQKAPWRIQVLFSVECQNYFDWQTVGLMHSFRKAKQPGHITRLLSCTEEQKKTYRGMHLAPTFEVPSMSKHPTTGDWYPAINKPAGVLHWLKHSKDAENIDWVIILDADMIIRGRIVPWKLGAEKGRPVAAYY

SEQ ID NO: 225135 - protein, 490 aa, Glycine max
  Coding DNA Sequence Number=SeqID_108357
  Gene Ontology: Mol. function=RNA-directed DNA polymerase activity; Biological process=RNA-dependent DNA replication
MVAQASSIGMINPCMVETLTIPISKVDNPGNLKDFCPISLCNVLLKAISKVLESFNPHRGLQQGDILSPYLFVLCMEKLSILIQHVVENNSWKPVKIAKNGPGISHLFLSKIAFSLHKQRVPRVNNSSFSFLMDRVKGCLSDWKERLLNRVERVTLAKSILSSILIYSMQNMWLPQGICDELDKITRRFIWGSSDHNHWMKWKTLTQRRHNRGLGIRTTWEANVAILGKHIWTMLHDPNHGPPKALYIYGLMDDVSNQDFSLFVSDLWILWIEGDWCFDYLHTTVPLWLQYEIQSVFLNDQVPDMVVWGDSPNSTYYAKSAYGRHTKARITTSYTMGRGSWVCGSGKESILPCFRDCLKAKRVWDMLRFDAYQNNTSNVISAWLRHHVRYGKSRKTICGGLLADLEIKLGMRKFFKTLSYQILVLYLASTTCITLSCRSLILTRKCLTRLNFVNMLQWQLDSWLHGYCGVTTVTNAELQAIYNGLSTCVA

SEQ ID NO: 225136 - protein, 148 aa, Glycine max
  Coding DNA Sequence Number=SeqID_108358
  Gene Ontology: Cellular component=integral to membrane; Biological process=transport
  Homolog annotation: Hit_ID=Q337A9; Match level="QueryCoverage=82%, HitCoverage=29%, E-value=1e-29, Identity=52%"; Hit description=Major Facilitator Superfamily protein, expressed
  Pfam annotation: Domain name=DUF791; Domain location=25-148; Score= -134.8; E_value=9.6e-05; Accession=PF05631.4; Description=Protein of unknown function (DUF791)
  Subcellular localization annotation: CTP_CleavageSite=96; ConfidenceScore=5.21e-01
MGSLPKTNNGSLPNLTLKPQSWTKVSSIIFGDLPAGTGFSYPKTERAVQQSSSKLVRHAHQFIRKHSPQYKVLMLGRILGGIATSLLFSSFESWLVAEHFKAIFLGNGLVAILSGLFGNVLVDTLALGLVAPFDAASCFLAIGVAIAL

SEQ ID NO: 225137 - protein, 224 aa, Glycine max
  Coding DNA Sequence Number=SeqID_108359
  Gene Ontology: Mol. function=transferase activity; Biological process= paclitaxel biosynthetic process
  Homolog annotation: Hit_ID=Q94CD1; Match level="QueryCoverage=56%, HitCoverage=28%, E-value=8e-10, Identity=33%"; Hit description =Putative N-hydroxycinnamoyl/benzoyltransferase
MQRLPHPKFNPLKTQPRPLRQNQHPHRVRTHPQLGHQLNHPPHVHIVHPLLRTLHQTRPVPDPSLPQLPRACLCAFPQYPSGSPGFTRFRMFTLNKSFSVWFLGRNPITLAQLLHMWATRTSNDVCDDILHTPFRALIRLSLNTMQVGLSLLVTQCKFPTRVFNGSTGGKENGSGGGMWRWGGGGIGEKVERGKREEERRRKMSDREKRNRREACKRGTDARYI

SEQ ID NO: 225138 - protein, 110 aa, Glycine max
  Coding DNA Sequence Number=SeqID_108360
  Homolog annotation: Hit_ID=Q9FME7; Match level="QueryCoverage=63%, HitCoverage=5%, E-value=1e-15, Identity=60%"; Hit description =Kinesin-like protein
MSLGARNSRIFALEKIIATSSTTLLSMASHLPKAEEPERVFSGKGRWNQVHSVLEAKNLMNHLFNLASSSSKGQTNTGELGSDKEQTRNKRRTCKPHYLEDYVTSANNKH

SEQ ID NO: 225139 - protein, 71 aa, Glycine max
  Coding DNA Sequence Number=SeqID_108361
  Gene Ontology: Mol. function=protein-tyrosine kinase activity; Cellular component=integral to membrane; Biological process=protein amino acid phosphorylation
  Homolog annotation: Hit_ID=Q1SML3; Match level="QueryCoverage=93%, HitCoverage=6%, E-value=2e-26, Identity=82%"; Hit description =Tyrosine protein kinase, active site
NGSVEKTLKDDGQAMAFDWYKRVNVVKDVANALCYMHHECSPRIVHRDISSKNVLLDSEYVAHVSDFGPHS

SEQ ID NO: 225140 - protein, 85 aa, Glycine max
  Coding DNA Sequence Number=SeqID_108362
  Gene Ontology: Mol. function=aminoacyl-tRNA ligase activity
  Homolog annotation: Hit_ID=Q45NM7; Match level="QueryCoverage=56%, HitCoverage=28%, E-value=2e-10, Identity=70%"; Hit description =Histidyl-tRNA synthetase
MLSEITGSGPIRHIIRLTSLSYLRLQNVLCTVETSEEEKGLIAEIADKIETYIKEKGPPLALLSKFREGSAFLKDDASVDALNDL

SEQ ID NO: 225141 - protein, 327 aa, Glycine max
  Coding DNA Sequence Number=SeqID_108363
  Gene Ontology: Mol. function=exonuclease activity; Cellular component= intracellular
  Homolog annotation: Hit_ID=Q8L7M4; Match level="QueryCoverage=87%, HitCoverage=68%, E-value=4e-31, Identity=53%"; Hit description =Exonuclease-like protein
MGSSEAENEALRGAEEEEGSTSNKKCGKFYDVYGPEGKADIVFNSPEDNSTLNLSDVQGLVTWVLSEGFMPSWVFIKQGKQPLERQTESLMAGCCQNLVDREICNSDVLSLTVQVHPDTVNWRSTPGSTWSHQQWQASGGWANKPLIPKVVMLYVPGLDAALFLSQSKMLPRLKKFCGKPRALLALSCVSDGMQTIDALLTCKMKRKRDENSSIMGKFARTSQQVKVQEYNYGRKPGSPHIVDISPYSLSFKELTKDIPFPVTYYTLTEKELEENGYSVNKPGFLSTLPAPSGSPFYEMLALDCEMSKEASFSVCGNMFIFCYSLYL

SEQ ID NO: 225142 - protein, 59 aa, Glycine max
  Coding DNA Sequence Number=SeqID_108364
MGQSVKFYPWIVLDLEAMPTPSKLQLEANAILKNGWWNRSQSDTRNICGMVYLAMILEA

SEQ ID NO: 225143 - protein, 45 aa, Glycine max
  Coding DNA Sequence Number=SeqID_108365
MVLVAIFTLKVEVKWVEYGKRHNCPYNVADICEPKVYIIRSYRRP

SEQ ID NO: 225144 - protein, 107 aa, Glycine max
  Coding DNA Sequence Number=SeqID_108366
MEEGFSTNKPPMFRGVKGQWTKEQTLRFLLNSKAQNVMLCALSEEEYTKVTTLRALKNLDSMSLNELIGTLKVHEQELQQDEGPKKEKSLALRVRRARRHHRLENKS

SEQ ID NO: 225145 - protein, 76 aa, Glycine max
  Coding DNA Sequence Number=SeqID_108367
MMSMKRMREDGGIRGIRREEIIDDMEVKVEQVFVCYNYNERKKIKLASLEFERYALVLWNQLRSDVEGMKRPLINT

SEQ ID NO: 225146 - protein, 60 aa, Glycine max
  Coding DNA Sequence Number=SeqID_108368
MGEFGELMLTTIIFQYFCYKGLVWETRGHCKVCLGCSLCTSIRQLTWSHGKAETLGIIKY

SEQ ID NO: 225147 - protein, 51 aa, Glycine max
  Coding DNA Sequence Number=SeqID_108369
MGTIVRWHGGSYWVNYGKCKAPCININKLKKFGGDNTGYSEGQFVTLGAAT

SEQ ID NO: 225148 - protein, 172 aa, Glycine max
  Coding DNA Sequence Number=SeqID_108370
  Gene Ontology: Mol. function=nucleic acid binding; Cellular component= mitochondrion; Biological process=DNA integration
  Homolog annotation: Hit_ID=Q1RWP6; Match level="QueryCoverage=99%, HitCoverage=17%, E-value=6e-55, Identity=60%"; Hit description=Zinc finger, CCHC-type; Polynucleotidyl transferase, Ribonuclease H fold
MAFSSQKEPRWFSSPLQGKPDDQHHPCNSPWQQLTHQLDVNNVFREGSLNEEVYMAQPPGLKDSQHPDHVCKFHKAIYGLRQAPRAWYNALKLFIVSCGFTASKSDPSLFVYTNNYVIAYFLVYVDDLLLTGVELVPSTSGILLSQHKFVRDFLEHFEMAKSEPSPTPLFVT

SEQ ID NO: 225149 - protein, 727 aa, Glycine max
  Coding DNA Sequence Number=SeqID_108371
  Gene Ontology: Mol. function=protein-tyrosine kinase activity; Cellular component=integral to membrane; Biological process=protein amino acid phosphorylation
  Homolog annotation: Hit_ID=Q1SML3; Match level="QueryCoverage=99%, HitCoverage=81%, E-value=0.0, Identity=39%"; Hit description =Tyrosine protein kinase, active site
  Pfam annotation: Domain name=LRR_1; Domain location=115-137; Score =18.9; E_value=0.018; Accession=PF00560.23; Description=Leucine Rich Repeat
  Pfam annotation: Domain name=LRR_1; Domain location=139-161; Score =4.5; E_value=41; Accession=PF00560.23; Description=Leucine Rich Repeat
  Pfam annotation: Domain name=LRR_1; Domain location=163-182; Score =5.3; E_value=29; Accession=PF00560.23; Description=Leucine Rich Repeat
  Pfam annotation: Domain name=LRR_1; Domain location=187-209; Score =10.5; E_value=3.1; Accession=PF00560.23; Description=Leucine Rich Repeat
  Pfam annotation: Domain name=LRR_1; Domain location=19-41; Score =13.7; E_value=0.66; Accession=PF00560.23; Description=Leucine Rich Repeat
  Pfam annotation: Domain name=LRR_1; Domain location=211-233; Score =11.5; E_value=2; Accession=PF00560.23; Description=Leucine Rich Repeat
  Pfam annotation: Domain name=LRR_1; Domain location=235-257; Score =9.6; E_value=4.5; Accession=PF00560.23; Description=Leucine Rich Repeat
  Pfam annotation: Domain name=LRR_1; Domain location=259-281; Score =15.7; E_value=0.17; Accession=PF00560.23; Description=Leucine Rich Repeat
  Pfam annotation: Domain name=LRR_1; Domain location=283-305; Score =19.6; E_value=0.011; Accession=PF00560.23; Description=Leucine Rich Repeat
  Pfam annotation: Domain name=LRR_1; Domain location=307-329; Score =6.8; E_value=15; Accession=PF00560.23; Description=Leucine Rich Repeat
  Pfam annotation: Domain name=LRR_1; Domain location=331-353; Score =13.4; E_value=0.83; Accession=PF00560.23; Description=Leucine Rich Repeat
  Pfam annotation: Domain name=LRR_1; Domain location=355-377; Score =12.4; E_value=1.3; Accession=PF00560.23; Description=Leucine Rich Repeat
  Pfam annotation: Domain name=LRR_1; Domain location=379-401; Score =17.5; E_value=0.049; Accession=PF00560.23; Description=Leucine Rich Repeat
  Pfam annotation: Domain name=LRR_1; Domain location=403-424; Score =14.1; E_value=0.49; Accession=PF00560.23; Description=Leucine Rich Repeat
  Pfam annotation: Domain name=LRR_1; Domain location=426-447; Score =9.2; E_value=5.3; Accession=PF00560.23; Description=Leucine Rich Repeat
  Pfam annotation: Domain name=LRR_1; Domain location=43-65; Score =17.0; E_value=0.067; Accession=PF00560.23; Description=Leucine Rich Repeat
  Pfam annotation: Domain name=LRR_1; Domain location=67-89; Score =10.4; E_value=3.3; Accession=PF00560.23; Description=Leucine Rich Repeat
  Pfam annotation: Domain name=LRR_1; Domain location=91-113; Score =12.8; E_value=1.1; Accession=PF00560.23; Description=Leucine Rich Repeat
  Pfam annotation: Domain name=Pkinase; Domain location=553-727; Score =5.8; E_value=6.6e-09; Accession=PF00069.15; Description=Protein kinase domain
  Pfam annotation: Domain name=Pkinase_Tyr; Domain location=553-727; Score=-55.0; E_value=4.3e-09; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::Pkinase::Pkinase_Tyr; Domain location=115-137::...
  Pfam module annotation: Domain location=139-161::163-182::187-209::19- 41::211-233::235-257::259-281::283-305::307-329::331-353::355 -377::379-401::403-424::426-447::43-65::67-89::91-113::553-727::553 -727
  Subcellular localization annotation: CTP_CleavageSite=50; ConfidenceScore=5.05e-01
MSYNSLSGSIPPQIDALSNLNTLDLSTNKLFGSIPNTIGNLSKLQYLNLSANGLSGPIPNEVGNLKSLLTFDIFTNNLSGPIPPSLGNLPHLQSIHIFENQLSGSIPSTLGNLSKLTMLSLSSNKLTGTIPPSIGNLTNAKVICFIGNDLSGEIPIELEKLTGLECLQLADNNFIGQIPQNVCLGGNLKFFTAGNNNFTGQIPESLRKCYSLKRLRLQQNLLSGDITDFFDVLPNLNYIDLSDNSFHGQVSPKWGKFHSLTSLMISNNNLSGVIPPELGGAFNLRVLHLSSNHLTGSIPQELRSMTFLFDLLISNNSLSGNVPIEISSLQELKFLEIGSNDLTGSIPGQLGDLLNLLSMDLSQNKFEGNIPSEIGSLKYLTSLDLSGNSLSGTIPPTLGGIQGLERLNLSHNSLSGGLSSLERMISLTSFDVSYNQFEGPLPNILAIQNTTIDTLRNNKGLCGNVSGLKPCTLLSGKKSHNHMTKKVLISVLPLSLAILMLALFVFGVWYHLRQNSKKKQDQATVLQSPSLLPMWNFGGKMMFENIIEATEYFDDKYLIGVGGQGRVYKALLPTGEVVAVKKLHSVPNGEMLNQKAFTSEIQALTEIRHRNIVKLHGFCSHSQYSFLVCEFLEKGDVKKILKDDEQAIAFDWNKRVDVVEGVANALCYMHHDCSPPIIHRDISSKNILLDSDYVAHVSDFGTAKFLNPNSSNWTSFAGTFGYAAPGN

SEQ ID NO: 225150 - protein, 135 aa, Glycine max
  Coding DNA Sequence Number=SeqID_108372
  Gene Ontology: Mol. function=protein-tyrosine kinase activity; Biological process=protein amino acid phosphorylation
  Homolog annotation: Hit_ID=Q1SML3; Match level="QueryCoverage=67%, HitCoverage=8%, E-value=8e-27, Identity=68%"; Hit description =Tyrosine protein kinase, active site
MEANDICDVYSFGILALEILFGEHPGGDVTSSCAATSTLDHMALMDRLDQRLPHPTSPTVVELISIVKIAVSCLTESPRFRPTMEHVAKELAMSSRSFVIMLILGEAVDIDAAPDVIITPHMSGKGQKQRWQIAL

SEQ ID NO: 225151 - protein, 47 aa, Glycine max
  Coding DNA Sequence Number=SeqID_108373
MSNTRNGCVSVNLKIFLCGDDDDNDINHNGGGGGSGTDSDGFKILSQ

SEQ ID NO: 225152 - protein, 681 aa, Glycine max
  Coding DNA Sequence Number=SeqID_108374
  Gene Ontology: Mol. function=protein-tyrosine kinase activity; Cellular component=integral to membrane; Biological process=protein amino acid phosphorylation
  Homolog annotation: Hit_ID=Q1SML3; Match level="QueryCoverage=97%, HitCoverage=91%, E-value=0.0, Identity=36%"; Hit description =Tyrosine protein kinase, active site
  Pfam annotation: Domain name=LRR_1; Domain location=115-137; Score =20.2; E_value=0.0075; Accession=PF00560.23; Description=Leucine Rich Repeat
  Pfam annotation: Domain name=LRR_1; Domain location=139-161; Score =7.7; E_value=10; Accession=PF00560.23; Description=Leucine Rich Repeat
  Pfam annotation: Domain name=LRR_1; Domain location=163-185; Score =13.1; E_value=1; Accession=PF00560.23; Description=Leucine Rich Repeat
  Pfam annotation: Domain name=LRR_1; Domain location=187-209; Score =12.3; E_value=1.4; Accession=PF00560.23; Description=Leucine Rich Repeat
  Pfam annotation: Domain name=LRR_1; Domain location=19-41; Score =10.5; E_value=3.1; Accession=PF00560.23; Description=Leucine Rich Repeat
  Pfam annotation: Domain name=LRR_1; Domain location=211-233; Score =16.3; E_value=0.11; Accession=PF00560.23; Description=Leucine Rich Repeat
  Pfam annotation: Domain name=LRR_1; Domain location=235-256; Score =15.8; E_value=0.16; Accession=PF00560.23; Description=Leucine Rich Repeat
  Pfam annotation: Domain name=LRR_1; Domain location=258-279; Score =10.9; E_value=2.6; Accession=PF00560.23; Description=Leucine Rich Repeat
  Pfam annotation: Domain name=LRR_1; Domain location=43-65; Score =11.5; E_value=2; Accession=PF00560.23; Description=Leucine Rich Repeat
  Pfam annotation: Domain name=LRR_1; Domain location=67-89; Score=9.6; E_value=4.5; Accession=PF00560.23; Description=Leucine Rich Repeat
  Pfam annotation: Domain name=LRR_1; Domain location=91-113; Score =15.7; E_value=0.17; Accession=PF00560.23; Description=Leucine Rich Repeat
  Pfam annotation: Domain name=Pkinase; Domain location=389-662; Score =145.8; E_value=1.2e-40; Accession=PF00069.15; Description=Protein kinase domain
  Pfam annotation: Domain name=Pkinase_Tyr; Domain location=389-662; Score=79.4; E_value=1.1e-20; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::Pkinase::Pkinase_ Tyr; Domain location=115-137::139-161::163-185::187-209::19-41::211 -233::235-256::...
  Pfam module annotation: Domain location=258-279::43-65::67-89::91 -113::389-662::389-662
LADNNFIGQIPQNVCLGGNLKFFTAGNNNFTGQIPESLRKCYSLKRLRLQQNLLSGDITDFFDVLPNLNYIDLSDNSFHGQVSPKWGKFHSLTSLMISNNNLSGVIPPELGGAFNLRVLHLSSNHLTGTIPLELCNLTYLFDLLISNNSLSGNIPIKISSLQELKYLELGSNDFTGLIPGQLGDLLNLLSMDLSQNRLEGNIPLEIGSLDYLTSLDLSGNLLSGTIPPTLGGIQHLERLNLSHNSLSGGLSSLEGMISLTSFDVSYNQFEGPLPNILAFQNTTIDTLRNNKGLCGNVSGLTPCTLLSGKKSHNHVTKKVLISVLPLSLAILMLALFVFGVWYHLRQNSKKKQDQATDLLSPRSPSLLLPMWSFGGKMMFENIIEATEYFDDKYLIGVGGQGRVYKALLPTGELVAVKKLHSVPDGEMLNQKAFTSEIQALTEIRHRNIVKLHGFCSHSQYSFLVCEFLEKGDVKKILKDDEQAIALDWNKRVDIVKGVANALCYMHHDCSPPIVHRDISSKNVLLDSDDVAHVADFGTAKFLNPDSSNWTSFAGTYGYAAPELAYTMEANEKCDVYSFGVFALEILFGEHPGDVTSSLLLSSSSTMTSTLDHMSLMVKLDERLPHPTSPIDKEVISIVKIAIACLTESPRSRPTMEQVAKELAMSSRSSSMSPQTHTEMKD

SEQ ID NO: 225153 - protein, 94 aa, Glycine max
  Coding DNA Sequence Number=SeqID_108375
  Homolog annotation: Hit_ID=P03938; Match level="QueryCoverage=44%, HitCoverage=31%, E-value=4e-10, Identity=71%"; Hit description =Hypothetical 14 kDa protein ycf68
MSPHGGDMDGGEKRKERDGVSLAFGIAGPGGRPARRAISSVVERAPDNCVVVPGLIWTVISRAQFRFGINGKNGAPNNVSSQTKNYEIAPFILG

SEQ ID NO: 225154 - protein, 83 aa, Glycine max
  Coding DNA Sequence Number=SeqID_108376
MDRTQGIPRHGLSFRVKILEILSQKIAPKPKEDILFGGRSRIGDGVPMRMEPDRIRAFFLITLFWHTLTTLQPKLNANSNSNR

SEQ ID NO: 225155 - protein, 133 aa, Glycine max
  Coding DNA Sequence Number=SeqID_108377
  Homolog annotation: Hit_ID=Q9LU97; Match level="QueryCoverage=45%, HitCoverage=52%, E-value=2e-10, Identity=53%"; Hit description =Similarity to transcription-associated zinc ribbon protein
  Pfam annotation: Domain name=TFIIS_C; Domain location=93-131; Score =15.0; E_value=0.0022; Accession=PF01096.9; Description=Transcription factor S-II (TFIIS)
MSAEVVKNSWEKRAKESVVISKGEGSDFVAKVVDLAARELITSASLGQGLTVPRLPAMVVTQVQLDRAKDIRRELGMEIIEEHTVMEYSKVSKKCEKCGHGEATYYTRQMRSADKGQTTLCTCTGYGHPSQEN

SEQ ID NO: 225156 - protein, 92 aa, Glycine max
  Coding DNA Sequence Number=SeqID_108378
MSLLTREKEKWKNKKKTKKTWDEDWKRRHLQQYVEQPREWKMKRLEKRTYGTIRGATKGVRNEKPKRPKNQGNGPKNTWQQGDRKPTQPRRA

SEQ ID NO: 225157 - protein, 117 aa, Glycine max
  Coding DNA Sequence Number=SeqID_108379
GKDGHSHPRSRFMVNWDFGSRLVEWLDMIYVRTLVWPAVQGYRNDGDLLITGPVPARTCSGGWVPAGWPCIVGNALALVNELRRILEVVAVRLSPATGRPQTVVVSRPAPAWGCSTS

SEQ ID NO: 225158 - protein, 165 aa, Glycine max
  Coding DNA Sequence Number=SeqID_108380
  Gene Ontology: Mol. function=nucleic acid binding; Biological process= DNA integration
  Homolog annotation: Hit_ID=Q1SIP9; Match level="QueryCoverage=37%, HitCoverage=6%, E-value=6e-16, Identity=62%"; Hit description =Integrase, catalytic region
MRNPNTKGPLEVEEDIQLVEDGVQGIGSHIGMLHILQICMSEILVGVCWMRRGTTMGNIGNQRNEESIDEVSGSAEGKSLELGRKAIKRPSGSKTPNVGVDKLKRLLAFDSGCRKRWLVVISALGLDDGWGMWYKPLLSCHFRSGTLVFRSFTKKWSEKIQSRLG

SEQ ID NO: 225159 - protein, 215 aa, Glycine max
  Coding DNA Sequence Number=SeqID_108381
  Gene Ontology: Mol. function=nucleic acid binding; Biological process= DNA integration
  Homolog annotation: Hit_ID=Q1SIQ0; Match level="QueryCoverage=99%, HitCoverage=77%, E-value=5e-48, Identity=49%"; Hit description=Zinc finger, CCHC-type
  Pfam annotation: Domain name=zf-CCHC; Domain location=154-171; Score =10.2; E_value=0.021; Accession=PF00098.13; Description=Zinc knuckle
MESLVQYSPCGDQLILHAIISSVDYIVIIMLGNVKTSKEAWDILHKMFSDKTRAQIMHLSCFIKGSKPIYEYLNGIKSISDELVVISSPLKDVDLVIHTLNGLDAEYREPDSIATAHATGKVKHNYYKKSTQSRYNPNYSSSTGRSTSPNSKKVICQYCEKIGHTTKVCYKIHGYPYPPKHNNALATHHARVLLPSVTNWIMDFGAIHHITCDLD

SEQ ID NO: 225160 - protein, 150 aa, Glycine max
  Coding DNA Sequence Number=SeqID_108382
  Homolog annotation: Hit_ID=Q1T493; Match level="QueryCoverage=83%, HitCoverage=24%, E-value=2e-11, Identity=32%"; Hit description =Nucleic acid-binding, OB-fold, subgroup
VNGVVEEVVFHHVSGKGRRVVFKPKDLSQQLLSCTLWDDYCLQFLKDIPNYKVLLTHGRIKEAQGSYPPSVSNSFKASKLVINQPVMEIQEFIERLAELGIEARSVFKSHGEGSTQLSGSIQLSSKESFFGKAEAKTIAEINTISEVIIL

SEQ ID NO: 225161 - protein, 115 aa, Glycine max
  Coding DNA Sequence Number=SeqID_108383
ESHPQRHLVDPEKSNRALGFPALGSRLQDTQWTRRSPTGSWSCQALVTGLCQFYGVLVTSGKGIKPPTNRAFIKKYCVPRQAQGETPQQPEDGRQRATDAPPSPLEFTSTHPQKG

SEQ ID NO: 225162 - protein, 66 aa, Glycine max
  Coding DNA Sequence Number=SeqID_108384
MAFVETSAMARSQILPSPGICPLLRYNILATWRPTYAFKKATWTLRRFDKVRGSRRNSCMMQMQKA

SEQ ID NO: 225163 - protein, 67 aa, Glycine max
  Coding DNA Sequence Number=SeqID_108385
MDDLATEELIGSRDEIETLKMQKKQSKVMELVKQASASPNANALTSILVQATSHPQRLLFLTISRPP

SEQ ID NO: 225164 - protein, 149 aa, Glycine max
  Coding DNA Sequence Number=SeqID_108386
  Gene Ontology: Mol. function=translation elongation factor activity
  Homolog annotation: Hit_ID=Q0WL81; Match level="QueryCoverage=96%, HitCoverage=13%, E-value=7e-22, Identity=43%"; Hit description =Translation elongation factor EF-1 alpha
MKGQLSVTVDAAVETVSNKLGGLSIGENSGKTAAQGSTVIWKRKSYGTASGGNVTEVENGAGVDAGVASTQKSSGSGLSKIFCGNFLKNFTYSRAQVRATFYPKFENEKADQEAYSFCHKFSLFRNVRTRMIELVAKGLATIKIKNKED

SEQ ID NO: 225165 - protein, 279 aa, Glycine max
  Coding DNA Sequence Number=SeqID_108387
  Homolog annotation: Hit_ID=Q6ER39; Match level="QueryCoverage=46%, HitCoverage=16%, E-value=5e-43, Identity=66%"; Hit description=CTR1 -like kinase kinase kinase-like
MPRNVMDYAIVPSLASEMLRNFTDCVLTLLFNSRHVAKLHGLPNDGCQETRLKEIFDSIPTLDELHALGGEGLKADIILEDLEKDKKLYMLKKLIMALVRGLNSNPAAIIKKIVGLVSDFYKRPNVESPAKAALDESSHMFENRGVQMLGQIKHGSCRPRAILFKVLADTIGLESRLMVAQRHILAGLASVVGDLSAPYEKACHVHESPIVNWLWAVGCHSFGPFSNTSHISQMLLDVALMNALSICQNGFYLPRGISQISFFLSTEELNICPCGFCAS

SEQ ID NO: 225166 - protein, 238 aa, Glycine max
  Coding DNA Sequence Number=SeqID_108388
  Gene Ontology: Mol. function=binding; Cellular component=membrane; Biological process=multicellular organismal development
  Homolog annotation: Hit_ID=Q96301; Match level="QueryCoverage=76%, HitCoverage=17%, E-value=2e-67, Identity=72%"; Hit description =Probable UDP-N-acetylglucosamine--peptide N- acetylglucosaminyltransf erase SPINDLY
MDDSHMLTLVIQEMSKEFPTFMESLVHERDQYVEELVRLPDNFHCCTPSPKAGPVCLTPALCNGFVTFGSFNNLAKVVIFLNISCNYILIINSIVKVTPKVLQVWPKILCAIPNSLLVLKCKLFCYDSVRQRFLSTLEKLGLEPLRVDILPLILLNHDHMQAYSLMDISLDTFSYAGTTTTCEYLYMGVPCVTMVGSHAYNVGVSLLSKVVCLFNAHKCCPIMPLERKHVSLPSTPWF

SEQ ID NO: 225167 - protein, 119 aa, Glycine max
  Coding DNA Sequence Number=SeqID_108389
MEGRLLNGSLARRKEESGFYLHAKDDSELRGSSNGIIGSYHKWLRVRTQGLDWLPNLKTVRDDEVKASEESDEVQALKAELERAWVVEEKFKAAIVSSSSEEVKGIITGQRHDLEGQAK

SEQ ID NO: 225168 - protein, 117 aa, Glycine max
  Coding DNA Sequence Number=SeqID_108390
MVFKIHVLTNKSEKHHFKALDLKDGFLGDDKSLKGSISGTYRLKTEERRRTMKNGGKPSQNRPRKRLGSVTEAPRLGFSSRKQFFSLILTYSRNFTDCLTMGVKYLEVVKGGSHPNK

SEQ ID NO: 225169 - protein, 106 aa, Glycine max
  Coding DNA Sequence Number=SeqID_108391
MAKRGQGPFVLLRIAKNALSAPTALSLFIASEKISISKRTHQVDHMASKKRKSSTSSSSQIRFDRSRFHSQEAWDRYNDIVVPRKLLPERNVVVYHTEFDEFKEEF

SEQ ID NO: 225170 - protein, 77 aa, Glycine max
  Coding DNA Sequence Number=SeqID_108392
  Gene Ontology: Mol. function=subtilase activity; Biological process =proteolysis
  Homolog annotation: Hit_ID=Q2HV70; Match level="QueryCoverage=88%, HitCoverage=8%, E-value=5e-23, Identity=75%"; Hit description =Proteinase inhibitor I9, subtilisin propeptide
MACPHASGVVALLKATQPQSSAAAIRSALVTTASPLDNTQNSIRDYGYHAQYASPLAIGASQMDPNKALGSSKKAAR

SEQ ID NO: 225171 - protein, 327 aa, Glycine max
  Coding DNA Sequence Number=SeqID_108393
  Gene Ontology: Mol. function=DNA binding; Cellular component=nucleus
  Homolog annotation: Hit_ID=Q1SBB3; Match level="QueryCoverage=91%, HitCoverage=53%, E-value=1e-48, Identity=34%"; Hit description =Homeodomain-like
MVSKSYSEGRISLEEYITSLKSTVGLGLLAKAIGIGKGKEDLTHPTVEHVKKTQAAVWPHLLARGWHSEKLKNQGSLSSKNCVAFLFPGVKKFSRRKLMKGDHYFDSVSDVLSKVIAEPNLLKLEVEDAEIGSDKDGQPDNNHHRYLKHQASTNNGDHMKYAVFYAGLVHRGKSCKVNVDTDDITYNKGNKHISKTKHKKETARIYSKKNSSNANYQKGKHNRDATGQKEVNANPNDANKTTENHENQKTYVPNGNQPKRIIENQFSQITRSGHSDVAVPPIKRQRLTAWAKAETSHILKNSLGGLGSEKLGLSVILSSIKCQQESR

SEQ ID NO: 225172 - protein, 154 aa, Glycine max
  Coding DNA Sequence Number=SeqID_108394
MAQNSYTSISYIHYSIANPNLKHKTFPIIDHHIQTLLVLATQKAIFNHKEVDDVCWRSAEYERVVVVGRGGATQLASWPVDHGVTMCERVEVLRSDRERIEKWQSGIGVRQENPNPNPTLVNLGFAYQNRGRSGLGPAGSGPIVMPSWGRGMRS

SEQ ID NO: 225173 - protein, 75 aa, Glycine max
  Coding DNA Sequence Number=SeqID_108395
MELAAHFGGHGGVKEVKTELATNFRGHQKMHICSREVVVVSLRPWTFLDNNYGNKVISMFAIIKLLYVLVGNSFK

SEQ ID NO: 225174 - protein, 57 aa, Glycine max
  Coding DNA Sequence Number=SeqID_108396
  Homolog annotation: Hit_ID=P45456; Match level="QueryCoverage=68%, HitCoverage=7%, E-value=5e-12, Identity=82%"; Hit description =Isocitrate lyase 1
MAKHLDTIYVSGWQYSATHTMSNEPSPNLADYFYETVRNKPKAAGTNRGSAPAVETE

SEQ ID NO: 225175 - protein, 153 aa, Glycine max
  Coding DNA Sequence Number=SeqID_108397
MDIAKYEGHNQGKEDQPMSSIKCFKKMMIEAHSKTPVSVDACYKDFRDRKDLENMDDRKFYIQTTITKADDLPPEIYNWKLQQHSGLPQARQHPMQEQLDKRNIIKLDSSLFNKSIEDFTLSISKYRDKTGNTLLNCHVEDELNEDASPFSVL

SEQ ID NO: 225176 - protein, 64 aa, Glycine max
  Coding DNA Sequence Number=SeqID_108398
MVHDIFVKVKLEVTRTSTVLNVFGSRRSSDRKMQGSRMSEHENKRQMQERYVHYDATKRCLCDA

SEQ ID NO: 225177 - protein, 49 aa, Glycine max
  Coding DNA Sequence Number=SeqID_108399
MRLDVMVGDHGTQLYGAFLKDSRIILLDEATSDLDAEPIIEWCKRHFSP

SEQ ID NO: 225178 - protein, 97 aa, Glycine max
  Coding DNA Sequence Number=SeqID_108400
MYPPLELIHKRCALSCSQYNNPSSCTLYLYHKGCTLQCVKTKDSQAVNPLNLWEGKNQKNSQAVSPLNSLGKREGRHKIIQAVSPSILLAKGEANEE

SEQ ID NO: 225179 - protein, 113 aa, Glycine max
  Coding DNA Sequence Number=SeqID_108401
PIDNLAMQGRVVSLTGEFQARGEVCRVAGLQVVVRTLRVKSEVEEMGRILNNIVASRTVKMGSDSWASPAHCGLEPNSLSPWVRWAQPVDEINGDVEKEEEVVLDFTVHDSNV

SEQ ID NO: 225180 - protein, 58 aa, Glycine max
  Coding DNA Sequence Number=SeqID_108402
MMFMDEWSSSLGHASVYGFLEPQSIHNAKDRHIECQHYIKTWVKESQREVYLGAYLNQ

SEQ ID NO: 225181 - protein, 83 aa, Glycine max
  Coding DNA Sequence Number=SeqID_108403
MHAGKKETASPIGEFGLASTCGTECNGLATRIGDLTMQGSRFRGSFFRPWGYSQCYWRDDKDIASATGKITDIASGAGKINML

SEQ ID NO: 225182 - protein, 98 aa, Glycine max
  Coding DNA Sequence Number=SeqID_108404
  Gene Ontology: Mol. function=protein binding; Biological process =ubiquitin cycle
  Homolog annotation: Hit_ID=Q6Z7V6; Match level="QueryCoverage=46%, HitCoverage=14%, E-value=5e-13, Identity=65%"; Hit description=F-box protein-like
  Pfam annotation: Domain name=F-box; Domain location=8-56; Score=25.1; E_value=0.00025; Accession=PF00646.23; Description=F-box domain
MEEACEFRSWAELIPDALGVIFTNLSLQERVTVIPRVCKSWANVVTRPYCWWCYLSSKYLAWDFVAGGMGEYYVDDSDSYDGMWDDEARLDELQFGFY

SEQ ID NO: 225183 - protein, 431 aa, Glycine max
  Coding DNA Sequence Number=SeqID_108405
  Gene Ontology: Mol. function=receptor activity; Cellular component =integral to membrane
  Homolog annotation: Hit_ID=Q2R2X1; Match level="QueryCoverage=73%, HitCoverage=62%, E-value=1e-104, Identity=57%"; Hit description=Lung seven transmembrane receptor family protein, expressed
  Pfam annotation: Domain name=Lung_7-TM_R; Domain location=180-425; Score=120.2; E_value=6e-33; Accession=PF06814.3; Description=Lung seven transmembrane receptor
MSSRRACSTSPSLNPTHTKCPFETLKFLLTLLDFPSTTFASIHIYDHEPFRELGNSYLLAGGSEGIVASQANSIHDDGRSYIRFENITFRRTKASTKARGSVSLHIIIFEAVDRNDIGGSAYGGQREICCSSDLAKMRVCKQWEIIRRPFATNINWAVILDVQFKGRSKTASLNSQKVSITKTGMYNLFFVACEPKLKGIVMSGKTAWKNPYAYLPSRMAPLMSGKTAWKNPYVCLNIIWFFQYVRFWDDVLQLQHCIITVIALGLFEMILWYFEYVNFNNTGMRPIVLTTWVVTVGAIKKSISRLLILSVSMGYGVVRPTLGGLTSKVLLLGITYFLASEKFSNALAVTVISSVAWIGYEVDPSNNLPLECVIRRVFKSSERDECICCSALLTRNHWMFLVISAACATSNPDFRVMFVYAYNSALKIRIP

SEQ ID NO: 225184 - protein, 69 aa, Glycine max
  Coding DNA Sequence Number=SeqID_108406
MGRNVSALIGKSVPQIPEKCKDPANRSVAYPAGFIEDVLVRVGELIFPVDFYILNMEEGFSQGINSHHF

SEQ ID NO: 225185 - protein, 76 aa, Glycine max
  Coding DNA Sequence Number=SeqID_108407
MYFFEKRKIACGGELASSFASLCKEQLPMTKVLNMLQVENNSAHSLCESEMLKMQASFLMLTTAEILEVFSFKHHS

SEQ ID NO: 225186 - protein, 83 aa, Glycine max
  Coding DNA Sequence Number=SeqID_108408
METASPISEFGLASTRGAECNGLATRIGDLTMQESSHTFLGFRGSFFRPWGYSQCNWRDDKDIANGTSEITDIASGADEINML

SEQ ID NO: 225187 - protein, 160 aa, Glycine max
  Coding DNA Sequence Number=SeqID_108409
MGDSQENNKEKSRDKDNYVSWTMEDTNELLHLLVDAMNRGLRDANGSLSKQNVERIILPQLNAKTKFPKTYSHYLSRMKWFRNQYNMMSTLMRNNSGFGWDPIGKTFTAHEDVWKDYLKQWFFNYDTTSTANKKNCEFQSGKKNRCTCGPKSQVVVRRKA

SEQ ID NO: 225188 - protein, 494 aa, Glycine max
  Coding DNA Sequence Number=SeqID_108410
  Gene Ontology: Mol. function=oxidoreductase activity; Cellular component=mitochondrion; Biological process=electron transport
  Homolog annotation: Hit_ID=O80874; Match level="QueryCoverage=91%, HitCoverage=87%, E-value=0.0, Identity=73%"; Hit description =Putative NADH dehydrogenase
  Pfam annotation: Domain name=Pyr_redox; Domain location=242-342; Score=32.3; E_value=1.7e-06; Accession=PF00070.17; Description =Pyridine nucleotide-disulphide oxidor
  Pfam annotation: Domain name=Pyr_redox_2; Domain location=74-387; Score=89.7; E_value=8.8e-24; Accession=PF07992.4; Description =Pyridine nucleotide-disulphide oxidor
  Pfam module annotation: Pfam domain module=Pyr_redox::Pyr_redox_2; Domain location=242-342::74-387
  Subcellular localization annotation: CTP_CleavageSite=57; ConfidenceScore=5.59e-01
MAWLRNLSKFATMKRASSSSSQRPKNTDPFCLLPSFTFFSNFSTNTIEEKPCVKPVEYNNYSGLQPTRPHEKPRVVVLGSGWAGCRLMKGLDPRVYDIVCVSPRNHMVFTPLLASTCVGTLEFRSVAEPIGRIQPAISREPGSYFFLANCTQIDAHNHMVHCETVTEGVETIAPWKFTISYDKLVIALGSQPSTFGIQGVKEHAIFLREVHHAQEIRRKLLLNLMLSDVPGISEEEKQRLLHCVVVGGGPTGVEFSGELSDFITKDVRQRYVHVKDYIRVTLIEANEILSSFDDRLRRYATKQLTKSGVRLVRGIVKDVKPQKISLNDGSEVPYGLLVWSTGVGPLPMIQSLDLPKAPGGRIGVDEWLRVPSVQDVFSIGDCSGFVESTGRQTLPALAQVAERQGKYLAALLNKIGKAGAGHANSAKEIEFGDPFVYRHLGSMATIGRYKALVDLRQTKVIFSIPEILLVLQKHSVIHLPCSYRRQKGWLWQDF

SEQ ID NO: 225189 - protein, 612 aa, Glycine max
  Coding DNA Sequence Number=SeqID_108411
  Gene Ontology: Mol. function=growth factor activity; Cellular component=cellular_component; Biological process=regulation of progression through cell cycle
  Homolog annotation: Hit_ID=Q1EMP9; Match level="QueryCoverage=95%, HitCoverage=82%, E-value=2e-40, Identity=46%"; Hit description =Jacalin-domain protein
  Pfam annotation: Domain name=Jacalin; Domain location=23-154; Score =132.5; E_value=1.2e-36; Accession=PF01419.7; Description=Jacalin -like lectin domain
  Pfam annotation: Domain name=Jacalin; Domain location=250-381; Score =80.9; E_value=4e-21; Accession=PF01419.7; Description=Jacalin-like lectin domain
  Pfam annotation: Domain name=Jacalin; Domain location=462-595; Score =113.2; E_value=7.6e-31; Accession=PF01419.7; Description=Jacalin -like lectin domain
  Pfam module annotation: Pfam domain module=Jacalin::Jacalin::Jacalin; Domain location=23-154::250-381::462-595
MVFGVQSFEEKPVSVGPWGGNGGYRWDDGVYSTVRQLVIVHGEGIDSIQIEYDKQGSSIWSLKYGGSGGYKIDKIKLDYPEEFLTSVDGYYGSLNQWGPIFIRSLSFESNKKLYGPFGVEQGTYFSLPMTGGKIIGFHGRYGWHLDAIGINVKSSQQQKPSKALSFSQNYMTNTNDNASYSVIQGSVGQGYDIVLALKQKDDFGKSPTVKISSFKEPNNVEPKEKVVFVEKVPPMVEGVVTYGPWGGTGGYVFDDGPYTGVRQIDMSRNVGIVWIRALYDLDGEPVWGYKHGGAGGFKHEKIIFDFPYEVLTHISGYYGSLMYMGPAVIRSLTFHTTKRPYGPFGDEYGTYFTTKLREGKVVGIHGRSGLFLDSLGVHAIEGKVIVPVATAPSMEIISKEPNISEIDNPQRPVVAKPAPIEQHYIEEDILFTFAPYFTSQASRCVIKEPAPCGPGPWGGDGGRPWDDGVFSGIKQIYMTKAPEGICSIQIEYDRYKQSVWSVKHGGNGGNTMHRIKLEYPNEVLSCISGYYGSITADEQPIIIKSLTFHTSRGQYGPFGDEVGKYFTSTTTEGKVVGLHGRSSMYLDAIGVHMQHWLGGIQKTSKLSFFKLF

SEQ ID NO: 225190 - protein, 128 aa, Glycine max
  Coding DNA Sequence Number=SeqID_108412
SLQVVAPPGSILTVEQFLEKVSWPGTLPSLEREGGGPSAQVPQQVQDASSKTTIPEPFIFEVGETQPADPPTLVHEIPADPPTPLLDLPEDPSTLVLGLTTAPSATHVLHLTDEEGTQDEDTQSQDLS

SEQ ID NO: 225191 - protein, 161 aa, Glycine max
  Coding DNA Sequence Number=SeqID_108413
MAFLGETSSQTIVNSRLAFIYPNGSIIHNDTGVYFQTSTPVPIRVPNRCDFVSLKTRIHNTLQLSDKQFLDEIHYRKPFTDTDGIINLLERTMSRIHDAILYYNGKWNMPPQNKFVRCAFTGKNPKKFQIPSTCTIDELKNLIKQVAPKGIPPLGIHESQT

SEQ ID NO: 225192 - protein, 111 aa, Glycine max
  Coding DNA Sequence Number=SeqID_108414
MERYFQHLVRQQAANHRGQVQIHECLYQLSLSQQSQGFAPFACPTPDQFRAEVAWPGDWPEDQTEEALAGAPDGAEDARMDEEMTRFLGRKRSHVTEVTAFFDISVFFRFV

SEQ ID NO: 225193 - protein, 88 aa, Glycine max
  Coding DNA Sequence Number=SeqID_108415
MARGCFPNEYMMWNCPSSAYRWHETSFSNARNGSEKASAKRSRKDAAAEGTSAAPEFDSHRFRSAEHQQCFAGVGRRWSLPWPSLTQM

SEQ ID NO: 225194 - protein, 134 aa, Glycine max
  Coding DNA Sequence Number=SeqID_108416
LGFPALITGLCQSFGVLVTPSKVIRPPITQAFIKKYCTPRQAQDDAPQAADAPPPPHQADPAGSFGMERYFQYLVHQQAANHRGQFRTEVAWPRDWPEDQTEEAPAGAPDGAEDAHMDEEMTDLLGFLGGSGAT

SEQ ID NO: 225195 - protein, 97 aa, Glycine max
  Coding DNA Sequence Number=SeqID_108417
  Homolog annotation: Hit_ID=Q1T1Y0; Match level="QueryCoverage=52%, HitCoverage=12%, E-value=2e-07, Identity=54%"; Hit description =Ankyrin
  Subcellular localization annotation: CTP_CleavageSite=73; ConfidenceScore=5.17e-01
MDEPNSSLCIPPSKSEVTQGLHCRHTYGPSHWPVLAMATSGETINNSTKSSTASSVRRGWKSCNASTIGRWRRAATSSSMIEISPTGRWKLEVSRCH

SEQ ID NO: 225196 - protein, 184 aa, Glycine max
  Coding DNA Sequence Number=SeqID_108418
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=2e-20, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TLTLRRLHALAFRGLHALALRRLHAIAFRGLQALAVRGLYVLTSRGVHVLAFRGLHVLAFRGLHVLTFRGLHALVFRGLYLLTIRGLHVLTFRGLYILTFRGLHVLTFKGLHALSFRGQHVLSSKGLHVLAFKGLHILAFRGLHVLTFRGLHALAFKGLYVLAFKGLYVLTFRGLRVLTLRGLH

SEQ ID NO: 225197 - protein, 264 aa, Glycine max
  Coding DNA Sequence Number=SeqID_108419
  Gene Ontology: Mol. function=receptor activity; Cellular component =outer membrane-bounded periplasmic space; Biological process =glycolysis
  Homolog annotation: Hit_ID=Q1LEV4; Match level="QueryCoverage=60%, HitCoverage=48%, E-value=9e-59, Identity=67%"; Hit description =Uncharacterized protein UPF0065 precursor
MALRSAVDTASARNWPDCTNGRPDARSALRRALVGHVQDVDPGAVGQRGAGHDAGAVAAGVGNAARVLARIGHQVGHGLPGPLGVDHQDEGQVAAARDGREVLDRVVGNVLHQPGRGRVRGVGGDEQRVAVRLGARDVAGGDGGVGAGLVLDHDLLSQDGRQLGAKDAPDGVGARAGRERHDQRDGFVRIVRGMGSGQGQQAGAAEQGGAQQAVKLHGLSLQMVGNRAQLLRPLPGDAGGPGASGAGCGRGKTADDAVGRFFVG

SEQ ID NO: 225198 - protein, 55 aa, Glycine max
  Coding DNA Sequence Number=SeqID_108420
  Subcellular localization annotation: CTP_CleavageSite=33; ConfidenceScore=5.04e-01
LISGLSAHPPLSAASARQKNLARHHHHQGRALSARPGSAKREGSAKHNVTNSEPI

SEQ ID NO: 225199 - protein, 93 aa, Glycine max
  Coding DNA Sequence Number=SeqID_108421
MASGNRLPRVARRASGNRLPEDVIDYQASKGNWEIVEASGNRLPVCVINYTEEWVTGNRLPGFHVLKLCNSSLASGNRLPRLCNRLPEMKSFK

SEQ ID NO: 225200 - protein, 82 aa, Glycine max
  Coding DNA Sequence Number=SeqID_108422
MSASQFGGECAYCNFLAVEESEYAFMDVVESNSLEIGSTNVDSDSSEMELDMGDEMTTLSILVSIMHIFLMKNKQEQQQKMQ

SEQ ID NO: 225201 - protein, 64 aa, Glycine max
  Coding DNA Sequence Number=SeqID_108423
MGCFLCFRSHSLILGYGEFVPNRRTARKPHYKRNLKESWASSSKGNNTRKSSLPWIQTENAIET

SEQ ID NO: 225202 - protein, 98 aa, Glycine max
  Coding DNA Sequence Number=SeqID_108424
MRVHDGATPDSTVGALKNSARNYPVVKSKHDHWGTLAGRRKRHAITMWKREVVQMRWAFLFTPLLKPQHPRVPTHKLIRQLQLPPGRCILEPGGTKSK

SEQ ID NO: 225203 - protein, 71 aa, Glycine max
  Coding DNA Sequence Number=SeqID_108425
MALQLMGTDQKCALAARRLKMLDPKYYATLYAAQLEMLYYFFEPFLAEIIKKVQTGFYKDFDAIYNDLKDR

SEQ ID NO: 225204 - protein, 143 aa, Glycine max
  Coding DNA Sequence Number=SeqID_108426
  Homolog annotation: Hit_ID=Q7N6J8; Match level="QueryCoverage=95%, HitCoverage=93%, E-value=1e-40, Identity=55%"; Hit description =Similar to Hcp protein
  Pfam annotation: Domain name=DUF796; Domain location=2-127; Score =90.0; E_value=7.2e-24; Accession=PF05638.2; Description=Protein of unknown function (DUF796)
MVGSCLVSGREGAIELKSFTHNVNIPVDGNTGKLTGTRIHMPVMFQKEFDRVTPFLFRALSTGRTLQSATIKMYQINEAGLEQEYFNIIMENVKITSITPDLYPGANTGTYLETVLIRYEKITWKHCDGNVIYSDAWNERATY

SEQ ID NO: 225205 - protein, 74 aa, Glycine max
  Coding DNA Sequence Number=SeqID_108427
  Subcellular localization annotation: CTP_CleavageSite=29; ConfidenceScore=5.07e-01
MSIGFNDEICAISAHQWAKRASTAKCSFSATEESGRASISRPCAKREISVLSTTVVFSQAQRTSGAKLKSPYLH

SEQ ID NO: 225206 - protein, 452 aa, Glycine max
  Coding DNA Sequence Number=SeqID_108428
  Gene Ontology: Mol. function=transferase activity, transferring nitrogenous groups; Cellular component=chloroplast; Biological process=histidine biosynthetic process
  Homolog annotation: Hit_ID=Q2L2S9; Match level="QueryCoverage=53%, HitCoverage=64%, E-value=1e-101, Identity=77%"; Hit description =Histidinol-phosphate aminotransferase precursor
VRQVADRCQHPVVRAGVHVDHIGATGPPGLAHQGDGGGAVFGQRRQDDAAPLVQTGVGGFGAAALGAGDGMPRHELAEARAQRQAGGVDHLGLGAAAVGQQRGVAQMRQHARQHVLQAAHGGGQEHQVGAGGGVFGADGFVNQAQLDRARQRLRIAAHAQHPSDLPRPAQRRGEGSADQAHADDGQHRNQGASGPLIRLGGSAVHSDRMAADGHAQPLGQAVAGHRTHDHAALEQRQVDARRVAHVHQHEVAVAWHVAQLEAVERFAQLRLAGLVGRVRLFQVGGIAQRGHGGGLRQRVDVERLAHAVEQVGQGRLGHREAHAQARQAIGLGEGARDDQVGIAAHQRGAVEPELRFQVFVVGLVQHHRDPIAMGGMDALQERGHLVARHEGAGGVVGVGDEQEARVVGDGVEHGVQVMAVVLGRHHDVARAAGLRGQTIDRERMLRVDRRGA

SEQ ID NO: 225207 - protein, 75 aa, Glycine max
  Coding DNA Sequence Number=SeqID_108429
MDFRLARVGVLSARRDNVLIGRSDYALGEQISILSSFRVSYPLSELDASLSGCISLSESVSLSESSAAFAFSSLT

SEQ ID NO: 225208 - protein, 176 aa, Glycine max
  Coding DNA Sequence Number=SeqID_108430
  Homolog annotation: Hit_ID=Q1T2D5; Match level="QueryCoverage=70%, HitCoverage=7%, E-value=1e-30, Identity=51%"; Hit description=Chromo
MMENRNKEYAARFETLETTLEMTLKDKTRDPGSISLAMNNHPFKVVPWYQMMTRENSFKTWIAFMRALETEFGPSPCECPRSQLFKLTQIGSVQSYYVQFTALANRVQGITQEALLDCFVGGLKPNIRMDVIAQSPTSLLRTVSLAKLYEEKYTPKLKPFSSSFSPKHKPQTQTQT

SEQ ID NO: 225209 - protein, 144 aa, Glycine max
  Coding DNA Sequence Number=SeqID_108431
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=52%, HitCoverage=12%, E-value=8e-19, Identity=60%"; Hit description=E3 ubiquitin ligase PUB14
LRQGDPLAPLLFHLVAEGLTGLMRVIRIGSPRNRENVAAVLWSLCTGDPLQLKLAKEHGAEAALQELSENGTDRAKIKAGSILELLQRMEGGPAIKSAATAEPGSQNGKKLEGGRWGEVKILGGPLDTKCYTINGQIAKAVPNF

SEQ ID NO: 225210 - protein, 334 aa, Glycine max
  Coding DNA Sequence Number=SeqID_108432
  Gene Ontology: Mol. function=beta-alanine-pyruvate transaminase activity; Cellular component=cytosol; Biological process=amino acid metabolic process
  Homolog annotation: Hit_ID=UPI00003CC8DC; Match level="QueryCoverage =77%, HitCoverage=59%, E-value=2e-94, Identity=65%"; Hit description =COG0161: Adenosylmethionine-8-amino-7-oxononanoate aminotransferase
MGRGEGAVDAAEGADDFVEDQQDAVPVADLAQLLQVAARRHQHAGGTRHRFDDDGGDGRGVMQRDDAFERIGQVRAPVRLAAAVGHLFAVIGMRQVVDIGQQVAEGLAMPADARHRQAAEAHPVIRTFAADQAHALAFAARAVIAQRDLEGGVDRFGTGVRKEHLRVAGRRLLAQPFGQLERLWMAHLERRRIVQVVGGARDGLDDLRAPMASVDAPQAGDAVQHAAAVGADVVHALGRAEQHRIALVAPVGGEGHPIGVGIEGRRRKRRGRGHGFLLQGSSGRIWRDRRPRIPRGGAPAGKCVDDEGGTDKDGAMARERGITIAAARSSGVRA

SEQ ID NO: 225211 - protein, 261 aa, Glycine max
  Coding DNA Sequence Number=SeqID_108433
  Gene Ontology: Mol. function=protein binding; Cellular component =integral to membrane; Biological process=protein amino acid phosphorylation
  Homolog annotation: Hit_ID=Q1SWI6; Match level="QueryCoverage=83%, HitCoverage=96%, E-value=5e-46, Identity=48%"; Hit description =Leucine-rich repeat, plant specific
  Pfam annotation: Domain name=LRRNT_2; Domain location=27-67; Score =49.3; E_value=1.3e-11; Accession=PF08263.3; Description=Leucine rich repeat N-terminal domain
  Pfam annotation: Domain name=LRR_1; Domain location=120-145; Score =10.2; E_value=3.5; Accession=PF00560.23; Description=Leucine Rich Repeat
  Pfam annotation: Domain name=LRR_1; Domain location=147-169; Score =14.5; E_value=0.38; Accession=PF00560.23; Description=Leucine Rich Repeat
  Pfam annotation: Domain name=LRR_1; Domain location=171-193; Score =0.6; E_value=2.2e+02; Accession=PF00560.23; Description=Leucine Rich Repeat
  Pfam annotation: Domain name=LRR_1; Domain location=195-220; Score =8.8; E_value=6.5; Accession=PF00560.23; Description=Leucine Rich Repeat
  Pfam annotation: Domain name=LRR_1; Domain location=222-244; Score =14.2; E_value=0.49; Accession=PF00560.23; Description=Leucine Rich Repeat
  Pfam module annotation: Pfam domain module=LRRNT_2::LRR_1::LRR_1::LRR_ 1::LRR_1::LRR_1; Domain location=27-67::120-145::147-169::171 -193::195-220::222-244
MNSSSIYILVFVQLWLFSLPCRESVCIPSERETLLKFKNNLIDPSNRLWSWNHNHTNCCHWYGVLCHNLTSHLLQLHLNTSDSAFYHDHDGYLYSDFDEEAYEKSQFGGVISPCLADLKHLNYLDLSGNGFLGEGMSIPSFLGTMTSLTHLDLSHTGFYGMIPPQIGNLSNLVYLDLSSDVANGTVPSQIGNLSKLRYLDLSANIFLGEGMSIPSFLGTMTSLTHLDLSGTGFMGKIPSQIWNLSNLVYLRLTMAIKYVEA

SEQ ID NO: 225212 - protein, 248 aa, Glycine max
  Coding DNA Sequence Number=SeqID_108434
  Gene Ontology: Mol. function=iron ion transporter activity; Biological process=high affinity iron ion transport
  Homolog annotation: Hit_ID=Q5DQI7; Match level="QueryCoverage=100%, HitCoverage=74%, E-value=1e-115, Identity=83%"; Hit description=EitA
  Pfam annotation: Domain name=Peripla_BP_2; Domain location=40-248; Score=-43.4; E_value=0.042; Accession=PF01497.9; Description =Periplasmic binding protein
MKKVICTLCLVFASVSSALATTYPLTIENCGYKETFTKPPERVVALGQNTAEILLLLGLQDKVIASAFWPTKVLPQLAEQNAKIKTLTVEIPTLESVLAQNPDFVPAQTPLLLGPESKVAKREDLITLGVNSYVSPGMCATKKAAGDMYGSRQQLWDMTYLYQEIQDFAKIFNVEDRGQAVIADFKKREAALRQEFGSSKKDLSFVFWFSSSSPSADAYVGGKNSPSGFIASVLGGHNAITSETEWPT

SEQ ID NO: 225213 - protein, 70 aa, Glycine max
  Coding DNA Sequence Number=SeqID_108435
  Subcellular localization annotation: CTP_CleavageSite=32; ConfidenceScore=5.20e-01
MGTLRCQREIVSLSYHRHGPARIAYRTFCKSRSAASRSPFPTGVTYSMRRACQASIRFAAPGYRRPPIQA

SEQ ID NO: 225214 - protein, 138 aa, Glycine max
  Coding DNA Sequence Number=SeqID_108436
  Gene Ontology: Mol. function=chitin binding; Cellular component =extracellular region; Biological process=chitin metabolic process
  Homolog annotation: Hit_ID=Q86AI8; Match level="QueryCoverage=96%, HitCoverage=35%, E-value=8e-18, Identity=35%"; Hit description =Similar to Homo sapiens (Human). Mucin 2
  Subcellular localization annotation: CTP_CleavageSite=40; ConfidenceScore=5.62e-01
ARTCSPLKARTCSPLKVRACSPTKVKVPGPSKVRACSPLKARTYSPLEVRACSPLMVRACSPLKARTCSPLEVRAYSPLMVRTCSPLKVRACSPLMVRTRSPLKARTCSPLMVRACSPLMVRTRSPLKARTCSPLNGE

SEQ ID NO: 225215 - protein, 41 aa, Glycine max
  Coding DNA Sequence Number=SeqID_108437
MARNVFAPCPYLRDLYGKELTRLLVITPQEVSSPSKNILQQ

SEQ ID NO: 225216 - protein, 132 aa, Glycine max
  Coding DNA Sequence Number=SeqID_108438
  Subcellular localization annotation: CTP_CleavageSite=74; ConfidenceScore=5.05e-01
MSISPRGSISWDRAHKAPSGPEEVQQGPGVSSSGYRPLSFLQGARPPNKGSCPQDTQWTRRSPTGPWGFQLWLRASVSPTGCPIPPARNHARKTPSGPKEVQQGLEVPSTDYGPLPILRSARRPQQDHQAPH

SEQ ID NO: 225217 - protein, 167 aa, Glycine max
  Coding DNA Sequence Number=SeqID_108439
  Gene Ontology: Mol. function=DNA replication origin binding; Biological process=regulation of DNA replication
  Homolog annotation: Hit_ID=P69931; Match level="QueryCoverage=99%, HitCoverage=67%, E-value=4e-81, Identity=89%"; Hit description=DnaA -homolog protein hda
  Pfam annotation: Domain name=Bac_DnaA; Domain location=2-151; Score= -123.6; E_value=0.024; Accession=PF00308.9; Description=Bacterial dnaA protein
MSARGEAVGYVPLDKRTWFVPEVLEGMENLALVCIDNIECIAGEAEWEMAIFDLYNRILETGKTRLLITGDRPPRQLNLGLPDLASRLDWGQIYRLQPLSDEDKLQAMQLRAGLRGFELPEDVGRFLLKRLDREMRTLFDTLDRLDRASISAQRKLTIPFVKEALGL

SEQ ID NO: 225218 - protein, 185 aa, Glycine max
  Coding DNA Sequence Number=SeqID_108440
MPIARTKVSVGLCRPDMGIAPTKTPSGPEEVQQGPGISILVTGLCRPYRAPVPPSKFMSSWHRDCARKTPSGPEEGQQGLGVASSKYGSLSVLGSACRPQQIHQAPLPIELSSRSTAPQAGAGRNTTAALGWPVAGNRHTATTSRVHLSSSTKRLERCLRHMADQQATKSKAKGKQSTRSVTDKS

SEQ ID NO: 225219 - protein, 193 aa, Glycine max
  Coding DNA Sequence Number=SeqID_108441
MPTGRKEAISFLWVLSLHDKSFQGSENLSTRVGPCKAKQKWSSRSTKEVFGGKGQRPWQNQGEWASFIDILALLIFGVVLFPNMEGLVDLAVIDAFLAYHNHKESPVVAILAMYDTFNRGCRPVYPLQGHRSCIEKGKANWDQLLASMERRLLIGSLAGRKEESGFYLHAKDVQMSLDGTRGCINYNPVLVIR

SEQ ID NO: 225220 - protein, 773 aa, Glycine max
  Coding DNA Sequence Number=SeqID_108442
  Gene Ontology: Mol. function=DNA binding; Cellular component=beta -galactosidase complex; Biological process=DNA integration
  Homolog annotation: Hit_ID=Q1S1E0; Match level="QueryCoverage=94%, HitCoverage=98%, E-value=1e-162, Identity=48%"; Hit description =Integrase, catalytic region
  Subcellular localization annotation: CTP_CleavageSite=49; ConfidenceScore=5.31e-01
MATSGSSGEDDSTPPPPPSFTDPSQNPANPFYIHHSENPTSVIVTPPLTANNFQSWSRSFRMALISKHKMGFLNGSIPIPQPTDSIYSSWDMLLIFGMTSVNASLKVICFESPNCRRKSMLLNKPLSVTDYYSTLKSLWEELDNYRPLPPCSCSAKTYHQQDFIICFLKGLDERFAMVRSQILLLDPLPSANRVFSMIIQHEQQHSNPASSALNTNSFVNAVFGKGRGNPQQGGDQINTHCNKLGHTSDVCYSKFGYPPGHPKYPGRPRLSNNKYTSGGRTTSSGGGAVNNAKVGTPTHGGESKKESSTQDHGFHITMAQYQQLMNLLSKSSRPDGSIERYKARLVAKGYSQIEGIDYFETFSPVVKMATVRVVLALASINRWHLHQLDVSNAFLHGYLRKDVYMEIPPGLLGYTSSQSCKLKKSLYGLKQSSRKWYEKLSTLLLTCGYSHAHADHSLFIKAHNSEFTALIVYVDDIVLTGNSLAEIEHIKRTLHTNFHIKDLGKLKYFLGLEVAHSDKGISLCQRKYCLDLLKDSGMLGFGRLVYLTSTRPDIAFATQQLSQFMSKPTKAHHAAAVRVLRYLTGCPGQGLFFPRTCSPHLLGFSDADWATCIDSRRSITGYCFFIGNSLVSWKTKKQTTVSHSSSEAEYRALASATCELQLLSYLLRDLRIPLSKTPVLYCDNHSALHIAANPVFHERTKHLDIDCHLVREKSQAGLMLLLSVPSSNQLADIFTKALPPQSFNTNLSKLQLQNIFAPPTSDVAAIPVAIALQ

SEQ ID NO: 225221 - protein, 228 aa, Glycine max
  Coding DNA Sequence Number=SeqID_108443
  Homolog annotation: Hit_ID=Q9FYR2; Match level="QueryCoverage=39%, HitCoverage=64%, E-value=2e-08, Identity=41%"; Hit description =Arabidopsis thaliana genomic DNA, chromosome 5, BAC clone:T13C12
MQNGINRQKSLKEKLKSSLCCFSGTVHSDPLERGEGGFFYDKLRIPKTPISPQGSTSSSWFKIMSPTSTNFGDPHPRVRGRSLKSRMGRKLLHHRQSQSADFSYDPSSYALNFEDDSPQEFPFRNFSSRLPSSPSPVDYSTGGKEIVGDWTKTNEFNGGTERSEEGFVVNICEAPFLCSPNSNNGTTSLTPMTSPPHVPLPDSGDQIPTTSALTFASTSWSDSSNDTA

SEQ ID NO: 225222 - protein, 91 aa, Glycine max
  Coding DNA Sequence Number=SeqID_108444
  Subcellular localization annotation: CTP_CleavageSite=33; ConfidenceScore=5.65e-01
MAYAKRSSRAKQTLWAQHASTAKRNFNTLSVTRESGRAQESRPRAKCEISSLSETLSLARLSARLAPSPNPLTRAKREGGTKRNVVISKPI

SEQ ID NO: 225223 - protein, 105 aa, Glycine max
  Coding DNA Sequence Number=SeqID_108445
MASTSSSKPKEQKNAQISDEKTLSCSLLGLFTCSSGLLPKKETNKNGKLLRNEKSNTQLQYDSASYALNFDDGAQKDDAGFPCFADRYANPMGHKSATGVNKETK

SEQ ID NO: 225224 - protein, 74 aa, Glycine max
  Coding DNA Sequence Number=SeqID_108446
MNIKIIKTKTKIRERGTGHRVLCLAPLTLWDLAIGAHNYEGMGWFIDEVTNLFSGDCCYATPFHYASCLDFLFA

SEQ ID NO: 225225 - protein, 58 aa, Glycine max
  Coding DNA Sequence Number=SeqID_108447
MEKHTGCSDNRGRDEVLCGSRSLNDSGTFSAASMVVVARRKRTKEKRLSVVKVVDLSG

SEQ ID NO: 225226 - protein, 63 aa, Glycine max
  Coding DNA Sequence Number=SeqID_108448
  Homolog annotation: Hit_ID=Q1RYE3; Match level="QueryCoverage=75%, HitCoverage=5%, E-value=8e-10, Identity=64%"; Hit description=IMP dehydrogenase/GMP reductase
MIHLHVDVAIKKAKEVVTASKEVEKFFEDLTVELITAKESLDTTHGAHLEAEEQRIEFQEMGF

SEQ ID NO: 225227 - protein, 350 aa, Glycine max
  Coding DNA Sequence Number=SeqID_108449
  Gene Ontology: Mol. function=RNA-directed DNA polymerase activity; Biological process=RNA-dependent DNA replication
MSLLPLARSVNSIDRSKQCRYHQNYGHTTKECVALKDMIEELIQEGTLNNYTYRATHCKYGHTTKEFQDISCNSHSSYSANPQSQVAIIPICLRLDNKLDPFVRSQEVPSKGSTWSTSWSSSFPMKATTNVSGHYTLMELQTTKVVVLGFNNQAEYKAFIAGLKLAKENNDRANALAFLGSTKKSGQHITLIQETKHQAQTLLKSYLIKSFEVFRCLQYGPTSSTIFYLQKKWNEDHTQYVIVEVHRGIYGMHTRGRNMATQVIHVGYYWPTIRVDYVEYIKKYKEHQEFNNIQHAPLKELHSLTSPWPFGIWGMDILSPFLVAKGQIKFLLVANYFTKWIEETLATIMT

SEQ ID NO: 225228 - protein, 320 aa, Glycine max
  Coding DNA Sequence Number=SeqID_108450
MNELVRGVEVIGVEGNKNGHIQNDEVDVGDSRKDTFPPVTIPGYEWVSREVNSYCTCFQTPDSIATFKKEVDMTIYDDFESLVVEHCTSDDRVFLKASKIMKGYDYKSLRAFVTNDQANPPLGGSDFIGDDIVGGGKLVPQHHIIDFTDRTNKVILHYYQGKLCRLDHVLVAPNIISLWNAELIAVIWHWKEIVATADERIKLMSELLKIMKVEVSKIEQLGVALAKITTLEKSVMDAKTKLEELSLELVVEQNKSKTIEDEKKIDEDNLTSANEELANLTKVMENLESKLQNKYKIKSDLDTKLEESMVRLLENLNLLR

SEQ ID NO: 225229 - protein, 95 aa, Glycine max
  Coding DNA Sequence Number=SeqID_108451
MSGVSIPNRLAYRSNPEETKESQRQVESLMEKGWVRESLSPCAMPIILVNRTLSQLLRCLVDAWLHLGNYIWKKGDLTAAKKCLSLALDKAYHTM

SEQ ID NO: 225230 - protein, 79 aa, Glycine max
  Coding DNA Sequence Number=SeqID_108452
  Gene Ontology: Mol. function=protein serine/threonine kinase activity; Cellular component=membrane; Biological process=protein amino acid phosphorylation
  Homolog annotation: Hit_ID=Q94KG6; Match level="QueryCoverage=88%, HitCoverage=41%, E-value=5e-23, Identity=73%"; Hit description=Pto -like kinase SG5
MQKGPLWDHLYNTNLPSLSWNQRLGICIGAAKGLHYLHKGVVVRGIIHHDVKSSNLLLDENHVAKVADFGLWGILNLNI

SEQ ID NO: 225231 - protein, 195 aa, Glycine max
  Coding DNA Sequence Number=SeqID_108453
  Homolog annotation: Hit_ID=Q8S8B4; Match level="QueryCoverage=36%, HitCoverage=6%, E-value=8e-12, Identity=50%"; Hit description =Putative chromosome associated protein
MARVAKEEERGSPSWGASFFTQTTQDVARAVAAAVNSQRPCVVYAFKNDHGGSQLQRLQFTEFGGPIHKRLVQDLAFAAARFIIRGRSFVNYYMVSWLKLIQKSMTLASTLRNQFWTNINRRKLEITTLESVIAQSHEGLNRYKEERDKLHGERKSLWGKENKLTAEIDKLRAEVEKAEKSLDHHAIPGVSNPSF

SEQ ID NO: 225232 - protein, 91 aa, Glycine max
  Coding DNA Sequence Number=SeqID_108454
  Subcellular localization annotation: CTP_CleavageSite=36; ConfidenceScore=5.05e-01
MAISPYESIGWSLPSRHRDRAHKTPSGPREVQQGPRVSRSSYRPMSVLQGACLPQQGHVVVTLFYRVAHHPQQGHQAPINRAFIEKYCAPR

SEQ ID NO: 225233 - protein, 375 aa, Glycine max
  Coding DNA Sequence Number=SeqID_108455
  Gene Ontology: Mol. function=nucleic acid binding; Cellular component= membrane; Biological process=DNA integration
  Homolog annotation: Hit_ID=Q1S1G2; Match level="QueryCoverage=78%, HitCoverage=23%, E-value=8e-53, Identity=35%"; Hit description =Integrase, catalytic region; Zinc finger, CCHC-type; Peptidase aspartic, catalytic
  Pfam annotation: Domain name=zf-CCHC; Domain location=230-247; Score =7.3; E_value=0.061; Accession=PF00098.13; Description=Zinc knuckle
  Pfam module annotation: Pfam domain module=Retrotrans_gag::zf-CCHC; Domain location=59-166::230-247
  Subcellular localization annotation: CTP_CleavageSite=66; ConfidenceScore=5.22e-01
MSGSASNTSNPGSDENSSNPPPDPTQNPSSPYHIHPSESPSSVIIAPALVGNNYHSWSRSFHMALVSENKMGFLNAQSVIYLDRAIDIWTNLREHFSQSDLLRIAELQEEVYAFKQGTRNVTDYITGLKALCEELDNFRPMTACGCSAKTYHTQDFIIRFLKGLDDHFSVVRSQVLHMDPLPSVNRIFSMVIQHECQQPDAVFSTNEPNSFANAAMDRARSTTNKANSSKKCGYCHRLGHTMDVCYSKHGYPPGHACYPGRPKFNPHTGSLANSAVSDASYAKEKETNEGFTQDSGLNLTKVQFQHLISLLQHTPPSGSSSSVDNNQPKSVNLSLKSPIPSPGSNLGILLFFAPPHTSFLTHMQCLFLHTPPPGL

SEQ ID NO: 225234 - protein, 216 aa, Glycine max
  Coding DNA Sequence Number=SeqID_108456
MQSGSQSEPFDVDMGDRLEDMIRDLGQESFQQAHAPMYEGLHSDSKKPLYTRKWALTADMDGVDDTVCEKYNISKEKWAQFCQTCRDPSWEDVRKKAQAIQKQNIAPHVLSRGGYEYLEQKLMAEKKKERLEEAAQSGSTEGVIDPLSSRAQRTIWAQRASDAKRSFSVLSVTRESGRAQESRPRAKREISLLSETFVFSQTQRMTGTKLKSTNSC

SEQ ID NO: 225235 - protein, 231 aa, Glycine max
  Coding DNA Sequence Number=SeqID_108457
MARTNKTGQMTSEAAKEIAEKIASQGSFVPHGRQDVLTVSIGRPEHSGRVHAILRIDSTNLPQFFLHGLALPPEPEVGPSGARASTKESCVDPSGNDPKTGDSDKCGLYIEENHSRLVVLGRLYEGSTTVHNISLLHGQVKFGVEEALNTFFAWPTHLVKHLSEQVVVFPKKPPESPDPEVDDPLYLMTLTIPQLFLKPLQVMWDATVFRVFNQNFPLYIKHENLSEIAHG

SEQ ID NO: 225236 - protein, 107 aa, Glycine max
  Coding DNA Sequence Number=SeqID_108458
  Gene Ontology: Mol. function=transition metal ion binding
MQSGSQSEPFDVDMGDRLEDMIRDLGQESFQQAHAPMYEGLHSDSKKPLYTRYKNSLTLLSASDKSFTSLLQVVHELLPEENMLPRSYYQAKKILCPMGDQEMGTYS

SEQ ID NO: 225237 - protein, 434 aa, Glycine max
  Coding DNA Sequence Number=SeqID_108459
  Gene Ontology: Mol. function=sequence-specific DNA binding; Cellular component=nucleus; Biological process=regulation of transcription, DNA-dependent
  Homolog annotation: Hit_ID=O04136; Match level="QueryCoverage=93%, HitCoverage=100%, E-value=1e-152, Identity=69%"; Hit description =Homeobox protein knotted-1-like 3
  Pfam annotation: Domain name=ELK; Domain location=308-329; Score =33.7; E_value=6.2e-07; Accession=PF03789.4; Description=ELK domain
  Pfam annotation: Domain name=Homeobox; Domain location=330-387; Score= -11.0; E_value=0.07; Accession=PF00046.19; Description=Homeobox domain
  Pfam annotation: Domain name=KNOX1; Domain location=142-186; Score =70.4; E_value=5.7e-18; Accession=PF03790.4; Description=KNOX1 domain
  Pfam annotation: Domain name=KNOX2; Domain location=196-251; Score =106.0; E_value=1.1e-28; Accession=PF03791.4; Description=KNOX2 domain
  Pfam module annotation: Pfam domain module=ELK::Homeobox::KNOX1::KNOX2 ; Domain location=308-329::330-387::142-186::196-251
MAYHNHHNLSQQDLPPLHHFPNQSMLPDQQLLPSSPEPNSKPPSDPHPLQTAPNWLNDALLRTHYTDTTNTATVATNSNVNVKVNGSNFLKLNPGASDAQWLARPALHRHPGEVIDDGAGESMVEHADLKDGGGDAVSWQIGRCKTEILQHPLYEQLLSAHVACLRIATPVDQLPRIDAQLAQSQNVVAKYAVFGHNNIVADDKELDQFMSHYVLLLCSFKEQLQQHVRVHAMEAVMACWELEQSLQSLTGVSPGEGTGATMSDDENDQVDSDANLFDCSFDGADSMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTALKSKRKREKIRVVALQRLLGMKREVLAEDPRSAPSQ

SEQ ID NO: 225238 - protein, 110 aa, Glycine max
  Coding DNA Sequence Number=SeqID_108460
MESSTGSTRVLSENTKEEEDLLLRSTRKVKCKPSEGEADRHMEVEDKGEGIKVANPYKEKLLMNGGVVPFSQYDKHFFGQLDMEIPTLPLLKKDKDCFPKIPISNEEFMD

SEQ ID NO: 225239 - protein, 69 aa, Glycine max
  Coding DNA Sequence Number=SeqID_108461
  Pfam annotation: Domain name=zf-CCHC; Domain location=33-50; Score =10.0; E_value=0.022; Accession=PF00098.13; Description=Zinc knuckle
MELFNDQFLDKPLQPKIIVRVYLLSLQYEGLHSICFLYGKYGHKEAQCLERNAMPMMQKGNDGSSSMVA

SEQ ID NO: 225240 - protein, 70 aa, Glycine max
  Coding DNA Sequence Number=SeqID_108462
MGVRINGGGNIPGRIDKEDSKNEVGSWSSKQDQEKDKASKISLVDQAFASKHIVSNIQGSGNRLPGSVID

SEQ ID NO: 225241 - protein, 197 aa, Glycine max
  Coding DNA Sequence Number=SeqID_108463
  Gene Ontology: Mol. function=RNA-directed DNA polymerase activity; Biological process=RNA-dependent DNA replication
MSKLKDFRPISLSNVSYKRITKILSHKLRSLMEKLVNPCQCSFPPNRQSRDNIIIAQEVFHSMRNKKGATGWMEIKIDLEKAYECLNWNFITDTLSNIGCPVWQTWILLLERVLGQERLLEKGIRQVPEELLGQKSLILNYVEVLIHLTGRVSWMELSISLAYQLLSNYDPSNLNSLHKVVWSWKGRERVRVLLYKI

SEQ ID NO: 225242 - protein, 125 aa, Glycine max
  Coding DNA Sequence Number=SeqID_108464
MLLDCYLLDVGFQGYPHTLKRGDLEQSLDRVGGPFVVAKPYLFVLWLCGLHMQIFTGKKGLIRKLNNLNRRLGSSRNPQVMQEMERIWKEYEEALVQEELLWFQKSRSKWLSLEIATRDSSMVPL

SEQ ID NO: 225243 - protein, 43 aa, Glycine max
  Coding DNA Sequence Number=SeqID_108465
MVYKILLILLVASEHPKQDYHEGYNQSSVDYEDSVKQLCTSKF

SEQ ID NO: 225244 - protein, 107 aa, Glycine max
  Coding DNA Sequence Number=SeqID_108466
  Gene Ontology: Mol. function=transferase activity; Biological process= isoprenoid biosynthetic process
  Homolog annotation: Hit_ID=Q9FET8; Match level="QueryCoverage=79%, HitCoverage=20%, E-value=4e-27, Identity=74%"; Hit description =Geranyl diphosphat synthase
MAGDDELSLLGNKLRAMVVAEVPKLASAAEYFFKIGVEGKRFRPTVLLLMSTALNLSIHEAPPPVEVGGTLTTDVRSRQQRIAEITEMIHGILDVYIFNYMNANNFA

SEQ ID NO: 225245 - protein, 464 aa, Glycine max
  Coding DNA Sequence Number=SeqID_108467
  Gene Ontology: Mol. function=DNA binding; Cellular component=beta -galactosidase complex; Biological process=DNA integration
  Homolog annotation: Hit_ID=Q1SDN3; Match level="QueryCoverage=95%, HitCoverage=34%, E-value=1e-166, Identity=65%"; Hit description =Polynucleotidyl transferase, Ribonuclease H fold
MATNRLVLALASVNRWHLQQLDVSNTYLHGELSEDVYMIVPPGVMGHCSLQCCKLKKSLYGLKQASRKWYEKLSLLLLSCGYNQAHADHSLFIKSAAHDFTALIIYVDDIVLTGNSVHEIAHIKQILHSHFHIKDLDLLKYFLGIEVAHSDAGISLCQRKYCLDLLKDSGMTGSKPCSTPMDSALSLHQDSIEPLADPLSYRRLVGRLLYLTSTRPDITFATQQLSQFMGNPTQMHLRAAMRVLHYLKSSPGTGLTFRRDSPIQILGFSDADWATCVDSRRSVTGYCFFLGNSLISWKTKKQNTVSRSSSEAEYQALASATCELQWLNFLLRDLNIPCSKQAVFYCDNQSTLHIAANPVFHERTKHLDIDCHLVCEKLQAGLMRLIPVSSSNQLADIFTKALPPRLFSLNLSKLELINIFPPPTCGGLTDKEPNPSQKQHCAAVEMGHNAHSATSYFCITEITE

SEQ ID NO: 225246 - protein, 185 aa, Glycine max
  Coding DNA Sequence Number=SeqID_108468
  Gene Ontology: Mol. function=cysteine-type peptidase activity; Cellular component=cytoplasm; Biological process=proteolysis
  Pfam annotation: Domain name=Transposase_21; Domain location=63-183; Score=25.0; E_value=9.6e-17; Accession=PF02992.5; Description =Transposase family tnp2
MYKHEYEEMHKCPRCGVSRYKVKDDDECSSDESTMKVPPAKVLWYLPIIPRFKHFFANADDAKDLTWHADGRNCDGMLCHPVDSFQWKKINRLYPNFGKKTRNLRLGLALDGMNPYGSLSTQHSSWLVFPRQPRNDIDVYISLLIEDLTNLWDKVVAVHDGHRNETVKLCAILFVPSMTSQHMEI

SEQ ID NO: 225247 - protein, 100 aa, Glycine max
  Coding DNA Sequence Number=SeqID_108469
MQSQGLALPPELEVDPSAARVSTKESCVNPSRKDPNTGGSEKCGLYDDENPPHLVAIGRVYEGSTIIHKIPLDNDQVKVGVEEVRDVDVHILVHPFKRLS

SEQ ID NO: 225248 - protein, 123 aa, Glycine max
  Coding DNA Sequence Number=SeqID_108470
  Gene Ontology: Mol. function=nucleic acid binding; Cellular component= nucleus; Biological process=cell redox homeostasis
  Homolog annotation: Hit_ID=Q69Y13; Match level="QueryCoverage=56%, HitCoverage=28%, E-value=3e-27, Identity=77%"; Hit description =Formin-binding protein-related-like
  Pfam annotation: Domain name=zf-U1; Domain location=8-44; Score=27.9; E_value=1.4e-05; Accession=PF06220.3; Description=U1 zinc finger
MTEYWVSQGNKWCDFCKIYISNNPGSIRNHELGQRHKDNVSKRLAAMRKDNIAKEKEQKETARAIEQIEAVRVSHLFYINHADAAFFILIHDNDITGIIMNNSFIHSVLPSLFTPQSLLKLLK

SEQ ID NO: 225249 - protein, 127 aa, Glycine max
  Coding DNA Sequence Number=SeqID_108471
MDEDPLATRWNPLRGIWCDLPIKEKPNELQMNIVIWCPYEEHKHVRPFVGQTLYFGFIRCKTNLRPYLLERVLRQFGHPYIIPLGNVVSLGGPWACSSNYMPWFYKLSHQVETMYQVETTLARIDSR

SEQ ID NO: 225250 - protein, 67 aa, Glycine max
  Coding DNA Sequence Number=SeqID_108472
MFSKPSKKQSKDFGNKTIFVMTCKKQTSYIGFHHVPSIFDRDAMTIYMRDMSNQAPMFGLPQLISCT

SEQ ID NO: 225251 - protein, 95 aa, Glycine max
  Coding DNA Sequence Number=SeqID_108473
  Subcellular localization annotation: CTP_CleavageSite=41; ConfidenceScore=5.34e-01
MASSSSSVLSQLLHNLKLQKTQLPFRNCDFSLNRHSSPVTLAQPEGEDGVLSELAFAQRLYTTQPPSRIVHALSHQIGCLANDALSQKISGLASS

SEQ ID NO: 225252 - protein, 556 aa, Glycine max
  Coding DNA Sequence Number=SeqID_108474
  Gene Ontology: Mol. function=two-component sensor activity; Cellular component=integral to membrane; Biological process=two-component signal transduction system (phosphorelay)
  Homolog annotation: Hit_ID=Q8ZLN7; Match level="QueryCoverage=100%, HitCoverage=79%, E-value=0.0, Identity=62%"; Hit description =Putative membrane domain protein involved in signal transduction
  Pfam annotation: Domain name=EAL; Domain location=405-556; Score =94.5; E_value=3.3e-25; Accession=PF00563.11; Description=EAL domain
  Pfam annotation: Domain name=GGDEF; Domain location=231-391; Score =203.2; E_value=6.2e-58; Accession=PF00990.12; Description=GGDEF domain
  Pfam annotation: Domain name=MHYT; Domain location=156-224; Score =26.5; E_value=9.4e-05; Accession=PF03707.7; Description=Bacterial signalling protein N terminal repeat
  Pfam annotation: Domain name=MHYT; Domain location=25-87; Score=60.8; E_value=4.5e-15; Accession=PF03707.7; Description=Bacterial signalling protein N terminal repeat
  Pfam annotation: Domain name=MHYT; Domain location=89-150; Score =58.9; E_value=1.6e-14; Accession=PF03707.7; Description=Bacterial signalling protein N terminal repeat
  Pfam module annotation: Pfam domain module=EAL::GGDEF::MHYT::MHYT::MHY T; Domain location=405-556::231-391::156-224::25-87::89-150
MAGRVASSTGRVALVWLLGGGFAMGVGIWAMHFIGMLSMSLDMVMSYDPLLTAASMVVAVLASIFALWLVCSSGDLPWRRLLGGALVLGSGVVAMHYTGMAALMFEPGISWNWGWIAVSVLIALVASGAALWLAFNLREGHGRVTLLRVGAAVVMGCAIAGMHYTGMAAANFPMHSHATHHGVNSDWLAMLVTVVTLAILGITLLVSMLDARMQARTSILARSLAEANRELAQLALHDNLTRLPNRILLEDRLEQAINKANRERSQFALMFMDLDGFKAVNDAFGHHVGDNLLIAVTERMTDQMKGHYTLARLGGDEFVLLIEIGDPNDAAAVADALVKAVDRPFSVSRYELMVSLSIGIAVYPGDGKDERELMFNADAAMYHTKNNGRNGYNFFQPSMNTLAQSQLQLNNDLWQALDSNELRLFYQPKYCAPSGPIIGFEALLRWQHPTRGLLTPDKFLPIAEKTGMIINIGNWVINEACRQLHIWHQQGHPHWSVAVNLSALQFEQCNLVDTVTQALEQHQIPAELLTLEVTETTAMRDPEESVRILTELTSMG

SEQ ID NO: 225253 - protein, 50 aa, Glycine max
  Coding DNA Sequence Number=SeqID_108475
  Homolog annotation: Hit_ID=O04874; Match level="QueryCoverage=62%, HitCoverage=14%, E-value=1e-07, Identity=84%"; Hit description =Glutathione transferase
MADEVVLLDFWPSPFGMRVKIALARKGFIYVSVPRTSITLAEVLVQCLMD

SEQ ID NO: 225254 - protein, 343 aa, Glycine max
  Coding DNA Sequence Number=SeqID_108476
  Gene Ontology: Mol. function=two-component sensor activity; Cellular component=integral to membrane; Biological process=two-component signal transduction system (phosphorelay)
  Homolog annotation: Hit_ID=Q8ZLN7; Match level="QueryCoverage=95%, HitCoverage=47%, E-value=2e-93, Identity=54%"; Hit description =Putative membrane domain protein involved in signal transduction
  Pfam annotation: Domain name=EAL; Domain location=249-341; Score= -102.9; E_value=0.00081; Accession=PF00563.11; Description=EAL domain
  Pfam annotation: Domain name=GGDEF; Domain location=75-235; Score =202.5; E_value=1e-57; Accession=PF00990.12; Description=GGDEF domain
  Pfam annotation: Domain name=MHYT; Domain location=2-55; Score=23.9; E_value=0.00056; Accession=PF03707.7; Description=Bacterial signalling protein N terminal repeat
  Pfam module annotation: Pfam domain module=EAL::GGDEF::MHYT; Domain location=249-341::75-235::2-55
MGVAIAGMHYTGMAAAQFSAPGSMQHHGMGQEGLAVWVTIITLTILGLTLLISMLDAQLRAARLAARLRRANSELRQLALHDNLTALPNRVMLDQQLSTQIKHATLYDQPFALMFMDLDGFKAVNDTWGHHVGDRLLVAVAERLRTQLDADILLARLGGDEFVMLCPQYAATQAEALAQRLVHSIDAPFELDRYSLRVSLSIGIVIFPQHGRSPQEMMFNADSAMYHTKHSGRNGWSLFEPVMSAVAQHQLALANDLWNALECQEMRLFYQPKFRAGGTILMGFEALLRWQHPRRGLLMPDMFLARAEKTGQIVALGNWVINEACRQHAASGMTRATATGASR

SEQ ID NO: 225255 - protein, 1038 aa, Glycine max
  Coding DNA Sequence Number=SeqID_108477
  Gene Ontology: Mol. function=structural molecule activity; Cellular component=viral capsid; Biological process=transport
  Homolog annotation: Hit_ID=Q3K9Z7; Match level="QueryCoverage=70%, HitCoverage=93%, E-value=1e-180, Identity=45%"; Hit description =Fimbrial biogenesis outer membrane usher protein precursor
  Pfam annotation: Domain name=Pili_assembly_N; Domain location=35-148; Score=-23.5; E_value=0.00017; Accession=PF00345.11; Description=Gram -negative pili assembly chaperone
  Pfam annotation: Domain name=Usher; Domain location=242-960; Score= -178.4; E_value=5.2e-13; Accession=PF00577.10; Description=Fimbrial Usher protein
  Pfam module annotation: Pfam domain module=Pili_assembly_N::Usher; Domain location=35-148::242-960
MMSLRALLLWFLLALSPASFAANSLMIWPIDPAINPQEKASELWLENRGNATTIMQVRIFNWQQIDGQEQYQTQQQVVASPPMVRLEPGQKQLVRLIRQSAPPAGVEQAYRVVLDEIPTPRSPGENQAGLTFQMRYSVPLFVYGDGLTRDSAKADLSWRQVSRDGKRWLELTNRGNGHARLSNVTVGGRALGNGLFGYVLANSSHRWPLNSPRCRALMKLTPPPCALAVTSVLCFSPLSSAETFSELPPPPAVSHSASGQQYMLELVVNQRERGEIVPVERRDGEFWLRSGDLQRAGIPAAKLAGEQVAPGQLGEVKVEYDERRQRLLLTVPPAWLPEQTLGQPQNGPRYPGQASNGALLNYDLYATRTDNAGSRLSSWNELRLFGPAGQFSSNGVYIQQLAGDTRGQQQGYIRYDTWYSNENENAALSWRAGDLITDALGWSNSVRLGGVQIARDFSVRPDLANVQPGPWSLTNVPFVNGAGDAVITTTDAVGRQVTTTLPFYVSSSLLKTGLSDYAFSAGAIRENYGIKNFDYGAAAASGSYRYGLRDWLTLESHAEGSSDVAMGGAGALVRLGSLGVINAALAQSQLDGRPGTQYSWGYQYNNSWFSLGTQHTLRSADFGNLALVGSRGDSANTSYSLARRSAQYTASLSLSQYGSLGLAYLDIAGGSGDRTRLWNLSWSKNLWGNSSLYISASRDQQQGDWSGAISLVIPFGEQSSASISVERDQQGQSNQRLYVSRAMPSDGGFAYDASWAHQGGDSGDYRQGSLRYRNNKIDTSAGFYGDDDNTTQWADFTGSLVLMDNHVFAANNINDAFVVVKTRYPDVTVRYENQTMGRTDDAGYLLVPSISSYYGAKYDIDTLDLPADMTAPKVEQRFAVKRKSGYLLNFPVERLRAASVILHDSDGQPLPVSSQVLRRDRATEYVGWDGLVWMEDLSASNPMRVVTPDGRQCETTLAIAEGQPKALQTYGPLTCPLPPAAPGTAVMPPTTHSQGSRHEEISVLAAVAAAGQQLRALFAFGPQRQLWHANHVLRAVDG

SEQ ID NO: 225256 - protein, 41 aa, Glycine max
  Coding DNA Sequence Number=SeqID_108478
MGAESKSEWTQSSLCRLERVKSSTVRCDSEGMLYETASPRR

SEQ ID NO: 225257 - protein, 363 aa, Glycine max
  Coding DNA Sequence Number=SeqID_108479
  Homolog annotation: Hit_ID=Q8XUX4; Match level="QueryCoverage=18%, HitCoverage=15%, E-value=3e-23, Identity=76%"; Hit description =Probable sugar transporter transmembrane protein
MVVYLAEIMPAEVRASGFSLAYSLATALFGGFTPAISSYLIHATGDKAMPGVWLSFAAVCGLVGTLLIGRMVKQYQARHSATGTVQCGFADLHFTSTLAWLAPSPAGPHPNPLPHAGEGTVQCGEKPAPALPAGPHPNPLPHAGEGTARCGFTDLRFTSTSARSAPSPAGGRRRGMRVPASSRPTPLKRHIHHHAIAVIARCGRILRSQNLRRIGKVARHGIRVERCRGRAAPAVAAARAPAISGGGAFINIVRQPVGAARHLARGAAEIAAVAQSHLVGDHHIHGDRHRRPAAALHRADAHAGHVQPGAHVITHRQRDGGGVTAGGNHLARHGAEIEWNDKIEAVAERQQRGRVQAIAAALA

SEQ ID NO: 225258 - protein, 210 aa, Glycine max
  Coding DNA Sequence Number=SeqID_108480
  Gene Ontology: Mol. function=nucleic acid binding; Cellular component= nuclear pore; Biological process=DNA integration
  Subcellular localization annotation: CTP_CleavageSite=56; ConfidenceScore=5.18e-01
MTEAQIISSPMTSSCKLTKIGSDLFSDPTMYQSVVGVLQFTTITRPELSFAVNKVCQFMENPHDSHWVAVKRILRYLKGSLHHGFHLKPTVSGIPISVMLTGHLIPMTTDQRLEKPSIWSKFDILVVSQTASCGLINPQPSSSFKNNHMEIDIFFVKEKVLAKQLLVQHVQHVPALDQWVDGLTKPLSPTRFFDLRSKLNVLEPQFERRG

SEQ ID NO: 225259 - protein, 70 aa, Glycine max
  Coding DNA Sequence Number=SeqID_108481
MEDFMAQMAWPGFQPFPIRGGEASTAQESQLEPEDTPEDTPGATPLEATEEGDVTEDTDYAADMAAVQST

SEQ ID NO: 225260 - protein, 98 aa, Glycine max
  Coding DNA Sequence Number=SeqID_108482
  Homolog annotation: Hit_ID=Q9FPR3; Match level="QueryCoverage=82%, HitCoverage=9%, E-value=5e-17, Identity=58%"; Hit description=EDR1
MVNRQDFFSSEEEFQVQLALAINASNSEFHEDPEKDQIHAVTLLSLGGHRIDSTRNRDDVGEVLSRQYWIWEVEDDSSQKIEFFDKNLKFLTRTKTLS

SEQ ID NO: 225261 - protein, 238 aa, Glycine max
  Coding DNA Sequence Number=SeqID_108483
  Gene Ontology: Mol. function=nucleic acid binding; Cellular component= nucleus; Biological process=mRNA processing
  Homolog annotation: Hit_ID=Q9FGL9; Match level="QueryCoverage=96%, HitCoverage=82%, E-value=1e-106, Identity=72%"; Hit description =Polypyrimidine tract-binding protein homolog 2
  Pfam annotation: Domain name=RRM_1; Domain location=20-91; Score =19.2; E_value=0.0024; Accession=PF00076.12; Description=RNA recognition motif. (a.k.a. RRM, R
MASVSSQQQFRYTQPPSKVLHLRNLPWECTEEELIELGKPFGKVVNTKCNVGANRNQAFIEFADLNQAIAMISYYASSSEPAQVRGKTVYLQYSNRQEIVNNKTAADVAGNVLLVTIEGEDARLVSIDVLHLVFSAFGFVHKITTFEKTAGFQALVQFSDAETATSAKDALDGRSIPRYLLPEHMGPCSLKITYSGHSDLSVKFQSHRSRDYTNPYLPVAQSAMEGSGQVQLLNCNLG

SEQ ID NO: 225262 - protein, 183 aa, Glycine max
  Coding DNA Sequence Number=SeqID_108484
MQIIDNPHVQPIQVGMPISLTHAIAPSYVCVPNSPSFASSGSTLLDVDFDLVIKSYDSPSLRNVSYPNFIWGQLFVNMRIFASNVELLKANCRTIPLGPSRPIRKLQHEATSSPGRAFCLCTKPPARLGELGGKLLLHFSYKMALEAEGKGFNTFGNQISLKISEEKKKEGENQGRGASVMLL

SEQ ID NO: 225263 - protein, 162 aa, Glycine max
  Coding DNA Sequence Number=SeqID_108485
  Gene Ontology: Mol. function=ubiquitin-protein ligase activity; Cellular component=ubiquitin ligase complex; Biological process =protein ubiquitination
  Homolog annotation: Hit_ID=Q10FT0; Match level="QueryCoverage=44%, HitCoverage=8%, E-value=1e-11, Identity=45%"; Hit description=U-box domain containing protein, expressed
  Pfam annotation: Domain name=U-box; Domain location=60-132; Score =22.5; E_value=1.8e-06; Accession=PF04564.6; Description=U-box domain
MDLARALGFDPGDRAEFCNQVKLFKGHPFRSHSLLERRVLMSLERILSNWSVEPVLFPLPLTKEVMKDPMVVLESSQVYERTTIDYWFEQCIQDGRDPTCLVTSRVLKSLELKPNIGLAGEIEEWVGRVVEYQIKSIVQYLSEEPLSVDHVEHALDPVYKVS

SEQ ID NO: 225264 - protein, 280 aa, Glycine max
  Coding DNA Sequence Number=SeqID_108486
  Gene Ontology: Mol. function=RNA-directed DNA polymerase activity; Cellular component=chromatin; Biological process=chromatin assembly or disassembly
MANSTCSKSNLDHLEDAIAKLFETQMLMSTKLDDLYQKLAVMESTQPSPTSSSAHPPSPSPSAQPHRIKLEVPHYDGFDPVVWLFKINQFFDYHVTLEHDCLMIPSFYMDGQALAWYQWMTCNGQITSWPSLLQALEAHFGPSNYEYPTGSLFKLTQQGSVNDYLSAFEALPNRIIGLPPPFLLSYFISGFSPEICREVEALQPLSYTQAAALGHLQEEKFLDCHYSRPRPFPQSSFVPRPSQTILNPTPPLLPPPPFLPTPPKPSVPFKLLSLEEIAIS

SEQ ID NO: 225265 - protein, 257 aa, Glycine max
  Coding DNA Sequence Number=SeqID_108487
MEYPSLSNLAKEVLRQMKRVEDNVQYFAAAERFGPLISRLHDGSVGVKIEMASLVGRMTLTNSCKEQIARQGGRDSSYELKSLAASTIANIVSKPGHWELASADKKGNPIQSEIIVLRLLGLLNSLHSQCQVMFLRILCGIASSPQASELVASHITSKGGFGSVIPFLEHPEVEHRQMSLDSNKLKFLKEKLLNNQSTSDERSDAAQILANLSLSEGEIQTLLGGEFVELTAFKVFSYCIKHAGRTYRSLASLHKEP

SEQ ID NO: 225266 - protein, 94 aa, Glycine max
  Coding DNA Sequence Number=SeqID_108488
MPTWQGRYLARDAPDATKKPKTKRKSGMEGRYLKETQDVMVAKDVNTRVEDQSSKTQCLYKYRPEIETPRVETKRVLRRRRREHGKIGLWFIFF

SEQ ID NO: 225267 - protein, 756 aa, Glycine max
  Coding DNA Sequence Number=SeqID_108489
  Gene Ontology: Mol. function=transporter activity; Cellular component= intracellular; Biological process=transport
  Homolog annotation: Hit_ID=Q9LRX7; Match level="QueryCoverage=47%, HitCoverage=59%, E-value=1e-129, Identity=61%"; Hit description =Phosphatidylinositol/phosphatidylcholine transfer protein-like
  Pfam annotation: Domain name=CRAL_TRIO; Domain location=284-456; Score=54.0; E_value=4.8e-13; Accession=PF00650.10; Description =CRALTRIO domain
  Pfam annotation: Domain name=CRAL_TRIO_N; Domain location=177-267; Score=40.2; E_value=7.1e-09; Accession=PF03765.5; Description =CRALTRIO, N-terminus
  Pfam annotation: Domain name=RRM_1; Domain location=551-622; Score =7.2; E_value=0.031; Accession=PF00076.12; Description=RNA recognition motif. (a.k.a. RRM, R
  Pfam module annotation: Pfam domain module=CRAL_TRIO::CRAL_TRIO _N::RRM_1; Domain location=284-456::177-267::551-622
MALCSVFLNLHLLFFVCLTIEALGVAKPSVASYLCQEILAEQEADRVHGLPAQPPVKFNNMVVISLSMKLKEEHCSICFLRPLTNQNKNPFSYGSMKLVSILDPGLDLLLLKVVLVFPLVQRKSRCKLLVLNRMPGEEVLAQEDERGRCFEPETSEDEWRKSRTRSLRRKAITASTRLAYSLRKRNTRVANSDFASIFIEDVRDANEEKAVNSFRQVLLTRDLLPDSHDDYHEMLRFLKARKFDIDKKVQMWADMLHWRKEYGVDSILQEFVYKEYEEVQCYYPHGYHGVDKEGQPVYIERLGKVEPSKLMSVTTVDRFLKYHVQGFEKMFKEKFPACSIAAKRHIDKTTTILDVHGVNWVSFSKVAHDLVMRMQKIDGDNYPETLNQMFIVNASSGFKLLWNTAKGNKFQSRLLQIIDTSQLPDFLGGSCSCPNDGGCLRSDKGPWNDPDILKLLHSREAMKLTKFGSSSVADGVDVKSYASKVKSTGISEPLSASEVRLNPSAFVQSVPSSEKRLGINFDATQNVTHAHLIGEKHRALSWRNNKDITSFYFSHFPDSVNETYLWNLFQEWGKVWEVFIPQSKNKQGQRYGFVCFKGVEDAGWLERQLDNKIYIEGKKLFVNKPKFQRGGKREVGRIGGEVVRVRKVSMNPMEPKQARINSTTSTSMKSYAEAVKHDHKTKEKEITMPLMGKKGPEVPDVSVVIQTGKDKTSWLDNLWVGRLKNRGMFEKAVDEVQEMVGMDVKVSYWGDDTIIL

SEQ ID NO: 225268 - protein, 71 aa, Glycine max
  Coding DNA Sequence Number=SeqID_108490
MKLHCKNCDDESDEQNDGDSDEVYFVEAFGKRRHREAPFGGGDSDCGAKVHRQASGDSDIGKHGPKGAKAG

SEQ ID NO: 225269 - protein, 153 aa, Glycine max
  Coding DNA Sequence Number=SeqID_108491
MKHAWLGNTPSLTRGLNVVGEDNTIFNKEVFSGIYRRNKIHSLYLQDGSLNIQPKVVKDEAKMYFQDLFSDDGMSKPYFPRGERGSFIPSKGTIDNDILAQEALHYIQKWKVKKGMLAIKVDLKKVYNKVCKLEPGRGGVSNLLRGVSGDLQS

SEQ ID NO: 225270 - protein, 68 aa, Glycine max
  Coding DNA Sequence Number=SeqID_108492
MQLRFQLQGRSSVMKGKQGRVKETEGVLNGAVYSHCHGFFSVQKILRLIFLSSSPYGFAHPANSTLGV

SEQ ID NO: 225271 - protein, 70 aa, Glycine max
  Coding DNA Sequence Number=SeqID_108493
  Gene Ontology: Cellular component=nucleus; Biological process =translation
  Homolog annotation: Hit_ID=Q9ZT87; Match level="QueryCoverage=64%, HitCoverage=12%, E-value=8e-16, Identity=82%"; Hit description =Pelota (PEL1) (Putative pelota (PEL1) protein)
MWFVVLHVIGSPGFTKDQFHRHLFLEAEQRELRPIIENKSRIILVHTSSGYKYGCFLYLQVIGLYKSFVR

SEQ ID NO: 225272 - protein, 75 aa, Glycine max
  Coding DNA Sequence Number=SeqID_108494
MAASDQAILRDGAHIPTKRNLLELSSQDALLAKNKLLSKVPSARLSTRLALSLIPLARAKREGGAKRNAIISEPI

SEQ ID NO: 225273 - protein, 125 aa, Glycine max
  Coding DNA Sequence Number=SeqID_108495
MSMKNIDGKHQKEKLKNATQYDLEQNTNALASKLILSLFEVINFKMLEAMKKMSIRKVPHNGNLKMTTSKWFYMLSVHDNCKMYLLALEACQLSGVHLNDLLGIFEEHDGQVEAFQNSNIKRSNS

SEQ ID NO: 225274 - protein, 84 aa, Glycine max
  Coding DNA Sequence Number=SeqID_108496
  Subcellular localization annotation: CTP_CleavageSite=43; ConfidenceScore=5.50e-01
MTKEVIHGHNSIAPQLYFFSSSSSAFFSTSFRLLDLFSLFSCMAIYRKSHLVQGKLAQASCLLRAEDLCTVSIRVARGYILLYI

SEQ ID NO: 225275 - protein, 148 aa, Glycine max
  Coding DNA Sequence Number=SeqID_108497
MAHAQLGPIDGSLLRLQHNHISNQVWEGEERMICPRGQAIKPLQTDIGGCLLLLQSGACDSIKCIVLWIDDLSDEEVQQELGFPLAQKFGTTFNTPPSAYNPPPSSSSYCPLLPIQMHDMSYEDEDEDDDNNNTNNNDDGHGGDGAPQ

SEQ ID NO: 225276 - protein, 127 aa, Glycine max
  Coding DNA Sequence Number=SeqID_108498
MSGEEPIIRDNVSDFSDNDQEHDVHECKEPSNQKENMSDKHVVKCIQYGNGCHWRARASFSKIHRRWEIKKINVKTNPSIQIKTLIADMLQCLSYIVTYKKAWAAKQEALKLHLEVGKNDTIICLYE

SEQ ID NO: 225277 - protein, 171 aa, Glycine max
  Coding DNA Sequence Number=SeqID_108499
  Gene Ontology: Cellular component=integral to membrane
  Homolog annotation: Hit_ID=Q2HTM6; Match level="QueryCoverage=61%, HitCoverage=26%, E-value=5e-19, Identity=53%"; Hit description =Sodium/calcium exchanger membrane region
MGLSGLKEHSNPVTPKAYTPKNPSGPLPHDSEHKPDKEQVESNESNGLPEENLDTKVHIEEERCGSQVEEHFSNKGQGINNKWHNIDGDKADDNDRDKGSGGENGTEADAALVGAEGNEGEDVEGAVAEGEEHDGVHAGKEVEVRGELCGDEGEMVLCGGDEDVEAEEDEE

SEQ ID NO: 225278 - protein, 124 aa, Glycine max
  Coding DNA Sequence Number=SeqID_108500
MAAEHQRIHPAHDVEAPHRPLVPQNIAKYDDKDLQRRVLEAEVVLRACDEFVSDCEILELKETSSPLESGYKNLVVYVCLNAVLVEFSLTRRICGRGLIRTRLGYHEESGSSSPGDNIGTHEHC

SEQ ID NO: 225279 - protein, 105 aa, Glycine max
  Coding DNA Sequence Number=SeqID_108501
MPISPCGSISWDLTRKTPNGPREIQQGPGVSSSGYRPLSVLQGACPPSIGGDSAHFSFLEDAPVSLASPSRRRVGCDRGIWGNCMGISALKASSRILARFVSKGV

SEQ ID NO: 225280 - protein, 35 aa, Glycine max
  Coding DNA Sequence Number=SeqID_108502
MSDESSIERFMASLIEGLNLSNLSDRGIRIDSKHP

SEQ ID NO: 225281 - protein, 79 aa, Glycine max
  Coding DNA Sequence Number=SeqID_108503
MRKSDRARDWEKQGNALETETVRTPKDQRRNPSICREQRSTPSVAKPLGSTQGQKEPRLIQWLLSCTHTSEDSKTKSWI

SEQ ID NO: 225282 - protein, 356 aa, Glycine max
  Coding DNA Sequence Number=SeqID_108504
  Gene Ontology: Mol. function=nucleoside-triphosphatase activity; Cellular component=integral to membrane; Biological process=transport
  Homolog annotation: Hit_ID=Q7PC84; Match level="QueryCoverage=99%, HitCoverage=71%, E-value=1e-135, Identity=48%"; Hit description =Probable pleiotropic drug resistance protein 11
  Pfam annotation: Domain name=ABC_tran; Domain location=24-214; Score =97.2; E_value=5.1e-26; Accession=PF00005.17; Description=ABC transporter
MKKQGIEENRLQLLRDISGAFRPGILTALVGVSGAGKTTLMDVLAGRKTGGYIEGSISISGYPKKQATFPRISGYCEQNDIHSPNVTVYESLVFSAWLRLSNDVNKETQKMFIEEILELVELHPVRHFIVGLPGISGLSTEQRKRLTIAVELVANPSIIFMDEPTTGLDARAAAVVMRTVRNTVDTGRTVVCTIHQPSIDIFENFDELLLMKRGGQVIYGGPLGRNSQNLIEYFEAIAGVPKIKDGCNPATWMLEISSPVVESQLNVDFAELYTKSDLYQKNQEVIKELCTPVPGTKDLHFPSKYSQSFVTQCKACFWKQNCSYWRNPQYNAIRFFTTIVIGIIFGLIYWDKGKKT

SEQ ID NO: 225283 - protein, 116 aa, Glycine max
  Coding DNA Sequence Number=SeqID_108505
  Gene Ontology: Mol. function=RNA-directed DNA polymerase activity; Biological process=DNA integration
MKTISKFGIVKHKIHRTILLAHMEPKSTKQALADPTWLVAMKVEYDALIKNDTWLLVPLPPNRVPIDSITYGLPLRNGILEEEVCMQQLLGFESSTKSMVCKLHKDIYGLKQAPRD

SEQ ID NO: 225284 - protein, 148 aa, Glycine max
  Coding DNA Sequence Number=SeqID_108506
  Subcellular localization annotation: CTP_CleavageSite=65; ConfidenceScore=5.09e-01
MTWNGKHNRHKYEHTLTIFSKFLVRCRHGPLRSLLSRASNTICPWSFLASPPKPAAPSDLSLPSCASTLSPKIPHTNHKKLLLLPLNRLPKPCLKGDPLAIKISKSEYQAGWADCKNILHGRFFLSKGDVPIKIWGPVGQVLDPVEAH

SEQ ID NO: 225285 - protein, 759 aa, Glycine max
  Coding DNA Sequence Number=SeqID_108507
  Gene Ontology: Mol. function=nucleoside-triphosphatase activity; Cellular component=integral to membrane; Biological process=transport
  Homolog annotation: Hit_ID=Q2PCF1; Match level="QueryCoverage=89%, HitCoverage=45%, E-value=0.0, Identity=59%"; Hit description =Pleiotropic drug resistance protein 2
  Pfam annotation: Domain name=ABC2_membrane; Domain location=315-520; Score=177.8; E_value=2.6e-50; Accession=PF01061.14; Description=ABC -2 type transporter
  Pfam annotation: Domain name=ABC_tran; Domain location=32-237; Score=- 10.3; E_value=1.4e-06; Accession=PF00005.17; Description=ABC transporter
  Pfam annotation: Domain name=PDR_assoc; Domain location=525-592; Score=121.8; E_value=1.9e-33; Accession=PF08370.2; Description=Plant PDR ABC transporter associated
  Pfam module annotation: Pfam domain module=ABC2_membrane::ABC _tran::PDR_assoc; Domain location=315-520::32-237::525-592
MGGRGLMGLRAWGVMRGSSKGKSYLKPWRGDFLKGHGGTGPARASGRVTYCGHELSEFFPQRTCAYISQHDLHHGEMTVRETLDFSGRCRGVGTRYNLLAELSRRELAAGIKPDPQIDAFMKATAMEGQETSIVTDYILKILGLEICADTLVGDEMKRGISGGQKKRLTTGEMLVGPAKAFFMDEISTGLDSSTTFQIVRFMRQMVHIMDVTMIISLLQPAPETYDLFDDIILLSEERKGVADFLQEVTSKKDQEQYWFRRDIPYQYVTVPEFVAHFNNYSIGQQLSEKIQVPYDPNESHRAALVKEKYGLSKWELFKACFSREWLLMKRNYFVYIFKTCQITILAIITMTVFFRTEMKHGQLEGAGKYYGALFFSLINVMFNGVAELAMTINRLPVFYKQRDFLFYPAWAFALPIWVLRVPLSLLESGLWIILTYYTIGFAPAATFFCVNQMALSLFRFIAAVGRIKVVASTLGSFTLLVVFVLSGFTVSRNDIEPWMIWCYYGSPMMYGQNAIAINEFLDKRWSAHNIDPRIPEPTVGKAFLRARGIFTKDYWYWISVGALIGFSLLFNICFILALTYLNPFGNSKSIIVEEEDQKKSTFGSSSVDKMATEATTEKSSTSIANSFEGTTDTECIIPPQHCCISNMQFTSSSLGNKHKDNVIITGIDMEVRNTAHGSNPKAEENTKSKKGMVLPFQPLSLVFQDVNYYINMPHFVGLGSSSSMDSFASWKMNDNRMEKEEREETPLQEEDESRRSSPP

SEQ ID NO: 225286 - protein, 219 aa, Glycine max
  Coding DNA Sequence Number=SeqID_108508
  Gene Ontology: Mol. function=nucleoside-triphosphatase activity; Cellular component=integral to membrane; Biological process=transport
  Homolog annotation: Hit_ID=Q7PC87; Match level="QueryCoverage=99%, HitCoverage=15%, E-value=2e-73, Identity=59%"; Hit description =Pleiotropic drug resistance protein 6
  Pfam annotation: Domain name=ABC2_membrane; Domain location=1-157; Score=80.0; E_value=7.6e-21; Accession=PF01061.14; Description=ABC-2 type transporter
MYAAVFFLGASNTNSVQPVVAIERTVLYRERAAGMYSELPYAIGQVAIEVIYVAIQSLAYTILLYWMIGFEPRVENFLWFYYFIFMCFMYFTLYGMMTVALTPNYQIAALVMSFFINFWNLFSGFVIPRTQIPIWWRWYYWGSPVAWTIYGLVTSQVGDKNSPIEVPGFRTMTVKDYLERQFGFQHEFLGVVALTHVAFCLLFLLVFAYGIKFLNFQRR

SEQ ID NO: 225287 - protein, 64 aa, Glycine max
  Coding DNA Sequence Number=SeqID_108509
MGSGDSNGGSIAIGTTMQGAKEHKGEKWEIAEKVRLGKHGWGFSSLGLGLGLGFGEKEAFESMI

SEQ ID NO: 225288 - protein, 203 aa, Glycine max
  Coding DNA Sequence Number=SeqID_108510
  Gene Ontology: Mol. function=nucleoside-triphosphatase activity; Cellular component=integral to membrane; Biological process=transport
  Homolog annotation: Hit_ID=Q2PCF1; Match level="QueryCoverage=86%, HitCoverage=12%, E-value=7e-49, Identity=57%"; Hit description =Pleiotropic drug resistance protein 2
MAKEEGGGEEIVGSMSEGRSFSSPRRSWATESFHEAVSGESDAFHTCEKEIDEEEELKWEALRRLPTYDRMRKGILKQVLENGNVNYEEVDITKLGVQEKKHLLESILRTAEEDNESFLNRMRERIDRVAIEIPKIEVRFENLSVEGDAYVGTRALPTLLNSTLNVIEGALGYIKLLPHNKRVVKILQDISGIVKPSRYLIND

SEQ ID NO: 225289 - protein, 137 aa, Glycine max
  Coding DNA Sequence Number=SeqID_108511
  Subcellular localization annotation: CTP_CleavageSite=79; ConfidenceScore=5.09e-01
MVATVVVISLTVVAPTEVTVVADLSILSVNFASSLATLQMSITLGTNKVFLRGVVGADGLCSFHNLKLQEHFSLLLFTSTSLVSSATHNGLSSAITAASKSPNVVSNSVISSPSNVSLWHARLGHPNSPCHEASQSL

SEQ ID NO: 225290 - protein, 95 aa, Glycine max
  Coding DNA Sequence Number=SeqID_108512
MAEALVVEVADAAAIVVVEDITLIFSIKCAINLGILLQCVILGLIKDINLIHHFLFKILQVKATPSSTSYHLSPSTATVNSIVHTSKLSSLCKPI

SEQ ID NO: 225291 - protein, 160 aa, Glycine max
  Coding DNA Sequence Number=SeqID_108513
  Gene Ontology: Mol. function=nucleic acid binding; Biological process= DNA integration
  Homolog annotation: Hit_ID=Q1S1X7; Match level="QueryCoverage=93%, HitCoverage=12%, E-value=9e-19, Identity=37%"; Hit description =Integrase, catalytic region; Zinc finger, CCHC-type; Peptidase aspartic, catalytic
ILFEKMVNTIMIEKFTRKNSFKLCRIKMLSLLKEQGIWVLLSYQSSKIDMSVLELQEEKAHSLIILSLSDEVLYKVLEEVTTLRLWLKLEKLFMTKSIYNKMLVKEYLDELNSILMELHDTNVKMEDKDLTMILLAYLPPFYANFVSALSVSKDSLTLEE

SEQ ID NO: 225292 - protein, 73 aa, Glycine max
  Coding DNA Sequence Number=SeqID_108514
MALYMAFNLLQVKEHIGTIRASLAKEKHHLELLEKEKGREIWANQRWWFPIEMKELVIIDSRESRAKLENESG

SEQ ID NO: 225293 - protein, 155 aa, Glycine max
  Coding DNA Sequence Number=SeqID_108515
  Homolog annotation: Hit_ID=Q8LJR8; Match level="QueryCoverage=47%, HitCoverage=30%, E-value=1e-14, Identity=60%"; Hit description=RING -H2 finger protein
MAKLFWVCGVKAREMTKEVLFHSRRHRLGRSALNLGLDTNSTPPVLSIATTTSATFVTTRYERASDRIDGRYRRSFASESVDSEENMRTSIGGMVGNFYVSSSILASGMLLLFLFTLFEFLTKSLFNRVVYEELGKYGDLDNQVLCREQVEELGN

SEQ ID NO: 225294 - protein, 110 aa, Glycine max
  Coding DNA Sequence Number=SeqID_108516
MVLLEYLPRVMEEAEVVRERRKTLKLFTAADMRMVGMRGSSEERDGVEERGVVGDQREKLGGERWCQRRRGGWRPKGGARKKLVGERGGQRRKAEVRKREKLRGERGDQR

SEQ ID NO: 225295 - protein, 47 aa, Glycine max
  Coding DNA Sequence Number=SeqID_108517
MTLYIFQSGIYSCLMWIAFLFILALAEVDGFACVSFCMLSIDIDEAV

SEQ ID NO: 225296 - protein, 74 aa, Glycine max
  Coding DNA Sequence Number=SeqID_108518
  Homolog annotation: Hit_ID=Q1SPJ5; Match level="QueryCoverage=86%, HitCoverage=3%, E-value=5e-20, Identity=76%"; Hit description=TPR repeat
MDLQFLQAHDLILVAIGRYLKALIATMCHYQTTASSLVRSSDNVLERMFALLMEQGSLWQEICSLPEIEGSVIS

SEQ ID NO: 225297 - protein, 149 aa, Glycine max
  Coding DNA Sequence Number=SeqID_108519
MEPQDTRLWWAGRLLLNLGSMEIAHSSFVRCLGEPLETCLETTVLVGILGWSYSIPPFMKLNIDGRKRDNLGRMGIGGVLRDCVGHWVLDFAKSLGKAETPHAKLLVVKVGLEACWNKSLVCEIDYLEVFSLFDSRSQKSHWDVFHDGD

SEQ ID NO: 225298 - protein, 123 aa, Glycine max
  Coding DNA Sequence Number=SeqID_108520
MRLPLLILATPRWWWENSSRISASEMVCMSYGSLGFLAVPFRWVVLSFSVSGDLPDKVSTRVCDEGIAAVVDGNVIGGIDLFGGEGGEEEAAARPEVVGGEGVEWRNPRRKCCGGDGVGGVLV

SEQ ID NO: 225299 - protein, 99 aa, Glycine max
  Coding DNA Sequence Number=SeqID_108521
MWQRQRSTCTKVIDSLLNWYGLHQLLFLILVCTLAELIGQSADEVNELKIEDGDVDLNASPQALDRLLGCFLAFKVKPCCKIKSSILDSTDPTELEFVS

SEQ ID NO: 225300 - protein, 164 aa, Glycine max
  Coding DNA Sequence Number=SeqID_108522
  Homolog annotation: Hit_ID=Q1S7R7; Match level="QueryCoverage=38%, HitCoverage=8%, E-value=4e-11, Identity=54%"; Hit description=IQ calmodulin-binding region
  Subcellular localization annotation: CTP_CleavageSite=63; ConfidenceScore=5.27e-01
MAPIESKKARLRGQGSPRFTTDLVDKNNATRQHSISSSLNGKSGSFSPRPKKLIGVSGRGGIRSFTVTKYEVVLNQIALAFTSKLPSLMPTRLHLLVDGLEGVTRVDVNVSEVDDVEPRGFEPAEDVVEGAILHELAAQALARRWEGKREMEGLGFRKREGIEK

SEQ ID NO: 225301 - protein, 131 aa, Glycine max
  Coding DNA Sequence Number=SeqID_108523
MHSPTRSFEGSNNFNQWGSPYQPPNQEPTLQEETAKLEELLIQFMQKIESHMKWIDATIKNLEVQIGQLAEPVAERLTETFAANTEMKPKEDCKVIFTEREEKEKKTEEDMRDEEGEKKEERERNEEKAQQ

SEQ ID NO: 225302 - protein, 594 aa, Glycine max
  Coding DNA Sequence Number=SeqID_108524
  Gene Ontology: Mol. function=nucleic acid binding; Cellular component= beta-galactosidase complex; Biological process=DNA integration
  Homolog annotation: Hit_ID=Q1S0A6; Match level="QueryCoverage=99%, HitCoverage=41%, E-value=0.0, Identity=62%"; Hit description=Zinc finger, CCHC-type; Peptidase aspartic, catalytic; Polynucleotidyl transferase, Ribonuclease H fold
  Pfam annotation: Domain name=rve; Domain location=401-562; Score =173.4; E_value=5.8e-49; Accession=PF00665.16; Description=Integrase core domain
  Pfam annotation: Domain name=zf-CCHC; Domain location=122-139; Score =7.9; E_value=0.048; Accession=PF00098.13; Description=Zinc knuckle
  Pfam module annotation: Pfam domain module=rve::zf-CCHC; Domain location=401-562::122-139
MVSYYGKLKTLWDELANYEQIPRCSCGGCKCDIATKLEKRREEERVHQFLMGLDDASYGTVRSNILAADPLPSLNRVYAILVQEERVRTISITKEERGAVMGLAVQAGHKSKWRGEIKDKSMVCSICRKAGHDDKNCFQVVGYPDGWGDRPRSEGKSSGKNQQRNGTSAGRGRGGMARANATHVEKSELPGLSNEQWQTLVEMLNNRKTDEIEKMTGKHPDNLWIIDTGASNHMTGYLKNLCQQRTIRGCPVGLPDGEKVIATKEGTVILDGGLKLENVLYVPKLQCNLISVSQMIDETDCVVQFTKKICAMQDRTLKTLIGAGERKDGLYLYHGVRNSKAYHTSTKYDLDILHKRMGHPSFKVVKLIPNVTCSGKHLNKVCEICERAKQTREKFPLSTYRASGIFDLIHCDLWGPYRTPSSCGASYFLTLVDDYSRSVWIYLLSEKREVSQTMINFFALIERQFDKHVKVIRSDNGTEFTCLKQYFLEHGILHQKSCTGTPQQNGRVERKHRHILNVARALRFQGRLPIRFWGECILTAGYLINLTPSPILDGKTPYELVHGTSPSYDHLRVFGSLCYAHNQDRKGDKFDSSS

SEQ ID NO: 225303 - protein, 68 aa, Glycine max
  Coding DNA Sequence Number=SeqID_108525
MTKLRSSRLTMEVAPPRFVSVTRCRVKKMLDIIKEEENDFAADKRFSSPSCGSSSLSLVERPVLLKNF

SEQ ID NO: 225304 - protein, 286 aa, Glycine max
  Coding DNA Sequence Number=SeqID_108526
  Gene Ontology: Mol. function=nicotianamine synthase activity; Biological process=nicotianamine biosynthetic process
  Homolog annotation: Hit_ID=Q1S0N0; Match level="QueryCoverage=95%, HitCoverage=80%, E-value=3e-74, Identity=49%"; Hit description =Nicotianamine synthase
  Pfam annotation: Domain name=NAS; Domain location=15-286; Score =416.6; E_value=3.5e-122; Accession=PF03059.6; Description =Nicotianamine synthase protein
MASFQGINNNIETLIPPELLITQIMQLHASISKLETLRPCKQVNSLFTHLVKLCTLPSSIDIESLPQEVQDMRESLINLSGRAEGLLELEFSTFISLTPEPMKNVTLFPYYGNYVKLANMESKILTENGVVNPKKVAFVGSGPMPLTSIVMATHHMESTHFDNFDIDEKANEVARKIVASDVALEKRMKFETQDVMEVRERLGQYDCIFLAALVGMSREAKVKILGHIRKYMKEGGVLLVRSAKGARAFLYPIVEERDMVNFEVLTIFHPTNDVINSVVLLRKPKA

SEQ ID NO: 225305 - protein, 118 aa, Glycine max
  Coding DNA Sequence Number=SeqID_108527
  Homolog annotation: Hit_ID=Q10F06; Match level="QueryCoverage=48%, HitCoverage=3%, E-value=9e-12, Identity=61%"; Hit description =Unconventional myosin heavy chain, putative, expressed
MDRSGAGSFHKKTLSISHRARITKHHVGPLDSPSNVSLMELDGLDDSKEYLATKRAMEVVGINSYEQELICSVSMSYDRKVEKAHVFKMDREEYTKEETNWSYIEFVDNQDVLDLVEK

SEQ ID NO: 225306 - protein, 227 aa, Glycine max
  Coding DNA Sequence Number=SeqID_108528
  Homolog annotation: Hit_ID=Q8W0S5; Match level="QueryCoverage=83%, HitCoverage=37%, E-value=2e-58, Identity=60%"; Hit description =Putative phosphate/phosphoenolpyruvate translocator
  Pfam annotation: Domain name=TPT; Domain location=62-196; Score =154.2; E_value=3.3e-43; Accession=PF03151.7; Description=Triose -phosphate Transporter family
MATNCIIALVLQLSITVPVAVFVLGVAAGLEVMSYKMLSIMSVISFGVLVASYGEININWIGVVYQMGGVVGEALRLIFMEIFVKRKGLKLNPISVIAICLFLPWIFLEKPKMDEHGPWNFPPVLLILNCLCTFALNLSVFLVITHTSALTIRVAGVVKDWVVVLLSAVLFADTKLTLINLFGYAIAIAGVAAYNNCKLKKETSRDTSDDSNPESSQRQESQPLTSR

SEQ ID NO: 225307 - protein, 994 aa, Glycine max
  Coding DNA Sequence Number=SeqID_108529
  Gene Ontology: Mol. function=nucleic acid binding; Cellular component= chromatin; Biological process=DNA integration
  Homolog annotation: Hit_ID=Q1S0A6; Match level="QueryCoverage=43%, HitCoverage=39%, E-value=1e-154, Identity=52%"; Hit description=Zinc finger, CCHC-type; Peptidase aspartic, catalytic; Polynucleotidyl transferase, Ribonuclease H fold
  Pfam annotation: Domain name=rve; Domain location=728-876; Score =21.9; E_value=8.7e-05; Accession=PF00665.16; Description=Integrase core domain
  Pfam module annotation: Pfam domain module=RVT_2::rve; Domain location=121-326::728-876
MDEECMVENGHDNDTNAYIRGGASEASNEPQSFAPPLEKQNCIDVVQCSSEGPETRSNIPPTSPLGKGHRIKRPSVKLSDYVTNTMIKLSPSTCSSASSHDSGREPMHFSEAVQDERWREAMASEIEALQNNGTWTITTLPPKKKALGCKWIYKIKYHSDGTIERFKARLVILGNHQVEGLDYTETFAPVEKMVTVRTVLAVAAAKAWELHQMDVHNAFLHGDLQEDVYMKLPPGFMTEHKGMVCKLRKSLYGLRQAPRCWFAKLSTALKNYGFCQSCSDYSLFTLRTTTVHLVALVYVDDLIVSDIILETGLLGAKPMSLPLEENHRLALAEGSLFSDPGRYHRLVGRLIYLCFTRPELSYCVHTLSQFMQQPRKEHWHVALRVVRYLKGNPGQGILLRSDNDLKLYGWCDSDWAGCPLTLEYRSMANTICELKWLKAILSSLVVLHPQPIQLYCDNQAALHIAKNPPSYVPSRIQLADIFTKALGTKQFLFLLSNVALNISTTLSLYKELNSTPPKYRPCCISRSRPLPNPCVDLGLDWAMTTTPVLSLPDFSVPFVIETDALGSRMGAMLMQQGHPIAFFSKQFCPKLLHSSTYIRELHAITTIVKQWRQYLLGHAFIILTNHKSLRELMSQPIQTPKQHVYLAKLIAEAFGIISVPQFKFLDGLKTELDATEEFKSLITRVRKSALYHPEFDIRNNLLLHKVTWGWQKLLVASNRVSSRKPIPSSSCPLEDIALDFITDLPNYQGATVIMTVVDRFSKGAHFRTRPTDFTAHTMAQMFIDLVCKLYGFPRSLISHRDPIFVSRFWSELFRLSDTKLCMSIAYHPQSDGQTEWCCNTTCHSSTNLSLYEVTYGKPPLGILAYLPGSSSVEMKRFANSHRCEVTFAIGYWVYVKLRPYRQTSLADNKFQKLGKVTYRLALPPTAKIHLVFHCSKLKLHQGPLVSDQPLPSASWDNNPIVEPLTILDLKWDNSMPPQLSVLVQWSGLQLEDST

SEQ ID NO: 225308 - protein, 690 aa, Glycine max
  Coding DNA Sequence Number=SeqID_108530
  Gene Ontology: Mol. function=ubiquitin thiolesterase activity; Cellular component=nucleus; Biological process=ubiquitin-dependent protein catabolic process
  Homolog annotation: Hit_ID=Q9LUK9; Match level="QueryCoverage=91%, HitCoverage=93%, E-value=1e-117, Identity=42%"; Hit description =Similarity to ubiquitin specific protease
  Pfam annotation: Domain name=UCH; Domain location=21-369; Score =203.8; E_value=4e-58; Accession=PF00443.19; Description=Ubiquitin carboxyl-terminal hydrolase
  Subcellular localization annotation: CTP_CleavageSite=61; ConfidenceScore=5.44e-01
MALQMTWQPSLLSQKRKTGTGPPLGLRNLGNSCYLNSVLQCLTYTPPLANFCLRLQHSSLCDSSASSCPFCILEKQIARSLRLDLTYDAPSKIQSCIRIFAENFRCGRQEDAHEFLRYVIDACHNTCLRLKKLRRKGAEANGGGGGDTGGGTVVKEIFGGALQSQVKCLCCGYESNKVDEIMDISLDVFHSNSLKDSMQKFFQPEVLDGNNKYKCDSCKKLVAAKKQMSILQAPNILVIQLKRFEGILGGKIDKAVAFEEVLVLSSFMCKASQLLKKHFYAGEPLKVLVIKLLIFRKSMRNKESIMIEDPQPEYKLFGTIVHSGYSPESGHYYAYIKDAMGRWYCCDDSCVTVATLQEVLSEKVYILFFSRTNQRPVASCNSLASNGVKPHSNGSQTSECPKVGVPPKAVHVKSNSELSPCKDMPSVSKTAKAPSSSRVKFDINGSSSKRNPAPVSVNGKVDVSRNQPSVINGHVKDSVSLENGKKDSSLPTSNGIDKNKVAVDKLKRKESTVTNGHTGNQTVDIHSVKSDLKEDTDRSRVIAGRVPDNFKHESNDLNNKPTILGNKRKLQEDPCILLAHDGQSQARVQELKDILGKEAKSVLRSCGWTDKVYEFMRSKKLHAQEAGNLTNGDEIRLGFLAFVGTKGMARLGTTIKLCLGDWLVMGSNLETTFAYERIRMHTMILPHTFA

SEQ ID NO: 225309 - protein, 328 aa, Glycine max
  Coding DNA Sequence Number=SeqID_108531
  Gene Ontology: Mol. function=O-methyltransferase activity; Cellular component=integral to membrane; Biological process=protein prenylation
  Homolog annotation: Hit_ID=Q84ZM2; Match level="QueryCoverage=59%, HitCoverage=58%, E-value=6e-68, Identity=78%"; Hit description =Putative O-methyltransferase
  Pfam annotation: Domain name=AT_hook; Domain location=66-78; Score =14.9; E_value=0.061; Accession=PF02178.9; Description=AT hook motif
  Pfam annotation: Domain name=Methyltransf_11; Domain location=137 -240; Score=1.1; E_value=0.043; Accession=PF08241.2; Description =Methyltransferase domain
  Pfam annotation: Domain name=Methyltransf_3; Domain location=89-289; Score=188.0; E_value=2.3e-53; Accession=PF01596.8; Description=O -methyltransferase
  Pfam module annotation: Pfam domain module=AT_hook::Methyltransf _11::Methyltransf_3; Domain location=66-78::137-240::89-289
MRMLRWMCGKTRQDKIRNEAIRERVGVAPIVEKMVENRLRWFGHVERRPVDSVVRRVDQMERRQTIRGRGRPKKTIREVIKKDLELNDLDRSTNEQQSHLPSVMFHIVIPLAYQEVSPDLAQLLAMLVQILGAEQCIEVGVYTGYSSLALALVLPESGRLVACERDAKSLDVAKKYYQLAGVSHKVDVKVGLAMDSLESLILNGEAGSYDFAFTDAEKKMNEKYFELLLQLVRVGGLIVIDNVLWHGKVADPLVNDPKTFSIRNFNQKLMEDKRVSISMINSVELIYNILTLLESPGTYWRWDDNLSKKMTIFENLFGSFQKDLRTAY

SEQ ID NO: 225310 - protein, 92 aa, Glycine max
  Coding DNA Sequence Number=SeqID_108532
MHKEGLWIRGQSSTNLAKGKRTNYIVPFGHDIREERGVTSAPPLWASSTPPPLPPSLWRPRIAMPCTNGVREARHPPWWLLLLRPKCRLFQP

SEQ ID NO: 225311 - protein, 96 aa, Glycine max
  Coding DNA Sequence Number=SeqID_108533
MDIVIEEGSETNDLLLAIVVITGNNKLSGCYEWEATCAAHKESMQPAQCYTWISRTKCLPEIAEKKKMKVAYILIPLNTLLQAIYKARFLTEYRIL

SEQ ID NO: 225312 - protein, 91 aa, Glycine max
  Coding DNA Sequence Number=SeqID_108534
  Subcellular localization annotation: CTP_CleavageSite=28; ConfidenceScore=5.12e-01
MHKSEKRKVSGLEDRAAQISRKRNRPITSSHLATTSEKRVGSPGNSSFPHSLTFLLPISLFFLFSIFLLLLLLLLLQSLTVCLAGELHGHQ

SEQ ID NO: 225313 - protein, 106 aa, Glycine max
  Coding DNA Sequence Number=SeqID_108535
MGVLESQTSNDKGIVSKEKRAMGIGIGIGKNLKWDLNFATSRKKKVVTLLGRVKVTPLFEEVQKYFQNARKGKACLVSSESDQNVTGDVSVALSLGNSFGFCSRRY

SEQ ID NO: 225314 - protein, 445 aa, Glycine max
  Coding DNA Sequence Number=SeqID_108536
  Subcellular localization annotation: CTP_CleavageSite=26; ConfidenceScore=5.57e-01
MKKLSSTSSSHASPSSSSTTSLDPTMCTSKSATSGCLTAILRKILCSDGLPRDQIRELDSSNAMLSDKDQNFKAKQNSETDTASTATTTAATVTTTTTTTPGIVARLMGLESIEIPFGPKPSSLSRSRSMNSVEYLGAYNGMEEVLHKRVKSTLSFREAPTFLLHESEKFLELSFEGGGGKSREFRSNRRKREPVCAELKQNVRSERGELRENKREKVCDEKVLIEKGKLGKKRVSHVSSGSVGSGGKLQEITNTLHHSKASSEKKCFDDSEAGKLSQNMKGKEVAVGEKQKRRRKKKKTICQKKNKIEVETKSEDSSPVSVLDFEREACATVGLSSRRKLSPKLDNDQHLPVQSDGNLMIDESKVEAIDNNKDEGSKKKEKNDQEYIDIWGEVCRIVEDELAESNKIHIWTNKQGDLGSISADFEAEIFDNLLNELVDQLAGIH

SEQ ID NO: 225315 - protein, 118 aa, Glycine max
  Coding DNA Sequence Number=SeqID_108537
  Subcellular localization annotation: CTP_CleavageSite=91; ConfidenceScore=5.12e-01
MEKKAKGYLTVRGTRKGSMLPHELPVASQLIPASFRSFSSTWATTNGALHVSAQRWNCSASSCCFRVRECRCKWKRVLRCCSTTVMNGKLRAQAIRKACNLLHEAFIARKLVRKCQCC

SEQ ID NO: 225316 - protein, 442 aa, Glycine max
  Coding DNA Sequence Number=SeqID_108538
  Gene Ontology: Mol. function=nucleic acid binding; Biological process= regulation of transcription
  Homolog annotation: Hit_ID=Q9LUZ4; Match level="QueryCoverage=91%, HitCoverage=66%, E-value=1e-121, Identity=54%"; Hit description=Zinc finger transcription factor-like protein
  Pfam annotation: Domain name=Ank; Domain location=60-93; Score=16.3; E_value=0.11; Accession=PF00023.20; Description=Ankyrin repeat
  Pfam annotation: Domain name=Ank; Domain location=95-130; Score=35.6; E_value=1.7e-07; Accession=PF00023.20; Description=Ankyrin repeat
  Pfam annotation: Domain name=zf-CCCH; Domain location=260-285; Score =23.5; E_value=0.00074; Accession=PF00642.15; Description=Zinc finger C-x8-C-x5-C-x3-H type (and similar)
  Pfam annotation: Domain name=zf-CCCH; Domain location=295-316; Score =1.2; E_value=0.91; Accession=PF00642.15; Description=Zinc finger C -x8-C-x5-C-x3-H type (and similar)
  Pfam module annotation: Pfam domain module=Ank::Ank::zf-CCCH::zf -CCCH; Domain location=60-93::95-130::260-285::295-316
MGDEHGRQEGLHHKISALLEFSAADDVTSFKDAVEKEGHDVDEVGLWYGRRVGSKELCFEERTPLMIAAMFGSKSVLSYILGTGRVDVNRACGSDGATALHCAVAGGSSASLEVIKLLLDASADVSTVDANGNRSCDLIFSVSNGVFNSRKRILQAVLEGADGIDEACLRFEEAVGQMEKQQQQDVDALQVSKDGTEKKDYPVDLSLPDIKNGIYSSDEFRMYTFKVRPCSRAYSHDWTECPFVHPGENARRRDPRRYQYSCVPCPEFRKGFCSKGDACDYAHGIFECWLHPAQYKTRLCKETGCTRRVCFFAHNVEDLRPVYASTGSAMPSPRSYSVSSPPLDPFTLGSPSALIPPASSPPLTPSGGSSPAGGTMWHSQIHVAVPTLQLPQSRLKSALNARDVELDMELLGIENHRCLMQQLMMEGTAGLSSPSNWNNSNA

SEQ ID NO: 225317 - protein, 286 aa, Glycine max
  Coding DNA Sequence Number=SeqID_108539
  Gene Ontology: Mol. function=nucleotide binding; Biological process =protein folding
  Homolog annotation: Hit_ID=O80875; Match level="QueryCoverage=99%, HitCoverage=25%, E-value=4e-43, Identity=38%"; Hit description =Expressed protein
MRKTVLDYIAGELSKKPHSVVFLENVDQADFLVQNSLFHAMRAGKFPYSHGREISINNAMFIVTSSVFKSSGSFNLEEDPKMFPEERILEAKRCQMQLSLGHASEGAKRSGCTNVKVAERKGKSKTTFLSKRKLIESGDLKDKAPCKTLKPVREASRSYLDLNMPLEEVEEGNNYNDDESESIVENSGAWLNDLCDQVDEKVVFKPFNFDSIAEQVIKSIDTQFQKMLGSEFILEIEYEVMTQILAAAWLSDKKKSLEDWVEHVLGRSFGEAHQKYHFAPEFVMKL

SEQ ID NO: 225318 - protein, 114 aa, Glycine max
  Coding DNA Sequence Number=SeqID_108540
MQPPTQIHHEQNKSRILAVKPPPSTCRKDKMKSNRTPPLIPSPHANQEREGKLCGCNNVLWGARRGRATQLHFENRFMQRLQGLYVSNRGSSSHVYAPQGLYSKVTRIDLCAKT

SEQ ID NO: 225319 - protein, 71 aa, Glycine max
  Coding DNA Sequence Number=SeqID_108541
MTVSSPPTLTYCQTTSVPLTLYSCITKMGPRMTDVVVVDIQRHLEQRRCGARRRYRFSTDVEASFCSCEPK

SEQ ID NO: 225320 - protein, 90 aa, Glycine max
  Coding DNA Sequence Number=SeqID_108542
MIGSAKMMDGLYYFENTFKNKEAQGLSDFIDQTNENKGNPMPDLGGAQAGKEIPQSNKECRVYTRKYPKRIKEQSIISAPNQEEFLEEHY

SEQ ID NO: 225321 - protein, 44 aa, Glycine max
  Coding DNA Sequence Number=SeqID_108543
MWVMGTEGLCSEALSHMLETKGHVCTEAQSQGYAQNEKGGGDAI

SEQ ID NO: 225322 - protein, 161 aa, Glycine max
  Coding DNA Sequence Number=SeqID_108544
MADLGGGFAKKRHRIAVAWRVWDGGAMAATIAMAVVTIMAGWRKMAGFAWFLSAVGVGPTRPNPTRLCIQLNVVPRRTSPLRPSLTSASFPHPVAPSRRRDRRHPHSPRTQPPPPATPLHEDEGQLRASPGNAASRDRDASSFCLVKKTKKTKTQTRVSQP

SEQ ID NO: 225323 - protein, 123 aa, Glycine max
  Coding DNA Sequence Number=SeqID_108545
MPSPVQPSHSPSAEGEKHKQLNKEIRGMLSAITHRVTDFHKPGSTNQMENDGEHAINNSVMLGGSYQANDPGVHMDISDFSTAHEHHHQSHYHKEERHGKKGKKIEKKASKPKESSSSSSSSD

SEQ ID NO: 225324 - protein, 421 aa, Glycine max
  Coding DNA Sequence Number=SeqID_108546
  Gene Ontology: Mol. function=kinase activity
  Homolog annotation: Hit_ID=Q10LZ1; Match level="QueryCoverage=31%, HitCoverage=30%, E-value=9e-40, Identity=59%"; Hit description=Myb -like DNA-binding domain, SHAQKYF class family protein, expressed
  Pfam annotation: Domain name=Myb_DNA-binding; Domain location=186 -237; Score=43.5; E_value=7.2e-10; Accession=PF00249.21; Description =Myb-like DNA-binding domain
IDCVGRTQQSYGLNGDWNSEFGNCSSQYFDVRQASNMGTCNQPLAMASGGGVEQEPHIGQNKSSSSIISRFKSPASAFYATEMCMGGFPQYDSQIGNPSLMSHSSNNFLPIEQHKLFIDDAAPISRSPSIPSKGNQGQTVSCGSFNLPSAQLSFSSQQEMLSPTGSMPTNSGNSSSNGSVVSSKTRIRWTQELHEKFVECVNRLGGAEKATPKAILRLMDSDGLTIFQVKSHLQKYRIAKFMPQPTQGKSDKRTNAENVHLDVKTGFQIREALQLQLDVQRRLHEQLEIQRKLQLRIEEQGKQLKMMFDQQQKTTDSHLITENSDRPISSKDVLGKAAYNIPPPYLRIAKSLWAMGNNLNSGAGGGDNGCSSSERNKNDSGDCSGRNNSVVMVVAIKIKNFLTKTKVDLVVNGEGKGKEVT

SEQ ID NO: 225325 - protein, 197 aa, Glycine max
  Coding DNA Sequence Number=SeqID_108547
  Gene Ontology: Mol. function=phosphoinositide phospholipase C activity; Cellular component=integral to membrane; Biological process=intracellular signaling cascade
  Homolog annotation: Hit_ID=Q1GYG2; Match level="QueryCoverage=93%, HitCoverage=93%, E-value=2e-42, Identity=49%"; Hit description =Fimbrial assembly
  Pfam annotation: Domain name=PilN; Domain location=4-165; Score =149.2; E_value=1.1e-41; Accession=PF05137.4; Description=Fimbrial assembly protein (PilN)
MIKVNLLPHRQIRRAVRQREFGLMASLVTVPTAAILFVSWSYIHNKIQAQQARNQRLQDEMSRLDKEIAVIGTLKEQIKHVLERKQIVEGFQSDRNQPVLILDELARQLPEGAFLKSVKQLGDEIELKGVADTNARIATLVHNLSDSAIMHSPNLVEIKANTNALGVKEYEFVLRVSLKREVAQEGADKQKLMPAKG

SEQ ID NO: 225326 - protein, 194 aa, Glycine max
  Coding DNA Sequence Number=SeqID_108548
  Gene Ontology: Mol. function=chorismate mutase activity; Cellular component=integral to membrane; Biological process=cell redox homeostasis
  Homolog annotation: Hit_ID=Q1GYG3; Match level="QueryCoverage=91%, HitCoverage=82%, E-value=2e-47, Identity=55%"; Hit description=Pilus assembly protein, PilO
  Pfam annotation: Domain name=PilO; Domain location=29-177; Score =177.4; E_value=3.4e-50; Accession=PF04350.3; Description=Pilus assembly protein, PilO
MKAVLLSILAAALLVLGYVFLLSPNLKELKAEKEKEQGLRDEYMAKKIQAVKIKAYEQQVVEIQRTFGALLKQLPDKAEMDRLLTDINQAGLGQGLSFEGFVPMPEVFAEFYAEKPINIKVLGHYHELGAFVTEVAKLSRIVTLHNLQIQAAGKDDKQPHKDMLVMEAVAKTYRYLDADEVAARKAQESKAGKK

SEQ ID NO: 225327 - protein, 152 aa, Glycine max
  Coding DNA Sequence Number=SeqID_108549
  Gene Ontology: Mol. function=transferase activity, transferring nitrogenous groups; Cellular component=cytosol; Biological process =biosynthetic process
  Homolog annotation: Hit_ID=UPI0000669483; Match level="QueryCoverage =95%, HitCoverage=38%, E-value=5e-41, Identity=57%"; Hit description =putative aminotransferase
MIQLPLSKLSNVGTTIFSQMTQLANENQAINLSQGFPDFMPDPELLNYVDNFIKKGFNQYAPMGGMIGLKEEIARKIENSHQAIYHPDSEITVTAGGTQAIFTAIATFIKRDDEVIIFEPAYDCYEPTVELFGGVIRRFEMKAPDYVIDWNA

SEQ ID NO: 225328 - protein, 90 aa, Glycine max
  Coding DNA Sequence Number=SeqID_108550
  Homolog annotation: Hit_ID=Q9FMX9; Match level="QueryCoverage=38%, HitCoverage=7%, E-value=3e-11, Identity=82%"; Hit description=Serine carboxypeptidase II-like protein
MVVISLSMKLKEEHCSIGFSRPLTNQNKNPFFYGSMECQNLLLELADYSVYQCGGCGAVLRAKHKGYVSGSLSDEGKVVLGGDSGKLESS

SEQ ID NO: 225329 - protein, 50 aa, Glycine max
  Coding DNA Sequence Number=SeqID_108551
MHSINFLLCQYLLAKVCDIYPRIELANGKTKYAKYSDSKSIQMPKLRRIQ

SEQ ID NO: 225330 - protein, 198 aa, Glycine max
  Coding DNA Sequence Number=SeqID_108552
  Gene Ontology: Mol. function=nucleotide binding; Biological process =protein folding
  Homolog annotation: Hit_ID=O80875; Match level="QueryCoverage=90%, HitCoverage=16%, E-value=8e-20, Identity=37%"; Hit description =Expressed protein
QPISCLDDNCRRIVEVITRKTKRNPLLMGVYAKTALRSFVEVVKKNGKGGVLPCELNGLSVVSVEKEIGEFLREGGRGEMIFEHVGHLVEHGGGGVVVCYGEIEVFVGGYKEEGSVGFVVSQLTRLLGVHGGGKVWLLGVAGTSEDYSKFLRLFPTVDKDWDLHLLTMTSATPSIEKLYPKSRPITLMQAGMVAISLH

SEQ ID NO: 225331 - protein, 65 aa, Glycine max
  Coding DNA Sequence Number=SeqID_108553
MYLRIGKEQKGRKRGENESIQCIMGSRYEKWRVLIKWAPSQLNHHSRTKNASLYPTPQSLAFSHN

SEQ ID NO: 225332 - protein, 145 aa, Glycine max
  Coding DNA Sequence Number=SeqID_108554
  Subcellular localization annotation: CTP_CleavageSite=38; ConfidenceScore=5.55e-01
MGSFVPFGGFFSTPSEFKNPVGPAATSTSVYSSTSLPRLQKVNVDSDRGLDVAKEVAAEILPVSVPFDTVSITDEADQIPKVSKTDMHGTWVSPSPKANISLLDPTTFSSVTPVTTDLGLGTIYTSAAHEPDTPKLSDHKKPLHH

SEQ ID NO: 225333 - protein, 304 aa, Glycine max
  Coding DNA Sequence Number=SeqID_108555
  Gene Ontology: Mol. function=RNA-directed DNA polymerase activity; Cellular component=intracellular; Biological process=RNA-dependent DNA replication
MKEEVQKEVLKLLEAELIYPISDSAWVSFVQVVPKKEEMTVIRNEKNDLIPTRIVTEWRICIDYRKLNDATRKDHFPLPFMDQMLERKFGAEVGEISLHGSRRNNVGPQGIKVDKAKIHVIEKLPPPFNVKGIRSFLGHAGFYRRFIKDFSKIARPLSNLLNKDEVFKLDEECLTTFQTLKNSLVSALIIVTLDWTKEFELMCDASDYAVAAVLGQQRDKADLKPRLVRWALLIQEFDIVIKDKKGSRNVVVDHLFRKDLGFHIWPTTKLQVLFQMTSTGISGRSSSMMFVSVSGMIPIFSRLE

SEQ ID NO: 225334 - protein, 167 aa, Glycine max
  Coding DNA Sequence Number=SeqID_108556
MKNKKVEATGVSLSEALNSLSELGEYAKHTCAQPTISSPNESFVSSGAKRASLAKPKAKFDEGSENEVPGSLCSGDVHNAVIISSDLCNIIITNTRGITPLQKVVGLLARQPEREIPLVSSLAAGEIVDEGYGPREVGHGRGSRAWGRVAPVEKKAGQWEKRRLEEG

SEQ ID NO: 225335 - protein, 112 aa, Glycine max
  Coding DNA Sequence Number=SeqID_108557
MESMIPRTGSSKEKLDQALATPEWIDMFPSFKLINVKRFHFENTWLLELELNDVVELGWSHLNGQNFLSKLSITSAEMNSWGNQIRGKYCTKIVEVRTKMEQTREMNDIHST

SEQ ID NO: 225336 - protein, 49 aa, Glycine max
  Coding DNA Sequence Number=SeqID_108558
MASSYFLISSSVSTLFFFKDLTIFTIEVQSHRAIFEGFGLYQLQAFNSA

SEQ ID NO: 225337 - protein, 126 aa, Glycine max
  Coding DNA Sequence Number=SeqID_108559
  Pfam annotation: Domain name=DUF623; Domain location=40-104; Score =107.4; E_value=4.2e-29; Accession=PF04844.4; Description=Protein of unknown function, DUF623
MLTIFSFKKFVLGLILGLSSSDESEAKALLDRSVAVRKYSPDPYADFRQSMEEMVAARPELMDVAAKWRELHELLLCYLALNPKSTHKFILRAFSDFLLSLISRSYLPPQDPGSGDIAGDGGGCLS

SEQ ID NO: 225338 - protein, 34 aa, Glycine max
  Coding DNA Sequence Number=SeqID_108560
MTEELTPDATMAGDATMSFIVGASEDDVINEEGF

SEQ ID NO: 225339 - protein, 142 aa, Glycine max
  Coding DNA Sequence Number=SeqID_108561
  Gene Ontology: Mol. function=transmembrane receptor activity; Cellular component=exocyst; Biological process=exocytosis
  Homolog annotation: Hit_ID=Q9FFX6; Match level="QueryCoverage=95%, HitCoverage=18%, E-value=5e-39, Identity=59%"; Hit description =Putative leucine zipper protein
MERANSTSRPHYEDSKPNNNNKQKENVSPFAAQLMRVMELLDTNLEGKAKLYKEVPLSLIFMMSNRRYIVQKIKGSTEIYEVMGETWCRKRSMDLRTYHKNYQVETWSKILSSLSPKGLNENRKVHKLVLKKRFKSFNLTFE

SEQ ID NO: 225340 - protein, 44 aa, Glycine max
  Coding DNA Sequence Number=SeqID_108562
MKRLSRAEDAYGHAEELRLQPRAKNSSQMSSNLRPAYAIQREMR

SEQ ID NO: 225341 - protein, 81 aa, Glycine max
  Coding DNA Sequence Number=SeqID_108563
MDLCAALVLMGHLKEEIKDSSLIPNMVKSTSFLDACNLLKCSNEVDANIDELSTSLGADIETFLRSPPTSKQKKQKVGSRE

SEQ ID NO: 225342 - protein, 495 aa, Glycine max
  Coding DNA Sequence Number=SeqID_108564
  Homolog annotation: Hit_ID=Q1STP5; Match level="QueryCoverage=75%, HitCoverage=74%, E-value=1e-15, Identity=31%"; Hit description=IMP dehydrogenase/GMP reductase
  Pfam annotation: Domain name=DUF1723; Domain location=168-215; Score =10.3; E_value=0.031; Accession=PF08330.1; Description=Protein of unknown function (DUF1723)
MVRTRGLGRDLGTGRGRDLSQDAHEPEVRRRHWPTASVHWQQVHVTEDVTQKPKDVPQLNEDVPHVSDATPEMTSAVDVADAEGVASDGSLGSPAVDEGFPGGPRDPSVLTGFAEHVAHSIWSGEERPNLKLVSHGRKVDKFGRLAPEIEDMIAATRLSPLIRCSIITTDPGLISAFVMRWHRETSTFHLPPLVTFDAVGLLTELLEVTPEEAIAETRQAGGPHVRLSWLQDAFKDLAQEGGFSWGADALIHLYEHLNEASQTPTRQMAGYITLLQCWIYEHFSMVHQCIVDDAYVEASPRASRWLTGKAHMTGIKGAPYRACMEALTVTDIVVYVRPEWVLRQFGYIQTVPPPPVRDLLIGHDIDDRWLHFLDHLVPTREICVVPGQVAPDYMDWFFRISHLFVTQTEDGAEPRHPPTPHDEEFVEPPIPEVPVASDLRTHSVDLGAIAEDLERVINLRMVTEGTNLYDILARCLMIARGDAADEVLGRDKEDA

SEQ ID NO: 225343 - protein, 70 aa, Glycine max
  Coding DNA Sequence Number=SeqID_108565
MSWLQVKGGFPLSPQQHFLHHLGVQPAGLFEEAIFLLWSWLRGFEKDFTVHFNHWSSNLPQSFMYQQGIA

SEQ ID NO: 225344 - protein, 838 aa, Glycine max
  Coding DNA Sequence Number=SeqID_108566
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=88%, HitCoverage=36%, E-value=0.0, Identity=52%"; Hit description=CCHC -type integrase
  Pfam annotation: Domain name=B_lectin; Domain location=51-155; Score =60.0; E_value=7.9e-15; Accession=PF01453.15; Description=D-mannose binding lectin
  Pfam annotation: Domain name=Pkinase; Domain location=496-766; Score =122.2; E_value=1.5e-33; Accession=PF00069.15; Description=Protein kinase domain
  Pfam annotation: Domain name=Pkinase_Tyr; Domain location=496-766; Score=114.8; E_value=2.5e-31; Accession=PF07714.7; Description =Protein tyrosine kinase
  Pfam annotation: Domain name=S_locus_glycop; Domain location=175-305; Score=-34.0; E_value=0.012; Accession=PF00954.11; Description=S-locus glycoprotein family
  Pfam module annotation: Pfam domain module=B_lectin::Pkinase::Pkinase_ Tyr::S_locus_glycop; Domain location=51-155::496-766::496-766::175-305
NIAIGDSHTAGASTSPWLVSSPSGDFAFGFLPLEDTPDHFMLCIWYAKIQDKTIVWFANRDKPAPKGSKVVLTADDGLVLITAPNGNQLWKTGGLTVRVSSGVLNNTGNFVLQDGDSNTVWESFKDYRDTLLPYQTMERGQKLSSKLRRNYFNKGRFVLFFQNDGNLVMHSINLPSGYANEHYYESGTVESNISSAGTQLVFDGSGDMYVLRENNEKYNLSRGGSGASSTTQFFYLRATLDFDGVFTLYQHPKGSSGTGGWTPVWSHPDNICKDYVASAGSGVCGYNSICSLRDDKRPNCKCPKWYSLVDPNDPNGSCKPDFVQACAVDELSNRKDLYDFEVLIDTDWPQSDYVLQRPFNEEQCRQSCMEDCMCSVAIFRLGDSCWKKKLPLSNGRVDATLNGAKAFMKVRKDNSSLIVPTIIVNKNRNTSILVGSVLLGSSAFLNLILLGAICLSTSYVFRYKKKLRSIGRSDTIVETNLRCFTYKELEKATDGFDKVLGKGAFGIVYEGVINMGSDTRVAVKRLNTFLLEDVHKEFKNELNAIGLTHHKNLVRILGFCETEEKRLLVYEYMSNGTLASLLFNILEKPSWELRLQIAIGVARGLLYLHEECSTQIIHCDIKPQNILLDDYYNARISDFGLAKLLNMNQSRTNTAIRGTKGYVALEWFKNMPITAKVDVYSYGVLLLEIVSCRKSVEFETEDKEKAILAEWAYDCYTERTLHALVEGDKEALDDMKNLEKLVMIALWCVQEDPDLRPTMRNVTQMLEASMKSFNGNFPPWRCNGRQRRRGERRRHPLGNKPWKKELHHQDEPWIRSLKRMLQWMKRKRERKREGGARN

SEQ ID NO: 225345 - protein, 61 aa, Glycine max
  Coding DNA Sequence Number=SeqID_108567
MVEPDKNCETRVEDVAWPCSLSESEIAWLMYSDHIGMANVKKYSEKSVGSNLGSAGSNNLG

SEQ ID NO: 225346 - protein, 186 aa, Glycine max
  Coding DNA Sequence Number=SeqID_108568
  Subcellular localization annotation: CTP_CleavageSite=33; ConfidenceScore=5.09e-01
MVNFIINSPHLSQAPHRFLFASLRGLSFVHSCRSNASLYYIKMKEITMDFRNKQCDRGSVKVTKITPFSEKDNLYKVSSSSRKRCKDKLKLTRNKHRITVTLKKTVNARLGFILYRNCETSLEDYTSIEGFPRCGVSTENNGGPWWPPVVVGGGEEAWDVGEGFWKKEGERNDCYPRLHKKYDLKH

SEQ ID NO: 225347 - protein, 52 aa, Glycine max
  Coding DNA Sequence Number=SeqID_108569
MAESDGSNNNFRKRHFDDKKKKILMVVWDDSNNEKSSNSDNEQVVKQVASIT

SEQ ID NO: 225348 - protein, 66 aa, Glycine max
  Coding DNA Sequence Number=SeqID_108570
MAGCRDDEAGRYKGRGVGEEGGELGELGHGGEEGNEDQVHSWHYINNCIQGIHIALAMVEGDSEET

SEQ ID NO: 225349 - protein, 129 aa, Glycine max
  Coding DNA Sequence Number=SeqID_108571
  Gene Ontology: Mol. function=GPI anchor binding; Cellular component =membrane; Biological process=cell adhesion
  Homolog annotation: Hit_ID=Q5N9U4; Match level="QueryCoverage=65%, HitCoverage=21%, E-value=2e-10, Identity=40%"; Hit description =Endosperm specific protein-like
MSLKGKLVVNDMLVDEDSKSDEAFRPSTTEESDEDTNLERKDGGVGGGVRCGGANRDDAKLEVVGEIHGAEVVSDTGSGLKEHGDELARRGEGMEVGLEEELEEDVIAKDVDDGGRGQGEVVVRDRGAT

SEQ ID NO: 225350 - protein, 133 aa, Glycine max
  Coding DNA Sequence Number=SeqID_108572
  Homolog annotation: Hit_ID=Q9SDQ4; Match level="QueryCoverage=35%, HitCoverage=5%, E-value=4e-11, Identity=70%"; Hit description =Glutamate receptor 3.7 precursor
METGGRTGLDQWQHMKQEELGEHQQFEKPCELRQMTADQLWLQPLSQVPPSLNLEISHPNVPMDNVCVLPDQDKGRLCGSFSRPSPKNAAKLTTAAILFYYTIITGPEKSISLKPIGLEQRDSSVFSHVTKVL

SEQ ID NO: 225351 - protein, 116 aa, Glycine max
  Coding DNA Sequence Number=SeqID_108573
  Gene Ontology: Mol. function=ionotropic glutamate receptor activity; Cellular component=integral to membrane; Biological process=ion transport
  Homolog annotation: Hit_ID=Q9SW97; Match level="QueryCoverage=86%, HitCoverage=10%, E-value=2e-20, Identity=47%"; Hit description =Glutamate receptor 3.5 precursor
MMNSGYVWIASDDALASTLDSLDPVDTKTMNLLQGVLVLRHHTPDTNEKKSFLSRMKRPKTKETPSFNSYALYAYDTVWFVARALDAFLKKGSVVSFSSDPRHKWKHVAFTIASCF

SEQ ID NO: 225352 - protein, 534 aa, Glycine max
  Coding DNA Sequence Number=SeqID_108574
  Gene Ontology: Mol. function=ionotropic glutamate receptor activity; Cellular component=integral to membrane; Biological process=ion transport
  Homolog annotation: Hit_ID=Q9SDQ4; Match level="QueryCoverage=95%, HitCoverage=54%, E-value=1e-161, Identity=56%"; Hit description =Glutamate receptor 3.7 precursor
  Pfam annotation: Domain name=ANF_receptor; Domain location=42-404; Score=312.8; E_value=6.1e-91; Accession=PF01094.18; Description =Receptor family ligand binding region
MKKFMVLHLLTWIWLCGVAHSGRPASVNIGAVFSFDSIIGRAAKTAMEMAVSDVNEDPTVLMGTKLNLIMKDAMCNAFLGSIGAFQVLEKGVAAIIGPQSSAVAHTVSQIADALQVPLVSYAATDPTLSSLQFPFFIRTTQSDLAQMTAMADIIDFHGWKEVIVVFLDDDYGRNGLSALSDELEKRKLKISYKLPLSIKFDLDEITNLLNQSKVVGPRVYVVHVNPDPRLRIFFIAHKLQMMAKDYVWLVTDWLSATLDSLSPVNQTSFSVLQGVVGLRQHIPDSSKKRAFVSRWIKMQKEGLANTGLNSYGIYAYDTVWAVARAIDIFIKVHNNITFSLPDNYNLSHTVGIGILLDKLKIFAGGSDLVDILLQSNFTGVSGQLHFNSDRSIVSGGYDIINVNQMGISGVGFWSNNSGFSVVPPTALKKRKYNRFSQDQKLGKVIWPGGVTDQPRGWVIADNTKPLRIGVPKRASFVEFVTELPDSHQIQGYCIDVFKKALEFIPYEVPFVFKPFGNGKENPNYDALVKMVDEN

SEQ ID NO: 225353 - protein, 968 aa, Glycine max
  Coding DNA Sequence Number=SeqID_108575
  Gene Ontology: Mol. function=ionotropic glutamate receptor activity; Cellular component=integral to membrane; Biological process=ion transport
  Homolog annotation: Hit_ID=Q8GXJ4; Match level="QueryCoverage=94%, HitCoverage=93%, E-value=0.0, Identity=62%"; Hit description =Glutamate receptor 3.4 precursor
  Pfam annotation: Domain name=ANF_receptor; Domain location=67-446; Score=308.1; E_value=1.6e-89; Accession=PF01094.18; Description =Receptor family ligand binding region
  Pfam annotation: Domain name=Lig_chan; Domain location=627-892; Score= 301.1; E_value=2e-87; Accession=PF00060.17; Description=Ligand-gated ion channel
  Pfam annotation: Domain name=SBP_bac_3; Domain location=508-851; Score=-2.7; E_value=6.9e-08; Accession=PF00497.10; Description =Bacterial extracellular solute-binding proteins, family 3
  Pfam module annotation: Pfam domain module=ANF_receptor::Lig _chan::SBP_bac_3; Domain location=67-446::627-892::508-851
  Subcellular localization annotation: CTP_CleavageSite=71; ConfidenceScore=5.11e-01
MEVLWVTRHGRMFEGRVLLLLVLFLWIPAQVVVGRTRTTITNSTTSSAPRVLRVGALFTLNSIIGRSAKPALMAAFEDVNADSSVLPGIQLKVILHDTNCSGFVGTMEGSANMLLEFRQYGYNLPVLALLHMLMEDEVIAAIGPQSSGIAHVISHVVNELHVPLVSFGATDPSLSSLQYPYFVRSTQSDYYQMHAIADLVDYYRWREVIAIYVDDDNGRNGITVLGDALSKKRAKISYKAAFPPGALKKDISDLLNGVNLMESRVFVLHVNPETFLNIFTIANKLGMMNSGYVWIASDALASTLDSLDPVDPNTMNLLQGVLVLRHHTPDTNEKKSFLSRMKRLKTKETPSFNSYALYAYDTVWLVARALDAFLKKGSVVSFSSDPKLLDTNGSMLHLQSLRVFDDGPSFLETILSTNFSGLTGTVQFDIERNRNHPAYDILNIGGSGMRRIGYWSNYSGLSVVTPEILYKKPPNTSTSSQQLYGVIWPGETAAKPRGWVFPNNGKPLRIAVPNRVSYKEFVSKDKNPPGVRGYCIDVFEAAINLLPYPVPREYILFGPGNRNPSYDDLASQVALNNYDAAVGDVTIVPNRTRILDFTQPYMESGLVVVVPVKETKSSPWSFLKPFTAQMWCVTGAFFIFVGTVVWILEHRHNPEFRGRPKKQLMTVFWFSFSTMFFSHRENTVSGLGRLVLIIWLFVVLIINSSYTASLTSILTVQQLSSQIEGIDSLISGTQPIGIQEGSFARKYLTEELNIQPSRIVTLKNMEAYIDALEKGPKDGGVVAVVDELPYIEILMSSTNCKVRTVGQEFTKSGWGFAFQRDSPLAVEMSTAILQLSENGDLQKIHDKWLLKHDCSAPDNDADLNKLSLSSFWGLFLICGIACLLALVAFSIRVLCQYTKFSPEPEQDDEETSPNRPTKGKRLFRSTTSFRDLIYFVDKKEKEIKEILRQKSKKRRRNLSLDGQSSSPT

SEQ ID NO: 225354 - protein, 91 aa, Glycine max
  Coding DNA Sequence Number=SeqID_108576
  Homolog annotation: Hit_ID=Q00UQ3; Match level="QueryCoverage=51%, HitCoverage=29%, E-value=1e-09, Identity=57%"; Hit description =Chromosome 15 contig 1, DNA sequence
MSSSSRPVPRRESPWGVTGENHPEPKAHRCNDRVEDVIQACFEGNPFKTVPGPFKLFWQCMRSKPGSDSHLLLSYEFCELIQHFASKEPLL

SEQ ID NO: 225355 - protein, 1383 aa, Glycine max
  Coding DNA Sequence Number=SeqID_108577
  Gene Ontology: Mol. function=RNA-directed DNA polymerase activity; Cellular component=membrane; Biological process=RNA-dependent DNA replication
  Pfam annotation: Domain name=Exo_endo_phos; Domain location=654-888; Score=56.8; E_value=7e-14; Accession=PF03372.13; Description =EndonucleaseExonucleasephosphatase family
  Pfam annotation: Domain name=RRM_1; Domain location=68-138; Score =42.4; E_value=1.6e-09; Accession=PF00076.12; Description=RNA recognition motif. (a.k.a. RRM, R
  Pfam module annotation: Pfam domain module=Exo_endo_phos::RRM_1::RVT _1; Domain location=654-888::68-138::1147-1383
MNRFRERNTSFRARNTGWVRDRLRRKAAARIGDSPWKVTQWDSAGNRSRGLQLHKVSNWRDHKDIATFYFTRFGEEITEEELWQHFKKWGDVREVFIPNRRNYSGRRYGFVRFKGVRDVPYLARQLDRIIIGGLKLYVNIPKHGREKPAQGGAGIKLQRNEGGTQTQADHARQPHQTHPASYREVGAWVGRLRNPATFDRLEDDLWWEIGLKIAPKYIGDDLVLLLGLSEEDEEQIMHGGQDRSSPMFYSMEKWSPSLRTGNRLVWVHCWGIPLQAWDKKYIQQIMSVMGEMVDMDDEVEEKRRLDRARVLIKTSWRPTIQHTIHVLTADETFAVDVIKETTSTYHEGIRGRRSVGGSSDDIFSDDSSYGDRHSQTHSQTHCGDAATSSAANAMPEAHMQTSTVPETQVERGCRTDGGLESHGTILLPSGLSNFEYPVDNIVNQRTIAEPQWVTAAPHKFHQNGNFERREKEGLTETHNDSIAATPDHSSIGDPTEPKDQSCSNGKFKNVEEDEDRGVETPREQRMGICEDISGPNHITSSSICTPNGKMHKLGLGPIATKAETENNTWQVYSRQKRYQKKSKPGLNECNTVETEQGSSARNQPLQILARRDSAYCETNNCASDISNHNGGRGPNTESHQDRISEMGSQQEGSMNIVSYNVRGLGRGVKWAAIRRMIKKEGADMICIKETNKEVVDKAMCQALWGDVEVCWEMLPANNTAGGILCLWSEINFRLQSKTIGNGFIHLTGEWIKEGQHINIVSVYSPCDIHGKRLLWDNIKQLKDSLHGGLWCILGDFNNIRHPDERYGTGQRISGDSSITEFNDWIQDLELIEAPWIGRNYTWYRPNGESRSRIDRFLVSHEWIERWPGSYQSTLARNFSDHCPILLRSKVTDWGPKPFRILDCWLSDKSFKEIVYQSWNSHQQPGWGGYVLKEKIKRLKRRLKIWNQEQFGDTLKRVKKVEAEINKLEEDTSHRQLSSEEVSKRKQLQEALWTTAQAHESLLRQKARSRWIKEGDCNSRYFHLLMNTNRRNNSLKGIMLDGMWTDEPHKVKEAVRSFFLQRFQEPDFQRPRLDGINFRSISHQQNSLLSAPFQVEEVEQAIRDCGSDKSPGPDGLNFKFIKKFWQLIKLDVIRFIHEFHANGIFPRGCNASFIALIPKVVDPQLLNEYRPISLIGCMYKIVAKLLASRMKEVMSSIIDEVQSAFIEGRQLLHSALIANEVIEEAKRSNKACIVFKVDYEKAYNSVSWDFLLYMLRRTGFSPKWSKWIEGCLKSASISVLVNGSPSSEFLPQRGLRQGDPLAPFLYNVVAEALSGLMRKAVEENLYEGFSVGSNQVKISILQYADDTIFFGEASIANVKAIKAVLRHSHWGQPEALSDVGANYS

SEQ ID NO: 225356 - protein, 184 aa, Glycine max
  Coding DNA Sequence Number=SeqID_108578
MDPNFDVPGSGNQLFTMAISSNQPTWTKQTSDKQEYEPQGSHFVVPGSGKQSLTTTTSANHQSMAIKQTNIYHVESTTLGNHRPIWAEPTTSTPSLIDPNVIVDVIKNHFKIQLKLIGKPIYKKLYLKWIDKVAPLLRGDEVPNFSHSQSLGNAPSAEGEADNARLCKPFSTDDQSYKGGTMCP

SEQ ID NO: 225357 - protein, 119 aa, Glycine max
  Coding DNA Sequence Number=SeqID_108579
  Homolog annotation: Hit_ID=Q9LKB3; Match level="QueryCoverage=99%, HitCoverage=25%, E-value=5e-31, Identity=59%"; Hit description =Similarity to rab3 GTPase-activating protein non-catalitic subunit
MARRSYKTELGCIACEELGELGAGKPHWLVETPQLLCAIDTHSLILANRSTILLLSWSSDSSAAPPPLKIRPDLSPIDAESISALEWLAFRDHRVIVAGTSSGNVLFYSLRGELIHRQV

SEQ ID NO: 225358 - protein, 95 aa, Glycine max
  Coding DNA Sequence Number=SeqID_108580
  Gene Ontology: Mol. function=transition metal ion binding
MTKEWGRYSFYPKSQDNKSIMQNNGVSLRAESQQFAIVYDDNPHVASMPYFGVIEEIRELNYVKFTFCVFKCKWVDSNIGVRTDDFRFEEARLSK

SEQ ID NO: 225359 - protein, 35 aa, Glycine max
  Coding DNA Sequence Number=SeqID_108581
MSAFILLLHLLYFTYCSCSSTGKNVMSNATNEQHG

SEQ ID NO: 225360 - protein, 267 aa, Glycine max
  Coding DNA Sequence Number=SeqID_108582
MAYNNHTLKEWATPDVVYQTWCIKYPKIEVSYELKSRLAYLLPKFQGLASEDPHKHLKEFHVVPQQQQYNPYSNTYNPGWRDHPNLRYGPSPQQQFQPSISQYHAPPFRPQQQQFQQSTPPLSQPVHNSSFGPSLEELIKQMAINNIQFRQKLQLSISHSDKVLAIFPHNQLSIQRGNVSVITLKSDRELPKPTDDGAKIDDVSVVTLKSVATYPSVGGRCEAHGCVFQGRKMHRVTTIVYSRKTLGKTKRRPTNFKSKRFGSCFYA

SEQ ID NO: 225361 - protein, 322 aa, Glycine max
  Coding DNA Sequence Number=SeqID_108583
  Gene Ontology: Mol. function=nucleic acid binding; Cellular component= membrane; Biological process=DNA integration
  Homolog annotation: Hit_ID=Q1ST43; Match level="QueryCoverage=98%, HitCoverage=26%, E-value=2e-67, Identity=40%"; Hit description =Integrase, catalytic region; Peptidase aspartic, catalytic
MQIPQGYNHEPPSRSYAPLVCKQNKSIYGLKQASRSWFNMFKTTLTSQNYTQSKYDYTLFTKGTGSSFIAILVYVDDIVIASPNKITINSAKIMLQHYFKLKDLGDIKFFLGLELSRSQVGIFMCHRHYTMSILEDTGMLACKPSAVPMEADLKLNAKSGSQLPDPRIYRRLIGRLLYLTISRHDICYTVHKLRNSLISWKAKKQKTVSKSSSEAEYRALSSVSSELTWLRNDLNIKTSFAVVYCDNKAVIHIATNPTYHERTKHLEIDLYYVREQVGKGALKLIHVRKHHQLANVFTKSLPRSTFLSIISKLGIENIFLPS

SEQ ID NO: 225362 - protein, 157 aa, Glycine max
  Coding DNA Sequence Number=SeqID_108584
MACGGHWWSWVVEEEFLGFRMEFRERGGGFLLVTLSCLKPIVVRSVMFRDVSKGNEPKTQNGGGELINLGGVLFSLGPIRNLLEEATARLGEHVASSLSHQLIWAQASWAASSSSIFPIKWHLEVEGKGFSTFGNQISLKLVRRRRKKEKIKVEVLL

SEQ ID NO: 225363 - protein, 111 aa, Glycine max
  Coding DNA Sequence Number=SeqID_108585
  Subcellular localization annotation: CTP_CleavageSite=37; ConfidenceScore=5.37e-01
MQQLRLLRNLPLKNLLPSQSVQNPKNVSVIALRSGKQCQEPQPATSSSSTNEPAQLHSTLEKDDDKNLKKKQYIPLPFPPRAISNKKMEEAEKEILETFRKVEVNIPSSGA

SEQ ID NO: 225364 - protein, 175 aa, Glycine max
  Coding DNA Sequence Number=SeqID_108586
MPPNVARTPEENVDNSGHIPIKSNNPNLVIHRSLNPWGRHMKVPPAMVEREKFDHIEERLRAIEGGRDYAFADMAELCLVPDIVMPPKFKVPDFDKYKGTTCPKNHLKMYCRKMRAYAKDEKLLMHLFQESLIGETVTWYTNLEPSRVHSWKDLMVAFIRQYHYNSDIALDRTHL

SEQ ID NO: 225365 - protein, 364 aa, Glycine max
  Coding DNA Sequence Number=SeqID_108587
  Gene Ontology: Mol. function=kinase activity; Biological process=D -ribose metabolic process
  Homolog annotation: Hit_ID=Q1MN20; Match level="QueryCoverage=68%, HitCoverage=75%, E-value=1e-108, Identity=79%"; Hit description =Putative Pfk family kinase
  Pfam annotation: Domain name=SH3_3; Domain location=23-76; Score =19.0; E_value=0.0014; Accession=PF08239.2; Description=Bacterial SH3 domain
  Pfam annotation: Domain name=SH3_4; Domain location=21-77; Score =113.8; E_value=4.8e-31; Accession=PF06347.4; Description=Bacterial SH3 domain
  Pfam module annotation: Pfam domain module=SH3_3::SH3_4; Domain location=23-76::21-77
MAQGAAKGASGLPLPRFVSLKSKRVNMRIGPSTDYAVSWMYLKSGMPVEIIQEYENWRRIRDADGTEGWVNQALLSGERTAVAAPWMRGKGKEVYVNMRREAQSGAAVVARLEPGVEAGGEKIARTRRVDHVMHRIGLHLHTFRAAQDDGAFLAHRHRRDLAVGCDPGQRQFEVVGFVERQCFLLVGENDVHRAGAHQVEKLFAVAADAEAVGKRHGDFAAVFMRNAGAFADGVLGARRIPQVTLEVGDFRIRHHIIFHIFRTEIDAGAEIGVHRALAVFRHEDHGAGGRREGAFRFRFEIDTLGADIVLEDFSELVFRHLAEIGGLTAEIRYACCRVASAAAGGFKSRPHKRIKQLGAFRVDE

SEQ ID NO: 225366 - protein, 155 aa, Glycine max
  Coding DNA Sequence Number=SeqID_108588
FAKRDTQWLSTRKNPEEDELSGSLSAPLQVIKRTASAHPLSKRSALRHNPPMHAKRSRFALKASACTKVWSWLEAFASLGCSREKKVQVPKSSKRFCCVKICRDESSKRKPRFLDHGKLYPLLDLPCRYLMIRLGYHEESGSSSPGDNIGIHGHC

SEQ ID NO: 225367 - protein, 86 aa, Glycine max
  Coding DNA Sequence Number=SeqID_108589
  Gene Ontology: Mol. function=chitin binding; Cellular component =extracellular region; Biological process=chitin metabolic process
  Homolog annotation: Hit_ID=UPI0000612705; Match level="QueryCoverage =80%, HitCoverage=90%, E-value=5e-08, Identity=30%"; Hit description =UPI0000612705 related cluster
LHALTFRGLHVCAFRGIHVFTFIGLHVLAFRGLHICVFRGLHVLAFSGLHILTFKGLHVLVFRGLHVLAFKGLHICAFRELKVLRP

SEQ ID NO: 225368 - protein, 62 aa, Glycine max
  Coding DNA Sequence Number=SeqID_108590
MWGYLMVTHTFRQPGANEPVDAQRLTSSSAPFVVLTREVRVTIWLPAPFIKQGQTGPLTRRD

SEQ ID NO: 225369 - protein, 74 aa, Glycine max
  Coding DNA Sequence Number=SeqID_108591
MILIDCLSGGGAWQGLRVANWEWMSHLQHKTRVGKNPQAQVVASLAVHSTVTESPASKIKIPMLITPLTTRHTI

SEQ ID NO: 225370 - protein, 90 aa, Glycine max
  Coding DNA Sequence Number=SeqID_108592
MKNDVEVDYGRNSPPSHLFIAKDDIKGHGSSPKRVGARPGKGAGYFTPKLFGGLGEPEASLGEPRFRKPLEMTLLPYPFGIFHILDQNIE

SEQ ID NO: 225371 - protein, 40 aa, Glycine max
  Coding DNA Sequence Number=SeqID_108593
  Homolog annotation: Hit_ID=O04181; Match level="QueryCoverage=100%, HitCoverage=19%, E-value=1e-07, Identity=72%"; Hit description=Krm protein
MTLGISASTVFAEDATTEASSDNDPGGDLIGLRKIEDDSV

SEQ ID NO: 225372 - protein, 341 aa, Glycine max
  Coding DNA Sequence Number=SeqID_108594
  Gene Ontology: Mol. function=protein binding; Cellular component =kinesin complex
  Homolog annotation: Hit_ID=Q3ARE4; Match level="QueryCoverage=61%, HitCoverage=47%, E-value=7e-10, Identity=26%"; Hit description=TPR repeat
  Pfam annotation: Domain name=TPR_2; Domain location=161-194; Score =8.6; E_value=3.3; Accession=PF07719.7; Description=Tetratricopeptide repeat
  Pfam annotation: Domain name=TPR_2; Domain location=36-69; Score =12.4; E_value=1.2; Accession=PF07719.7; Description=Tetratricopeptide repeat
  Pfam module annotation: Pfam domain module=TPR_2::TPR_2; Domain location=161-194::36-69
AELYRVKKAFDKAEPLYLEAINILEESFGPDDVRVGVAVHNLGQFYLGQRKLEEARVSYERALKHVIMTIYSDKKACSGVWPFRMFRYNVSSRSVGIFAQMRILFYNNCVQVLYLQGKERDAEALIKDSIRMLEEGGEGESFVCIRRLRYLSQGWYFLDTVIAAESLALTLQASGNTKDSKELLERCLNVRKDLLPSDHIQIGANLLHLARVAMLDCSQHKKLDVSRAKAELDMAKNHLYNSIREKPGRTINYLTAVSHYAFNLLGPASKVLKQKDKLKKFSKPGDSRKEGQVALAILLQSLYTLSSVELDKQELQEIQERDNINIEAQEALLQCISTYKE

SEQ ID NO: 225373 - protein, 96 aa, Glycine max
  Coding DNA Sequence Number=SeqID_108595
MSASFDRHYEKFSFAIRKNQRTIATCDKRRPLQPFQRCQRLPTDTMKKSDLLFRLWTDTTKKSHLLSVRHKARLQAVKNVVTCTLSGDASVFRPTQ

SEQ ID NO: 225374 - protein, 236 aa, Glycine max
  Coding DNA Sequence Number=SeqID_108596
  Gene Ontology: Mol. function=protein heterodimerization activity; Cellular component=soluble fraction; Biological process=regulation of GTPase activity
  Homolog annotation: Hit_ID=Q9LKB3; Match level="QueryCoverage=98%, HitCoverage=51%, E-value=1e-92, Identity=70%"; Hit description =Similarity to rab3 GTPase-activating protein non-catalitic subunit
MIYPSRVLKLRVRGTKKDLIQDTSSEEFCLIMSGVIAHFDGSDIQNMLQKWFEESHSRFWDQNPKSHDSEDFGNTDVKIPYQLWNIGKYGTCAEAAITGIMPPPLMEQQQSSQRYYCAVAVGEDAVISAYRLSENKGRSLVGAILSKVVPATFSTISSFSKLIWRSEQSSPKKSDQKPQPFARASPLTCLKDHPRKGEKLTLSPSGTLAAITDSLGRILLLDTQALVVVRLWKVCF

SEQ ID NO: 225375 - protein, 54 aa, Glycine max
  Coding DNA Sequence Number=SeqID_108597
  Gene Ontology: Mol. function=protein serine/threonine kinase activity; Cellular component=integral to membrane; Biological process=protein amino acid phosphorylation
  Homolog annotation: Hit_ID=Q56YS9; Match level="QueryCoverage=94%, HitCoverage=6%, E-value=5e-17, Identity=76%"; Hit description =Receptor protein kinase-like
MLVYEHIPNGTLMDSLSGKSGIWMDWIRRLKVALGAARGLAYFHELADPPIITY

SEQ ID NO: 225376 - protein, 99 aa, Glycine max
  Coding DNA Sequence Number=SeqID_108598
  Gene Ontology: Mol. function=protein serine/threonine kinase activity; Biological process=protein amino acid phosphorylation
  Homolog annotation: Hit_ID=Q6RFY3; Match level="QueryCoverage=57%, HitCoverage=9%, E-value=7e-23, Identity=87%"; Hit description=MAP3Ka
MAPEVVMNTNGYSLPVDIWSLGCTILEMATSKPPSNQYEGVAAIFKIGNSRDMPEIPEICLGSWVLELSSERPQNLLPQIATHTPHCFSLPHTPPYRCQ

SEQ ID NO: 225377 - protein, 122 aa, Glycine max
  Coding DNA Sequence Number=SeqID_108599
MGYTSGRMNNGTNVLFEGAVEDLCLVVGLRMSEVFSDRGWNRKRLKQASRLAASVSLSEACALSEDHALSEAFSLFSELGESAGKSEKHLHAQRIISSLSEVFVSSLAKRAQLAERIFTNSR

SEQ ID NO: 225378 - protein, 178 aa, Glycine max
  Coding DNA Sequence Number=SeqID_108600
  Homolog annotation: Hit_ID=Q9LSZ3; Match level="QueryCoverage=91%, HitCoverage=84%, E-value=6e-17, Identity=34%"; Hit description =Arabidopsis thaliana genomic DNA, chromosome 3, P1 clone: MSD21
MEHSLNPSMGKAVSGSANEESGWTSYFEEFSKGMEQQSYCSNLGGSSLVSDAASCAAWKLSHHNHLVSHPSNNNVVSKKLRFKKTRTQQISDDDPLEDTASSPVNSPKVGVLKVSSKIDNQLDGCTSRGKEFNSEHHPKLQADECDINFNGNNIECNTNLKKKGLCLVPLSMLVNYYG

SEQ ID NO: 225379 - protein, 173 aa, Glycine max
  Coding DNA Sequence Number=SeqID_108601
  Homolog annotation: Hit_ID=Q1STP6; Match level="QueryCoverage=84%, HitCoverage=77%, E-value=2e-16, Identity=32%"; Hit description =Harpin-induced 1
  Pfam annotation: Domain name=Hin1; Domain location=28-160; Score=0.8; E_value=0.0013; Accession=PF07320.4; Description=Harpin-induced protein 1 (Hin1)
MASRGLKICLAVSLLLLIIFTIAIVTLFMTIFKPKNPEITVHPVGLEDFQSSFSPNLTLNVTLGMIITIRNPNYGSFQYINSTSYVKFHDTVVAEVPIEAELVPARSQINVNTSADFMVAKLINDPNFLSDVLGGTLNFTSTIALPGKARTTFVLEYIYAFFGIKEYAGIMYK

SEQ ID NO: 225380 - protein, 420 aa, Glycine max
  Coding DNA Sequence Number=SeqID_108602
MSELKVAKEKEVNKELEDELLIFKKEVVEQHEKGFFKSVRLAGFFVEGLEFSLFDPFKDVKDGQLLDEDKIVVGEEDDELNKIIFDHLKFDFNLVEGLASHLGLVGCETNSSGMANLRRREAYQEWTLGLTSFWRFDQGHVCPGFGETHPGWTLGLTILWRFDQGHVCLGFGEAHQGRTLGELSLPKRVGYFTMKLFGGPGKPEASLGKPGPLDLSSLMHRALRMTLFAASTWPAFVSDNGVGKIASACEVLPVKDISLECRPIIANVYYLGCQGAPPYVKAIDSYMQLSHVTVCLLAVQEAQQLDVGRAIHELIDLRQGICILGACFVKVGVVNAHALFLIGLLFHDNIKQPGQGVEAKLHGESKNQEEFKTQEESLESRIKIQGSRSQESRSRFKTQDSRIKRRLNQDKYEKFFSKIE

SEQ ID NO: 225381 - protein, 107 aa, Glycine max
  Coding DNA Sequence Number=SeqID_108603
  Gene Ontology: Mol. function=DNA binding; Cellular component =mitochondrion; Biological process=DNA integration
  Pfam annotation: Domain name=rve; Domain location=1-107; Score=6.1; E_ value=0.0018; Accession=PF00665.16; Description=Integrase core domain
MDILGSLPKAPRQVKFLLVVIDYFTKWIEARPLCNLPYAIVTNKGTQFKAQAYEEFLSRLGIKHFVTSVEHPQTNGQVEAANRVILKALCMRLDKSKGLRKAPPNIL

SEQ ID NO: 225382 - protein, 69 aa, Glycine max
  Coding DNA Sequence Number=SeqID_108604
MALKCTRQPSSSALDPERQCYLLNNQVPLLFLQWRIPARLTQEIMEPILMTVYPIASLLKILGYIGLGF

SEQ ID NO: 225383 - protein, 79 aa, Glycine max
  Coding DNA Sequence Number=SeqID_108605
  Homolog annotation: Hit_ID=Q1RVN6; Match level="QueryCoverage=46%, HitCoverage=4%, E-value=3e-08, Identity=67%"; Hit description =Integrase, catalytic region
MAARGGGGVVCDIEVQVVEVDAAVVIENKATKEAAMEECSKERYYILIRLVQLELRPLVERGMDLSYSTTTLDGHGLCS

SEQ ID NO: 225384 - protein, 81 aa, Glycine max
  Coding DNA Sequence Number=SeqID_108606
MGGRGGIFIASPQWAPNVLTKFDAQLDKRITTLSLRFKYIESLMAQLPSCSASSTDSLDLGLSRRVDVYTLMLRHLLCHLC

SEQ ID NO: 225385 - protein, 162 aa, Glycine max
  Coding DNA Sequence Number=SeqID_108607
  Subcellular localization annotation: CTP_CleavageSite=42; ConfidenceScore=5.26e-01
MRNLNPKVALHSMLLALQPSKFINNCTRNIPTAWKSYMSMLRATFRWKRYRGSKMKFDRLDKSVRKGKDKRQPLPRGPIYEHYTPLTKNQATTLEIAFNVETVTPHTCSQTWSRQNQAFKYHHNHDHNTKDYWALKDKIEELIQAKNLAQFMKKPDDNRTGG

SEQ ID NO: 225386 - protein, 162 aa, Glycine max
  Coding DNA Sequence Number=SeqID_108608
  Homolog annotation: Hit_ID=Q1STP6; Match level="QueryCoverage=64%, HitCoverage=56%, E-value=2e-10, Identity=33%"; Hit description =Harpin-induced 1
  Pfam annotation: Domain name=Hin1; Domain location=29-159; Score= -14.1; E_value=0.024; Accession=PF07320.4; Description=Harpin-induced protein 1 (Hin1)
MANKGLKFCLIVSLLFLIIVTIVIVTLFFTVFKPKDPNITVHPIGLEHFDFSLLPNITANVSLGMVITIENPNYGSFEFTNSIGHINFHDTVVGEVPIGAELVPAHGQINVNTWANFMVAKLISVPKFWSDVLSGTLNFTSTSSLPRDRSHVQDFQIEGHGL

SEQ ID NO: 225387 - protein, 80 aa, Glycine max
  Coding DNA Sequence Number=SeqID_108609
MDAPRGDCIGLTQGKVQLHTPPPEAPPPCAPLAIPRAHDLTRRGVRARLRLAEAIHQPHPRFWLVRVRLGLHPLLSLVHL

SEQ ID NO: 225388 - protein, 243 aa, Glycine max
  Coding DNA Sequence Number=SeqID_108610
  Gene Ontology: Mol. function=molecular_function; Cellular component =membrane; Biological process=auxin mediated signaling pathway
  Homolog annotation: Hit_ID=Q8L9I2; Match level="QueryCoverage=89%, HitCoverage=76%, E-value=1e-31, Identity=32%"; Hit description =Nodulin MtN21-like protein
  Subcellular localization annotation: CTP_CleavageSite=4; ConfidenceScore=5.41e-01
MTPRSTATKSKPWSWRGKPSSYKFCSVQMLRFFGIGYDSPTFATAMFDLIPAFTFILVIVFSMEKLDWKANSTQAKSIGTLVSIAGALIITLYKGQAVIKNHPSNKLFPKKHVSSEQFDWTWIIRNYLAELVIVLTHAIALQAIIGVSLRSIVHIWVMSKKGPLYVAMFKPIGIIFAVIIGIAFLGDSIYLGSVLGTAIVVIGFYAIIWGKSQEQAKEECKVYDDSESYSPIVPLLENKRMEE

SEQ ID NO: 225389 - protein, 119 aa, Glycine max
  Coding DNA Sequence Number=SeqID_108611
MELHHIVYFYRGNDGGSRSKDIDDENLTKFWNVGFPGIDHFSYSSWDTLLEEEYTFGVYGNKELVVKEFPSRQTATPDPNILIFQHWPTDRKMYPPGASVWKSRESESAEMPFSTPLDL

SEQ ID NO: 225390 - protein, 126 aa, Glycine max
  Coding DNA Sequence Number=SeqID_108612
  Gene Ontology: Mol. function=protein serine/threonine kinase activity; Biological process=protein amino acid phosphorylation
  Homolog annotation: Hit_ID=Q5JNC9; Match level="QueryCoverage=37%, HitCoverage=7%, E-value=4e-13, Identity=75%"; Hit description =Putative receptor protein kinase PERK1
MPHCTGSQKIIHRDIKSANILLDNAYEAQVSNFGLARLADAANTYVSTRVMGTFGFPLELLGKMSTDCLVMQNHHFLNIKILIGNPDPINSTNHNPTNPATTKAGFVTKSPHKHNLKGARGFRKES

SEQ ID NO: 225391 - protein, 92 aa, Glycine max
  Coding DNA Sequence Number=SeqID_108613
MKERVLRCPYRTRARARVISEIEEDDGGQYGYSRCPAKISQPPFLRGYNLNVTCAYHGGVPGHSIEHCITLKHKVQSLIDTGWLRFEEENRL

SEQ ID NO: 225392 - protein, 70 aa, Glycine max
  Coding DNA Sequence Number=SeqID_108614
MENVVFAAQCGMGIRITLQFQERDHLIRCYVPAYVMLPVGVITNDNVLRTRQIKVVLAREPTKGATCSRC

SEQ ID NO: 225393 - protein, 160 aa, Glycine max
  Coding DNA Sequence Number=SeqID_108615
MLLMLLPLSLRDWYAMKRFYRLKKCCFGLDPNEKPPTDAIDHEVGRYYQTLNHTCFTQETPFNMVCTWTRELYVMSDCTFSFVVFLPFSKFFFTHHVDPIIGEVECYVEDAFDSMVVQKPPRPPMPPGSLIHLSSNSGDSSEEFLRKLDEEVAKQNGEKK

SEQ ID NO: 225394 - protein, 257 aa, Glycine max
  Coding DNA Sequence Number=SeqID_108616
  Gene Ontology: Mol. function=protein serine/threonine kinase activity; Cellular component=membrane; Biological process=protein amino acid phosphorylation
  Homolog annotation: Hit_ID=Q1EPA3; Match level="QueryCoverage=63%, HitCoverage=25%, E-value=2e-47, Identity=57%"; Hit description =Protein kinase family protein
  Pfam annotation: Domain name=Pkinase_Tyr; Domain location=133-256; Score=-102.7; E_value=3.6e-06; Accession=PF07714.7; Description =Protein tyrosine kinase
MKQGHQEEERFGNHCPEPDEEGLLDFKGGGGAVPNGGVCEGFDGGSNTSDGGGCEGFVGGGSISEGGGYVRSGEGSNGHYYVQQPIPSPPLVNNYGNGNMSMRHLGAFFNSTQFKSDQIFFTYEMIMEMTNAFSTQNVIGEGGFGCVYKGWLPDGKIVAVKKLKAGSGQGEREFKAEVEIISHVHHRHLVALVGYCICEQQRILIYEYVFFKDHHLHESGMPVLDWAKRLEIAIGAAKGLAYLHEDCKHICIYFLLP

SEQ ID NO: 225395 - protein, 81 aa, Glycine max
  Coding DNA Sequence Number=SeqID_108617
MTYAQISAHEVGDAGVYGGGGNYLHNCDLCNIVPPSQLLEMPGSVVVAVTIGNVGVRGGGYGWVHGCNFCDVDENPKTAQI

SEQ ID NO: 225396 - protein, 238 aa, Glycine max
  Coding DNA Sequence Number=SeqID_108618
  Gene Ontology: Mol. function=transporter activity; Cellular component= outer membrane; Biological process=transport
  Homolog annotation: Hit_ID=Q8A8P8; Match level="QueryCoverage=41%, HitCoverage=11%, E-value=6e-26, Identity=56%"; Hit description =Putative outer membrane protein, probably involved in nutrient binding
VPPVQLLTGWCVTAKAPPDISAGKCSGHAARRVPFAIQAAQLLGRAIGAGLFAITPAGERGMCCKAIKLGIRYPSDIEKFEVLKNAAETAQFGSRGAAGVIVVTTKKGREGKFQISYDGNYGWESVYRNLEMLSAQEYVAEAQRLGVPYINGGYNENYTDFPSSLSIPSTSRGGPVPAFVPFSEVGKPVVPAALMNRPTRGERRFAYWALAECILAYYVGTDEGVSEVLHVAGEKRLH

SEQ ID NO: 225397 - protein, 113 aa, Glycine max
  Coding DNA Sequence Number=SeqID_108619
EFKIPETGPGHPESEPPPHLSDGKIGESERATTSPYKESERSAASPAGDSGGAATSPDGESEMIIKGGDGGTTSSSGEEGGFTTGDCGLAGTGSTRAGVGSGGAASLGLTNGG

SEQ ID NO: 225398 - protein, 154 aa, Glycine max
  Coding DNA Sequence Number=SeqID_108620
MTTKSNCNCGIKRFTNISLVTLFGKLQGHEMELMRLNQHDENEKKKKGIVLKASSSIHEESDKEDLNERNNLEEDDDFSLFVQRFNKFLRNKGNQRGSNFNPKKKGEDFSSVPKSYECDQPRHLRLDCSIFKRRMKKFDKKTFKDKKGKKAYIT

SEQ ID NO: 225399 - protein, 87 aa, Glycine max
  Coding DNA Sequence Number=SeqID_108621
MAVNENGLLGRRKDDGGEERIKKKTLPPETAFGGNKWWLGLGRLSKGRRFVQQKRITMGEENKGMDIGGGEDINLGWGEEEDERRRR

SEQ ID NO: 225400 - protein, 97 aa, Glycine max
  Coding DNA Sequence Number=SeqID_108622
  Subcellular localization annotation: CTP_CleavageSite=91; ConfidenceScore=5.22e-01
DEIDCSQFASTAEQPPTVSMVDSGGQPKPITVQTSLLPQEPNFVSVQPTPTFRPLLTRPTAPIRIPFLAGPSPRMIKPNFMSFILRPGMPQRENKKK

SEQ ID NO: 225401 - protein, 71 aa, Glycine max
  Coding DNA Sequence Number=SeqID_108623
MTRRMTLKNLVLEDAETQCSDKMVSHFVSQKVLILARKSTVEDVLAIRDVIGDGGGGETMVVNYGNDENDE

SEQ ID NO: 225402 - protein, 173 aa, Glycine max
  Coding DNA Sequence Number=SeqID_108624
  Subcellular localization annotation: CTP_CleavageSite=42; ConfidenceScore=5.20e-01
SSKSFKWILALALGHVLITCARPEEPPQILLPSRTQKSRATRSEAPSPSVVPTPPTFVLPSTPAALVLPEPEPGPTPDYAELARCGLATTSYEHGGVYAEGLCSPGASAGPRGLMRILKLAKYRLKAQVEKGEGPSNPCGVYPDLSSFTGSGVYPDLSSFIGSGVIQNSTACI

SEQ ID NO: 225403 - protein, 174 aa, Glycine max
  Coding DNA Sequence Number=SeqID_108625
  Subcellular localization annotation: CTP_CleavageSite=68; ConfidenceScore=5.14e-01
SRLFWFFRRFPQINVGGDSARIPFVEHASRESRVALPPKGRLRQSSKKRKGSSASASASRAHRAGATSASTAAIPPSLSSSTLFSSEEQQKRYSNLFSSRSIIDPKFIDMEFFSAETFDCIQAFQNLGLIPFMIKMVIDQSLFHDLTQLSSDGVPFEGTLNDDWKFDFSAHDAR

SEQ ID NO: 225404 - protein, 152 aa, Glycine max
  Coding DNA Sequence Number=SeqID_108626
  Gene Ontology: Mol. function=chitin binding; Cellular component =extracellular region; Biological process=chitin metabolic process
  Homolog annotation: Hit_ID=UPI0000612705; Match level="QueryCoverage =81%, HitCoverage=90%, E-value=8e-13, Identity=27%"; Hit description =UPI0000612705 related cluster
MSSPLKDYTSSPSEGHTPSHSEDYTSLPSEDYTSPPSGGYTSSPSKGCMPSPLEDYLSSPSKGYTPSSSKGLHALTFKGLHALIFKGLHALIFKGLHALTFRGLHVPFFRRLHALAFRGRHVLTFGGLRSPSPFEGYVSSLSVAPYPHLKRI

SEQ ID NO: 225405 - protein, 230 aa, Glycine max
  Coding DNA Sequence Number=SeqID_108627
MASRKRKAIASRPQPHYDTYRLTYEDTWNCCADNILGQNILLERNAKLFVTKFDEFRIELVRRNWHRTLTNLMEGSIDVALVKEFYANRYDPKDKFPKQVRVRGHLIKFDADSLNTFLETPVVLEPGETLPAYSRFCRLRPDPQELVARFVSLTWNVMSYFNLAPTSHTSDLNMDRASFPGTRKARARGSEGPSSATPQTSTAPAPIPLALVPATFDPSTQSTDLMMAML

SEQ ID NO: 225406 - protein, 77 aa, Glycine max
  Coding DNA Sequence Number=SeqID_108628
MEIISKRFKELDVCGKVTLKSKLQEIAYPNQNSMCPPPEKVWVKILSPWCATIWLKNLANGQMTISSSLVAQTDSRN

SEQ ID NO: 225407 - protein, 219 aa, Glycine max
  Coding DNA Sequence Number=SeqID_108629
MTTLTQIWMTLLLSNILPTDHNSDLPLPKCQLVYAILTRMSIHVAQLIADAIYIFAGMMPTRHPLDPDKSNRALGFPVLITGLCQSFGVPVTPTKRQAQRDAPQAAGAPPPPHQAGPAVSFDMEQYLRHLVRQQAANHRAHVQTHDCLYQLSLSMQSQGFASFSCPTPDQFRAEVAWPGDWPEAQAGEAPPEAPGDGEEAHEDEEMADLLDFLGGSGAT

SEQ ID NO: 225408 - protein, 86 aa, Glycine max
  Coding DNA Sequence Number=SeqID_108630
MWVLWGSSDDNVGFPAVQGVLMVPTRTTWRFPTDFRREEKEKSDFRQKDDKEKREGKVFERARLVKSQFLLTYKHNNIGFFMDNRC

SEQ ID NO: 225409 - protein, 143 aa, Glycine max
  Coding DNA Sequence Number=SeqID_108631
  Homolog annotation: Hit_ID=Q1SWQ8; Match level="QueryCoverage=96%, HitCoverage=50%, E-value=9e-17, Identity=31%"; Hit description =Nucleic acid-binding, OB-fold; TonB box, N-terminal
MDLKENCTYVMHNFKVLKNNGQYRVCDHQFKLVFIGVTVVRQCVLDDVPFRKYRFARFADVVAGQFEPGPLVDVIGVVEEVVFRQVSGKGRRVVFKLKDLSQQLLSCTLWDDYCLQFLKFLDDYEGDGPITVLLTHGRIKEAR

SEQ ID NO: 225410 - protein, 320 aa, Glycine max
  Coding DNA Sequence Number=SeqID_108632
  Homolog annotation: Hit_ID=Q9LSX7; Match level="QueryCoverage=96%, HitCoverage=96%, E-value=6e-77, Identity=53%"; Hit description =Arabidopsis thaliana genomic DNA, chromosome 3, P1 clone: MSD21
MATGGDGDTSKQELFQLIKRFGAYVTFKISNLFPLSLHNLDLRSIGAVAGLAVAIVFTWRLLRSPSGSQRRQQKRQGPSSSNPGVGTNSNSNASVVPSDACSPSDDSRAQNVVDEFFQPVKPTLGQIVRQKLSEGRKVTCRLLGVILEESSPEELQKQATVRSSVLEVLLEVTKFCDLYLMERVLDDESECFSNTLLFILVPINVVEKAKVNEVYKVRGQNEDFVKSGAKKRVLVALEEAGVFTSGGLVKDKVLFCSTENGRSSFVRQLEPDWHIDSNPEIVTQLARFIKYQLHVSPYKTERTAANVFSAPSLEQFFGSI

SEQ ID NO: 225411 - protein, 360 aa, Glycine max
  Coding DNA Sequence Number=SeqID_108633
  Gene Ontology: Mol. function=oxidoreductase activity; Cellular component=vacuole; Biological process=response to oxidative stress
  Homolog annotation: Hit_ID=Q9ZNZ6; Match level="QueryCoverage=99%, HitCoverage=92%, E-value=1e-166, Identity=83%"; Hit description =Peroxidase precursor
  Pfam annotation: Domain name=peroxidase; Domain location=39-322; Score=413.7; E_value=2.5e-121; Accession=PF00141.13; Description =Peroxidase
MGSNLRFLSLCLLALIASTHAQLQLGFYAQSCPKAEKIILKFVHEHIHNAPSLAAALIRMHFHDCFVRGCDGSVLLNSTTNQAEKNAPPNLTVRGFDFIDRIKSLVEAECPGVVSCADILTLAARDTIENLKSISTTSASPLLSLHFLFENKMTHLLVYAITDIGVQGGPYWKVPTGRRDGVISNLVEARNNIPAPFDNITTLQTLFANQGLDLKDLVLLSGAHTIGIAHCSSLSNRLFNFTGKGDQDPSLDSEYAANLKAFKCKDLSKLNTTKIEMDPGSRKTFDLSYYSHVIKRRGLFESDAALLTNSVTKSQIIQLLEGTVENFSAEFATSIEKMGRINVKTGTEGEIRKHCAFVNS

SEQ ID NO: 225412 - protein, 340 aa, Glycine max
  Coding DNA Sequence Number=SeqID_108634
  Gene Ontology: Mol. function=translation initiation factor activity; Cellular component=mitochondrion; Biological process=translational initiation
  Homolog annotation: Hit_ID=Q9LSZ0; Match level="QueryCoverage=85%, HitCoverage=85%, E-value=1e-101, Identity=50%"; Hit description=APO protein 4, mitochondrial precursor
  Pfam annotation: Domain name=DUF794; Domain location=2-322; Score =427.2; E_value=2.3e-125; Accession=PF05634.2; Description =Arabidopsis thaliana protein of unknown function (DUF794)
MESLRKMMRYGVLCSGNPRRLYATKVDLKKLRPMILKRIEKRAHTYPVRGMVPVANEVLQVRNDLIHGVSTLLNFLPLMACKFCPEIYIGEQGHLIQTCSGYKHRAKNRVHEWIKGGLNDILVPVETFHLDNMFQSVIRHNERFDFDRIPAVVELCWQAGADFHDENLNSSSWNLEADNGSVPETESLSPNDLTSIANKTLTAWETLRSGVEKLLLVYPVKVCKYCSEVHVGPSGHKARLCGVFKYESWKGAHFWMKANVDNLVPPKIVWRRRPQDPPVLLNEGRGFYGRVPAVLDLCSKAGAVVPAKYNCMMKVQENQTLESNSKLNYRSDRNEAPNQG

SEQ ID NO: 225413 - protein, 188 aa, Glycine max
  Coding DNA Sequence Number=SeqID_108635
  Subcellular localization annotation: CTP_CleavageSite=78; ConfidenceScore=5.48e-01
MTYMRFIMIMMKVYGRTFMLNCVVSMVMGTPPRSPPQSDGNSEATPKKTRQSTRLRRLTLRTLYQPRPTVSVDPATRRGSSPKKQKFHSYLGVVAQQKIPIVHSNWKDMLKTLKDLVWDDILCITGVATYPSVGGRRVTRGMRVPRKEYARSRHQRLFEENVEKTGKDAIYELLSERFGSCIYARGRY

SEQ ID NO: 225414 - protein, 53 aa, Glycine max
  Coding DNA Sequence Number=SeqID_108636
MVCLQEQDARKGKSRLCHNRERGTAPCCDEASPYYAAPGDDQGGSSIFNRIEF

SEQ ID NO: 225415 - protein, 182 aa, Glycine max
  Coding DNA Sequence Number=SeqID_108637
  Gene Ontology: Cellular component=integral to membrane
  Homolog annotation: Hit_ID=Q2HVJ5; Match level="QueryCoverage=54%, HitCoverage=24%, E-value=1e-27, Identity=57%"; Hit description=EXS, C-terminal
MFGGVNAPANSPHLRKSGSRPVVYDLDEHEVENGIEEGLLHPVEADDSKGGTPVSAAAMMPSPILLWRFKVGWDSVMRMSADKRDLFLYEAFLYFNPLLLAVSSSLLTALMVWLWGINLWFFAQGGVNYAKIFDLDQSHLTHREIWKVSTHHFDLSLVWHIKSAFARSEGNKNGSVMTWEQE

SEQ ID NO: 225416 - protein, 199 aa, Glycine max
  Coding DNA Sequence Number=SeqID_108638
  Gene Ontology: Mol. function=calpain activity; Cellular component =intracellular; Biological process=proteolysis
  Homolog annotation: Hit_ID=Q1S667; Match level="QueryCoverage=79%, HitCoverage=41%, E-value=2e-19, Identity=39%"; Hit description =Cyclin-like F-box; F-box protein interaction domain
  Pfam annotation: Domain name=F-box; Domain location=7-54; Score=40.9; E_value=4.4e-09; Accession=PF00646.23; Description=F-box domain
MRSKKKPWSPLLCDELFEEILSRLPVKPLMQFKCVCKGWNSLISDPYFIKLHLSKSAAKDNLEHLQLMKNVCLGSIPEIHMESRDVSSLFHSLQIQTFLFNFANMLGYHLVGSCNGLHCGVSEIPEGYRVCFWNKATRVISRESPMLSFSPGIGRRTMFGFGYDPSSDKYKVVAIALTMLSLNVSEKTEMKVYGAGDSS

SEQ ID NO: 225417 - protein, 209 aa, Glycine max
  Coding DNA Sequence Number=SeqID_108639
  Gene Ontology: Mol. function=oxidoreductase activity; Cellular component=cytosol; Biological process=leukotriene metabolic process
  Homolog annotation: Hit_ID=Q0PIN2; Match level="QueryCoverage=91%, HitCoverage=54%, E-value=1e-36, Identity=43%"; Hit description =Phenylpropenal double-bond reductase
MGDHEEVRSLVVEEEMRVVESKEWYLVSYAPHGVPTTDHLKLRKVRLSIAPESIPDGHVAIEMLLFSIDPYLRGRLNGTLDGLYFPQFELNQVITIYGIGRVKRSNDSEYKEGDIVLSANFPAAEYCVMPSCEIVRKIDAACGISLPDYLSTLGVPGFAAWLGIEVLADPKPGSNVFISAASGGVGMIAGQLAKIRDCRVIGSTGSDEK

SEQ ID NO: 225418 - protein, 479 aa, Glycine max
  Coding DNA Sequence Number=SeqID_108640
  Gene Ontology: Mol. function=transferase activity, transferring glycosyl groups; Cellular component=membrane
  Homolog annotation: Hit_ID=Q6ZJW6; Match level="QueryCoverage=87%, HitCoverage=85%, E-value=3e-90, Identity=44%"; Hit description =Putative fringe-related protein
  Pfam annotation: Domain name=DUF604; Domain location=203-452; Score =435.3; E_value=8.3e-128; Accession=PF04646.3; Description=Protein of unknown function, DUF604
  Pfam annotation: Domain name=Fringe; Domain location=60-322; Score= -100.0; E_value=0.084; Accession=PF02434.7; Description=Fringe-like
  Pfam module annotation: Pfam domain module=DUF604::Fringe; Domain location=203-452::60-322
  Subcellular localization annotation: CTP_CleavageSite=42; ConfidenceScore=5.58e-01
MESFHKPIKNQKALMKFFVFSSSFFAISLCVSMLLLAKTKLVVDMSSSLQSLLRVSESDPTTTADHLVFGIASTGTAWNRRKVYTKLWWNRKPYNTMRGCVFVDTLPHEENANNNNDGSLPPLCVSEDTSQFPYTYKNGQRSAIRVARVVKETVALLNHSGVRWYVFGDDDTIFFPQNLVKTLSKYDHRLWYYVGSSSEIYDGAQVFGFGMAFGGGGFAISSSLAHVLAKVLDSCIQRYPHLYGSDSRVYSCITELGVGLTHEPGFHQVDLRGNIFGLLAAHPLTPLVSLHHPEFTDPIFPNMTTTQSLQHLFEAVNVDSERMLQQTVCYERSLSWTISVSWGYAVQVFQNNMLLPDVLRVQKTFQQWLWGDVLKGIYNFNIRELHPDPCERPTIFYLDKVFSGKDGIASSYRKHFQNCSYKEPMKKLEVIKVVSNKLYLDNKQTTRRHCCDVLPSNNAGDLMEIAIRECKYEELIYML

SEQ ID NO: 225419 - protein, 495 aa, Glycine max
  Coding DNA Sequence Number=SeqID_108641
  Gene Ontology: Mol. function=transferase activity, transferring glycosyl groups; Cellular component=membrane
  Homolog annotation: Hit_ID=Q6ZJW6; Match level="QueryCoverage=84%, HitCoverage=85%, E-value=2e-94, Identity=45%"; Hit description =Putative fringe-related protein
  Pfam annotation: Domain name=DUF604; Domain location=220-469; Score =453.0; E_value=3.8e-133; Accession=PF04646.3; Description=Protein of unknown function, DUF604
MCIPIITIIQSSFEHLHCLEINAEEGLQDQQPTIFFLYVTFASHSHLMQSWHFQLAMLLLATPKIVEVGSSPQYVSDPTTVDHLVFGIASSGISWPKRKEYSKIWWNWKLNKTMRGCVFVDTLPHEENANNNNDGSRPPLCVSEDTSQFLYTYKPGGLRSAIRVARVVKETVALNHSGVRWYVFGDDDTIFFPQNLVKTLSKYDHRLWYYVGSYSEIYEGSQVFGFGMAFGGGGFAISSSLAQVLAKVFDSCIQRYSHLYGSDARVYSCITELGVGLTHEPGFHQVDLRGDIFGLLAAHPLTPLVSLHHPDHTDPIFPNMTTTKSLQHLFEAVNVDSERILQQTVCYERRFSWTISVSWGYGVQVFQNNMLLPDVLRVEKTFKQWKEGNVLAGIYTFNTRELHPDQCKRPTIFYLDKVSSGKDGIISSYRKYSQNCSYKEPMKKLEVIKVFTNKLYLDNKQIPRRHCCDVLPSNAGDSMEIAIRECKYEEMIYMH

SEQ ID NO: 225420 - protein, 357 aa, Glycine max
  Coding DNA Sequence Number=SeqID_108642
  Homolog annotation: Hit_ID=Q708X5; Match level="QueryCoverage=41%, HitCoverage=53%, E-value=2e-29, Identity=42%"; Hit description =Leucine rich repeat protein precursor
MADDKLFSKCLDRLKAAIANLAVTQASMTTKLDLLLLKMDNLLISQYPSSSSSAKAPPAQVPMLTLLSMPTLSPMAIPLPCLAPMQPSPASLSASLSMPIAPLCLVPMQQSQAPMPAPHLAANSKHQVPHGLSSVFNQLDHVRVVVSLDNLLSVVVHYGHAAVPHDKLLEHRDIALFEMVVESYGSAMVARKRQPVAFALWTAAKLSEFCRDRPWDLGITFGSHGLKPQHLEDKGVVDGPRNQHAAQHGQIPEVFRNLTVELIIDEVEFVDISGNLARELVANEVQDAEGGKHCDSGEDLLDNVFLISDDKGGEAGATNFLKDWVFGLPVEVDVADAAGGGVATDAVPVETAVGAHP

SEQ ID NO: 225421 - protein, 384 aa, Glycine max
  Coding DNA Sequence Number=SeqID_108643
  Gene Ontology: Mol. function=transferase activity, transferring glycosyl groups; Cellular component=membrane
  Homolog annotation: Hit_ID=Q6ZJW6; Match level="QueryCoverage=93%, HitCoverage=74%, E-value=2e-78, Identity=44%"; Hit description =Putative fringe-related protein
  Pfam annotation: Domain name=DUF604; Domain location=109-358; Score =430.6; E_value=2.1e-126; Accession=PF04646.3; Description=Protein of unknown function, DUF604
  Subcellular localization annotation: CTP_CleavageSite=51; ConfidenceScore=5.07e-01
MRGCVFVDTLPQDKDNNNNASTLPPLCVSQDTSRFRYTYSGWGGGMRSAIRVARVVKETVARMNHSHIRWYVFGDDDTLFFPQNVVKTLCKYDHRLWYYVGANSESYKQTWFFGFGMGFGGAGFAISSSLATVLVKVFDSCIERYPELYGSDARVYACITELGVGLTHEPGFHQVDLRGNAFGLLAAHPLTPLLSLHHLDNIDPIFPNMTIIKALQHLYEAAKVDSQRLLQQTVCYDKRLSWTISVSWGYAAQVFHNHLSLPDVVRVQKTFKHWTRGTALADQFTFDTKELHTDPCRRPTIFYLENLSRGEDGIIISNYRKSIQNCSSNVAPEVIRVASSKLELGIKQLLAQRRHCCDVLPSSVSDQMEIAIRECKEDELISMQ

SEQ ID NO: 225422 - protein, 472 aa, Glycine max
  Coding DNA Sequence Number=SeqID_108644
  Gene Ontology: Mol. function=metal ion transporter activity; Cellular component=membrane; Biological process=metal ion transport
  Homolog annotation: Hit_ID=Q3K849; Match level="QueryCoverage=57%, HitCoverage=84%, E-value=4e-55, Identity=44%"; Hit description=Mg2+ transporter protein, CorA-like
LTSAVTKVVADASTNQDAVNNAIQARTGMPTKINGQPGEAQPAPVMVQESSDAMPKEEPMTPQGATAVAPQADVQQPAEAAPVEQAAPAQPASNGNSLRRAGFFIARSPGSLPLCDCVAAQLRTQSCGRRNASQPATRVNTSTTSTNSRKPCGLFASGMPPTFMPKKPATILMGSASTVIEAGSDLLLQQANALHQAGKIVKRYAELLGENPQLTERFPVEPVWRPVKQAKQRGRLRRQQPLDAQQHAAQMAQLAAVGFDRRAQQPLFYRIHRLAGAPHHLLQLRFLFAEQPQQHRIRRAEAQPINLLMHTFNHANRAIARADHHLRPAPDPQRRILCVALLFTKGDVIQHRQQRIVLLRQPGARRGRMNLIEKIVIYAEVVLNPALGAGMIQVTVNQSGNFVVEVGQRGKRQNRLEHSGVKIPERSDPQPATGLLQHDDSPRWHHHSVIQNPYHTAVNGCHSCIVNSPRGV

SEQ ID NO: 225423 - protein, 245 aa, Glycine max
  Coding DNA Sequence Number=SeqID_108645
  Gene Ontology: Mol. function=receptor activity; Cellular component =membrane; Biological process=response to abscisic acid stimulus
  Homolog annotation: Hit_ID=Q9LRJ9; Match level="QueryCoverage=87%, HitCoverage=85%, E-value=6e-62, Identity=54%"; Hit description =Similarity to receptor kinase
  Pfam annotation: Domain name=DUF26; Domain location=190-244; Score =82.5; E_value=1.3e-21; Accession=PF01657.8; Description=Domain of unknown function DUF26
  Pfam annotation: Domain name=DUF26; Domain location=78-132; Score =88.6; E_value=1.9e-23; Accession=PF01657.8; Description=Domain of unknown function DUF26
  Pfam module annotation: Pfam domain module=DUF26::DUF26; Domain location=190-244::78-132
  Subcellular localization annotation: CTP_CleavageSite=2; ConfidenceScore=5.36e-01
MSSSKLSSPVTFLLIFALVFQTCFGANPLYHFCSSSQNFKANSPYESNLKTLINSLIYRTPSTGFGVGSVGQYQNEKAYGLALCRGDVSSSECKTCVSDATKEILSRCPYNKGGIIWYDNCMLKYLDTDFFGKIDNTNKFSLLNVRNVSDPAMFNYMTKELLSLLAYRASLSPKMYASGELKIGGESKDIYGLTQCTRDLSSSDCNKCLDDAISQLPNCCDGKEGGRVVAGSCNIRYEIYPFVKA

SEQ ID NO: 225424 - protein, 174 aa, Glycine max
  Coding DNA Sequence Number=SeqID_108646
  Gene Ontology: Mol. function=receptor activity; Biological process =response to abscisic acid stimulus
  Homolog annotation: Hit_ID=Q9LRJ9; Match level="QueryCoverage=84%, HitCoverage=79%, E-value=6e-26, Identity=37%"; Hit description =Similarity to receptor kinase
  Pfam annotation: Domain name=DUF26; Domain location=138-172; Score= -0.4; E_value=0.007; Accession=PF01657.8; Description=Domain of unknown function DUF26
MLSIFLNLLVSKEAILLVPYFVSDPSPYGANLNQLFELLHTKVPPTGFGHGSIGQGTDQVNATKKLQERCPPKKKGTIVWYDYCLIKYSNEYFFGEIDEKNKFYIVNIYDVDDPATFGDKVNELLSGLSYTASQIPMLYAISDHPNYCDGKQGARVVRGSCYVRYELYPIVEAP

SEQ ID NO: 225425 - protein, 99 aa, Glycine max
  Coding DNA Sequence Number=SeqID_108647
MTKLALRCYSTEEPRLQAQENSIDGISHRYECITTGQESSKIKGKSDVDPILARMSAHEFVSLIHVLKTQTPFLRLEGLQDCCIRMMLGTSLIDQIYRS

SEQ ID NO: 225426 - protein, 227 aa, Glycine max
  Coding DNA Sequence Number=SeqID_108648
  Gene Ontology: Mol. function=electron carrier activity; Cellular component=membrane; Biological process=electron transport
  Homolog annotation: Hit_ID=Q0WPC5; Match level="QueryCoverage=57%, HitCoverage=50%, E-value=3e-30, Identity=50%"; Hit description =Uclacyanin I-like predicted GPI-anchored protein
  Pfam annotation: Domain name=Cu_bind_like; Domain location=34-114; Score=148.7; E_value=1.5e-41; Accession=PF02298.8; Description =Plastocyanin-like domain
MGVPEMMFRVSFVAILIKLALATNYIVGGPNGGWDTNSNLQSWASSQIFSVGDSLVFQYPPNHDVVEVTKADYDSCQPTSPIQSYNDGTTTIPLTSLGKRYFICGTIGHCSQGMKVEIDTLASATNSVTPAASPEDSTTSPAESPEVSSASPEESPEDIIPSAPSPLFQAHLESPTFSPVFPSTEFPASASPLAQHSSDLSASSTSKGNLQAYFVVVLSFLIMFITF

SEQ ID NO: 225427 - protein, 221 aa, Glycine max
  Coding DNA Sequence Number=SeqID_108649
  Gene Ontology: Mol. function=transcription regulator activity; Cellular component=nucleus; Biological process=regulation of transcription
  Homolog annotation: Hit_ID=Q1SGR4; Match level="QueryCoverage=76%, HitCoverage=98%, E-value=1e-39, Identity=56%"; Hit description =Prefoldin; Helix-loop-helix DNA-binding
MDVNSSGGASDWLYDYGFDIPVAGSDFMASDSGGFRWGPQSHNFKGPSNMRWLGNGILTGFNCHGKWSFKAVKDRIMCIWLQGMSFLELSSILEPSRQPKSDKVAILSDAARVVIQLRNEAKRLKEMNDELQAKVKELKGEKNELRDEKNRLKEEKEKLEQQVKVANIQPSFLPQAPDAKGQVGSHKLIPFIGYPGIAMWQFMSPAAVDTSKDHLLRPPVA

SEQ ID NO: 225428 - protein, 45 aa, Glycine max
  Coding DNA Sequence Number=SeqID_108650
MRPSPKPKKLPAKRSRKGTIEEDSSVAPQADAGFDKHRFQSVEHQ

SEQ ID NO: 225429 - protein, 116 aa, Glycine max
  Coding DNA Sequence Number=SeqID_108651
  Subcellular localization annotation: CTP_CleavageSite=27; ConfidenceScore=5.04e-01
MKNQKENTSVIKTSTFVPGVYKGNIPSGNSKQNVEITFKDDNTFALSETFPGSTTPMSSTGTWKYYKDTNKVILKYSNIADRVTTFSIVNDKTIQMHSGSAWTKETAGTEYNLVRQ

SEQ ID NO: 225430 - protein, 213 aa, Glycine max
  Coding DNA Sequence Number=SeqID_108652
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=99%, E-value=1e-15, Identity=29%"; Hit description =UPI00006A17C9 related cluster
VDPWVLVPITFRGLHVLANRGLHALTVERTTCPRLERTTRPHHQRAARPHLQRTTCPRLERATCPHLGGLHVLALRGLHALTLGTSYPHRQRTTRPRLERTTRPHHQRAARPHLQRTISPRLERATRPHLGGLHVLAVKGSCAFTFVGLHALTFRGLHDYMFPIFKGGHALTFRGLHVLAIIGLHSLAFERRHVVNFRGLHALAFRGLRVLTF

SEQ ID NO: 225431 - protein, 206 aa, Glycine max
  Coding DNA Sequence Number=SeqID_108653
  Gene Ontology: Mol. function=pseudouridylate synthase activity; Cellular component=chromatin; Biological process=RNA processing
  Homolog annotation: Hit_ID=UPI00006B218B; Match level="QueryCoverage =98%, HitCoverage=93%, E-value=1e-81, Identity=64%"; Hit description =pseudouridine synthase, Rsu
  Pfam annotation: Domain name=PseudoU_synth_2; Domain location=39-158; Score=31.3; E_value=4e-09; Accession=PF00849.12; Description=RNA pseudouridylate synthase
  Pfam annotation: Domain name=S4; Domain location=1-41; Score=27.4; E _value=5.1e-05; Accession=PF01479.15; Description=S4 domain
  Pfam module annotation: Pfam domain module=PseudoU_synth_2::S4; Domain location=39-158::1-41
YLSEVGFCSRRAADKLLEEGRIKINGQIPELGTKISDEDVVEVDDTKREKNNIVDYINHPKRIFPIGRLDKPSEGLILLTSDGDIVNKILRARNNHEKEYLVRVDKPINPRFLEKMRNGVPILDTVTKKCEVEKVDDMTFRIVLTQGLNRQIRRMCEYLGYEVKKLKRMRIMNIKLDLPVGKWRDLTDEELSALNKLLEDSSKTVD

SEQ ID NO: 225432 - protein, 478 aa, Glycine max
  Coding DNA Sequence Number=SeqID_108654
  Gene Ontology: Mol. function=4 iron, 4 sulfur cluster binding; Cellular component=nitrate reductase complex; Biological process =nitrate metabolic process
  Homolog annotation: Hit_ID=Q7WX71; Match level="QueryCoverage=70%, HitCoverage=64%, E-value=1e-163, Identity=80%"; Hit description =Respiratory nitrate reductase subunit
AAQHDEDAGVGALVARQARTDGGQHVDGVVQQVPRHGRVDHAQELQEQRHVVRQFRHHRFEAVLAVGLEQVDHGLATVAAFAVHVLEQVQRMGAVAVEGGDVGFLQRDQVLAGQVADQRLQGFLGLGMGGQGGLDLGRGLLARFRHVDEDLAALRLAAEQRAFRDAARAAVAEGEAAAALLVEAVLDDFLVAAGHHEAVLVVGDGHDAVHVLHGFFRQADLFQQGRVVFAVHGLGALVGAHRQHPLQRLQHRGFLARGQQVGQVAHRDAQAGHVRDHGAGAERALRHLAGLGRGLDRRQRRDVPDHRQRAVFRMQREGDAPLHRHLVDRRLARGFQPGFRDALLARRGDHLGRVRIQEQVQLRFVQVLLVADGGGALDLVGVVQHDAQVADAADAGFRAHGRLAGLDARIAEGALLGLAAVPVVVDLLVRAARDAHAPAAALVLVDQHDAVVLALVDRARRAAGDTGRVQAVFAQARQ

SEQ ID NO: 225433 - protein, 117 aa, Glycine max
  Coding DNA Sequence Number=SeqID_108655
MRSIWAHEIQLFCLQKKNEKSDKRNFKEKKEKKGYITWEDNVINSSSDSEDKIISLGIMMKGYENEEEQSRYIDSNFSKHMACIKVYSYFSPRQQRPLDQQVQQVISNDTNGSLVFD

SEQ ID NO: 225434 - protein, 406 aa, Glycine max
  Coding DNA Sequence Number=SeqID_108656
  Homolog annotation: Hit_ID=Q1MP78; Match level="QueryCoverage=20%, HitCoverage=79%, E-value=1e-19, Identity=69%"; Hit description =Hypothetical protein amyX
MTVTGEEAPANFVPAAAADRSVRGEIPGLNPGTAFDTVDLEYGRGTPVAKAAYWSITDAEVRKRGEQTGLDTLVVHAVNDESTRRTLPALDIRGMGIGDDVLQLGWPQNRGLPVISREEGGDDVKSSWPLRAGLHTCYNGGDSGQRDSDVELISKSHLSSDCTLQLECMKLESLVIADQHAAVNTFPGLVHTARHTMGVGFTRRGTCGWITSFLRKLWNSKTPVLNRMNFPVRRPRFSFFKKTKAASTDLGDRAGWGCSSAGRAPALQAGGQRFDPAQLHHLIALTGERSFGPTLREGAERSATRYRAFASSERTDACSEYIVKRRYVWKLPGIGGRPSSDGNAGLMLPDRASPDDISRSWKDLIVKGNQVAVPLERLWMSIDNENEEAKKDVIRCEKPWGAANKL

SEQ ID NO: 225435 - protein, 115 aa, Glycine max
  Coding DNA Sequence Number=SeqID_108657
  Gene Ontology: Mol. function=nucleotide binding; Biological process =cobalamin biosynthetic process
  Homolog annotation: Hit_ID=P0AF08; Match level="QueryCoverage=91%, HitCoverage=28%, E-value=5e-41, Identity=75%"; Hit description =Protein mrp
MTAQSRDHHSPEALRAVVIGVLSEFEHPTLQHNLTTLKALRHVALLDDKLHIELVMPFAWASAFEALKAQTSAELLRLTNTRAIDWRLRHDIATLKRVKNQPGVNGVKNIVAVSS

SEQ ID NO: 225436 - protein, 1097 aa, Glycine max
  Coding DNA Sequence Number=SeqID_108658
  Homolog annotation: Hit_ID=P0AFI5; Match level="QueryCoverage=22%, HitCoverage=79%, E-value=1e-111, Identity=77%"; Hit description =Penicillin-binding protein 7 precursor
  Pfam annotation: Domain name=Beta-lactamase; Domain location=582-832; Score=-45.7; E_value=0.019; Accession=PF00144.14; Description=Beta -lactamase
  Pfam annotation: Domain name=DUF1282; Domain location=352-521; Score =50.3; E_value=1.6e-12; Accession=PF06930.2; Description=Protein of unknown function (DUF1282)
  Pfam annotation: Domain name=Peptidase_S11; Domain location=581-814; Score=340.8; E_value=2.3e-99; Accession=PF00768.11; Description=D -alanyl-D-alanine carboxypeptidase
  Pfam module annotation: Pfam domain module=Beta-lactamase::DUF1282::Pe ptidase_S11; Domain location=582-832::352-521::581-814
MTKADFLDVSFEDWRKVFTVDVDGAFVCGQIAARHMVDQGDGGRIINITSVHEHTPLPDAAAYTAAKHALGGLTKSMALSLLPHHILVNAVAPGAIATPMNDMSNSEAHSRRMPEIPIGRPGDTREIASLVAWLCSEWATYTTGQSFVVDGGFMLANPQFKAANHKAQHDAEHNCRRQPDEVLEVLIKLVQPRRNNFTGEVAEGDKNQRPQRGANDVKHEKAQRLKTAGANNNRSNQAKAVHEAHANHKQAGVLLNQPVSFFNGVLMFAEAPQNACAIAAAKPEQQLIANNAAAHRRQHHAAEMQQALVRRDAAQQGKGFPFGNAANQQRQPDRWGSPSHQRSDCMNHIWGLLAHPNQEMRDIKQENESVSHHYTHHVLLMAAIPVICAFIGTTQLGWNLGEGQFVQLNMLTGIGLGILFYLIILGGVAHSALYRICRLCGDAAVYQRAGGALSAGVAVRAGRGDSADVHRLSAPALLRLDAGDWRAGVRGAAGADGDSVGLRATLVLTVIKTSAYDSAASPRRIRPDAGGLCFDTAQTSSPDFFDTMSVKMRISLLSLALFVAAPAAMTPALAAAAKLADLAPIAQPQIASGSALIVDLDNNKVLFSSHPDRVRPIASITKVMTAMVVLDARLPMDEMLSVDISQTPEMRGVFSRVKLNSEISRRNMLLLALMSSENRAAASLAHHYPGGYDAFIRAMNAKARALGMTHTHYVEPTGLSLHNVSSAEDLVKLLKATRQYPLIGQLSTTKEETAVFKHPSYALPFRNTNHLVYKNDWRIQLTKTGYTDEAGHCLIMRTMINNRPVALVVLDAFGKYTHFADANRLRDWLETGKAAPCGRGVTQPVTQRSGARECAVCRGGAWLTAVIALESHSYVQVSFSVYPVPAATGEEDAAPKVNPAVELPKMQKILDKIKGQVSGDTNENQLNQLNEMALELSGNAETLGQALIPQRQQLDAQLAVLGPAPKADSGVKETPEVTRKRAALENQKGKLDDQIKQADGIKNGALVLSSQIVNLRRDQLKSQLALNSGRYRRAVVGAGLARGHGRLAAGGAAGDDAGPALQRRVSGVGQPFTNCRKGGLRRSFLAAGDCADYAGGR

SEQ ID NO: 225437 - protein, 288 aa, Glycine max
  Coding DNA Sequence Number=SeqID_108659
  Gene Ontology: Mol. function=D-lactate dehydrogenase activity; Cellular component=membrane; Biological process=lactate metabolic process
  Homolog annotation: Hit_ID=P06149; Match level="QueryCoverage=84%, HitCoverage=42%, E-value=2e-98, Identity=66%"; Hit description=D -lactate dehydrogenase
MNADPTRLCNVMVNSESASMPTRRLVGWPFMATGTALIPSGFHRPAFLLTGFPDARVKGIGRIELAVKRLQLRFGRIQMANVMLCRILRAARREDRQHLLLQRMGIYAFLHNVILMEHVTEEVAVVKAMNQIVIKLRRQALKPLMIAGAQRKVQRQNILYFVSVHRVIAHGGTGCGKTMQKGVRAIFGVAGKELTAAFAEILLQIRLRFGHAVAGHVQHQVMIVFVTILLQALRQVCREPAADALQQAIGQVRLNEAQLAKPGIHPAFEGEKQRHLIGAEFINHHKGV

SEQ ID NO: 225438 - protein, 418 aa, Glycine max
  Coding DNA Sequence Number=SeqID_108660
MNPFSVTRIHDRVNFMVSLNFNNGKTAQQWRSIDCKQGKAQLLYKDLLNDKGLTIARYYGNSYLRYAPAQDDQQITADDIHKVCKLPIKEAQWEKLSATSEIGTTKLVDVNSIQHTGDILSVRLGYDYADIIWEPPYDAPLGLKTEHYLYNCKTHQGAVIAAMNFDSEGRVTDSLITADLVRRKSSFKIDTQMTQRFDQLCQLPAGKKFTAEGHFVSAANKPASTLMGPLMPDLSKNNSQWLDKYSLSAEIERQAQALIKPWALPRFKQIRYTEVSTLGKVEVQLDAQPNGYVRKLEDYGIWKVQRLTLANQLQLKFTMPISTGASLLNKLQTDLRFPLVTGQQYQAQWESIDSDKKITSSRLRCKVTSMGDAKSIADEFSGKYLLVECQQTDSGQAGSRVRLAWLQDLNVFVTVAMQ

SEQ ID NO: 225439 - protein, 88 aa, Glycine max
  Coding DNA Sequence Number=SeqID_108661
  Homolog annotation: Hit_ID=UPI00005F7623; Match level="QueryCoverage =100%, HitCoverage=13%, E-value=1e-13, Identity=47%"; Hit description= COG0840: Methyl-accepting chemotaxis protein
MLKTTQSRFTATLVAFFVVLMLVTVLVINQFIAPQLSQNESRLVRYEVDGLAGRIVEQMNRVQAQQRAITEAAGVMDSAAIDTLLPAL

SEQ ID NO: 225440 - protein, 609 aa, Glycine max
  Coding DNA Sequence Number=SeqID_108662
  Gene Ontology: Mol. function=hydrolase activity, acting on glycosyl bonds; Biological process=polysaccharide catabolic process
  Homolog annotation: Hit_ID=Q9AT14; Match level="QueryCoverage=79%, HitCoverage=93%, E-value=0.0, Identity=70%"; Hit description=Beta -amylase
  Pfam annotation: Domain name=Glyco_hydro_14; Domain location=96-512; Score=451.1; E_value=1.4e-132; Accession=PF01373.8; Description =Glycosyl hydrolase family 14
MENVVCAAQCGMGTKITLQFQERYNLQHGISRRYGAICVERARKPRTTHCFFKSDCGHLKKERGVRVTLKAETAESKEQIHTSYKDPMLASYVPVYVMLPLGVVTNDNVLQDSAGLKNQLKELHAAGVDGVMVDVWWGIVESKGPQQYDWSAYRTLFKLVQDCKMKLQPIMSFHQCGGNVGDSVFIPLPKWVLEIGELDPNIFYTNNKGIRNKECISLGVDNQPLFHGRTPIELYTDYMRSFRENMKDFLESELMIDIEVGLGPAGELRYPSYTQNQGWVFPGIGQFQCYDKYLKDDFKEAATREGHPEWELPDNVGELNDAPESTKFFKSRGTYLTKKGKFFLTWYSNKLLIHGDEILDKANSVFLGCKVKLAAKIAGIHWLYKSKSHAAELTSGYYNLNRRDGYRPIARMLSRHKAVLNFTCLEMRNHEQPIEARSGAQELVQQVLSGCWMEKLEVAGENALARYDSEAYNQILLNARPNGISKWGPPKLKMYSMAYLRLSDELLQQTNFDIFKAFVRKMHANLDYCPEPERYYHFRVPMELSKPRIPLEVLLEATKPVKPYACFYHFTYIQTYIQAKSKLKMQMERKEGIDDRKGSKGMQNVESEL

SEQ ID NO: 225441 - protein, 473 aa, Glycine max
  Coding DNA Sequence Number=SeqID_108663
  Gene Ontology: Mol. function=hydrolase activity, acting on glycosyl bonds; Biological process=polysaccharide catabolic process
  Homolog annotation: Hit_ID=Q9AT14; Match level="QueryCoverage=97%, HitCoverage=95%, E-value=1e-180, Identity=72%"; Hit description=Beta- amylase
  Pfam annotation: Domain name=Glyco_hydro_14; Domain location=9-389; Score=194.3; E_value=2.9e-55; Accession=PF01373.8; Description =Glycosyl hydrolase family 14
MVAAVSWELLQMTMSCKIEWDLRANSRSYMQQDLVSNGSGLQIEATSYNVIPQMWGDWGNVGDSVLISLPKWILEIGELDPDIFYTNRKGVRNKECLSLGVDNQPLFHGRTAIELYTDYMQSFKDNMEDFLKSELMIDIEVGLGPAGELRYPSYTKNLGWVFPGIGEFQYLKADFKEVALKAGHPEWELPDNAGESNDVPESTEFFKSGGTYKTEKGKFFLTWYSNKLLTHGDEILNKANNVFLGCKVKLAAKVAGIHWWYKTESHAAELTSGYYNLHNRDGYRPIARILSRHNAILNFTCLEMRNHEQPAKAKSGAQELVQQVLSGGWLESLEVAGENALARYDREAYNQILLNARPNGVNKYGPPTLKMYGVTYLRLSDKLMQQTNFNIFKAFVRKMHANLDYCPDPEKYYHFTVPMKRSEPKIPLEVLLEATKPVEPYPWKKETDMNLDVTGFLDYIVAIIVRIFKLKVN

SEQ ID NO: 225442 - protein, 87 aa, Glycine max
  Coding DNA Sequence Number=SeqID_108664
MEHSTLIWGQESLSSTECLGRVKLYVWREQGSQEPPMASNWTVASSRNNRVLECRSKLAAATAEFELWPEVASSWVRLQEFLMVHHP

SEQ ID NO: 225443 - protein, 142 aa, Glycine max
  Coding DNA Sequence Number=SeqID_108665
MCYVGKATKIFIFIVTVLVVLGLVLGLGLLRRHHHNTSNKCSDESCIIPSPATTFPNPNFNTPTPPSPIDNNPTTPQTPPQLPNPNPIPPPPPPNSDNPSLPPPPPPEETTPPNPPSVAAPPMNTPTPGSAQVTPGPVHAMA

SEQ ID NO: 225444 - protein, 77 aa, Glycine max
  Coding DNA Sequence Number=SeqID_108666
MITIYPSGVAHTVQLSKAPKDIYTKRHTVCGDSTTMVVGSDAKALGHYVLAMALFADQCPYELAMAVVSLPQPLSDL

SEQ ID NO: 225445 - protein, 131 aa, Glycine max
  Coding DNA Sequence Number=SeqID_108667
  Gene Ontology: Mol. function=magnesium ion binding; Cellular component=chloroplast; Biological process=metabolic process
  Homolog annotation: Hit_ID=Q6EJ97; Match level="QueryCoverage=65%, HitCoverage=13%, E-value=3e-20, Identity=63%"; Hit description =Isoprene synthase
  Pfam annotation: Domain name=Terpene_synth; Domain location=1-125; Score=-36.4; E_value=7.7e-05; Accession=PF01397.11; Description =Terpene synthase, N-terminal domain
MASDLLSLPYCLSTTQIPPRSHIRHRINVFESFKDEEGKFKVKISNDVQGLLSLYEASYLSFEGETVWEAKAFSRTHLMNLMKEGIESTEVAEQVRHVLEGLPFHQSFQRLDAYGDILTYTIKRNNIIPLC

SEQ ID NO: 225446 - protein, 354 aa, Glycine max
  Coding DNA Sequence Number=SeqID_108668
  Gene Ontology: Mol. function=transcription factor activity; Cellular component=nucleus; Biological process=regulation of transcription
  Homolog annotation: Hit_ID=Q1SRF6; Match level="QueryCoverage=93%, HitCoverage=72%, E-value=8e-76, Identity=43%"; Hit description=GRAS transcription factor
  Pfam annotation: Domain name=GRAS; Domain location=2-248; Score=80.7; E_value=4.6e-21; Accession=PF03514.5; Description=GRAS family transcription factor
MSFKGSNTIQRRLMSVTELAGYVDLIPWHRFGYCASNNEIYKAITGFQRVHIVDFSITHCMQWPTFIDGLAKRPEGPPSLRITVPSCRPHVPPLVNISIHEVGLRLGNFAKFRDVPFEFNVIGNTEGPLTPAELSDESTSFHFEAMLSLLNPTMLNLREDEALVINCQNWLRYLSDDRKGISCQSFSLRDAFLNLIKGLNPRIVLLVDEDCDLSASSLTSRITTCFNHLWIPFDALETFLPKDSCQRSEFESDIGQKIENIIGYEGHQRIERLESGVQMSQRMKNVGYLSVPFCDETVREVKGLLDEHASGWGMKREEGMLVLTWKGNSCVFATAWVPCEILRDHHIGMDASLS

SEQ ID NO: 225447 - protein, 175 aa, Glycine max
  Coding DNA Sequence Number=SeqID_108669
  Gene Ontology: Mol. function=magnesium ion binding; Cellular component=chloroplast; Biological process=metabolic process
  Homolog annotation: Hit_ID=Q6EJ97; Match level="QueryCoverage=96%, HitCoverage=28%, E-value=7e-34, Identity=46%"; Hit description =Isoprene synthase
MVSQQQSDSTIQRVPQKWIDLVRRWGCSRSLLLLIVCQDQDVTEQALHSLANYHDFLRPAMIILRLCDDLGTSTDEMKMGEISTSIASYMHENGLSEEKVHQYFKTLIDKEWQYLNKGQVMGSTLSKSVIQVAIDLGRTARYTYQCGDGIGRQDGITKRRMKLWLVDPVEVNEAS

SEQ ID NO: 225448 - protein, 33 aa, Glycine max
  Coding DNA Sequence Number=SeqID_108670
MAQCISTSVEKGHQRRSSIGRRRFSATLKEYRG

SEQ ID NO: 225449 - protein, 40 aa, Glycine max
  Coding DNA Sequence Number=SeqID_108671
MEVLSCAVKVKVRCGGRRQQTRYAEGGGCITNIQLSYGSS

SEQ ID NO: 225450 - protein, 568 aa, Glycine max
  Coding DNA Sequence Number=SeqID_108672
  Gene Ontology: Mol. function=magnesium ion binding; Cellular component=chloroplast; Biological process=metabolic process
  Homolog annotation: Hit_ID=Q5SBP3; Match level="QueryCoverage=58%, HitCoverage=56%, E-value=4e-91, Identity=52%"; Hit description=R -linalool synthase
  Pfam annotation: Domain name=Terpene_synth; Domain location=235-418; Score=142.5; E_value=1.1e-39; Accession=PF01397.11; Description =Terpene synthase, N-terminal domain
  Pfam annotation: Domain name=Terpene_synth_C; Domain location=423 -568; Score=108.5; E_value=1.9e-29; Accession=PF03936.6; Description =Terpene synthase family, metal binding domain
  Pfam module annotation: Pfam domain module=Terpene_synth::Terpene _synth_C; Domain location=235-418::423-568
  Subcellular localization annotation: CTP_CleavageSite=52; ConfidenceScore=5.65e-01
MSLNAMAFTKLRVSSFTSSLASNNSRPSIYQPWNLSLQSSKIGMVPNKLSIKSVAFSDKIVAKTEPFESDENGEEEKEEEEEEGLVEICVPDCDDTHNKKGEADVEGKDAAVGGLCAGLLTGRWEAAMGKGGDVISAVGGGDVVAAVGGGFVKEEDGKSWLVTLGSRGGMVPTRGGDFAKEEDGEGCLGIMVFNFRRMASSLESMEAWAAASLALAAPRQSTQAAKSLAYIIEERQVPSQTYLGTKDLDQVIRKGQEALLNSSDPLRTLKIIDTIQKLGIEHHFEKEINLQLGRVGDWDTAEDLFATALQFRLLRHNGWPTCSDVFNKFLDKSGNFKESVTRDIWGMLSLYEASYLGAKGEEVLQQAMDYSRAHLCQSLPHLSPKVRSIVAEALKLPRHQRMVGLEAKNYMVEYSQASNQIPALLELARLDYDMIQSMHQKELAEISRWWKDLGLIERLGFGRDGPRECFLWALGIFPEPRHSSCRIELAKAICVLQVIDDVFDTYGTLDELVLFTKAIKRWDLDAMEQLPEYMKICYMALYNTTHEIAYKIQKDHSLTVVACLKITV

SEQ ID NO: 225451 - protein, 439 aa, Glycine max
  Coding DNA Sequence Number=SeqID_108673
  Homolog annotation: Hit_ID=Q5XM22; Match level="QueryCoverage=15%, HitCoverage=37%, E-value=8e-18, Identity=68%"; Hit description =Resistance-like protein HAAS-2
MVWAEEIVMIPMMLHNVDDLSHPHGGSDKPVLPTPDVEADVFSDDPMAPTDVADTGVDIPADTSTQAAEDEHEGFLGGPSDPSVLTQYADHVACSVWTGEERPELKLSSHGTKVHSLGRPVPAIEGLVVGTGLSPLIACDTGRCLVSILSLLHLLVVGDLHAFQPLHVDDAVAKAETGQFHGPYVRLQWECDIYEHRCQAGHWIVAARAYLLHLLGCTLFANKSATNVHVVYLEALRDLSQTGSAGYTSIFPQSWSPLLIRTTTRIHCVPGAPRLTPDSRCLLDPIWGASTDLGLPFDFMLFRSPALEARCCTIPASPIDSWVSYDDIHDRWMHYSDHMVPAGEVCVVPGQASDPLPDGNAPQPRVVPQAPQTDIPHVPDLGAPSTSVRPAVEEPRHVVEVFHGIVERSERHLSLGMVTPGSSTHEVIEECLRMAKSVT

SEQ ID NO: 225452 - protein, 218 aa, Glycine max
  Coding DNA Sequence Number=SeqID_108674
MDNIRFTAPFKVQKNLLQVPFSYHRQWLRNYPKYVLFHCDGEIHFIRVRTHGTKCFFADGLNDFRKAHNLNESVILRLVAGDKNTTFTVYIDGPAHHHSSLKPIIYRRRYIFTVDITHDMLQQNLSLTLPAAASKFVYGSKKSITIHHGLPKSTKWPLSIHNHMPAITEPWFNLIHEKNLRPRDEVAFYYRFHDHAWELVIRKTIKWNNNNTDLDFDE

SEQ ID NO: 225453 - protein, 81 aa, Glycine max
  Coding DNA Sequence Number=SeqID_108675
MVAISKTVLIKSVAAELNLLFRVKGRGNPERERERRVGNEGFQGSELTRGRWFWKGLQGSSCNGRGTLPAKVMEKVGITGS

SEQ ID NO: 225454 - protein, 76 aa, Glycine max
  Coding DNA Sequence Number=SeqID_108676
MEKCSASPVPIQKGDKFSLAQCPKNDMERKQIQYKASPCSLYSLFMYKFGGLLVERESRESSSGTVAMLQSSISTV

SEQ ID NO: 225455 - protein, 264 aa, Glycine max
  Coding DNA Sequence Number=SeqID_108677
  Gene Ontology: Mol. function=transporter activity; Cellular component= membrane; Biological process=sodium ion transport
  Homolog annotation: Hit_ID=Q21KX2; Match level="QueryCoverage=95%, HitCoverage=56%, E-value=5e-71, Identity=47%"; Hit description =Putative membrane protein
MRSHAMSIAEKIPVKEKIGYSLGDAASHIVFDSSVAILAYYYTDIYGLPPAVMGTMFLLVRLLDAITDPIMGAIADATSTRWGRFRPWLLAICVPFAVSCVLVYSIPDFTETGKIYYAVGAYIFMTLMYTAINIPYCSLGAALTSDPRENLSLQSWRFAITPIGGALGTALILPLADYLYPGDRATGIQVAMALFGAIGCLMFIVCFVTTKERVQPIKEENLNIARDVKILFRNDQWRILSIYNFMMLVAVVIRGGAVVYYVNT

SEQ ID NO: 225456 - protein, 48 aa, Glycine max
  Coding DNA Sequence Number=SeqID_108678
MTRQTTLGDQSGSHCFARMLQPCGINTNLKKHSNRVYLPPRPRLREVY

SEQ ID NO: 225457 - protein, 41 aa, Glycine max
  Coding DNA Sequence Number=SeqID_108679
MAKAITLPGKREIMDMMRLHILMLFRLSPGSSVQVENNRSS

SEQ ID NO: 225458 - protein, 155 aa, Glycine max
  Coding DNA Sequence Number=SeqID_108680
  Gene Ontology: Mol. function=RNA-directed DNA polymerase activity; Cellular component=mitochondrion; Biological process=RNA-dependent DNA replication
MVGCDPKGTFSVGAKLSRSRIFFGFLSDSPYEVASLFVDDSPPSMGIMVSVPYAFKLVKSSTQGPENDSISCLCMSVSLRMFNRGELFHLAGRNFLKWSCFYPLGEVVNNDKRSAWNVCKLLTSSASLGKVEGVYPKCWLVVARSHRFSGQGASS

SEQ ID NO: 225459 - protein, 155 aa, Glycine max
  Coding DNA Sequence Number=SeqID_108681
  Gene Ontology: Mol. function=nucleic acid binding; Cellular component= signal recognition particle, endoplasmic reticulum targeting; Biological process=SRP-dependent cotranslational protein targeting to membrane
  Homolog annotation: Hit_ID=Q1RXS1; Match level="QueryCoverage=78%, HitCoverage=35%, E-value=3e-15, Identity=34%"; Hit description=Zinc finger, CCHC-type; Peptidase aspartic, catalytic
  Pfam annotation: Domain name=zf-CCHC; Domain location=89-106; Score =29.2; E_value=1.4e-05; Accession=PF00098.13; Description=Zinc knuckle
MELLLLRVGLREAERTSIVRFLSGLNMEVRDKVKLLPYRDLDDLVQLYIRKDQGQGILRAAPSKPKDDKGKIIEKQSPKASMQEKTSSIKCFKCLGIGHIASQCPTKKTMIMRGQDIYSSQDEVTTSPSSSESEEAKGEESSEEIYPQEEGDLLM

SEQ ID NO: 225460 - protein, 57 aa, Glycine max
  Coding DNA Sequence Number=SeqID_108682
  Gene Ontology: Mol. function=oxidoreductase activity; Biological process=pyrimidine base metabolic process
  Homolog annotation: Hit_ID=Q6D6V1; Match level="QueryCoverage=85%, HitCoverage=16%, E-value=3e-11, Identity=63%"; Hit description =Probable ketopantoate reductase
MNTEIKTVVAVVGPGAIGTTVAAALHEVGRTPLLCGRTPRDHLTLQDGDRFITVPGP

SEQ ID NO: 225461 - protein, 294 aa, Glycine max
  Coding DNA Sequence Number=SeqID_108683
  Gene Ontology: Mol. function=transcription factor activity; Cellular component=intracellular; Biological process=regulation of transcription, DNA-dependent
  Homolog annotation: Hit_ID=Q0RHM0; Match level="QueryCoverage=78%, HitCoverage=76%, E-value=1e-22, Identity=31%"; Hit description =Putative RpiR familytranscriptional regulator with phosphosugar- binding domain
  Pfam annotation: Domain name=HTH_6; Domain location=17-123; Score =24.5; E_value=7.1e-06; Accession=PF01418.8; Description=Helix-turn -helix domain, rpiR family
  Pfam annotation: Domain name=SIS; Domain location=141-274; Score =58.0; E_value=3e-14; Accession=PF01380.12; Description=SIS domain
  Pfam module annotation: Pfam domain module=HTH_6::SIS; Domain location=17-123::141-274
MKNENGNRVSESEQRLQQWLGSIHARSGDLAASEAKVVDLLLVDPLFVGTSTTAQVATRAGVSPPTVIRAARAIGFTGFTELKIEIARARGTARFFAPPEVLTADATLASVLETSVRAGADALTALSGAIEISALDEAVDLIQSARQVFAFGAGPSATVAADAVFRLRTAGVITISIQDYLSAMIAARLLGSGDVMIVVSSTGRTSSTLAVADAASSAGASLIAITNQYDTPLATLANVSLVVGGAPLPAQMAAAGSRLAQLVVIDTLVAALTLRDKEQSRRAERAGIDLPDMS

SEQ ID NO: 225462 - protein, 488 aa, Glycine max
  Coding DNA Sequence Number=SeqID_108684
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=98%, HitCoverage=80%, E-value=0.0, Identity=77%"; Hit description=Indole -3-acetic acid-amido synthetase GH3.5
  Pfam annotation: Domain name=GH3; Domain location=1-460; Score=867.2; E_value=7.7e-258; Accession=PF03321.4; Description=GH3 auxin -responsive promoter
MPTIEEELERRSMLYSLLMPVMDQFVPDLDKGKGMYFLFTKSEAKTPGGLLARPVLTSYYKSSHFKHRKHDPYTNYTSPNETILCHDSYQSMYSQLLCGLYQNEEVLRVGAVFASGFIRALKFLEKHFVRLCNDLRTGTLDAKITDPSVREAVMKVLKPNPTLADFVETECMKGSWKGIITRIWPNTKYVDVIVTGTMSQYIPILDYYSNGLPLVCTMYASSECYFGLNLNPSCDPSEVAYTLIPTMAYFEFLPLDEINGHTNSISQLEQEHLVDLADVKLGQEYELVVTTYAGLYRYRVGDILRVAGFKNKAPQFNFVCRKNVVLSIDSDKTDEVELHNAVKSGAEQLAEFNASLTEYTSCVDTSTIPGHYVLYWEISTNDHTPTIPSSVFGHCCLSIEESLNSVYRQGRVSESIGPLEIKVVENGTFDKLMDFALSQGASINQYKTPRCVTYAPILDLLNSKVLSSYISPKCPNWVPGHKDWCTLH

SEQ ID NO: 225463 - protein, 241 aa, Glycine max
  Coding DNA Sequence Number=SeqID_108685
  Gene Ontology: Mol. function=transcription factor activity; Cellular component=nucleus; Biological process=regulation of transcription, DNA-dependent
  Homolog annotation: Hit_ID=Q4QYG1; Match level="QueryCoverage=78%, HitCoverage=95%, E-value=3e-82, Identity=82%"; Hit description=DREB
  Pfam annotation: Domain name=AP2; Domain location=105-169; Score =123.6; E_value=5.4e-34; Accession=PF00847.10; Description=AP2 domain
MEFLLFPIVMVLWRATNHWLAFALDIVLKNFIMFILFNLNCTQMLAKAHNKGDGSKSLAKILAKWKEYNAQIDSSSDADKPIRKVPAKGSKKGCMKGKGGPENSRCNYRGVRQRTWGKWVAEIREPNRGNRLWLGTFPTAIGAALAYDEAARAMYGSCARLNFPNVSVSSFSEESSKDSPSANHCGSSMAVSANESMISPSNSGVDAEEDVDMEPISLSLSVKHENGEGESGISSSPPSSS

SEQ ID NO: 225464 - protein, 52 aa, Glycine max
  Coding DNA Sequence Number=SeqID_108686
MNCPKNYATLYDFFGGLLSVAALIGVLDSQKSIYFLSIFLWAGKIPSENNQA

SEQ ID NO: 225465 - protein, 448 aa, Glycine max
  Coding DNA Sequence Number=SeqID_108687
  Gene Ontology: Biological process=cell adhesion
  Homolog annotation: Hit_ID=Q9FL53; Match level="QueryCoverage=69%, HitCoverage=90%, E-value=1e-50, Identity=40%"; Hit description =Putative fasciclin-like arabinogalactan protein 21 precursor
  Pfam annotation: Domain name=Fasciclin; Domain location=256-374; Score=0.2; E_value=0.0035; Accession=PF02469.12; Description =Fasciclin domain
MRLYRYSQRQRHSPSKRITFFVFFFLAMAYSRWCWFPLYLAASIALGIIAISSAIRSTSNKNPPQDPPIPHDISLNASNALRKAGFIVMADLLHHSPSFFKPPQNSTIFAIKDSAIKNTSHPLWFLKTLLLYHTTTSNAYSFNDLVKIPQGTCLPTLLRDKNVSLTKLDLDHAPNSVEINHVLISNPNIFLGEQLAVHGVLAPFSPLQPQDLLQRGFGFAIRTPTCRSNDVNVSVSKNGVEWNRVVHLLRAKGYASFSIALHSVLDGIKRDFSGSLGYVTIFAPRDLTLLGYPLTILDRAVRLHILPQRFVYKEISSLPVRSLLKTLMPDEHLEIDGVLDFVPGMVVNGVVIVAPDMIISEKFVVHGISRAFKMAECFNWRLSEGFTKIQVETDSQVVQRLIIRGCLRNQQAATLVRAINIKILASQLSFYMMEQCLQRNKFRWRRSS

SEQ ID NO: 225466 - protein, 109 aa, Glycine max
  Coding DNA Sequence Number=SeqID_108688
MALESEAPMPGLNPLEVKIQREVKVSDQKRDKVVVQPVAGSRGSSSSHEEGESKAEEAEAPSIRKLGKHHSADKSVAGGSVILGGLVTVTFAAVFCYIRVTRKRDNSDH

SEQ ID NO: 225467 - protein, 115 aa, Glycine max
  Coding DNA Sequence Number=SeqID_108689
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=75%, HitCoverage=14%, E-value=3e-29, Identity=68%"; Hit description =Indole-3-acetic acid-amido synthetase GH3.5
MPEAPKHLCHDPKDNLDDDDDDGSSNNNKRALEYIEEVTTNADEIQEKVLAQILSRSANAEYLQRHGLEGRTDRNTFKNIMPVVTYEDLKPDIDRIANGDTSPILCSKPISEFLT

SEQ ID NO: 225468 - protein, 999 aa, Glycine max
  Coding DNA Sequence Number=SeqID_108690
  Gene Ontology: Mol. function=protein serine/threonine kinase activity; Cellular component=membrane; Biological process=protein amino acid phosphorylation
  Homolog annotation: Hit_ID=Q9ZR08; Match level="QueryCoverage=94%, HitCoverage=93%, E-value=1e-132, Identity=50%"; Hit description =Putative receptor kinase
  Pfam annotation: Domain name=B_lectin; Domain location=76-183; Score =102.8; E_value=1e-27; Accession=PF01453.15; Description=D-mannose binding lectin
  Pfam annotation: Domain name=PAN_1; Domain location=332-422; Score =10.5; E_value=0.014; Accession=PF00024.16; Description=PAN domain
  Pfam annotation: Domain name=PAN_2; Domain location=332-409; Score =12.4; E_value=6.9e-05; Accession=PF08276.2; Description=PAN-like domain
  Pfam annotation: Domain name=Pkinase; Domain location=683-954; Score =148.5; E_value=1.8e-41; Accession=PF00069.15; Description=Protein kinase domain
  Pfam annotation: Domain name=Pkinase_Tyr; Domain location=683-954; Score=119.0; E_value=1.4e-32; Accession=PF07714.7; Description =Protein tyrosine kinase
  Pfam annotation: Domain name=S_locus_glycop; Domain location=195-321; Score=19.3; E_value=1.4e-06; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=76-183::332- 422::332-409::683-954::683-954::195-321
MRTGELLLFFSFLVSLALWFQLCFAGDTLIAGQEITQNRTGNLVSSSRTFELGFFSLSGEKKYYLGIWYRELEKETQKAVWVANRDKPVEDSSRVFRIAEDGNMVVEGASSKRYWSSKLEASSSTNRTVKLLDSGNLVLMDDNLGITSYLWQSFQNPTDTFLPGMKMDANLSLISWKDATDPSPGNFSFKLIHGQKFVVEKHLKRYWTLDAIDYRIARLLENATSGKVPYKLSGITLNPGRAYRYGKSMLLMNYSGEIQFLKWDEDDRQWDKRWSRPADKCDIYNCCGSFGFCNKNNLNLNLEPCRCLPGFRRRPAGEIQDKGCVRKSTSSCIDKKDVMFLNLTNIKVGDLPDQESFDGTEAECQSLCLNNNTKCSESQCQAYSYSNSTSYDRDHSSTCKIWRRDLSTLLERYNSDFLEEFVPGPILSILVKRSDIVPYAKSCEPCGIYVIPYPLSTGPNCGDPMYNNFNCNKSTGQVTFKILGGTSHQVIWIDEDTRMFYIQPNGSYPCNSSNQNITPNFPFNVTDQCSEADDDGKIKITWLPAPEPPCTELIDCHNWPHSTCRETSEGGSRCRCDSNYKWNNTIMSCTLEEHSTNQLELILIVILSGMAILACTIAFAIVRRKKKAHELGQANARIQESLYESERHVKGLIGLGSLAEKDIEGIEVPCYTFASILAATANFSDSNKLGRGGYGPVYKGTFPGGQDIAVKRLSSVSTQGLQEFKNEVILIAKLQHRNLVRLRGYCIKGDEKILLYEYMPNKSLDSFIFDRTRTLLLDWPMRFEIILGIARGLLYLHQDSRLRVIHRDLKTSNILLDEDMNPKISDFGLAKIFGGKETEASTERIVGTYGYMAPEYALDGFFSIKSDVFSFGVVLLEILSGKKNTGFYQSKQISSLLGHAWKLWTEKKLLDLMDQSLGETCNENQFIKCAVIGLLCIQDEPGDRPTMSNVLYMLDIETATMPIPTQPTFFVNKHFSSSASSSSKPEISLQFESSYQEGR

SEQ ID NO: 225469 - protein, 95 aa, Glycine max
  Coding DNA Sequence Number=SeqID_108691
MIVNSHHQHDLLSPLLFTTTTTTMITVITNNDGGDNHDDDHVDGDDGDHDSNHNSGGGGCSGSIFCSSLKFKMHCGKLSGRLQIMPEQTNSSGKP

SEQ ID NO: 225470 - protein, 93 aa, Glycine max
  Coding DNA Sequence Number=SeqID_108692
MESGNVRCIQQYCWCTQQLEEPSSGEVTGRIFSSSFVLPEKPSSREAYWKKFFQINNLFFRKNKVTGRSSSGIAHGIFGGKETGSSTERVMGT

SEQ ID NO: 225471 - protein, 156 aa, Glycine max
  Coding DNA Sequence Number=SeqID_108693
  Pfam annotation: Domain name=zf-CCHC; Domain location=52-69; Score =10.3; E_value=0.019; Accession=PF00098.13; Description=Zinc knuckle
MDSLITRLLRVPHALKEENPAELMETSVMVSPRGRGGGRNSRGGRGGRGGRPQCTYCKRMDHTQENCYSLHGFPDKVAQVTQTEKPESKFSDKEYQEYLKLKSEKSSSQASSSSVPCYSTACISQSVDGPSPWILDSGASDHISGTWHGSTDWRRM

SEQ ID NO: 225472 - protein, 201 aa, Glycine max
  Coding DNA Sequence Number=SeqID_108694
YGESDDMRAYLMVIRTFCHPQTASSMTFEGTKIIFCTVCHPEMANPMTCGGSLWLSTPFVNQRDDESDDMRGYLMFIRNFGQPNANELVNTDGESDDMRRYLMFIRNFGQPKANELASEPVDTQRLTSSSAPFVIQRRTASPMTCGGASESIDTWVLMVICTFSHQKMGYLMVIHTLCDQETPSSMTCGGALWLSAPFVIQ

SEQ ID NO: 225473 - protein, 105 aa, Glycine max
  Coding DNA Sequence Number=SeqID_108695
MKVLLVKKTKHQSRVSGLIVFYNIGVVVFIVQPNIFLEDNTERENWEHHSLSLPSSKSQHGKVHRKKEFNPTGSDNGWYSNLRKDKMVIEKLQKLFMPYLKLVGK

SEQ ID NO: 225474 - protein, 498 aa, Glycine max
  Coding DNA Sequence Number=SeqID_108696
  Gene Ontology: Mol. function=catalytic activity; Biological process =protein amino acid phosphorylation
  Homolog annotation: Hit_ID=Q9FM53; Match level="QueryCoverage=70%, HitCoverage=70%, E-value=1e-112, Identity=60%"; Hit description =Arabidopsis thaliana genomic DNA, chromosome 5, P1 clone:MJH22
  Pfam annotation: Domain name=DUF860; Domain location=58-405; Score =437.8; E_value=1.4e-128; Accession=PF05898.4; Description=Plant specific of unknown function (DUF860)
  Subcellular localization annotation: CTP_CleavageSite=52; ConfidenceScore=5.74e-01
MTFCVLLSFNNPKPSSFLSSTFVLGQTTPLSFSINEKLKPRNYLNSVLVSISCSSIKLVRDRSLDRHVVTKNKTRFVQKLKTLLLSKPKHYIPLHILSKCRTYLCLSKPRSILSMIHRYPSIFELFNVPWPPTPLNATKLHPQLCVRLTPAAAALAAEELSLQSSISNMLATKLQKLLMLSSHRRLLLSKLVHFAPDLGLPPNFRSRLCNDHPDKFKIVDTPYGRALELVSWDVNLAMPLVPPASSSHSLGFIVDRPLKFKQLSLRKGLNLKRRHRDFLLKFEEMPLVCPYRNPAEALAKESLEAEKRSCALVREVLAMTVEKRTLIDHLTHFRKEFGLPNKLRGMIIRHPELFYVSLKGERDSVFLVEGFGEKGDLLEKDEDGVLFIQDKWMDLARESKRMRRERRKGRISQDVGSLNDADQNNYDSDDDYDDNIEIDNFKEGYDDGFEDIFEELDFEDEDDDHTNRFFAQNNSGEFWIAGPFPIQHGLDEVQTQPW

SEQ ID NO: 225475 - protein, 473 aa, Glycine max
  Coding DNA Sequence Number=SeqID_108697
  Gene Ontology: Mol. function=protein serine/threonine kinase activity; Cellular component=cell surface; Biological process =protein amino acid phosphorylation
  Homolog annotation: Hit_ID=O64477; Match level="QueryCoverage=95%, HitCoverage=67%, E-value=1e-122, Identity=44%"; Hit description =Putative receptor-like protein kinase
  Pfam annotation: Domain name=PAN_2; Domain location=180-232; Score =26.4; E_value=2.4e-06; Accession=PF08276.2; Description=PAN-like domain
  Pfam annotation: Domain name=Pkinase; Domain location=317-472; Score=- 25.5; E_value=4.8e-07; Accession=PF00069.15; Description=Protein kinase domain
  Pfam annotation: Domain name=Pkinase_Tyr; Domain location=318-473; Score=-84.7; E_value=2.8e-07; Accession=PF07714.7; Description =Protein tyrosine kinase
  Pfam annotation: Domain name=S_locus_glycop; Domain location=82-171; Score=50.5; E_value=5.7e-12; Accession=PF00954.11; Description=S -locus glycoprotein family
  Pfam module annotation: Pfam domain module=PAN_2::Pkinase::Pkinase _Tyr::S_locus_glycop; Domain location=180-232::317-472::318-473::82 -171
MVDLIYMILDEFGYNSTPKTSSRDSDSLWQSFDHPTDMWLPGGKIKLDNKTKKPQYLTSWKNNQDPAMGLFSLELDPEGSTSYLILWNKPEEYWTSGAWNGHIFSLVPKMRLNYLYNFSFVTNENESYFTYSMGWSSNSRGWIMLLFWSQPRQQCEVYAFCGFVPKSPFDWNLVDYSGGCKRKTKLQCENSNPFNGDKDWECEAICLNNCSCTAYAFDSNGCSIWFANLLNLQQLSADDSSGETLYVKLAASEFHDSKNSNATIIGVAVGVVVCIEILLTMLLFFVIRQRKRMFGAGKPVEGSLVAFGYRDLQNATRNFFEKLGGGGFGSVFKGTLGDSTRERNSSEQKLAPMGTVQHVNLVRLRGFCSEGAKRLLVYDYIPKGSLDFHLFHNKNSKPENILLDAEFCPKVADFGLAKLVGRDFSRVLATIRGRRGYLAPEWISGMGIIAKADVYSYGMMLFEFVSGRRNSEP

SEQ ID NO: 225476 - protein, 440 aa, Glycine max
  Coding DNA Sequence Number=SeqID_108698
  Homolog annotation: Hit_ID=O64477; Match level="QueryCoverage=45%, HitCoverage=27%, E-value=4e-49, Identity=50%"; Hit description =Putative receptor-like protein kinase
  Pfam annotation: Domain name=B_lectin; Domain location=251-375; Score= 105.8; E_value=1.3e-28; Accession=PF01453.15; Description=D-mannose binding lectin
MRNVSKNRFLTCFRPVVDIDDMLEPKAAVVDDSASCRFACIPVADKHDAKNSTTKATLSDQDMLAQNWIVVPRPQKRTFSKIIKADLFLLRDYSAYTESSSTGDEKKQAFVGTNIQKIKPPEWSSSISSSNSPESKNESPKDQVEKQKKFRCLGIYWVLVSLVVTVFWGKVLKLRNAESKAHKNSRRDRNGRSGRNKGTLQLLIGVRATPMYSMRNQRFCVYLLTLFFNLFTHNFLAALTTISTNQTLTGDQTLVSEAGVFELGFFKPDNPVSDKSTAKLTISGGNLVLLDASSNQVWSTNITSPMSDSVVVAVLLDSGNLVLTNRPNGASASDSLWQSFDHLTDTFLPGGKIKLDNKTKKPQYLTSWKNNQDPATGLFSLELDPEGSNAYLISWNKSEEYWTSGAWNGHIFSLVPEMRLNYIFNFSFVSNENESYFTYS

SEQ ID NO: 225477 - protein, 90 aa, Glycine max
  Coding DNA Sequence Number=SeqID_108699
MEIAETTEENLCKRKVEYVNPDGNEFYLKRNLEKKLLSVKAGKPFKYLTYDKESESYIYDEEIKIPNGSLFHALREDGRLKLYMHFLDEE

SEQ ID NO: 225478 - protein, 94 aa, Glycine max
  Coding DNA Sequence Number=SeqID_108700
MFKLLNNQTKKRNLILVEESEPEVAIKEVIKKIENKKLGDGWLVKQTVRFGIGDGLGNMQLTLAEAGRVAVSVADMGRMVNKFGEYYPSGLNRD

SEQ ID NO: 225479 - protein, 98 aa, Glycine max
  Coding DNA Sequence Number=SeqID_108701
MVVLVVAVGSEVVVRVTEAEEGGLEKEEETGAHPSKLEAMILHGGPHDVSLSYFSKYLVANILLNFQALVWANIVKLMPREMDGPHTDKNGFKAVAFL

SEQ ID NO: 225480 - protein, 104 aa, Glycine max
  Coding DNA Sequence Number=SeqID_108702
  Subcellular localization annotation: CTP_CleavageSite=62; ConfidenceScore=5.27e-01
MAFSSGCVLPTRINWVQMHGVPALVQLRTPPPAMMGLPNLPVSLTGPTQKYKRRAVTSAKVSSEERKQWLQLKGEVVDDADAEQAAKENLLYGEGEFDEGKVQG

SEQ ID NO: 225481 - protein, 95 aa, Glycine max
  Coding DNA Sequence Number=SeqID_108703
  Subcellular localization annotation: CTP_CleavageSite=31; ConfidenceScore=5.09e-01
MVEPSKKRKGSSSRSQRHSEAQDTPIPSSISSSSLFSSEEKRIRYTNLFSSRSIIDPKFIDMDFFSDESFKCIQAFQNSNLIPFMSLKLLVYSEL

SEQ ID NO: 225482 - protein, 293 aa, Glycine max
  Coding DNA Sequence Number=SeqID_108704
  Gene Ontology: Mol. function=RNA-directed DNA polymerase activity; Biological process=RNA-dependent DNA replication
  Homolog annotation: Hit_ID=Q1SL01; Match level="QueryCoverage=99%, HitCoverage=32%, E-value=2e-50, Identity=32%"; Hit description =Ribonuclease H
MSTEVRGGKFITARMDLMIAMIDACSLIDMEATGLKYSWYKKQVGEVIMKRLDRALVDQPYRLAFPEAFVENLCRVYSDHCLMLIKCKGMQKPHGKRPFRFQAAWVTYNQYDGVVCIAWAKGSPIVLRGLTKVHGLPKLPDEAREAISTPVLKEKVQRAMNMKSFKALSLDGFQPFFLSIIGLWLGRISRIWPINLCNVVYKVITKVLVSCLQPFLNDLIGSFQGNFIHGCGTTDNAILAQEAIHSITKSKAKKGFVAIKVDLGKAYDKVNWSFLKSTLLDSGIPPDTVNLII

SEQ ID NO: 225483 - protein, 569 aa, Glycine max
  Coding DNA Sequence Number=SeqID_108705
  Gene Ontology: Mol. function=hydrolase activity; Cellular component =chloroplast; Biological process=RNA processing
  Homolog annotation: Hit_ID=Q8VX11; Match level="QueryCoverage=99%, HitCoverage=99%, E-value=0.0, Identity=79%"; Hit description =Diphosphonucleotide phosphatase 1 precursor
  Pfam annotation: Domain name=Metallophos; Domain location=244-460; Score=55.9; E_value=1.3e-13; Accession=PF00149.18; Description =Calcineurin-like phosphoesterase
MTNGMGKSRVLFFSMLVLATFQKAVSEEHQPLSKVAIHKTTLALDERAFIKATPNVLGLKGQNTEWVTLQYSNPKPTVDDWIGVFSPANFNASTCPAENIWVNPPFLCSAPIKYQYANFSSHGYKNTGKGSLKLQLINQRSDFSFALFTGGLTNPKLVAVSNKVSFINPNAPVYPRLAQGKTWDEMTVTWTSGYEISDAEPFVEWGPKGGNLVKSPAGTLTFDRNTIQEYQFKASPYPGQNSLQRVVIFGDMGKAEADGSNEYNNFQPGSLNTTKQIIQDLKDIDIVFNIGDLSYANGYLSQWDQFTAQIEPIASTVPYMTASGNHERDWPDTGSFYGNLDSGGECGVLAQTMFYVPAENREKFWYSVDYGMFRFCIANTELDWRKGSEQYKFIENCLASVDRQKQPWLIFLAHRVLGYSSAGFYVAEGSFEEPMGREDLQYLWQKYKVDIAMYGHVHNYERTCPVYQNICTNKEEHNYKGSLDGTIHVVVGGGGASLAEFAPINTTWSIFKDHDFGFVKLTAFDHSNLLFEYKKSSDGQVYDSFKISRQYRDILACTVDSCPPTTLAS

SEQ ID NO: 225484 - protein, 100 aa, Glycine max
  Coding DNA Sequence Number=SeqID_108706
MNIESYKVKKESKDLQVVVKAPGTSKMMTFLQLVVFYPHDPNVNQKRREENRRRKEGRGSQNCVGLAGADENPKWGKKETVSKCTENMEPCKVVVSSEPL

SEQ ID NO: 225485 - protein, 50 aa, Glycine max
  Coding DNA Sequence Number=SeqID_108707
MQIGLQGQAQPKSEEGPLLLKGVTFVKMGIVDKFLKYAQKHVKKKVRKEP

SEQ ID NO: 225486 - protein, 109 aa, Glycine max
  Coding DNA Sequence Number=SeqID_108708
MSLRVLLCDDDDNDDNGDVRSNDDDKDINDCHSGSGDSDGGSGDGGDIGGGGNADDSGSDNVVVVAMLVVVPCLEEKIMMVDNNNNSQFIVEEASLTRPPSFAGKGYPY

SEQ ID NO: 225487 - protein, 91 aa, Glycine max
  Coding DNA Sequence Number=SeqID_108709
  Gene Ontology: Mol. function=protein binding; Cellular component =spliceosome; Biological process=mRNA processing
  Homolog annotation: Hit_ID=Q1SAU1; Match level="QueryCoverage=78%, HitCoverage=82%, E-value=4e-33, Identity=90%"; Hit description =Splicing factor 3B subunit 10
  Pfam annotation: Domain name=SF3b10; Domain location=5-87; Score =155.5; E_value=1.4e-43; Accession=PF07189.2; Description=Splicing factor 3B subunit 10 (SF3b10)
MQASDRFNINSQLEHLQAKYVGTGHADLNRFEWAVNIQRDSYASYIGHYPLLGFFAIAENESIGRERYSFMQCSTVLGEFMREVEWELPVV

SEQ ID NO: 225488 - protein, 100 aa, Glycine max
  Coding DNA Sequence Number=SeqID_108710
MYIKSNHYRLRLIITNGDIPIPQLEAELIDVNLAIMELNTKARYTLTCALSKNEYNEVVTLMRHYENFSMKEGESMDDMFRRLQVLLSGLEPLGHTFTKA

SEQ ID NO: 225489 - protein, 85 aa, Glycine max
  Coding DNA Sequence Number=SeqID_108711
MILIFNQHPHDKFGLRLEKGASSSKSQFVLDKCDFYGESFMFLDLKSIEGVIVAFGGMGKGNITSIGKIGIPSLASINNILYVEV

SEQ ID NO: 225490 - protein, 357 aa, Glycine max
  Coding DNA Sequence Number=SeqID_108712
  Homolog annotation: Hit_ID=UPI000065F757; Match level="QueryCoverage =43%, HitCoverage=46%, E-value=1e-15, Identity=33%"; Hit description =Homolog of Homo sapiens "growth inhibition and differentiation related protein 86
MEKGIQNWSESVEDLVDAGDVESAISLLESVAETLNPSDSASALSDLANLYSSRGFSLKADHLLSRASLLKQLHHSNTPAERVPKESKEDGVVKSTTVASRRAAEGSVEKRGEFPAQTSAAGGSSDEDWEAIADLEPDELLPTVSWDCSSGISNLKLENAKSGTPKRRGRGTFSYEKKELYSDQLLDRSVVDVEREETPRSSEDNTDVQISKYGTGHVLVLADFSPSTRTTELEKLFENFQDRGFVIRWVNDTVALAVFRTPAVALEALNSVRCSFTTRILDEDDTLLSSIKARDLEPPRLRPKTSAQAAQRLIAHGMGLKLSSTGVGSREYRKQEDARRERIVTRQKLRDEAWGDH

SEQ ID NO: 225491 - protein, 38 aa, Glycine max
  Coding DNA Sequence Number=SeqID_108713
MTTKDSDKNRDLLGAYWDKLSVEEAKEVVSFKNVILEI

SEQ ID NO: 225492 - protein, 398 aa, Glycine max
  Coding DNA Sequence Number=SeqID_108714
  Gene Ontology: Mol. function=binding
  Homolog annotation: Hit_ID=Q2IVD8; Match level="QueryCoverage=95%, HitCoverage=8%, E-value=4e-58, Identity=38%"; Hit description =Filamentous haemagglutinin-like protein
APIGVDIVANAFNGAAGSIVDVSGGGELTGAAFVAGRGGSVDVLRHSLADANPRYGFSRAGNAVYAIVPGRADVQAPLATGDGSVDPRVGQEIVIPDGVPGLPAGTYTLLPANYALQKGAFRVEIGAESAMGNVSPVATGTGSWRISGHRAQGLGGAVSPLLTDLVLTPAEAVRRHAGYNETSYNAFVHGVAERRGEALRWRTVDAGSLNLVFGEGAGRSGTPAATFLGLSRFGAGSSDGLGGTLSVNLRVSNGATLEIASEGADAASGRGATVSDTTLNAFRPVTMLIGGTLRRDATTYALEGGAQHIVVRNGVNLTAQEVLLSAAFGGRGILVEQGVSIDTLSQSGPSSVAQPTAPYLVAGGLLAVSNQRLTALSAQGGSAGGPVAIDIGGCEADC

SEQ ID NO: 225493 - protein, 396 aa, Glycine max
  Coding DNA Sequence Number=SeqID_108715
  Gene Ontology: Mol. function=galactosyltransferase activity; Cellular component=membrane; Biological process=protein amino acid glycosylation
  Homolog annotation: Hit_ID=Q6F2F5; Match level="QueryCoverage=96%, HitCoverage=95%, E-value=1e-139, Identity=63%"; Hit description =Putative glycosyltransferase
  Pfam annotation: Domain name=Galactosyl_T; Domain location=152-326; Score=165.6; E_value=1.3e-46; Accession=PF01762.12; Description =Galactosyltransferase
MTWKSRGDLLPKSVMSQKWMIFLCIGCFCAGMFFTNRMWTIPEPKGLARTTAMEAEKLNVVSEGCNSRILLEKEVKGEAKGIYSEVFKTQNAIQTLDKTISNLEMELAAAKAAQESIRGGAPVPEDIKMSESSGRRRYLMVVGINTAFSSRKRRDSVRETWMPQGEKRKKLEEEKGIIIRFVIGHSATSGGILDRAIEAEDRKHGDFLRLDHVEGYLELSAKTKTYFATAVNLWDADFYIKVDDDVHLLTWPLSCRGVRYHEPEYWKFGEAGNKYFRHATGQLYAISKDLATYISNNKHVLHKYANEDVSLGSWFIGLDVNHIDDRRLCCGTPPGVYYTVRKIVNGKHKQATFVLLHLIGRAVEFAGLLKGSKRFTRDVGKVRKPCGMPLSKWHGS

SEQ ID NO: 225494 - protein, 193 aa, Glycine max
  Coding DNA Sequence Number=SeqID_108716
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=79%, HitCoverage=48%, E-value=5e-37, Identity=50%"; Hit description =Similarity to MADS-box DNA-binding protein
  Pfam annotation: Domain name=SRF-TF; Domain location=9-60; Score =51.0; E_value=3.9e-12; Accession=PF00319.9; Description=SRF-type transcription factor (DNA-binding and dimerisation domain)
MARKKVDLSYITNARKRKATLSKRKNGLIKKMDEISTLCGIEACAIFYTPNNPQPEVWPSDSGAQSVLSRFRKVSELEQSKKKLSQESFLRQRINKAQVQLGKLRNENRKKEVTLLMFQNLNAKNNFENSNMIDLNDVSNLINHNLEEVKRKINMSQAQEVKPIVDNEGETMSQGGKSLVNHVQGTETNVDAM

SEQ ID NO: 225495 - protein, 257 aa, Glycine max
  Coding DNA Sequence Number=SeqID_108717
  Gene Ontology: Mol. function=ribonuclease H activity
  Homolog annotation: Hit_ID=Q1SCU9; Match level="QueryCoverage=79%, HitCoverage=88%, E-value=1e-73, Identity=67%"; Hit description =Ribonuclease H; Ribosomal protein L9 N-terminal-like
MKQEKDAFYVVRKGDVVGIYNSLADSQAQVGSSVCNPPVSVFKGYSLSKDTEEYLVSHGLKNALYTIRATDLKEDLFGMLVPCPLQEPSTKESTSNKDVSKKRSLGVLGQDEKVISEDPLRKQVKLDHAAVAEAPLHATVSGNDTDAGNPGKAGAGAILRANDGSVGIATNNAAEYRAMILGMKYALKKGFTGIRIQGDSKLVCMQCGVSTPHSTLQPPTIPNYVGGSTSNALLTASYSSEPILETLQNNLGKLNSQ

SEQ ID NO: 225496 - protein, 201 aa, Glycine max
  Coding DNA Sequence Number=SeqID_108718
  Subcellular localization annotation: CTP_CleavageSite=21; ConfidenceScore=5.08e-01
MTKSCFVFSSATLWSPYATVVAFVHPPTNNLATFYDEPNSWVLSGTFVYLSLGIEVEGTSEEIKKTEAGRRKFSTLPFSSTKRLVTRAAEYKFPDPIPEFADAETQKFKSHLLKKLSKKDMYGESIEEVVGICTEIFSTFLHSEYGGPGTLLVLPFVDMADALNEQGLPGGPQAARAAIKWAQDHVDKDWKEWTNGDNNKK

SEQ ID NO: 225497 - protein, 153 aa, Glycine max
  Coding DNA Sequence Number=SeqID_108719
  Gene Ontology: Mol. function=nucleic acid binding; Biological process= DNA integration
  Homolog annotation: Hit_ID=Q1SJY4; Match level="QueryCoverage=94%, HitCoverage=42%, E-value=1e-15, Identity=29%"; Hit description=Zinc finger, CCHC-type
MTIMELNTKACCTLTCTLSRNEYNKVCRLKTTKEIWDSLSINYEGIKDVQLRKDVTLSHQSLGHTFTKDHTILKILDSFPKVREPKTTIIQEARNLKTLAWDELLGTLRAHKMAESDSLDNNSEGSTDDEVALMSKNFKQMIKKKGKFQRSSR

SEQ ID NO: 225498 - protein, 256 aa, Glycine max
  Coding DNA Sequence Number=SeqID_108720
  Gene Ontology: Mol. function=nucleic acid binding; Biological process= DNA integration
  Homolog annotation: Hit_ID=Q1SKG1; Match level="QueryCoverage=73%, HitCoverage=22%, E-value=9e-27, Identity=33%"; Hit description =Integrase, catalytic region; Zinc finger, CCHC-type
MDKGIFIGYFDTSKAYIVFNTRTLVVEESIHVKFNDGLTSDRELSDLKNDFANMQISPSIAPKENEVKKSDEILPQIEGSSDQQPQMKNLKLEAIRIMLVFAAHINIKHYQMDVISIFLNNFIEEEVYVKQPPSFEDHTVSDHAPRAWYDKLSFFLFENGFMRSKDFSDMMKSEFEISMIGEFKFFLGLQIKHDIKAEWRRKRERRRHFKEKMSLEEAYHHRRPWIRAWRKKQMNEGRGKEEHEILCSKRALKSGV

SEQ ID NO: 225499 - protein, 113 aa, Glycine max
  Coding DNA Sequence Number=SeqID_108721
MEALSMEENKKKLDGDARLGALERKRKATKEATMVDDEPVYEEHGVELISANVAARQAEVEVAIIPEDLDLKEKEYLEESMVKSLPPPSPLRVVPIKPDVHVRYYPGFRGLEC

SEQ ID NO: 225500 - protein, 210 aa, Glycine max
  Coding DNA Sequence Number=SeqID_108722
MLRKRRRPFHKIGSSLGSGTTRHDRVNIRGTINGKECCPEEGLVFDKDWEEDITQETLDIMLYGKPYLETTSEEALVNFLRIWNLTYMCRLIHNFLLNTVMPILGAKDYVMVGEKVNLPEVIFFNWLQAFKDIFHTKDKKNRIPYEMFFTQIIRNGGMDVSVLELSIGATQIKCDLFKMGVAANFLEYAQKHIKRKVKNKPKKESQYVAG

SEQ ID NO: 225501 - protein, 107 aa, Glycine max
  Coding DNA Sequence Number=SeqID_108723
NEDKGYVGVRELSEGGQLRMVGLCVICGCGELTCTIARPPPSTTCDGVVPGDMSRGLGDLGDVRRTPGSQPIKEQRPQSKEACVVAGQLLKNEIRKLRGLLVIDYKG

SEQ ID NO: 225502 - protein, 209 aa, Glycine max
  Coding DNA Sequence Number=SeqID_108724
MRNFIKNKERSAFRQLHNNPRLGGLATYDQSKTSNLIKNSLEEIKKIQDSREVDFKIQEKTSRRIRIQEKMNSRFKRRNQEATSQDFTREIQRTNRLRILCLNTLEGTSFVVQVEGTSTWVVVTKNKRGYISCGSVQVEDTSTWLFKESKGGYIPCRSLLVKDFTRLKEISRTDGCLGTGCRHGLLSNQYKILVFVFFFPTLFNFHCAL

SEQ ID NO: 225503 - protein, 379 aa, Glycine max
  Coding DNA Sequence Number=SeqID_108725
  Gene Ontology: Mol. function=chitin binding; Cellular component =extracellular region; Biological process=chitin metabolic process
  Homolog annotation: Hit_ID=UPI00006A17C9; Match level="QueryCoverage =91%, HitCoverage=100%, E-value=5e-41, Identity=33%"; Hit description= UPI00006A17C9 related cluster
MTDPLDESISCFLMRVNPWVLVPITFRGLHAFTFRGIHVLTIRGLHALAFVGLHALAFVGLHVLTFKGLHALAFIGLHALTIQGLHVLTFRGLHILTIRGLHALTFRGLHALAFVGLHALTFRGLHVLTFRGLHALAFVGLHALTFRGLHVLTFRGLHSLPSEDNTSSPSPSEDYMSSPSENYTSSPSKGCTPSPSEGYTPSPLATRPRLRRATCPHLPRTTCPHLQRTTRPRLQRTTRPRLHLPRTSCPHLHRTTRTRLQRTTHPCRRLHRATRPHLLRTTCPYHLTIRGLHVLAFRGQHVLAFTFVGLHALTFRGLHVLAFRGLHVLTFNGLHAQAFKGRHVLNFRGLHALAFRGLHVLTFSGLHIHTLREFKVLCP

SEQ ID NO: 225504 - protein, 133 aa, Glycine max
  Coding DNA Sequence Number=SeqID_108726
MGLKVKEVMEDIIADLERVVVVVVGMVVMKNMMELTNQERGMEEWMECLLVVEVGRVEEVFSQEFVMLNSWTKHASTAKRSFSVLSAKENLAGHQHQARALSTKGTELHRHHSAYFGKRALEAVRGAAFVEIP

SEQ ID NO: 225505 - protein, 58 aa, Glycine max
  Coding DNA Sequence Number=SeqID_108727
MSFSRDFLSGNRLPKYVIDYQCPKTNYTAFAHWKLKITLCNRLPVAGARLLRYVTGSH

SEQ ID NO: 225506 - protein, 136 aa, Glycine max
  Coding DNA Sequence Number=SeqID_108728
MKQAKYSLKAQVEKDEGPSGEGQSPRVEKDEGPNLSSFTGSGVYPDLSSFIGSGVYPDLSSFTGSGVYPDLSSFTGSGVYPDLSSFTGSGVIQTFVACIKRSVPTQVHINVDCQFFQSISEKNIFLPRWANVFVAE

SEQ ID NO: 225507 - protein, 65 aa, Glycine max
  Coding DNA Sequence Number=SeqID_108729
MEDQCTLPPTNIHNIQRMNVAQSKCQRPWKADILIARFPNPNYGVKMGSNDKQQRLTEDTSGLGW

SEQ ID NO: 225508 - protein, 144 aa, Glycine max
  Coding DNA Sequence Number=SeqID_108730
  Homolog annotation: Hit_ID=Q2QNL3; Match level="QueryCoverage=86%, HitCoverage=16%, E-value=8e-08, Identity=29%"; Hit description=Zinc knuckle family protein
  Pfam annotation: Domain name=zf-CCHC; Domain location=75-92; Score =12.9; E_value=0.0073; Accession=PF00098.13; Description=Zinc knuckle
MADSEICKQIYTPQQYHKEIRRKRPQYKPPSKQPSRKKNPTRRYSIRASNSRKPTLNKERHVRKLRDNKRYTKQLECYARHQPRHYSRDCPNKTNLFTREVELIKSCRMNLIPIDETVSTDSEIYSIDQIIRNVISVKDIPIKH

SEQ ID NO: 225509 - protein, 45 aa, Glycine max
  Coding DNA Sequence Number=SeqID_108731
MALYGSAFAYSNPLKVALPACPEMGKGRQSIGRDPSLYLRPSLST

SEQ ID NO: 225510 - protein, 180 aa, Glycine max
  Coding DNA Sequence Number=SeqID_108732
  Gene Ontology: Mol. function=transferase activity, transferring glycosyl groups; Cellular component=membrane fraction; Biological process=nucleotide catabolic process
  Homolog annotation: Hit_ID=P12758; Match level="QueryCoverage=71%, HitCoverage=51%, E-value=5e-60, Identity=86%"; Hit description =Uridine phosphorylase
  Pfam annotation: Domain name=PNP_UDP_1; Domain location=70-180; Score= 9.3; E_value=9.2e-10; Accession=PF01048.10; Description=Phosphorylase family
MVLSVLASAQSRNYSLALRQGWRRGRGMVNLVCFSINTAFYGYTAPLESDMAQSDVFHLGITKADLKGATLAIVPGDPERVKKIAALMENPQHLASHREFTTWLAEIDGKPVVVCSTGIGGPSTSIAVEELAQLGVRTFLRVGTTGAIQPHINVGDVLVTTASVRLDGASLHFAPMEFPA

SEQ ID NO: 225511 - protein, 78 aa, Glycine max
  Coding DNA Sequence Number=SeqID_108733
MGFRIRFDGGGCTNSARQSIRGAPDSMAINSWGSGLDGGGCMNDNQFMGLRIRFDGGGCTNSARQSIRGAPDSMVEDA

SEQ ID NO: 225512 - protein, 504 aa, Glycine max
  Coding DNA Sequence Number=SeqID_108734
  Gene Ontology: Mol. function=transcription regulator activity; Cellular component=nucleus; Biological process=regulation of transcription
  Homolog annotation: Hit_ID=Q5ZAK6; Match level="QueryCoverage=31%, HitCoverage=41%, E-value=1e-24, Identity=46%"; Hit description=BHLH transcription factor-like protein
  Subcellular localization annotation: CTP_CleavageSite=88; ConfidenceScore=5.32e-01
MTEESAGNTVATSITPFNWWYLQANSLSSWNDTNSTWSNQPNPNSSSSCEEDISVSTSFTNASNHSSLTVESSRRLIEPPAPSSTELMGEHASDNQLWSHVLSGVGSDGELHNSQEIGENFLDALSSKSMTSTMFQPVCDYLKKLDHTSWEYNGSTSLNSFEKHLNGFSEAMLENNERLTKLSNLVSTWSIAPPDPEVSSHFDPQKTNNMSLSSNSMDHHFPQFEHFKQPFEEASRNSGVFPNCYDHDMKVKQEYHASEVSPGSVFGKPLNANGYRNGFNSLSVVDSCKLYHDMPNISSCTRNFSDVISFNSRLGWPVIGVHGQKPSMKYLNVSEPKKQGLQTPSPPIRTNVNGKGEGTTREVKKKRSEESSDAMLKKPKQDTSTASSSKVQAPKVKLGDKITALQQIVSPFGKTDTASVLFEAIGYIKFLQEQVQLLSNPFLKANSHKDPWGSLDRKDHKEDTKLDLRSRGLCLVPTSCTPLVYRESSGPDYWTPAYRGCLYR

SEQ ID NO: 225513 - protein, 967 aa, Glycine max
  Coding DNA Sequence Number=SeqID_108735
  Gene Ontology: Mol. function=RNA-directed DNA polymerase activity; Cellular component=chromatin; Biological process=chromatin assembly or disassembly
  Pfam annotation: Domain name=Chromo; Domain location=856-907; Score =27.4; E_value=5e-05; Accession=PF00385.14; Description='chromo' (CHRromatin Organisation MOdifier
  Pfam annotation: Domain name=RVP_2; Domain location=136-254; Score= -47.0; E_value=0.0046; Accession=PF08284.2; Description=Retroviral aspartyl protease
  Pfam annotation: Domain name=rve; Domain location=576-707; Score =30.5; E_value=5.7e-06; Accession=PF00665.16; Description=Integrase core domain
  Pfam module annotation: Pfam domain module=Chromo::RVP_2::rve; Domain location=856-907::136-254::576-707
  Subcellular localization annotation: CTP_CleavageSite=76; ConfidenceScore=5.24e-01
AVGLACLQEKLHDPRLPPRFRPAPPSTPTPLTLPPAHIPLSPALLPSPSRPPTSLTVHRLTPEELASRHEKGLCFSCDEKFHRRHKCAPKVHLLIAEDDDPNDPSLIESGDPTSYPIDGPDPLAAHISLHSLTGLVAPETLRLIATVVGHTILVLIDDGSTHNFIQQALADQLGLPRQTTSALRVMVGNGQHLDCTSFCKAVTIDMQITSFMVDLYILPIAGANIVLGVQWFQSLGTILTYYNTLHMQFFYKGQLIELRGPHPAQHEPFSSPVLLVKKHDARCFSKLGLLQGYHQIRMHPDDVPKTAFKTHHGHYEFKVMPFGLCNAPSSFQALSSAPMLALPNFELPFTVEIDASGVGMGAALSQQGYPIAFFSKAFTPKLLRSSTSVRELFAITSVVKKWRQYLLGHHFTIIIDHRSLKELVNQVIQTPEQHMYLASLMGFDYTIPYRSGNCNQAANALSRLPKQDHVAFMVLSVPCLTFIEELRAQIVENTEYQLLLQKIQSHLEDHQDYSIAHNLILFKGRLWFPRGLPLTTTLLTKFYATPTGGHVGIAKTIALTKYEAKRLAGLLCPLPVPFRPWEDLSLDFITGLPNYRGNSAILVVVDRFSKGIHLGMLPTSHTVFSVASLFVDIVMKIHEFPRSLISDRDPLFSDGQMEVLNRVVEQYLRAFVHQRPGQWGKFLSWVEWSHNSSWNAGTGSTPFEITFGRKSFTFPEYIVGSSKLDVVDSSLVERDVVIQAIRKKLLKAQERMKRYADKKRKEVTFNCGEWVLVKLRPHRQTSAKGAQHTSDKLSKHFYGPFQILERISPVAYRLQLPEGIRIHPVFHVSSLKLFKGPPDMEAIELPDNFEGDQPLIFPIAILNSCRKDSTPNAPWEVLVQWRGLSPDETSWEDWSQLCQDFHLEDKVTLQGPRDDTEARVEKGEETTIENQEAKMKAGVSIAGTIADQPKRTKRKITKPNYLGDYVQ

SEQ ID NO: 225514 - protein, 193 aa, Glycine max
  Coding DNA Sequence Number=SeqID_108736
  Gene Ontology: Mol. function=chitin binding; Cellular component =extracellular region; Biological process=chitin metabolic process
  Homolog annotation: Hit_ID=UPI000044A8F0; Match level="QueryCoverage =81%, HitCoverage=99%, E-value=2e-17, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MIGPLDESISCFRIRVDPWVHALTFRGLHAFAFVGLDILKFRGLHVLAIRGLHILAFKGLYPLAFRGLHALALRGMHDLAFRGLHVLAVRGLYVLTFRGLHVLTFRGLHALAFRELHVLSVRGLYVLTFKGLHVLTFRGLHALTFRGLHVLHFRGLHVLHFRGLHVLHIRGLHTLAFSGLHIHTLREFKVLCP

SEQ ID NO: 225515 - protein, 85 aa, Glycine max
  Coding DNA Sequence Number=SeqID_108737
ACQTLTKGGLAFHCHERLLHFRGLMWIEEDGWIEEEKRIMDIERGFPKLEILRLTMYSLENSKSSGVVLSRCMGYGLPFYFLIFS

SEQ ID NO: 225516 - protein, 72 aa, Glycine max
  Coding DNA Sequence Number=SeqID_108738
GLVGACTLSATLDRLARISEFQLSTRLLAQQMDSSGALSGMVPHSTNMHNSSFFQILPRAQPKGWCAQGMAS

SEQ ID NO: 225517 - protein, 148 aa, Glycine max
  Coding DNA Sequence Number=SeqID_108739
MGEVEEVQEKMKADMEAMKEQMAAMMKAMMSMKKIMEANAVAVAATSIVAKVNPKSPSGLNQMNHPTSAMVGKDLGSTGGPHYAQSQNKHAFPPYGLPPNYTPPNVAYTPNKNVNNSTPIPIESQQPRMIMHMSLKPWGRHMKFPITI

SEQ ID NO: 225518 - protein, 47 aa, Glycine max
  Coding DNA Sequence Number=SeqID_108740
MTISDSYPVGSSLNLKQSKEKLEESQGTARDAAIDVRRHVSPLRGKG

SEQ ID NO: 225519 - protein, 72 aa, Glycine max
  Coding DNA Sequence Number=SeqID_108741
MKFGAFINRFFFLFSFEVFRYCRRAKAVFKELNQVPHVVELDERGFISSFAIAEIERLLSRRGWFKDSGYHD

SEQ ID NO: 225520 - protein, 283 aa, Glycine max
  Coding DNA Sequence Number=SeqID_108742
  Gene Ontology: Mol. function=nucleoside-triphosphatase activity; Cellular component=chloroplast
  Homolog annotation: Hit_ID=Q2PMM5; Match level="QueryCoverage=99%, HitCoverage=12%, E-value=1e-163, Identity=97%"; Hit description =Protein ycf2
MPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTRDRIRAIP

SEQ ID NO: 225521 - protein, 176 aa, Glycine max
  Coding DNA Sequence Number=SeqID_108743
MIMRGQDIYSSQDKATTSPSSSESEEAKGEESSKEIYPQKEGQPLMVKEECKVTLVSIVTPLRLEFIPQVKELLDESLVRKSLNPCALLVPKIGVPMNPKRIKVIQERPTPPSVEEKSLEFQEPWDLRSNPFQGEGMMQSYPARALDRRLQEDWAKDAREGPRVLMSLRVDFRPMG

SEQ ID NO: 225522 - protein, 149 aa, Glycine max
  Coding DNA Sequence Number=SeqID_108744
  Homolog annotation: Hit_ID=Q5WMZ9; Match level="QueryCoverage=46%, HitCoverage=5%, E-value=8e-18, Identity=72%"; Hit description =Putative RNA polymerase II
  Pfam annotation: Domain name=G-patch; Domain location=113-149; Score =17.1; E_value=0.0016; Accession=PF01585.13; Description=G-patch domain
MEIEKDWTHGRQQETIVGAQKATFKMEHVISGSWLKRVMVAAVLSSRRLLLRDENKCKDDITHQLAMIIRHNENLKRQEKNGSPAHIISEFVQLLLFQVAKYFDNEFKCNANSSNIGFQLLKKHGWKEGTGLGVSEQVFFLTPSFFSIE

SEQ ID NO: 225523 - protein, 174 aa, Glycine max
  Coding DNA Sequence Number=SeqID_108745
MNMPRRASSFTLKSFGGLGKPEASLGELRSIRRNTGSNKIEENHTKVYKSPHRQVFHLNSKSQICHKLILQVISHLIKDNVHNHHGSIGLFKVELVGNFGFSCSGLSFLGVSGRAGIKIWVGLETFILGQDSGKNQMSGLKGLQMEENNVYWDNYLANGLERMNAQITSMNHML

SEQ ID NO: 225524 - protein, 262 aa, Glycine max
  Coding DNA Sequence Number=SeqID_108746
  Homolog annotation: Hit_ID=Q8H6Q8; Match level="QueryCoverage=56%, HitCoverage=4%, E-value=8e-29, Identity=41%"; Hit description=CTV.20
MEPEYWDKNPFKATAKAFPPGFHYRPTTLNKTRKFYEFILVDTNSVSIKHFKDPKDPNLNTHSTIQILKVMQPRHYGSNLNQPKKFSAPFDPTRYTYWDYIDAWTNVFWHQNNKYKHSWLIYFKNNTTYNFPNWFLQWWNYFGPIPQIYPEEVQQEFDNSKAALDQVKNWFQVHPEFLKPADPETSLFLNKKSQLAIFLAGSKSKEILAKNLKEVLHLLQQQEEEEKPSKKKVESSDENDDQDDDPFYQNEDDCFGISLEED

SEQ ID NO: 225525 - protein, 140 aa, Glycine max
  Coding DNA Sequence Number=SeqID_108747
MPPTVPGNQYSDPEGQHNRIRILWCYPMLMYTERTGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 225526 - protein, 79 aa, Glycine max
  Coding DNA Sequence Number=SeqID_108748
EHFGANREVMVKLFLSPFVKLMFFDEMSGQMNDDSMSRTRIVPPMLESLMAEMVKMRRQAKESMRIANKALRGQDDLHL

SEQ ID NO: 225527 - protein, 78 aa, Glycine max
  Coding DNA Sequence Number=SeqID_108749
  Homolog annotation: Hit_ID=Q1S1N3; Match level="QueryCoverage=79%, HitCoverage=19%, E-value=2e-13, Identity=57%"; Hit description =Calcineurin-like phosphoesterase family protein, related
  Pfam annotation: Domain name=DUF1723; Domain location=39-76; Score =41.3; E_value=3.2e-09; Accession=PF08330.1; Description=Protein of unknown function (DUF1723)
VTNDVIQLYDKTMLSPYPRIEPLLVQVRFSDVAKLGQVKIDNTLVTVLVERWRPESHTFHLPVGECTITLEDVVLQLG

SEQ ID NO: 225528 - protein, 236 aa, Glycine max
  Coding DNA Sequence Number=SeqID_108750
MDCNLEGRRKYVLIGQPILGKIEHESPLELVPNKFKNFPKTFFSATGEDHISNLMGIDLRTLESAYAYMQSMLIPSFASFHQSIVGSSSTNDFFHKEQPIVLDEQLEPQEHGRVRQQPSLYESYENSKSLNIYSNRVVRCKSAPLFDIHPISSSSNHLFFSHKVSFIMDNNPWEFFVIDDSDLSSFVCPSNPNLSSSNSTILIPSPRGVVQAVRINQQYRETLPTQEFIMRVHQVT

SEQ ID NO: 225529 - protein, 508 aa, Glycine max
  Coding DNA Sequence Number=SeqID_108751
  Gene Ontology: Mol. function=sugar porter activity; Cellular component=integral to membrane; Biological process=carbohydrate transport
  Homolog annotation: Hit_ID=Q1T6J4; Match level="QueryCoverage=96%, HitCoverage=95%, E-value=0.0, Identity=61%"; Hit description=Sugar transporter superfamily; Major facilitator superfamily MFS_1
  Pfam annotation: Domain name=MFS_1; Domain location=22-444; Score =35.0; E_value=2.5e-07; Accession=PF07690.6; Description=Major Facilitator Superfamily
  Pfam annotation: Domain name=Sugar_tr; Domain location=18-483; Score =476.3; E_value=3.7e-140; Accession=PF00083.14; Description=Sugar (and other) transporter
  Pfam module annotation: Pfam domain module=MFS_1::Sugar_tr; Domain location=22-444::18-483
MEVPIKYPAKLTLRVVLTCIMAATGGLIFGYDHGVSGGVTSMDSFLKKFFPSVYEKESNVKPSSNQYCKFNSQILTLFTSSLYLSALAAGLGASSITRMLGRRATMIMGGIFFVAGALLNGLAVSIWMLIVGRLLLGFGIGCANQVSIESCFDYSPLLTNNHLYFQSVPIYVSEMAPYKYRGALNMCFQLSITIGIFVANLFNYYFSKILNGQGWRLSLGLGAVPAFIFVIGSFCLPDSPSSLVERGLHEDAKRELVKIRGTTEVDAEFRDILAASEASQNVKHPWRTLMDRKYRPQLVFAICIPFFQQFTGLNVITFYAPILFRTIGFGSGASLMSAVIIGSFKPVSTLVSILLVDKFGRRTLFLEGGAQMLICQIIMTIAIAVTFGTNGNPGFAWSWGPLGWLIPSEIFPLEIRPAAQSITVGVNMISTFFIAQFFTSMLCHMKFGLFIFFGCFVVIMTLFIYKLLPETKGIPLEEMSMVWQKHPIWGKFLESDNPIQNDKMNSKC

SEQ ID NO: 225530 - protein, 55 aa, Glycine max
  Coding DNA Sequence Number=SeqID_108752
MDIKQVVLMDNRGYEYFRYLRVNKYFSKWSEVAVRHYVCHPVFVVIPTSVMGVLH

SEQ ID NO: 225531 - protein, 130 aa, Glycine max
  Coding DNA Sequence Number=SeqID_108753
  Gene Ontology: Mol. function=RNA-directed DNA polymerase activity; Cellular component=intracellular; Biological process=RNA-dependent DNA replication
MSFRGPMQVVLKKDGMTVIKNDKNELIPTRIVTGWRMCVDYRILNKATRKNHFPLPFMDQMLERIKRRQPSLAYLESLPIGECPWTLQCTIHIPKNLALNWKKSHFLVTEGIMLGHKISARGIEVDQAKI

SEQ ID NO: 225532 - protein, 67 aa, Glycine max
  Coding DNA Sequence Number=SeqID_108754
MACGGHQWPWVVEKKVLGFGWAFGEKKSEKSCDPTVNESEIGILPEQVWVKLEISQFQHRSIKLQIT

SEQ ID NO: 225533 - protein, 88 aa, Glycine max
  Coding DNA Sequence Number=SeqID_108755
MQVQGDAHQAADAPPPPRQADPAGSLGMERYLQHLVRQQAANHRGQLGDWPEAQAGEKPAGSPGEAEEAYMDEDMTDLLGFLGSSGAT

SEQ ID NO: 225534 - protein, 317 aa, Glycine max
  Coding DNA Sequence Number=SeqID_108756
  Gene Ontology: Mol. function=oxidoreductase activity, acting on NADH or NADPH, quinone or similar compound as acceptor; Cellular component=integral to membrane; Biological process=electron transport
  Homolog annotation: Hit_ID=Q2PMN7; Match level="QueryCoverage=55%, HitCoverage=49%, E-value=8e-82, Identity=89%"; Hit description =NAD(P)H-quinone oxidoreductase subunit 1, chloroplast (EC 1.6.5.-) (NAD(P)H dehydrogenase subunit 1)
  Pfam annotation: Domain name=Complex1_49kDa; Domain location=1-160; Score=78.1; E_value=2.8e-20; Accession=PF00346.9; Description =Respiratory-chain NADH dehydrogenase,
  Pfam annotation: Domain name=NADHdh; Domain location=157-316; Score =86.6; E_value=7.5e-23; Accession=PF00146.11; Description=NADH dehydrogenase
  Pfam module annotation: Pfam domain module=Complex1_49kDa::NADHdh; Domain location=1-160::157-316
MLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPKGELGIFLIGDQNGFPWRWKIRPPEIQDIHFFFRLESFKEIYGIIWVFAPILILILGITISVLAIVWLEREISAGIQQRIGPEYTGPFGVLQALADGTKLLFKENLIPSRGDIRLFSIGPSISVISIIISYSVIPFGYNFVLSDLNIGVFLWIAISSIAPIGLLMSGYGSNNKYSFLGGLRAAAQSISYEIPLTLCVLSISLRAIR

SEQ ID NO: 225535 - protein, 83 aa, Glycine max
  Coding DNA Sequence Number=SeqID_108757
MATTTDIQNQSQSHKQLEAEGRLKSKIVCNNQLLEEAQQLWDLGTSIGLEADTCHSDFIQSFADMEARDRNEAMDLGERKTHR

SEQ ID NO: 225536 - protein, 82 aa, Glycine max
  Coding DNA Sequence Number=SeqID_108758
MWVSRKRFPADFRREEKDKSDFRQKDDKEKREDKVFERARLVKSQFLLTYKHNNIGFLWKTDVNYIGFVKTDVNIKYITSVF

SEQ ID NO: 225537 - protein, 149 aa, Glycine max
  Coding DNA Sequence Number=SeqID_108759
  Gene Ontology: Mol. function=catalytic activity; Biological process =metabolic process
  Homolog annotation: Hit_ID=Q01CB8; Match level="QueryCoverage=70%, HitCoverage=33%, E-value=4e-16, Identity=42%"; Hit description =Homology to unknown gene
MNVKRREDMVGVLPKRRILMRHGKSQGNQDTVAYTTIPDHNIQSMAQGMAQALRTSKHLRRMMGSDGCSPDWRVQFNVSPYTHTQSMFHKLKRCFLKKRIIGVRKESRVREQDFGNFLVKEKMKVLNVNVLEDSSIKKRISISHLLEGN

SEQ ID NO: 225538 - protein, 172 aa, Glycine max
  Coding DNA Sequence Number=SeqID_108760
MRFGECSSGKENGEKAVGNYLGNRSRKCILHGGKKNWIENESLEVQKEGEREPRGDFFSFPSLFVAEECHKGVDGAREGSDGGLVNMEDDEASEEGGGEGATVRGAAEERRPSTTRSTLASSSRERWRRRERGGHEGANVDATNEYTRQGKEAVVEDGIELIVEAGDALVWA

SEQ ID NO: 225539 - protein, 70 aa, Glycine max
  Coding DNA Sequence Number=SeqID_108761
  Homolog annotation: Hit_ID=Q2R7H6; Match level="QueryCoverage=90%, HitCoverage=25%, E-value=2e-15, Identity=53%"; Hit description =Expressed protein
MSVNSCSRCCPQRGEKFSCHGCNLLSQCCNSYEYCVSCYFNPALISKEQVVKMKVAKPSTAKLYLEPWTD

SEQ ID NO: 225540 - protein, 72 aa, Glycine max
  Coding DNA Sequence Number=SeqID_108762
  Homolog annotation: Hit_ID=Q9M112; Match level="QueryCoverage=47%, HitCoverage=4%, E-value=1e-10, Identity=88%"; Hit description =Putative GTP pyrophosphokinase
MLLNNTEEMQTLSSSSNLKVKDYIATPKPNGYQSLQTTMIPFLYERMFRLEVQCIKEGVATKEKIGVKRKMR

SEQ ID NO: 225541 - protein, 94 aa, Glycine max
  Coding DNA Sequence Number=SeqID_108763
LGGVDGDPVLRGTRIRAIVVPGDMSRGSRDLGDVRRAPSSQPIKEQSPRSKEACVAAGQLCILGGLKNGDRMLKWPLGDRALVIDYQLGVIDYT

SEQ ID NO: 225542 - protein, 55 aa, Glycine max
  Coding DNA Sequence Number=SeqID_108764
MVRGKRAMKERIREAQKVFKGYIEKQICFGSAGVAKDKLVFRMLKHGHVSFQILT

SEQ ID NO: 225543 - protein, 221 aa, Glycine max
  Coding DNA Sequence Number=SeqID_108765
  Gene Ontology: Mol. function=pyrroline-5-carboxylate reductase activity; Cellular component=cytoplasm; Biological process=amino acid biosynthetic process
  Homolog annotation: Hit_ID=Q5H301; Match level="QueryCoverage=97%, HitCoverage=71%, E-value=2e-78, Identity=72%"; Hit description =Pyrroline-5-carboxylate reductase
  Pfam annotation: Domain name=F420_oxidored; Domain location=1-201; Score=114.4; E_value=3.2e-31; Accession=PF03807.7; Description=NADP oxidoreductase coenzyme F420-dependent
VHDNAADAAAQGGTWLLAVKPQVLREVCQSLRALAQANQPLVVSIAAGITSAQLERWLGGNLPVVRAMPNTPALLGAGVTGLFATPSVDTQQHAQAEKVLASAGRTVWIDSEALMDSVTAVSGSGPAYVFLLAEAMEAAGIAQGLPADAARTLVVQTLLGASRMLDEAGESPAELRRRVTSPNGTTQAAIESFQAGGFEALVDTALRAAQVRGQELSAAND

SEQ ID NO: 225544 - protein, 161 aa, Glycine max
  Coding DNA Sequence Number=SeqID_108766
MASRICKSIGSRPTTEYDTRRFHSLDAWNQYTDNVLGRNILPERKVELYHTEFDDFKTELERRNLHKCLTNLVDGSIDVALVKEFYANLYNSKGHSPKQARVRGHLVKIDADSLNTFLETLWLPSDPREIEAALCIPGQGFILNAEGHPRRIMRKDLTNLA

SEQ ID NO: 225545 - protein, 153 aa, Glycine max
  Coding DNA Sequence Number=SeqID_108767
SSLPCSVLLGCDSLCCLYVVLLGCCGSLGGLMGARGWWVYARIVDVENLLCTIARPPPSTTCDGVKLPAFIVDHRVVPGDMLRGSGDLGDVRRAPGSQQIKGTKTTKQGGLWWLASCEFCVICGLWPLVIDYQGLENEVRKLREPLVIDYQPV

SEQ ID NO: 225546 - protein, 80 aa, Glycine max
  Coding DNA Sequence Number=SeqID_108768
  Subcellular localization annotation: CTP_CleavageSite=49; ConfidenceScore=5.36e-01
MRGIVHEPQVNLGANQKFSPNRFPATRFPTSNVQSFEFGMTGPLDESISCFLIRVDPWVLVPSPLEGCTPSPSEDYMSSP

SEQ ID NO: 225547 - protein, 120 aa, Glycine max
  Coding DNA Sequence Number=SeqID_108769
  Subcellular localization annotation: CTP_CleavageSite=68; ConfidenceScore=5.10e-01
MPQYVPPPIQQQQQQQPQKQQTVEAPPQPSLEELVRQMTMQNMQFQQETRASIQSLTNQMGQLATYLPSQSVQNPINVTAISLRSGKQCQGPQIVAASSFANEPAQPYSTPEKDDDKNLK

SEQ ID NO: 225548 - protein, 168 aa, Glycine max
  Coding DNA Sequence Number=SeqID_108770
  Homolog annotation: Hit_ID=Q8PDP9; Match level="QueryCoverage=21%, HitCoverage=44%, E-value=7e-12, Identity=89%"; Hit description =Oxidoreductase
  Pfam annotation: Domain name=Tautomerase; Domain location=93-152; Score=25.2; E_value=0.00023; Accession=PF01361.11; Description =Tautomerase enzyme
MTALGRVGLPDDIGPMIASLLGPDNRWVTGQRIEVSGTFDAAERQQIARDLTQLGLDCEALPDSPLVRSTVWTYFAEYSSDAVFMGDKPAWLPVVSLQIYVIKGGLDEEAKKKLIEGATAILDRRPSGTSVAPVYVVIQEIEEANWGIFGQQADLAALRASDDNAPAI

SEQ ID NO: 225549 - protein, 190 aa, Glycine max
  Coding DNA Sequence Number=SeqID_108771
  Gene Ontology: Mol. function=DNA binding; Cellular component=nucleus; Biological process=regulation of transcription, DNA-dependent
  Homolog annotation: Hit_ID=Q6H975; Match level="QueryCoverage=99%, HitCoverage=24%, E-value=5e-69, Identity=67%"; Hit description=STY-L protein
  Pfam annotation: Domain name=WD40; Domain location=111-149; Score =10.5; E_value=2.1; Accession=PF00400.22; Description=WD domain, G -beta repeat
  Pfam annotation: Domain name=WD40; Domain location=152-190; Score =24.0; E_value=0.00052; Accession=PF00400.22; Description=WD domain, G-beta repeat
  Pfam annotation: Domain name=WD40; Domain location=69-106; Score =26.7; E_value=8e-05; Accession=PF00400.22; Description=WD domain, G -beta repeat
  Pfam module annotation: Pfam domain module=WD40::WD40::WD40; Domain location=111-149::152-190::69-106
MSLDFHPKKTEVFCFCDGENEIWYWNINSATCTRVTKGASAQVRFQPRLGRFLAAASDKGVSIFYVESDTQIYTLQGHPEPVSYICWDGNGDALASVSPNLVKVWSLTSGGEWIHEFSSTGSQLHSCVFHPSYSTLLVIGGSSSLELWKMTDNKSLAVSAHENVISALAQSTVTGMVASASYDNYVKLWK

SEQ ID NO: 225550 - protein, 185 aa, Glycine max
  Coding DNA Sequence Number=SeqID_108772
MSASDHAILRDRVHQPTKKSLLELSSQDVVLAQNKFLSKQLEILTETIEQMQEASYMGNQQKQGYNQGGFSGFQQGQWRSHPGNQFNKDQGGPSNRPPQQGPNIFQRTTKLEETLAQFMQVGQLAKQLAGKSSQSFGKNTKKNPKEECKVVVTRSRKLVAAEDEDVVALKEQAALKDTTIKKKNE

SEQ ID NO: 225551 - protein, 73 aa, Glycine max
  Coding DNA Sequence Number=SeqID_108773
MGSKIYPKVHENPMAFFSSSSPSLLESSIQYPWGVGLHHKSLCFVGAQNRYCEAPNPYDRCYDECVEWCNLFL

SEQ ID NO: 225552 - protein, 402 aa, Glycine max
  Coding DNA Sequence Number=SeqID_108774
  Gene Ontology: Mol. function=inorganic phosphate transporter activity; Cellular component=1-2nm peptidoglycan-based cell wall; Biological process=phosphate transport
  Homolog annotation: Hit_ID=Q8YE91; Match level="QueryCoverage=70%, HitCoverage=65%, E-value=1e-125, Identity=82%"; Hit description =PHOSPHATE TRANSPORT SYSTEM PERMEASE PROTEIN PSTA
  Pfam annotation: Domain name=BPD_transp_1; Domain location=103-303; Score=66.6; E_value=7.8e-17; Accession=PF00528.12; Description =Binding-protein-dependent transport s
MRDLGRFYSDGVRIQLREIVMNNPSLIGTTQVVPVLAGADIDSAFKGQIDLSVPEANRKVSDRQVGWMRTLSEEGVMKESFNTGLFTFGASSRPETSGLGVALVGSLYMMLIVLGLSLPIGVAASIYLEEFAKKNRFTDMIEVNINNLAAVPSIVFGLLGLAVFINFFGLPRSASLVGGLVLTLMTLPTIIIATRAALRAVPPSIRSAALGLGASKTQMVFHHVLPLAAPGILTGTIIGLAHALGETAPLLLIGMVAFVADVPSTPMDPATALPQSFCAAASSAAGKRESKAMNLMTERSLEKAVGEKMNANANSIKMRGDKVCVFYGEKQALFDVDLEIQEKMVTALIGPSGCGKSTFLRSLNRMNDTIEGCKVGGKITLDNEDIYDPKIDVVELRARVGM

SEQ ID NO: 225553 - protein, 117 aa, Glycine max
  Coding DNA Sequence Number=SeqID_108775
ISPISLGRPFRKTARTKIDVYAGTLSMEAIAKVNPMPPSDINQMNHPTSNMDVNNCAPILIESQQPQANHAHVSQPTGETHGMPHHNLADFEPCLGYATEGKGSGPLKEVKIMPLLT

SEQ ID NO: 225554 - protein, 160 aa, Glycine max
  Coding DNA Sequence Number=SeqID_108776
MEGKGNLKQARDSFLCEAWMTLWSSQVALHLVYMIYTKLLHTNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 225555 - protein, 114 aa, Glycine max
  Coding DNA Sequence Number=SeqID_108777
  Homolog annotation: Hit_ID=Q5W7C9; Match level="QueryCoverage=50%, HitCoverage=21%, E-value=2e-20, Identity=79%"; Hit description =Unknow protein
MDKRLVGLHEGWWGLYFWERTPVEYEAPGYKLCLGMEENSESALSTNKEAISNATRNLMESSILAQDERWRHALHMQVGREVVFPVADGWKRLLIPRRLRSKRRNPPEEGLASD

SEQ ID NO: 225556 - protein, 71 aa, Glycine max
  Coding DNA Sequence Number=SeqID_108778
MEQPKSQLECLFDYLDQYHHVAKRHIGFSSCTQHLHTPDSERKNKKYTSINLHFHLYELTIRVSYTDWQSA

SEQ ID NO: 225557 - protein, 36 aa, Glycine max
  Coding DNA Sequence Number=SeqID_108779
MSISHTWNPKTTRSSSPEYATIPTVPRGQSSTVTSW

SEQ ID NO: 225558 - protein, 365 aa, Glycine max
  Coding DNA Sequence Number=SeqID_108780
  Gene Ontology: Mol. function=DNA binding; Cellular component=beta -galactosidase complex; Biological process=DNA integration
  Homolog annotation: Hit_ID=Q1SDN3; Match level="QueryCoverage=98%, HitCoverage=29%, E-value=1e-112, Identity=54%"; Hit description =Polynucleotidyl transferase, Ribonuclease H fold
  Subcellular localization annotation: CTP_CleavageSite=56; ConfidenceScore=5.20e-01
MKLPPGLNVDNPNLVCRLQRSLYGLKQASRQWFTRLSSFLLSQGFSQSSADHSLFLCTNNSSDITVILVYVDDIILTGNNLDTIIHITKLLDQTFSIKDLGILKYFLGLEVARSTHGIHLCQHKYALDILSDSGMLGSRPGSTPMEYSTRLNATMGTPLSESCASSYRRLVGRLIYLTNTRPDIAYALSGSGLFFAAKGSFTLKAFSDSDWAGCRDTRRSVTGFSIYLGDSLISWRSKKQTTVSRSSSEAEYRALASTTCELQWLSFLLRDFRVQLSQPAALYCDNQSAIQIASNPVFHERTKHIEIDCHIVRDKVNQGLLKLLPISSSMQLADIFTKPLPPASFQSLYTKLGMMNIHSQLAGGS

SEQ ID NO: 225559 - protein, 180 aa, Glycine max
  Coding DNA Sequence Number=SeqID_108781
  Gene Ontology: Mol. function=transferase activity, transferring glycosyl groups; Cellular component=cytoplasm; Biological process =purine ribonucleoside salvage
  Homolog annotation: Hit_ID=Q9LFP0; Match level="QueryCoverage=94%, HitCoverage=87%, E-value=5e-67, Identity=77%"; Hit description =Adenine phosphoribosyltransferase-like protein
  Pfam annotation: Domain name=Pribosyltran; Domain location=39-175; Score=151.7; E_value=2e-42; Accession=PF00156.17; Description =Phosphoribosyl transferase domain
MFVLENGVKNKGEDPRLQAISQAIRVVPHFPKQGIMFQDITTLLLDHNAFKDAVDIFVDRYRDMDISVVAGVEARGFIFGSSIALGIGAKFAPLCKPGKLPGEVISEKYVLEYGTDCLEMHVGAVQQNERVIIIDDLVATGGTMSAAIRLLERADAEVVECACVIGLSDLKTGSPSSLPK

SEQ ID NO: 225560 - protein, 194 aa, Glycine max
  Coding DNA Sequence Number=SeqID_108782
  Homolog annotation: Hit_ID=Q1S1N3; Match level="QueryCoverage=49%, HitCoverage=33%, E-value=1e-14, Identity=40%"; Hit description =Calcineurin-like phosphoesterase family protein, related
  Pfam annotation: Domain name=DUF1723; Domain location=57-106; Score =66.5; E_value=8.4e-17; Accession=PF08330.1; Description=Protein of unknown function (DUF1723)
MKSTTTLLWKQHPNRFGEVTNDVIQLYAQVMPCSDPIIKSLMVQAEFSDVVKLGQIKTDDALVTTLVERWRPESHAFHLLVGECTITLKDVSLQLGLRIDGKLVIGSTGVVHLKNALVGSTPKLKWLKENMLTLLNSLSHIPNNGRMYNVVIVVGMISHVIHSTKDRVSAVISTCNKMEGQGATIFLESHAVML

SEQ ID NO: 225561 - protein, 1335 aa, Glycine max
  Coding DNA Sequence Number=SeqID_108783
  Gene Ontology: Mol. function=RNA-directed DNA polymerase activity; Cellular component=chromatin; Biological process=chromatin assembly or disassembly
  Pfam annotation: Domain name=Chromo; Domain location=1262-1318; Score= 11.8; E_value=0.04; Accession=PF00385.14; Description='chromo' (CHRromatin Organisation MOdifier
  Pfam annotation: Domain name=RVP_2; Domain location=318-447; Score= -45.0; E_value=0.0032; Accession=PF08284.2; Description=Retroviral aspartyl protease
  Pfam annotation: Domain name=rve; Domain location=1006-1162; Score =115.5; E_value=1.5e-31; Accession=PF00665.16; Description=Integrase core domain
  Pfam module annotation: Pfam domain module=Chromo::RVP_2::RVT _1::Retrotrans_gag::rve; Domain location=1262-1318::318-447::509 -664::102-192::1006-1162
MADATRSKTSMERWEDAFAKLSASMTSKFDELLSRMNQLETSHANNQAPLAFVNSAAMATANTTYRLKLEVPRFNGTDPEGWIFKVTQFFEYHATPEHDRLTIASFYMEGPALAWFQWMYRSGQLSSWSAFLHAIHARFSSSAYEDPTGVLCKLTQQTTVSPFLSEFETLANRVIGLPTPFILSCFISGLNPAIRRDIQVMQLHSLAQAISFARLHEEKLLDSRRHTSKPPSSSTPGTSVTRTSSSLTLSPTGSSLLPSPSKPRASSIPFKRLTPSELALRREQGLCFNCDEKYSRGHKCASSLFLFVTEDDDDNLPVQISLHALSGHGAPETLRLTGFICEHRVQILIDGGSTHNFLQQELVALLQLQPQETSTLRVTVGNGEELRCTQVCPNLAMKIQKHEFPVDLHVLPIRGANVVLGVQWIKALGPVLIDYTTLTMKFIYDGQLIELVGDRDSSFQMISPSQLRRLVDTAPVNVKPYRYPHFQKQEIETQVAAMLRQGHIQHNSSPFSSPVLLVKKRDGSWRFCVDYRALNAITVRDRFPIPTVDELLDELGGVILMRESDISKTAFRTHHGHYEFRVMPFGLCNAPSTFQAMMNRLFQPHLRRYIIVFFDDILIYSRSLEEHINHLEIAFQVLHYGQFTLKLTKCSFAQKKIEYLGHIVTGNGVQPVPEKVQAIQDWPQPRSTRALRGFLGLVGFYCRFIKGYSMITHPLSQLLTKAELVWSSEADSAFQRLKQVVTTAPVLALPDFSKPFTIETDASGLGMGAVLSQEGHPISFFSKQFCPRLLQASTYVRELATITAAVKKWWQYLLGHSFIILTDHKSLKELMNQAVQTPEQHKYLARLLGFDYVIQYRAGKSNIVADTLSRSTPASLFIITVPHFVFLDELRRELQANPAFIELRRKVTAEPHAYPDHSLAQDLILYRGRIWLPQDCSFIEVLLSEFHQSPLGGHMGFRKTLNRISENFTWSTSTRDTRDFVSNCLDCQLVKYETAKPRGLLCPLSVPSQPWEDLSMDFIVGLPAYRGHTCILVIVDRFSKGVHLGMLPSHHTSQMVAQSFMEMVGKLHGMPCSITFDRDPLFLSKFWQSLFSLSGTKLRMSSAYHPQMDGQTEVANRVVEQYLRAFVHRKPSSWGRFLLWAEWSYNTSIHSSTGMTPFEVTFGRKPLSFPQYLAGTSTVAAVDDLLSQRDDTFNLLRRKLQKAQTRTKDIADGHRRNHAFQVNEWILVKLRPYRQTTVAGTGQSKLSRRFYGPFKIVERLGPVAYKLELPEHSRIHPGLTRMVLVQWQGLHPDEMSWEEWEGLKERHHLEDKVLFEDHGNTLVEVQQQEERGKSF

SEQ ID NO: 225562 - protein, 165 aa, Glycine max
  Coding DNA Sequence Number=SeqID_108784
MKLAKYRLKAQVEKDKGLSGEGQSPRVEKDEGSKFLSGFLVEPIIRLIKVILVASTLTYLPSPEVASTQTYLPSLGVYPDLSSFTGSGVIQTIVACIKRSAPTQFLSYPSFIGSGVYPDLSSFTGSGVIQISVTCIKRSAPTQQLRISGYEAQKKEQHSWALEGL

SEQ ID NO: 225563 - protein, 84 aa, Glycine max
  Coding DNA Sequence Number=SeqID_108785
GQPPGQVQIHECLYQFSLSQQGQGFAPFACPTLELFGVEVAWPGDWLEAQAGEEPAGSPGAAEEARMDEEMTNLLGFLGGSRAT

SEQ ID NO: 225564 - protein, 105 aa, Glycine max
  Coding DNA Sequence Number=SeqID_108786
MFSNPRLFPHVDDPLLREASSKLAELHLSTKGVVVAHHMTKVLVGADGLGHTLRRSLNVVIGCGGSLAQVYMEDDYVRKMSDEVDMEVDMDNEVRIDEDIHKDYG

SEQ ID NO: 225565 - protein, 86 aa, Glycine max
  Coding DNA Sequence Number=SeqID_108787
  Gene Ontology: Mol. function=nucleoside-triphosphatase activity; Cellular component=membrane
  Homolog annotation: Hit_ID=Q7PC87; Match level="QueryCoverage=97%, HitCoverage=5%, E-value=5e-32, Identity=80%"; Hit description =Pleiotropic drug resistance protein 6
MVRETLDFSGYCLGVDIRYEALVELSRREREAGIKPDPEIDAFMKVIALLGQKTNLVTDYVLKILGLDICVDIVVGDEMRRGISGG

SEQ ID NO: 225566 - protein, 160 aa, Glycine max
  Coding DNA Sequence Number=SeqID_108788
  Gene Ontology: Biological process=response to biotic stimulus
  Homolog annotation: Hit_ID=Q53HY7; Match level="QueryCoverage=86%, HitCoverage=70%, E-value=2e-28, Identity=55%"; Hit description =Hypothetical protein c17
  Subcellular localization annotation: CTP_CleavageSite=22; ConfidenceScore=5.00e-01
MRWLTTTPTSCPRTSGTPPWCRRSTPRSTLYIVRRFDNPRYYKYFVIKSCHVILGNSDVRPFHEIHVFSGLLAAISTECLDDECHIIGLSMIGGDHPSPTTASSPPSTPAPPLAPSSSTSPPATPPRTCTSSSTPSSAATSGLSFSNALLNFKLINESLN

SEQ ID NO: 225567 - protein, 501 aa, Glycine max
  Coding DNA Sequence Number=SeqID_108789
  Gene Ontology: Mol. function=oxidoreductase activity; Cellular component=endoplasmic reticulum; Biological process=electron transport
  Homolog annotation: Hit_ID=Q8W2N3; Match level="QueryCoverage=91%, HitCoverage=90%, E-value=0.0, Identity=71%"; Hit description =Cytochrome P450-dependent fatty acid hydroxylase
  Pfam annotation: Domain name=p450; Domain location=31-501; Score =125.6; E_value=1.3e-34; Accession=PF00067.12; Description=Cytochrome P450
  Subcellular localization annotation: CTP_CleavageSite=51; ConfidenceScore=5.19e-01
MEPESPALLLILFATLLWFLATTLSRGKSPPPSPTTIPKAYPVIGSVFSIAANNRRRIHWISDILHASPSSTFVLHRAFGSRQVFTANPTVVQHILKTNFPVYPKGLTLNRALGDFLGQGIFNSDGAGWKVQRQISSHEFNTRALRKFVETVVDAELSGRLLPLLAAAAKNKTVIPDLQDILQRFTFDNICKIAFGFDPEYLLPSLPLTPFATAFDDATRISSERFNAAFPLFWKIKSLLNLGSEKRLKEAISEVRGLARRIIVEKKKEFQEKETLDTLDLLSRFLCSGHSDEEFVMDIIISFILAGRDTTSAALTWFFWLISKHPKVEEEVVKEVMEKDAAYTHVYDEVKDMVYTHAALCESMRLYPPVPVDTKEAGEDDVLPDGTEVKRGWRVAYHIYAMGRSEKIWGADWGEFRPERWLSRDEVEGRWKFEGVDAFTYPVFQAGPRVCLGREMAFLQMKRLVAGIIKSFKVLSEVAEPEFAAYLTSFMVGGFPVRIQN

SEQ ID NO: 225568 - protein, 857 aa, Glycine max
  Coding DNA Sequence Number=SeqID_108790
  Gene Ontology: Mol. function=protein transporter activity; Cellular component=soluble fraction; Biological process=conjugation with cellular fusion
  Homolog annotation: Hit_ID=Q5ZC01; Match level="QueryCoverage=61%, HitCoverage=53%, E-value=3e-52, Identity=31%"; Hit description=IFA -binding protein-like
  Pfam annotation: Domain name=DUF593; Domain location=529-622; Score =167.9; E_value=2.5e-47; Accession=PF04576.6; Description=Protein of unknown function, DUF593
TVVEMASGGKETSFVKARRMKGFISLLTSAACEWLLIFLLLLNALLSYMLTKFASYCQLQMPCLLCSRLDQILCRERPEFYVNLFCSSHKSEISSLILCHIHGKLADGHRMCDDCLLSVTAKTKCNAKTHKLLVGKFGLVLGGSGFKSPSLSRDLFAGSKGARLCTRQCTCCGKLWKSDQNSPRSIQLKSPGRAFLKPNIPFPCAPRQSRLNHRDNLKKMRDKFPGSEGKSSFQPLSHIGYTELRLNSDSESEFLFSDDDDVSSVFHENIEASNDPKAQVTSAPSSNCIPSALNPENLNDSSAKSMPLPSDQCVEPNVSEHQDVNANSAEEINLQQEKQETFSSDLAELISINEVSPSPIVMNVPDRESEDSKITSPSQDSRPTPLSELMTLNDTHAHAEASSEKYVAQASDTGMVSEKKGEVLEKIGTEEKASTETHLEVCNSAPINPKEVDNVKEELEQSPSDKSSPNGSNISSYVPINHIHSPPGTDAEASSSNGVQVLQKSSSVESGIDSLDESNIDEIEGDSNDDRLRRQIEYYKKCMDSLQKELEAERNASAVATNEAMSMITRLQEEKAALQMEALQYLRMMEEQAEYDNDELEKVNDLLTEKEKEIQDLEAELEYYRSNLGDDEPMVHNMHKESRDLKGEDVTVQNTGVHNITNTASSSKNAEVSKVGEEDVTSGTTFLEFEEEKEYISQCLKNLEEKVHQISLHAPNDRSEKLEVSELNQQGASNGEGHQLDGHEDTGLSTEKSINTLNGNHIDKDGSAAEDVDACSLSAENNHSKSPELQICTPRREVELVALENEISDLNERLEALEFDHDLLEHLTNSLQNGNDGKQFIQDIAHRLHELRKIAIR

SEQ ID NO: 225569 - protein, 506 aa, Glycine max
  Coding DNA Sequence Number=SeqID_108791
  Gene Ontology: Mol. function=kinase activity; Cellular component =cytoplasm; Biological process=D-ribose metabolic process
  Homolog annotation: Hit_ID=Q8S5U3; Match level="QueryCoverage=84%, HitCoverage=83%, E-value=1e-124, Identity=54%"; Hit description =Putative sugar kinase
  Pfam annotation: Domain name=PfkB; Domain location=98-433; Score =53.9; E_value=5.4e-13; Accession=PF00294.14; Description=pfkB family carbohydrate kinase
  Subcellular localization annotation: CTP_CleavageSite=71; ConfidenceScore=5.18e-01
MPLSVPARARIHHLHGPSFFPSISKPKQKPIWPTLLPLNRAFGCRSLEIAVPSPSSSLPSNVGPNSWKHVDVATLSNLCVDIVLNVPQLPPPSPLQRKAFMDRLAQSPPDKVELAEALTKVGSLSHGVKNWEAGGNCNMAIAAARLGLNCISIGHVGNEIYGKFLSDVLRDEGIGLVGMITNDDIVNSSSGSASCETLLCWVLVDPLQRHGPNYVFSISRADFCEEPILHWMSKLSSEVKMAIKNSKVLFCNGYGFDELSPGALLSAMEYAVEVGTSIFFDPGPRGKSLSTGTPDEQRALNQLLRMSDVLLLTSEEAEELTGINDPILAGQEFLKRGIRTKWVIVKMGSKGSILITASSVACAPAFKALSSHSNFFIAFVNVIDTVGCGDSFVAAIVYGFIHNMPLVNTLAIANAVGAATAMGCGAGRNVATLENVVHILRSSNLSEDDEFWIEILEKNVVAQEITYLSNVMNGNKNRLNLVSFDKVASELLPKLELPQTVGNAPT

SEQ ID NO: 225570 - protein, 207 aa, Glycine max
  Coding DNA Sequence Number=SeqID_108792
  Gene Ontology: Mol. function=ATP binding; Cellular component =extracellular space; Biological process=cobalamin biosynthetic process
  Homolog annotation: Hit_ID=Q8LEZ2; Match level="QueryCoverage=85%, HitCoverage=56%, E-value=3e-67, Identity=67%"; Hit description=ATP binding protein-like
MVVIMSKQYDLYIKLSFAANASSFHYRLLVEKDAPIVWRGPMVSNALEKMTRGVDWGNLDILVMDMPPGTGDVQIAMSQNLQLSGALIVSTPQDVALMDARRGVKMFNKVDVPILGIVENMSCFKCPHCGEPSYIFGKGGTQRTASEMGLELLGKIPLEVEIREACDQGHPIVLAAPDSVVSRAYGEVAEKLAQKLKEQQFQPEIIL

SEQ ID NO: 225571 - protein, 119 aa, Glycine max
  Coding DNA Sequence Number=SeqID_108793
  Homolog annotation: Hit_ID=Q10KZ6; Match level="QueryCoverage=87%, HitCoverage=20%, E-value=1e-35, Identity=67%"; Hit description =Proline-rich family protein, putative, expressed
MVILAKKPSAEVVVTQTVSDHPNESIHVLHVGKMRMKLCKGNTTIAKEYYSSSMQLCGVRGGGNAAAQAVFWQPKQGLSFVLAFESERERNAAIMLARRFAFDCNIILAGPDHKAPLET

SEQ ID NO: 225572 - protein, 103 aa, Glycine max
  Coding DNA Sequence Number=SeqID_108794
MDELIHRAMKVEQQLKRKQTYKKTSYTYSSWKDKDTSKKEGSSSQHLEWKSSRERFLQRQKLFVLIEYIVVVIDYKKLSEACRVKSHIGLIDCGNTLIDYTVV

SEQ ID NO: 225573 - protein, 325 aa, Glycine max
  Coding DNA Sequence Number=SeqID_108795
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-25, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPLEYYTSSRSEGCTPSPLEDFKSSPSEEYTSPPSEGYTYSPSEGCTPSLVLTFRGPHVLTFRGLRYLTFRGLQASAFRGLHVLTVRGLDTPGFRGVHPRAFRGLRVLAIRGLHTLARPHLQRTTCPHHGLHTLAFRGLDFLSFRRQHVLAFRGLHALAFRGLYILAIRGLHVLTFRGLHVLDFRGLHVLTFRGLHVLPFRGQHILQFRGLDLHSFRGLHVLAFRGLHAIAFRELHILTFRGLDAPAFSGLHPRARPHLQRTTCHHIQMTTHPHLQRTTRPRLQRTTHPPLQGSKPPPLKRTTHPRLQRTTRPRLQRTTRPTL

SEQ ID NO: 225574 - protein, 89 aa, Glycine max
  Coding DNA Sequence Number=SeqID_108796
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=62%, E-value=1e-07, Identity=33%"; Hit description =UPI00006A17C9 related cluster
  Subcellular localization annotation: CTP_CleavageSite=61; ConfidenceScore=5.24e-01
MKRTCIPLKLRVCSPLKERARSSLKVRTCSPLKARACSPLKEKTCSPLKVRTCSPLKARVCSRLKVRTYSPLKVRTCSPLMARTCSPLK

SEQ ID NO: 225575 - protein, 68 aa, Glycine max
  Coding DNA Sequence Number=SeqID_108797
MDNNFLKNISSAEKVPRWRRNHGRRHRHQMHDYQYRCYDRDTVMAEGVGVKRKWEGTVQQWLQWQGAA

SEQ ID NO: 225576 - protein, 166 aa, Glycine max
  Coding DNA Sequence Number=SeqID_108798
  Homolog annotation: Hit_ID=O80959; Match level="QueryCoverage=41%, HitCoverage=13%, E-value=1e-07, Identity=47%"; Hit description =Similar to latex allergen from Hevea brasiliensis
MGIGKCEQSENRNGMGMGKEEMEKNGQDTWRMGKGAWKSEFQILKSKFLKRHLHGDALLHQRPPPPDFLRRRHVAVSGRERKQILSCERCKQPRVLEEGSWNSKQGDSRLSMEITDLRDFCEIDDPGGKINCSLLKRREEEDWAKKNSGRIGEAVVVVGGAGKEET

SEQ ID NO: 225577 - protein, 174 aa, Glycine max
  Coding DNA Sequence Number=SeqID_108799
MGYVRVRELSWRWATGDGGFMRALWMWKTCCAPSPDRHLVPHVMEWYLEICRGGQETLGTSGGVLLPKTKLDQSRPNPGIVGQLENEVRKLREPLRDGSLVIDYQIVMAAQLIHDRVEMECLEGAWETLEGNTRCRFRGTIRFAATSLVHPDEPARTLQRTVEWTAFWISFVYF

SEQ ID NO: 225578 - protein, 218 aa, Glycine max
  Coding DNA Sequence Number=SeqID_108800
MEALESGAVMIVMMSAVAVSIKILMVVAILVVATNGGDVGGGGGDNDEGDINGGGDGNSDSGGVVAVVATMLVVVTVTVREVVLLVVVVVTITTMIVAMTLMVMVVVAIPIMIAMMVLGTVVLLVAPSGCGGCDHIGGGDNDGDGGGDTNGGGVMTISYSNNNDGDGNGGGSGNNESGIGGGDGNGNDNGDGSGGGGGSSSGDGCCDDDGKKKYHYQM

SEQ ID NO: 225579 - protein, 91 aa, Glycine max
  Coding DNA Sequence Number=SeqID_108801
MDSTDMIIMELNAKARYTLAYALSKNNFEGFINDKVALMSKKFKQIMNKNEKFHNSSKRKDTRFKKYYKEGGNEITCFECKNPRHMKAEYP

SEQ ID NO: 225580 - protein, 57 aa, Glycine max
  Coding DNA Sequence Number=SeqID_108802
MGNSSIGNDGGHEFGARDDVGGSLGDVAVEVELSWINEWCWNNMWKLQRDIFNDGRK

SEQ ID NO: 225581 - protein, 142 aa, Glycine max
  Coding DNA Sequence Number=SeqID_108803
  Gene Ontology: Mol. function=RNA-directed DNA polymerase activity; Cellular component=intracellular; Biological process=RNA-dependent DNA replication
  Homolog annotation: Hit_ID=Q0ZCD0; Match level="QueryCoverage=70%, HitCoverage=8%, E-value=2e-23, Identity=52%"; Hit description =Integrase
MKFRTRQFFKQLINKGEGEMVLSGDFIEFLVINTYLSLDGLSLRYEIFPLIFHGNGAPFLRETLYQTYAFTVTDGVDDVYIEQLQYLSLHNVHHVGVESPLSQCSSFPANENGKADNQIYFVTLAGLFTVFMSLTNFFRWTT

SEQ ID NO: 225582 - protein, 201 aa, Glycine max
  Coding DNA Sequence Number=SeqID_108804
MTHHRARDQTVGGSVEEEVSPNGCSAACDSKGLRFEEEEWGLEEWRLAMFFHICIKLMTRLRDSKIHVHLHDNPIYKLGPVHVGVRGVGGESKVEVGEDAACLSHSSHSLHQDLPWGPLGVQNEMASGQAELGLNGLVVRVCVQELGEVSPLELLQELIKIRVGQLQTPLWMNVLEMNVVLIFVQATIDMNLVESQPSSTC

SEQ ID NO: 225583 - protein, 279 aa, Glycine max
  Coding DNA Sequence Number=SeqID_108805
MAEQAKQVFYVQDPCDERWSVVLHGKTIGVNVEDDDSYIDNYVSPLSTQMSPNIIGEEETDDIHSNLTLKWALATAKDDVDDTVCEKHPSWEFLEKKLMDEKKNKQLEEAAQSKSTDTVIDPSFPIRRHVKWKMARTKKTDSLEEQASQGSFVAHGRQDDLPQFFIHGSRKPGEADTKNQGPTGEGLALPPEPEVGPSVAHVSTKESCVDPSGNDPDTDDLEKCRLYVEENTPRLVALGRLYEGLTTIHSILLRHDQVKVGVEEVRDADAPIPIPTKKF

SEQ ID NO: 225584 - protein, 78 aa, Glycine max
  Coding DNA Sequence Number=SeqID_108806
MKLTSTPTTTVATRLAASGSEKEKLRRGEEHLCGGATLGVVMKMITWATPKLRQRRRYAIDMSELGCGANNILKNRIH

SEQ ID NO: 225585 - protein, 575 aa, Glycine max
  Coding DNA Sequence Number=SeqID_108807
  Gene Ontology: Mol. function=nucleotidyltransferase activity; Cellular component=integral to membrane; Biological process=aromatic amino acid family biosynthetic process
  Homolog annotation: Hit_ID=Q6R3L0; Match level="QueryCoverage=94%, HitCoverage=81%, E-value=0.0, Identity=68%"; Hit description=Metal -nicotianamine transporter YSL1
  Pfam annotation: Domain name=OPT; Domain location=43-575; Score =360.8; E_value=2.1e-105; Accession=PF03169.6; Description=OPT oligopeptide transporter protein
MMSSPANLNTGGEEKKLEIEKVVESQVEVADTESKRIQPWKEQITVRGLVVSTVLGIIYSIIAMKLNLSAGIVPNFNVSAALLAFLFVRSWNKVLHKAGFISKPFTRQENTIIQTCVVSCYSIAVHGGFASYLLGLNRKTYELSGVGTEGNNPNTVRDPGFAWMTTFLFVVCFVGLFILIPLRKIMIVDLKLTFPSGLATAVLINGFHTQGDKMAKKQVGGFLKYFSISFMWGFFKWFFSGTQDCGFAQFPTFGLQAWKQTFYFDFNMTYVGAGMICPHLVNLSLLLGAILSFGVIWPLIDRRKGDWFPTNLDESNMKALYGYKVFLTVALILGDGLYNFVKILVSSILSVHEKIKNRKNASSADQQRDNAEELKQKEVFLRDNISMWIGTGGYIVLSVISIIVIPLMFPQLKWFYVVVAYILAPSLAFCNAYGTGLTDMNMAYNYGKVALFVVAAMSGRDNGVVAGLVGCGLVKSVVSVACTLMHDFKTAYYTCTSPKAMFICQLIGTALGCVIAPLSFFLFYKAFDVGNPHGEFKAPYALIYRNMAVLGVEGFSALPQHCLQLCYGFFAFVGW

SEQ ID NO: 225586 - protein, 138 aa, Glycine max
  Coding DNA Sequence Number=SeqID_108808
  Gene Ontology: Mol. function=nucleotidyltransferase activity; Biological process=aromatic amino acid family biosynthetic process
  Homolog annotation: Hit_ID=Q1EGL9; Match level="QueryCoverage=58%, HitCoverage=12%, E-value=5e-33, Identity=75%"; Hit description =Putative YS1-like protein
MVRDLSPNVFGKWMPLPMVMAIPFLVGAYFAIDMCLGSLVVYVWHKLNTKKAEAMIPATASGLICGEGLWALPASILALAKVHFIHNQNAINIPSVWPLGLGTLYYCLLQLCRKSQFLLIDLSEGNFFFTGVIINSSY

SEQ ID NO: 225587 - protein, 166 aa, Glycine max
  Coding DNA Sequence Number=SeqID_108809
  Pfam annotation: Domain name=zf-CCHC; Domain location=94-111; Score =10.5; E_value=0.018; Accession=PF00098.13; Description=Zinc knuckle
MSLATLFGKLQEHEMKWLRLNQHEENDKKKKGIVLKDSSSIQEKSDKEDLIELDEDDDFSLFVKRFNKFLRIRGNQRRQNFKPKRRTEDSSSTPKCYECNQPRHPRVDCLIFKKRMKKSEKKIISEKKAKRTYITWDDNDLESSEDSENEVINLSLMAKSYESDEE

SEQ ID NO: 225588 - protein, 47 aa, Glycine max
  Coding DNA Sequence Number=SeqID_108810
MGDNDLHWWTTSYHIKKLETQVYGSSPHLYGAPHFHFFPMWDFTSHL

SEQ ID NO: 225589 - protein, 122 aa, Glycine max
  Coding DNA Sequence Number=SeqID_108811
MRRHLTVICTSSFGDPKSDDTHRPMWSSTPSPEMSASFDRDYLVSPFAIQRPKSPSHPRHPEMASPMTRKDISWLSAPSSSGDGKSDDTQRPIMVICTPLSKISESFDRDYFSLTFAIRRRL

SEQ ID NO: 225590 - protein, 440 aa, Glycine max
  Coding DNA Sequence Number=SeqID_108812
  Gene Ontology: Mol. function=aminoacyl-tRNA ligase activity; Cellular component=endoplasmic reticulum; Biological process=translation
  Homolog annotation: Hit_ID=Q10HJ4; Match level="QueryCoverage=96%, HitCoverage=66%, E-value=1e-148, Identity=62%"; Hit description =Expressed protein
  Subcellular localization annotation: CTP_CleavageSite=62; ConfidenceScore=5.03e-01
MACEEVAHSRPLFLTIYTIVFVGVVFSSLYVFSAIRYPSTNASTWSLSNEDVRLTEQTLNVSQSGNAHVVPSVPPEARNVKTRPILNIPPRNKKMPSLNTFRLTEELVQQRVKDNIIIVTFGNYAFMDFILTWVEQLNDLGVSNYLVGAMDTKLLEALYWKGIPVFDMGSHMSTDDVGWGSPTFHKMGREKVILINLILPFGYELLMCDTDMVWLKNPLPYLASYPKADVLTSSDQVVPTVVDDSLEIWQEVGAAYNIGIFHWRPTESAKKLAKEWKELLLADDKIWDQNGFNDIVHRQLGPSVDEDSGLVYAYDGNLKLGILPSSIFCSGHTYFVQAMYQQLRLEPYAVHTTFQYAGTEGKRHRLREAMVFRDPPEYYNPPGGFLSFKPSIPKSLLLSGKHTIESHFTLVNYQMKQIRTALAIASLLNRTLVRTIFLGS

SEQ ID NO: 225591 - protein, 70 aa, Glycine max
  Coding DNA Sequence Number=SeqID_108813
MAVVQEWQASMAKLIVSTVVDKVIIILTTMLGVSHKQRNLYRQNMTARKTMFHLAVRAYLLHFVGCTIFA

SEQ ID NO: 225592 - protein, 171 aa, Glycine max
  Coding DNA Sequence Number=SeqID_108814
MSTQSSFFSDAGPSNMMARTRFTAAFRVQKNIIEVPLSYHSQWRPYYPTYVLFDYNGTKHFIRVHKCGTRCFFADGLKEFRRTHDINDSVIIRFFAASKDTSLEVDIMGPILRQTCQRSVVTTRRHIFTADVTQDMIEHTNPLVLPATTLNFLFGSKKIVPVQLPNGTRNQ

SEQ ID NO: 225593 - protein, 333 aa, Glycine max
  Coding DNA Sequence Number=SeqID_108815
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q6PP98; Match level="QueryCoverage=95%, HitCoverage=92%, E-value=1e-141, Identity=75%"; Hit description =Mitochondrial pyruvate dehydrogenase kinase isoform 2
  Pfam annotation: Domain name=HATPase_c; Domain location=207-330; Score=48.8; E_value=1.8e-11; Accession=PF02518.16; Description =Histidine kinase-, DNA gyrase B-, and HSP90-like ATPase
MEVKIQKTLSMCKNLMKEVKTWGCLKQTGLSLRYMMEFGSNPTPKNLLISAQFLHKELPIRIARRAIELHTLPHGLSHRPPVLKNMNDEKEFTELIKSIKVRHNNVVPTMALGVQQLKNVFEDPDEIDEFLDRIYMSRIGIRMLIGQHVELHNPNPPPNCVGYIHTNMSPVNVARNASEDARSMCYGEYGSAADVRIYGDPDFTFPYVPAHLHLMFFELVKNSLRAVQDHFMDSDEVAPPIRIIIADGIEDVTIKVSDEGGGIPRSGLPKIFTYLYSTARNASWDENEPSDLGTTDNISVKMAGNGYGLPICRLYARYFGGDLQVISMEGYGE

SEQ ID NO: 225594 - protein, 608 aa, Glycine max
  Coding DNA Sequence Number=SeqID_108816
  Gene Ontology: Mol. function=binding; Cellular component =intracellular; Biological process=protein kinase C activation
  Homolog annotation: Hit_ID=Q67X36; Match level="QueryCoverage=98%, HitCoverage=98%, E-value=1e-166, Identity=51%"; Hit description =Pentatricopeptide (PPR) repeat-containing protein-like
  Pfam annotation: Domain name=PPR; Domain location=137-171; Score=9.5; E_value=0.55; Accession=PF01535.11; Description=PPR repeat
  Pfam annotation: Domain name=PPR; Domain location=200-233; Score =29.3; E_value=1.3e-05; Accession=PF01535.11; Description=PPR repeat
  Pfam annotation: Domain name=PPR; Domain location=236-270; Score=3.3; E_value=3; Accession=PF01535.11; Description=PPR repeat
  Pfam annotation: Domain name=PPR; Domain location=302-336; Score =38.7; E_value=2e-08; Accession=PF01535.11; Description=PPR repeat
  Pfam annotation: Domain name=PPR; Domain location=338-371; Score=5.5; E_value=1.7; Accession=PF01535.11; Description=PPR repeat
  Pfam annotation: Domain name=PPR; Domain location=374-408; Score =15.6; E_value=0.11; Accession=PF01535.11; Description=PPR repeat
  Pfam module annotation: Pfam domain module=PPR::PPR::PPR::PPR::PPR::PP R; Domain location=137-171::200-233::236-270::302-336::338-371::374 -408
EMSSCWVPPPWACSSMAEVKQQHSLLLRLGLSTNNHAMSRIFTFCSLSKHGDINYALKLFTTLPNPDTFLYNTLFKAFFSLSQTPSLSLLFYSHMLQHCVTPNAFTFPSLIRACKLEEEAKQLHAHVLKFGFGGDTYALNNLIHVYFAFGSLDDARRVFCTMSDPNVVSWTSLVSGYSQWGLVDEAFRVFELMPCKKNSVSWNAMIACFVKGNRFREAFALFRRMRVEKKMELDRFVAATMLSACTGVGALEQGMWIHKYVEKTGIVLDSKLATTIIDMYCKCGCLDKAFHVFCGLKVKRVSSWNCMIGGFAMHGKGEDAIRLFKEMEEEAMVAPDSITFVNVLTACAHSGLVEEGWYYFRYMVDVHGIDPTKEHYGCMVDLLARAGRLEEAKKVIDEMPMSPDAAVLGALLGACRIHGNLELGEEVGNRVIELDPENSGRYVILGNMYASCGKWEQVAGVRKLMDDRGVKKEPGFSMIEMEGVVNEFVAGGRDHPLAEAIYAKIYEMLESIRVVGFVPDTDGVLHDLVEEERENPLFYHSEKLAIAYGLLKTKRGETLRVTKNLRVCKDCHQASKMISKVYDCDIIIRDRSRFHHFSNGECSCKDYW

SEQ ID NO: 225595 - protein, 54 aa, Glycine max
  Coding DNA Sequence Number=SeqID_108817
MDDQEGPWPREVTSIALRRGAFLRAKVLANPPNETNGDMRQSLQTMYQELQNSQ

SEQ ID NO: 225596 - protein, 391 aa, Glycine max
  Coding DNA Sequence Number=SeqID_108818
  Gene Ontology: Mol. function=sugar porter activity; Cellular component=membrane; Biological process=transport
  Homolog annotation: Hit_ID=Q75I89; Match level="QueryCoverage=92%, HitCoverage=92%, E-value=1e-149, Identity=74%"; Hit description =Expressed protein
  Pfam annotation: Domain name=TPT; Domain location=158-298; Score =176.9; E_value=4.9e-50; Accession=PF03151.7; Description=Triose -phosphate Transporter family
MMNKTLLLTYFYLFIYILLSSGVILYNKWVLSPKYFNFPLPISLTMIHMGFSGAVAFFLVRVFKVVTPVKMTFEIYATCVIPISAFFASSLWFGNTAYLHISVAFIQMLKALMPVATFLVAVMCGTDKARCDVFFNMLMVSVGVVISSYGEIHFNVVGTVYQVTGIFAEALRLVLTQVLLQKKGLSLNPITSLYYIAPCSFVFLSVPWYLLEKPVMEVSQIQFNFWIFFSNALCALALNFSIFLVIGRTGAVTIRVAGVLKDWILIALSTVIFPESTITGLNIIGYAIALCGVVMYNYIKVKDVRASQSPNEIIPDGITKFISSSSIDIQDWKFEKRSSDFYVPDNVSNNGGSGGGNGSLSDMNIDEEAPLISSRVSHIGRMQLANHATGK

SEQ ID NO: 225597 - protein, 87 aa, Glycine max
  Coding DNA Sequence Number=SeqID_108819
MGMNVNFITYSTEIEPKCRQTQSDIMNVPRDLGRPMKTNINSCLLQLHQHIDARIQQKYALQPDILEEASILVEKYNVSFKLPKFMY

SEQ ID NO: 225598 - protein, 995 aa, Glycine max
  Coding DNA Sequence Number=SeqID_108820
  Gene Ontology: Mol. function=hydrolase activity; Cellular component =intracellular; Biological process=protein amino acid phosphorylation
  Homolog annotation: Hit_ID=Q8S1U2; Match level="QueryCoverage=83%, HitCoverage=93%, E-value=0.0, Identity=34%"; Hit description=PPR -repeat protein-like
  Pfam annotation: Domain name=PPR; Domain location=211-245; Score =15.3; E_value=0.11; Accession=PF01535.11; Description=PPR repeat
  Pfam annotation: Domain name=PPR; Domain location=312-346; Score =18.6; E_value=0.023; Accession=PF01535.11; Description=PPR repeat
  Pfam annotation: Domain name=PPR; Domain location=413-447; Score =34.1; E_value=4.8e-07; Accession=PF01535.11; Description=PPR repeat
  Pfam annotation: Domain name=PPR; Domain location=516-550; Score =36.5; E_value=9.2e-08; Accession=PF01535.11; Description=PPR repeat
  Pfam annotation: Domain name=PPR; Domain location=620-653; Score =21.1; E_value=0.0039; Accession=PF01535.11; Description=PPR repeat
  Pfam annotation: Domain name=PPR; Domain location=722-756; Score =21.7; E_value=0.0027; Accession=PF01535.11; Description=PPR repeat
  Pfam annotation: Domain name=PPR; Domain location=820-854; Score =41.5; E_value=2.8e-09; Accession=PF01535.11; Description=PPR repeat
  Pfam annotation: Domain name=PPR; Domain location=855-889; Score =14.0; E_value=0.17; Accession=PF01535.11; Description=PPR repeat
  Pfam annotation: Domain name=PPR; Domain location=954-988; Score=4.9; E_value=2; Accession=PF01535.11; Description=PPR repeat
  Pfam module annotation: Pfam domain module=PPR::PPR::PPR::PPR::PPR::PP R::PPR::PPR::PPR; Domain location=211-245::312-346::413-447::516 -550::620-653::722-756::820-854::855-889::954-988
MLKELPEEEFGPGIDIREYSILDNPILPSEVKKSWLDVQLCKDGTQDCFASNNTTVGGVLKFPRHSNEEREREDRFRKRVKRYPGIWCCVLDHTPGHIYYDMYWDEKPEWKPIPPQTSADDHPPCVIQLFDEMPQRYIHGREIHFELVDYIKLCLKKPKIVTATVAHCAALKIGALAHLPTSTSLLTIYSKAGDFTSSKGLFDEIQNRDAIAWNAIVAASLENKCYRIAMDFFDKMIKAQTGFDSTTLLLIVSASLHMKNFDQGRAIHCVSIKSGMLVDISLGNALVDMYAKCGDLSSSECLYEEIECKDAVSWNSIMRGSLYNRHPEKALCYFKRMSFSEETADNVSLCCAISASSSLGELSFGQSVHGLGIKLGYKSHVSVANSLISLYSQCEDIKAAETLFREIALKDIVSWNAMMEGFASNGKIKEVFDLLVQMQKVGFFQPDIVTLITLLPLCAELMLSREGRTIHGYAIRRQMISDHVMLLNSLIGMYSKCNLVEKAELLFNSTAEKDTVSWNAMISGYSHNRYSEEAQNLFTEMLRWGPNCSSSTVFAILSSCNSLNINSIHFGKSVHCWQLKSGFLNHILLINILMHMYINCGDLTASFSILHENSALADIASWNTLIVGCVRCDHFREALETFNLMRQEPPLNYDSITLVSALSACANLELFNLGKSLHGLTVKSPLGSDTRVQNSLITMYDRCRDINSAKVVFKFFSTPNLCSWNCMISALSHNRESREALELFLNLQFEPNEITIIGVLSACTQIGVLRHGKQVHAHVFRTCIQDNSFISAALIDLYSNCGRLDTALQVFRHAKEKSESAWNSMISAYGYHGKGEKAIKLFHEMCESGARVSKSTFVSLLSACSHSGLVNQGLWFYECMLERYGVQPETEHQVYVVDMLGRSGRLDEAYEFAKGCDSSGVWGALLSACNYHGELKLGKKIAQYLFQLEPQNVGHYISLSNMYVAAGSWKDATELRQSIQDLGLRKTAGYSLVDV

SEQ ID NO: 225599 - protein, 194 aa, Glycine max
  Coding DNA Sequence Number=SeqID_108821
  Gene Ontology: Biological process=response to biotic stimulus
  Homolog annotation: Hit_ID=Q45W75; Match level="QueryCoverage=75%, HitCoverage=72%, E-value=2e-54, Identity=67%"; Hit description =Disease resistance-responsive family protein
  Pfam annotation: Domain name=Dirigent; Domain location=23-193; Score =206.0; E_value=8.7e-59; Accession=PF03018.5; Description=Dirigent -like protein
MAKSKTFMLSILRIALALLFSSFAAAEEEPRFDRNLSPKSLGLRKEKLTHLRFYMHDVMSGPKPTAVKIAEAQMANTSSSFFGLLDMADDPLTAGPEPESKLVGKGQGMFGFADQNELGLVMLFNFAFTEGKYNGSTLSMLGRNMVLTAVREMPIVGGSGVFRFARGYAQAKTHTLDAKTGDAVVEFNVYVFHY

SEQ ID NO: 225600 - protein, 76 aa, Glycine max
  Coding DNA Sequence Number=SeqID_108822
  Homolog annotation: Hit_ID=Q2QX08; Match level="QueryCoverage=64%, HitCoverage=27%, E-value=2e-12, Identity=66%"; Hit description =Dirigent-like protein, expressed
MAALSACWGRNMVLSAVREMPIVGGSGAFRFARGYAQAKTYSFDVQTGDAAVEYNYVDSSIFPRIKQFRLKSLHLR

SEQ ID NO: 225601 - protein, 94 aa, Glycine max
  Coding DNA Sequence Number=SeqID_108823
  Subcellular localization annotation: CTP_CleavageSite=8; ConfidenceScore=5.19e-01
MSHAVAVGALAVPSPTPIPFVLPSLSSLLFSSFPFYLNSTAPVELEHGHGHGVKLIQDGYKWRIVLAYDGTQYAVALKNLKHCIYRFRVISVIN

SEQ ID NO: 225602 - protein, 160 aa, Glycine max
  Coding DNA Sequence Number=SeqID_108824
  Gene Ontology: Mol. function=nucleoside-triphosphatase activity; Cellular component=mitochondrion; Biological process=electron transport
  Homolog annotation: Hit_ID=Q93YY0; Match level="QueryCoverage=89%, HitCoverage=28%, E-value=6e-61, Identity=70%"; Hit description=68 kDa protein HP68
  Pfam annotation: Domain name=Fer4; Domain location=48-71; Score=19.9; E_value=0.00027; Accession=PF00037.17; Description=4Fe-4S binding domain
  Pfam annotation: Domain name=RLI; Domain location=6-37; Score=24.9; E_ value=0.00029; Accession=PF04068.5; Description=Possible metal -binding domain in RNase L inhibitor, RLI
  Pfam module annotation: Pfam domain module=Fer4::RLI; Domain location= 48-71::6-37
MADRLTRIAIVSNVRCKPKKFRQECKKSCPVVTTERLCIEVTSVSKIAFISEELCTGCGICVKSCGGRLPVPRPGQVLGLVGTNGIGKSTALKVLAGKLKPNLGRFTNPPDWQEILTYFRGSELQNYFTRILEDDLKVMSAPLFNMYACRDVLVIWTLTL

SEQ ID NO: 225603 - protein, 492 aa, Glycine max
  Coding DNA Sequence Number=SeqID_108825
MAVIHDGYLLDLFRAKICIFYLPIHLNSLLFGKKFSLPGITHLFFVGTKMWRQVEATNQDESIGRRRNINPVHVAFIVDKYLCDNHFSNTRCIFRNEASSLFATSSINQLPKTLEEMLDEYIFLKKQNAILGQERIMVMEEKNRIQILLQGMQNALNTYNAFQRPPSLNVAAMNANFAVVPQPRVYNKTPQGVSTITSIAAAMQNTSNTQLLTRPVNTNVDTGNFSTPMISVSDKKRKDTEAVNGPIVAKKPRGRPPGRKNQVQGENTSPQSSNAVNNQVVSRPSSSATQSSSGNCATSGSLVQGSNVVKGSFNHPPLFVPDNSPIPKTPTTQSSQSDTYVSPTKIYPAASCNGEASPTCCTMNPTNKVMVGPETQMAYKENSHCNSPIEVDTGKSSKMDDVRSKLNFDASNMPESLDKSLSNEVYTSESDKEVDISDIDFSNLMDCCPFLGITSEDFSYHPVPTHSKDNASTSSHECNANHLTYHQTENNH

SEQ ID NO: 225604 - protein, 748 aa, Glycine max
  Coding DNA Sequence Number=SeqID_108826
  Gene Ontology: Mol. function=nucleic acid binding; Cellular component= nucleus; Biological process=regulation of transcription, DNA-dependent
  Homolog annotation: Hit_ID=Q9FI74; Match level="QueryCoverage=99%, HitCoverage=99%, E-value=0.0, Identity=67%"; Hit description=Mutator- like transposase-like protein
  Pfam annotation: Domain name=PB1; Domain location=19-102; Score=43.7; E_value=6.3e-10; Accession=PF00564.15; Description=PB1 domain
  Pfam annotation: Domain name=SWIM; Domain location=618-658; Score =39.6; E_value=1.1e-08; Accession=PF04434.8; Description=SWIM zinc finger
  Pfam annotation: Domain name=zf-CCHC; Domain location=730-747; Score =10.5; E_value=0.018; Accession=PF00098.13; Description=Zinc knuckle
  Pfam module annotation: Pfam domain module=MuDR::PB1::SWIM::zf-CCHC; Domain location=145-314::19-102::618-658::730-747
MATRKVIAICQSGGEFVTDKDGSLSYSGGDAYAIDIDQQTSLSDFKSEIAEMFNCNVSTMIIKYFLPGNKKTLITVSKDKDLQRMVNFLGDANTVDVFVMSEEGAARNNNSNMPGSRSSRTTVSEAAVPVVAPMNVIVDAVQCMDQVEVVDVANEVPARSICSGGNDDNHRKAAQQWENTITGVDQRFNSFSEFREALHKYSIAHGFAYKYKKNDSHRVTVKCKSQGCPWRVYASKLSTTQLICIKKMHCNHTCEGSVVKAGYRATRGWVGSIIKEKLKDSPNYKPKDIADDIKREYGIQLNYSQAWRAKEIAREQLQGSYKEAYTQLPLFCEKIKETNPGSFATFTTKEDSSFHRLFVAFHASISGFQLGCRPLIFLDRTPLNSKYQGELLAAISVDGNDGIFPVAFAVVDTETEDNWHWFLQELKLATSTSEQITFVADFQNGLKKSLSDVFEKCYHSYCLRHLAEKLNKDLKGQFSHEARRFMVNDFYAAAYAPKLETFERSIENIKGISPEAYDWVIQSEPEHWANAFFNGARYNLLSSNFGQQFYSWVSEAHELPITQMIDALRGKMMETIYTRQVESNQWMTKLTPSKEELLQKERLVAHSLQVLFSQGSTFEVRGESVDIVDIDNWDCSCKGWQLTGVPCCHAIAVFECVGRSPYDYCSRYFTVENYRLTYAESIHPVPNVDKPPVQGESTALVMVIPPPTKRPPGRPKMKQVESIDIIKRQLQCSKCKGLGHNRKTCKLS

SEQ ID NO: 225605 - protein, 100 aa, Glycine max
  Coding DNA Sequence Number=SeqID_108827
MELAGTEAGHIPRCYVMDMSKDFIPMSVFSDTPQALTVLKWLIKHALTVSVALTASFSTLSPYTSNHQRSIREIDGNVNYEKLKFCMHSVRVSISKKMRR

SEQ ID NO: 225606 - protein, 60 aa, Glycine max
  Coding DNA Sequence Number=SeqID_108828
  Gene Ontology: Mol. function=RNA polymerase II transcription factor activity; Cellular component=transcription factor TFIIF complex; Biological process=transcription initiation from RNA polymerase II promoter
  Homolog annotation: Hit_ID=Q5N8X8; Match level="QueryCoverage=80%, HitCoverage=18%, E-value=5e-13, Identity=70%"; Hit description =Putative transcription initiation factor IIF beta subunit
MAIKEKKAPTKPTDMKRTRRDHGKIEEIVFELFERQPNWSLRKLIQETNQPEVGLYKHTI

SEQ ID NO: 225607 - protein, 162 aa, Glycine max
  Coding DNA Sequence Number=SeqID_108829
  Gene Ontology: Mol. function=pseudouridylate synthase activity; Biological process=tRNA processing
  Homolog annotation: Hit_ID=Q0WPX6; Match level="QueryCoverage=98%, HitCoverage=49%, E-value=2e-54, Identity=66%"; Hit description =Putative tRNA pseudouridine synthase
  Pfam annotation: Domain name=PseudoU_synth_1; Domain location=24-131; Score=101.9; E_value=1.9e-27; Accession=PF01416.10; Description=tRNA pseudouridine synthase
MDPFQRHFAYHSVYKLNSAVMREAATYFVGKHDFSAFANASHNDRVPDPVKHVFRFDLKEMGALLQLEVEGSGFLYRQVRNMVALLLQIGREAIPPDIVPHILASRDRKELAKYSLPAPPHGLCLVSINYNESHLLPPPESPPANSFGRHQTIRKCKVPFFL

SEQ ID NO: 225608 - protein, 137 aa, Glycine max
  Coding DNA Sequence Number=SeqID_108830
  Homolog annotation: Hit_ID=Q9FHK0; Match level="QueryCoverage=87%, HitCoverage=36%, E-value=2e-23, Identity=50%"; Hit description =Arabidopsis thaliana genomic DNA, chromosome 5, P1 clone:MFC19
  Pfam annotation: Domain name=F-box; Domain location=76-123; Score =41.7; E_value=2.6e-09; Accession=PF00646.23; Description=F-box domain
MTLSDDEDENLAQFLESEVLSEVSDKEEENVEEPKAKRARLEEDEITKQKQSSDSLSAPKNIVVNNGVVPRRIETGYFSQIPPELFHHILKFLSSEDLVSCSLVCRFLNYAASDEALWRRLSASPISAGYERRNSPV

SEQ ID NO: 225609 - protein, 465 aa, Glycine max
  Coding DNA Sequence Number=SeqID_108831
  Gene Ontology: Mol. function=hydrolase activity; Cellular component =cytosol; Biological process=metabolic process
  Homolog annotation: Hit_ID=Q9FI75; Match level="QueryCoverage=97%, HitCoverage=76%, E-value=0.0, Identity=81%"; Hit description =Similarity to 5'-nucleotidase
  Pfam annotation: Domain name=5_nucleotid; Domain location=125-464; Score=499.7; E_value=3.3e-147; Accession=PF05761.4; Description=5' nucleotidase family
MVVPLLVGIDGHASLDGPIEEVARSEARDAEDLLQDLGIPSPSSSRNSPRGIFCSRTLNLRSISAIGYDMDYTLIHYNVMAWEGRAYDYCMENLKNMGFPVDGLAFDPDLVIRGLVIDKEKGNLVKADRFGYIKRAMHGTKMLSTRAVSEMYGRELVDLRKESRWEFLNTLFSVSEAVAYMQMVDRLDDETIPADLALDYKGLYKAVGKALFWAHVEGRLKSEIMSKPELFVEPDPELPLALLDQKEAGKKLLLITNSDYLYTDKMMQHSFNRFLPNDMGWRDLFDIVIVSARKPEFFQTSHPMYEVVTGEGLMRPCFKAQTGGLYSGGSAQMVENSLDIHGDEILYVGDHIYTDVSQSKVHLRWRTALICRELEEEYDALIGSRSYRESLVELINQKEIVGDLFNQLRLALQRRSKDRPAQTLAATNLNDEDLTDSMQKLLIVMQRLDEKIAPMLEADGELFNS

SEQ ID NO: 225610 - protein, 93 aa, Glycine max
  Coding DNA Sequence Number=SeqID_108832
  Gene Ontology: Mol. function=ATPase activity, coupled to transmembrane movement of substances; Cellular component=integral to membrane; Biological process=transport
  Homolog annotation: Hit_ID=Q9M1Q9; Match level="QueryCoverage=90%, HitCoverage=6%, E-value=4e-18, Identity=45%"; Hit description =Multidrug resistance protein 17
MAENIDLYGDSDIKQDSKSKVKDESAKTVPLYKLFSFADPLDHLLMFVGAVGAIGNGISMPLMTLIFGNMINAFGATENSNEVVDEVSKVVPH

SEQ ID NO: 225611 - protein, 113 aa, Glycine max
  Coding DNA Sequence Number=SeqID_108833
  Pfam annotation: Domain name=SWIB; Domain location=53-113; Score =31.9; E_value=2.3e-06; Accession=PF02201.9; Description=SWIBMDM2 domain
  Subcellular localization annotation: CTP_CleavageSite=74; ConfidenceScore=5.56e-01
MAPARVFGAIAGRAFMAAAAKSAAKKKPAPSSGAAAKAAVKKTAAPRTTNSGIQKVVPVSSELGDFLGAPQVSRTEAVKKVWAYIKLQNLQNEAIRLVLCFSVCNVERYLCFI

SEQ ID NO: 225612 - protein, 174 aa, Glycine max
  Coding DNA Sequence Number=SeqID_108834
MAWEQGYQKVWVESDYKVAINLVTSDNANHHMRPLISIARTHARNAYMGLVPPFDKKNLVFDNTLVTALLVDVDPTTVIKGCEATLDYLGLLNTNNDQAFHVASSHDGLYNGWGIRTDGIKWVKERKKRNGGKGEENSPRKSSQALGSSENALRLVVLSTSYALSEESGLSLVA

SEQ ID NO: 225613 - protein, 659 aa, Glycine max
  Coding DNA Sequence Number=SeqID_108835
  Gene Ontology: Mol. function=nucleoside-triphosphatase activity; Cellular component=integral to membrane; Biological process=transport
  Homolog annotation: Hit_ID=Q9C6W5; Match level="QueryCoverage=99%, HitCoverage=99%, E-value=0.0, Identity=72%"; Hit description=White -brown complex homolog protein 14
  Pfam annotation: Domain name=ABC2_membrane; Domain location=397-603; Score=181.0; E_value=3e-51; Accession=PF01061.14; Description=ABC-2 type transporter
  Pfam annotation: Domain name=ABC_tran; Domain location=98-286; Score =157.6; E_value=3.2e-44; Accession=PF00005.17; Description=ABC transporter
  Pfam module annotation: Pfam domain module=ABC2_membrane::ABC_tran; Domain location=397-603::98-286
MPQNCIAPKPEFCNSHNSVEGPPEMTEPHNSTVLSYPMQANEQQQQPFPKLIMYPITLKFEELVYKVKLEQKGGCWGSTWTCKEKTILNGITGVVCPGEILAMLGPSGSGKTTLLTALGGRLNGKLSGKITYNGQPFSGAMKRRTGFVAQDDVLYPHLTVTETLVFTALLRLPNTLKRDEKVQHVERVITELGLTRCRSSMIGGPLFRGISGGEKKRVSIGQEMLINPSLLLLDEPTSGLDSTTAQRILNTIKRLASGGRTVVTTIHQPSSRLYYMFDKVVLLSEGCPIYYGPASTALDYFSSVGFSTCVTVNPADLLLDLANGIAPDSKHATEQSEGLEQERKQVRESLISAYEKNIATRLKAEVCSLEANNYNITKDACARNSIKPDQWCTSWWHQFKVLLQRGVRERRYEAFNRLRIFQVVSVAFLGGLLWWHTPESHIDDRVALLFFFSVFWGFYPLYNAVFTFPQERRMLIKERSSGMYRLSSYFLARTIGDLPLELALPTAFVFIIYWMGGLKPDPMTFILSLLVVLYSVVVSQSLGLAFGAILMEVKQATTLASVTTLVFLIAGGYYIQQIPPFIVWLKYLSYSYYCYKLLLGVQYNENDYYECSKEELCKVADFPPIKSMGLNHLWVDVCIMAMMLVGYRLVAYLALHRVR

SEQ ID NO: 225614 - protein, 63 aa, Glycine max
  Coding DNA Sequence Number=SeqID_108836
  Subcellular localization annotation: CTP_CleavageSite=31; ConfidenceScore=5.13e-01
MPRPDKPNWPTMHSRSAPHLALSAFRSCAGRAMHAGPVLLLDRALGAGRLAGLSARNGFHLRA

SEQ ID NO: 225615 - protein, 65 aa, Glycine max
  Coding DNA Sequence Number=SeqID_108837
  Homolog annotation: Hit_ID=Q1SAS4; Match level="QueryCoverage=80%, HitCoverage=2%, E-value=4e-08, Identity=39%"; Hit description=RNase H, putative
MRIGDFPRDLRRMVEQEEREVKPHREETEVVNLGIGEEKKEVKVGTCMFMNVQDKIIISNWAEPD

SEQ ID NO: 225616 - protein, 102 aa, Glycine max
  Coding DNA Sequence Number=SeqID_108838
MAELCLVPNIIIPSKFKVLDFDKYRGTTCPKNHLKMYCQKMGAYAKDEKLLMHFFQESLAGAAITWYTNLESSQIHSWKDVMAAFIRQYQYNFDMALDRTQL

SEQ ID NO: 225617 - protein, 59 aa, Glycine max
  Coding DNA Sequence Number=SeqID_108839
VMATIALSSRYGSKLAYDTGIWGFVVDLGMAFVDNWVVGKEVIHFDPFTGEDQIRKPLR

SEQ ID NO: 225618 - protein, 386 aa, Glycine max
  Coding DNA Sequence Number=SeqID_108840
  Gene Ontology: Mol. function=nucleic acid binding; Biological process= transport
  Homolog annotation: Hit_ID=Q8H6Q8; Match level="QueryCoverage=97%, HitCoverage=14%, E-value=4e-22, Identity=34%"; Hit description=CTV.20
MGIDAALLMCLRDIRHNQFEDSLIGTVETSLGQVSLMDRNILDSLFLNIHFHGLDMKEGSIPAALIYRIQYKVMNTCASRVLLKPQKGETTLFITDMTKANVSLPRKIKWDEVTLPERWVMDKATPSIPRPAPTIEHIKQDNSGKTLLLAYLEQHTTKNKRTTKSRSNPQHTLLWNLMMLSDNFSIDKETLRKDFYSPENEPQRRWFFQLYKGTNRKQIQDKFYEFVERVKINVLFFDWFHAYAIRNDIDYPWKQDIIGDPTTNVITNWQVKDGELIQSELPPATQYQLPNNKDSNNKPVMAIPFKTKDVNEEVTSKDIKSLMEQANYTNKYLQALGETIKTKVVPKQKSIEEASPSIPIENLYSNLSKLVRRLNEKLGNLEKLNP

SEQ ID NO: 225619 - protein, 61 aa, Glycine max
  Coding DNA Sequence Number=SeqID_108841
MDRSTAAGEENRWEIISSIKERKNKKSKLDVQKTEDPWEVGGVACLSMNSDHKVIPDEEKH

SEQ ID NO: 225620 - protein, 79 aa, Glycine max
  Coding DNA Sequence Number=SeqID_108842
  Homolog annotation: Hit_ID=Q5W7C9; Match level="QueryCoverage=68%, HitCoverage=20%, E-value=3e-18, Identity=74%"; Hit description =Unknow protein
MEENSESACFTNKEAISKATRNLMESSILAQDERWRHALHMQVGREVVFPVADGWKRLLIPRRLRSKRRNPPEEGLASD

SEQ ID NO: 225621 - protein, 105 aa, Glycine max
  Coding DNA Sequence Number=SeqID_108843
FYGVPIAPNKVIRPPINWAFIKKYCTPQAGAGRDTTVAWEWPVASNRRTAATSRAHQLIYKGLSIAYDPWQTIRRPSPKPKVSKSTRSVTDKSSRVQLKMLKKRY

SEQ ID NO: 225622 - protein, 153 aa, Glycine max
  Coding DNA Sequence Number=SeqID_108844
  Gene Ontology: Mol. function=nucleic acid binding; Cellular component= intracellular; Biological process=chromatin modification
  Homolog annotation: Hit_ID=Q8RWX7; Match level="QueryCoverage=87%, HitCoverage=28%, E-value=4e-66, Identity=84%"; Hit description =Putative zinc finger protein
  Pfam annotation: Domain name=RS4NT; Domain location=99-136; Score =17.8; E_value=0.015; Accession=PF08071.2; Description=RS4NT (NUC023) domain
  Pfam annotation: Domain name=zf-C2H2; Domain location=114-136; Score =20.5; E_value=0.0061; Accession=PF00096.16; Description=Zinc finger, C2H2 type
  Pfam annotation: Domain name=zf-C2H2; Domain location=38-60; Score =23.0; E_value=0.0011; Accession=PF00096.16; Description=Zinc finger, C2H2 type
  Pfam module annotation: Pfam domain module=RS4NT::zf-C2H2::zf-C2H2; Domain location=99-136::114-136::38-60
MASASSSTPFLGIRQENQNPDAEVIALSPKTLMATNRFLCEVCNKGFQREQNLQLHRRGHNLPWKLKQKTNKEPKRKVYLCPEPTCVHHDPSRALGDLTGIKKHYSRKHGEKKWKCDKCSKKYAVQSDWKAHSKTCGTREYRCDCGTLFSRFV

SEQ ID NO: 225623 - protein, 148 aa, Glycine max
  Coding DNA Sequence Number=SeqID_108845
  Homolog annotation: Hit_ID=Q9C761; Match level="QueryCoverage=50%, HitCoverage=11%, E-value=1e-07, Identity=41%"; Hit description =Transposase, putative
MTLKMLGKCTKYWHECYEILAVGAILNPRLKFGAIRFAYTKIDLSTCEKMIIALRKKIEKLFDECVKVKSSESNASTSQQISPPPQQVSYMDDEQVIDALGLACVASMEAGSLSFNEEEGTSPPRIALDKKLEENALMEEKKQRRGGA

SEQ ID NO: 225624 - protein, 355 aa, Glycine max
  Coding DNA Sequence Number=SeqID_108846
  Gene Ontology: Mol. function=nucleic acid binding; Cellular component= intracellular; Biological process=chromatin modification
  Homolog annotation: Hit_ID=Q5UDB6; Match level="QueryCoverage=67%, HitCoverage=44%, E-value=2e-15, Identity=30%"; Hit description =INDETERMINATE-related protein 9
RDSFITHRAFCDALAHESARHPSSVNHLGTHHLYGTNHMSLGLGAQLQNHQISATNSILSLGSEPKFEHLISPNLHHSSSSSFGVQSPQSSSFFMTDPNHAFQDLQSQNQGHLFSNKQLHGLMQLPDLQGNTNNNSTTSASSLSASANNTNLFNLSFFPNTNTSGSIINDQFSNISGGNNNQGTATLYSTNSPVSNNHVGNSSLSSLFGNSSVQQDNMSPHMSATALLQKAAQMSSTTTTNNELGMRSSIENEHSSHLRGLLNSLANGNNLGQYHNVVEEPKKMSQNNLGLCFGGSDKLTLDFLGVGGMVRNMNNGGGFSQREQQQQHSMGITMSPLDPKLESAQANQHYGTSTL

SEQ ID NO: 225625 - protein, 709 aa, Glycine max
  Coding DNA Sequence Number=SeqID_108847
  Gene Ontology: Mol. function=ATPase activity, coupled to transmembrane movement of substances; Cellular component=integral to membrane; Biological process=transport
  Homolog annotation: Hit_ID=Q94IH6; Match level="QueryCoverage=96%, HitCoverage=97%, E-value=0.0, Identity=47%"; Hit description=CjMDR1
  Pfam annotation: Domain name=ABC_membrane; Domain location=56-321; Score=106.5; E_value=7.7e-29; Accession=PF00664.13; Description=ABC transporter transmembrane region
  Pfam annotation: Domain name=ABC_tran; Domain location=379-563; Score= 208.2; E_value=1.8e-59; Accession=PF00005.17; Description=ABC transporter
  Pfam module annotation: Pfam domain module=ABC_membrane::ABC_tran; Domain location=56-321::379-563
MVAEACLDGDTISNETTGSTSDHPPVQGPENTQEMDGRQQDSKKNKVKDSWDCLLMVVGAISAVGNGISMPLMTILIGDAIDAFGGNVDNKQAVVHQVYKASLKFASIGAGAFLAAFLQVSCWVITGERQTARIRGLYLKAILRQDISFFDKETVERLLEGCQLISQVGKFIQYVACFFGGIAIAFIKGWLLSLVLLSSLPLLVLSGSVMSFAFAKMASRGQTAYSEAATVVERTIGSIRTVASFTGEKQARAQYDEYLTKAYRVGVQEGVAVWFGGKMVLEKGYTGGQVISVFFAVLTGSMSLGQASPSLTAFAAGQAAAFKTFETIKRRPDIDAYEPYGQQPYDIPGDIELREVCFSYPSRPDELIFNGFSISIPSGTTAALVGQSGSGKSTVISFIERFYDQQAGEVLIDGINLREFQLKWIRQKISLVSQEPVLFAYSIKENIAYGKDGATHEEIRAAADLANAAKFIDIFPNGLDTMVGEHGTQLSGGQKQRISIARAILKDPRILLLDEATSALDAESERVVQEILDRIMINRTTVIVAHCLSTIRNADVIAVIHQGTAHMLSSLKILMQLLASSLDCKKLKGNQNSMLEMTGWPENFVDSERQLSQRLSFPESLSRGSSGRRNGCQHSFEISNAMPTSPDLFETSEGGPEILPSVASHKPQEVSLLCVTYLNKPEIPVLLLGTVAAAATGQYYPPWGFFSPT

SEQ ID NO: 225626 - protein, 60 aa, Glycine max
  Coding DNA Sequence Number=SeqID_108848
MAVSLAWQHVDEATRMNGETAATWMPPVEVARHPWKPPVVAARPVTWTLSRQFQCRHRAF

SEQ ID NO: 225627 - protein, 85 aa, Glycine max
  Coding DNA Sequence Number=SeqID_108849
MNTGTYRYNDLRRTVDKLPRGHDRRELHYTTGVSSTARNGCWRGTASPFSNTLEWKGLENATQHRKGGTFGSVEALHGTDACPDT

SEQ ID NO: 225628 - protein, 420 aa, Glycine max
  Coding DNA Sequence Number=SeqID_108850
  Homolog annotation: Hit_ID=Q84UR3; Match level="QueryCoverage=23%, HitCoverage=12%, E-value=6e-20, Identity=49%"; Hit description =Proline-rich protein family-like
  Subcellular localization annotation: CTP_CleavageSite=37; ConfidenceScore=5.81e-01
MKQKTPSSPTTARSVLKKQGHKSLQSPPPPPPPPRLRASSKAPKSPPEVVNRESISSTRAESVPPDLKNVSRAKRGVVVNKPKLNEEVLGSQKAEEGKIVIVARPRRRVGDFGSRKSEDDDSHGKKKKELLQEKLEVSENLIKSLQSEVLALREELDRVKSLNVELESQNTKLTQNLAAAEAKISNVGIGNNGKKEPIGEHRSPKFKDIQKLIAEKLERSRVKKEGTPEIIFAKASISAPTPSYAVPETISVGRKSPPNTCLQPPPPPPPPITSVGRNSPSNTCLPPPPPPPPPPIPTPPLARLANTQKAPTIVELFHSLKNKDGKIDSKGSVNHQRPVVISAHSSIVGEIQNRSAHLLAIRADIETKGEFINDLIKKVVDAAFTDIEEVLKFVDWLDGKLSSLFIHYYFSLLIRVHGRK

SEQ ID NO: 225629 - protein, 185 aa, Glycine max
  Coding DNA Sequence Number=SeqID_108851
  Homolog annotation: Hit_ID=Q9FJD4; Match level="QueryCoverage=31%, HitCoverage=8%, E-value=6e-08, Identity=47%"; Hit description =Importin beta
MIDSGIYTAWLPKVDDEAILKTDMDGLTGVVPNIMGVVGDVCRCFEEKSGAELAADISAADDSMTEYTNCLTNGILEAYSGILEGFKAGNLYNPMEERRTLEESHKWLWKEEKKRRLNVDRERERGREGIVATDNELVEIIIKKGEGYLRRQSECSKKERGMDCDGGAAEDGGDGKQRTKDARLQ

SEQ ID NO: 225630 - protein, 123 aa, Glycine max
  Coding DNA Sequence Number=SeqID_108852
  Homolog annotation: Hit_ID=Q84UR3; Match level="QueryCoverage=99%, HitCoverage=14%, E-value=1e-22, Identity=43%"; Hit description =Proline-rich protein family-like
MLEQEISSYKDDPDIPCGAALKKMASLLDKSERSIQRLIKLRSSVTHSYQMYNIPTAWMLDSGIMSKTSNIPSMQIKQASMTLVKTYMKRVTMELESIRNSDRESIQDSLLLQGVHFAYRAHQ

SEQ ID NO: 225631 - protein, 158 aa, Glycine max
  Coding DNA Sequence Number=SeqID_108853
  Gene Ontology: Mol. function=nucleic acid binding; Cellular component= intracellular; Biological process=regulation of transcription from RNA polymerase II promoter
  Homolog annotation: Hit_ID=UPI000034F468; Match level="QueryCoverage =93%, HitCoverage=28%, E-value=4e-52, Identity=58%"; Hit description =ATP binding / ATP-dependent helicase/ DNA binding / helicase/ nucleic acid binding
  Pfam annotation: Domain name=Helicase_C; Domain location=29-107; Score=80.4; E_value=5.5e-21; Accession=PF00271.21; Description =Helicase conserved C-terminal domain
MSTKGCFPAGCKFLIFAHHQPMIDSIHEFLLKKKVGCIRIDGSTPAASRQQLVTDFQEKDSIKAAVLSIKAGGVGLTLTAASTVIFSELSWTPGDLIQAEDRAHRIGQMLDGHENALEVSASLPVNSPSKQKTLDQFVRRCDNTDGLEYEPNPKRPRN

SEQ ID NO: 225632 - protein, 336 aa, Glycine max
  Coding DNA Sequence Number=SeqID_108854
  Pfam annotation: Domain name=GspL; Domain location=3-269; Score= -118.5; E_value=0.055; Accession=PF05134.4; Description=General secretion pathway protein L (GspL)
SLLSANGLSLAAFAPTPLWLPETASGWTLYCLDGYLVARQPDGRGALYAREMTDDDTPSTLARTLGPDAAACAAGARQWIGAVPAQWRGDAPDPVLPEAACGVMADIPWSIAAAADGHAAAGAWGWGRATALAMAAAAVWMAGLALQATRLEHGAQALRQQQAQALRQVFPSITTVVDPLAQARRQLAARRAGTGDDWRELGVLLRAAREHMAFAAGDVLAWRYEAGGLELDMPPAARPGTPDAPADGKPAATPGWVQAARQAGLAVQATATGLASPWRGGLDAPVAQRKTPAGALCLRRRRGAVLAGGDRTVAGAHRAQPASAAAAGSGRARTRC

SEQ ID NO: 225633 - protein, 97 aa, Glycine max
  Coding DNA Sequence Number=SeqID_108855
  Gene Ontology: Mol. function=nucleic acid binding
  Homolog annotation: Hit_ID=UPI000034F468; Match level="QueryCoverage =71%, HitCoverage=10%, E-value=9e-25, Identity=80%"; Hit description =ATP binding / ATP-dependent helicase/ DNA binding / helicase/ nucleic acid binding
MWIIIGLGGAKVDNLDPLVQRAIVAASAVPDLQDRYHKIPSFIESKLLPFQREGVRFILQHGGRVLLADEMGLGKTLQAIHCLKLNHFHTLSVHHDA

SEQ ID NO: 225634 - protein, 232 aa, Glycine max
  Coding DNA Sequence Number=SeqID_108856
  Gene Ontology: Mol. function=nucleic acid binding; Cellular component= intracellular; Biological process=regulation of transcription from RNA polymerase II promoter
  Homolog annotation: Hit_ID=UPI000034F468; Match level="QueryCoverage =97%, HitCoverage=33%, E-value=1e-103, Identity=80%"; Hit description= ATP binding / ATP-dependent helicase/ DNA binding / helicase/ nucleic acid binding
  Pfam annotation: Domain name=SNF2_N; Domain location=3-230; Score= -59.6; E_value=6.3e-05; Accession=PF00176.13; Description=SNF2 family N-terminal domain
MNKSGAIAVASCVQDSWPVLIIAPSSLRLQWASMIQQWLNIPSSDILIVLSQNGGSNRGGFNIVSSSAKSSIHLDGLFNIISYDLVPKLQNMLMTCNFKVVIADESHFLKNAQAKRTTASLPVIKKAQYALLLSGTPALSRPIELFKQLEALYPDVYRNVHEYGNRYCKGGFFGVYQGASNHEELHNLIKATVMIRRLKKDVLSQLPVKRRQQVFLDLAGKDMKQINALFRE

SEQ ID NO: 225635 - protein, 319 aa, Glycine max
  Coding DNA Sequence Number=SeqID_108857
  Gene Ontology: Mol. function=sequence-specific DNA binding; Cellular component=nucleus; Biological process=regulation of transcription
  Homolog annotation: Hit_ID=Q2HT21; Match level="QueryCoverage=66%, HitCoverage=38%, E-value=5e-42, Identity=45%"; Hit description=DNA -binding WRKY
  Pfam annotation: Domain name=WRKY; Domain location=116-176; Score =125.2; E_value=1.8e-34; Accession=PF03106.6; Description=WRKY DNA -binding domain
MEGKIALKKLLEVQEKAYVNDTDAINWTEEPSIKNTRIMQLGSSLLSLSLNNLEPPQNHEQQNLNQKDSQQNNMEKPALPSCRQFLNTGQWVILQEAKIVEEQAFEASCKKARVSMGDGCQWRKYGQKISKGNPCPRAYYRCNMGTACPVRKQVQRCAEDESVVITTYEGNHNHSLPPAARSMACTTSAALKMFLSGSTTSSHGSTYSYSNSDLFSPLCTSTYYPSAAPSCPTITLDLTQTSKNNMKFPSAISSNHLQPFPLSLHGQPQQSEGILPSEKNLALVDVVSAAITNDPSLKAALEAAVSSIIGDSQKSLPTL

SEQ ID NO: 225636 - protein, 167 aa, Glycine max
  Coding DNA Sequence Number=SeqID_108858
MDKVIPGKMLLLISTILIKTHFLHFKYSPDLVSWRSVELHVRRGARVGGKFGSFGASKRRHPQRFHHPLRYESDDDYITPHDWYSILRLLPDDTDNCDLTRQHPVFTVAAGVMRSGVVSENPDFVIGFEGWSDLGLRFGFLICVVNAHDGCGLKKRMNKNNIKILAF

SEQ ID NO: 225637 - protein, 162 aa, Glycine max
  Coding DNA Sequence Number=SeqID_108859
  Gene Ontology: Mol. function=nucleic acid binding
  Homolog annotation: Hit_ID=UPI000034F468; Match level="QueryCoverage =98%, HitCoverage=20%, E-value=5e-25, Identity=42%"; Hit description =ATP binding / ATP-dependent helicase/ DNA binding / helicase/ nucleic acid binding
MEVEDDWDLSAEDLDSLERDAFQKIAQLRNPTPPPSSPHQRHHSASATTNNLPPKPLPNSRSQTVDAFSQGARALPTTLKSGTNNDNQAKELPKFSVKFFLHSSGNVAAKFQYDQVVIAAFRRIPRSSWNAKERLWIFPLSSLSEAEKVIGEIPGYNVQLGN

SEQ ID NO: 225638 - protein, 187 aa, Glycine max
  Coding DNA Sequence Number=SeqID_108860
MSSVIACLQKGDNDLHPHFEDDNVFSHCIPSKRRQCHHFHFEDDNVFSPCMPSKGDNDHHLHFKDDNVFSHCMLSKGDNDLHLHFEDDNVFSHCTPSKGDNVIICISKTTMSSVIACLQKATMTIICISKMTMSSVIACLQKTTITFIHISKTTMSSVIACLQKAAMTYIYMSKTTMSSVIACLQRR

SEQ ID NO: 225639 - protein, 140 aa, Glycine max
  Coding DNA Sequence Number=SeqID_108861
GLSSDSLTFERLSPIINLPTSGRTYWNPNDLTVSIRGARRARRDQLSFPPHLQLLLQHPLQQPLQSQLRLILSTLMPCFRAFIRDISFYFRVYREDEGPTAQVPQHVEDASSEAIILEPFIIEEEAGETRVRQEAAATPE

SEQ ID NO: 225640 - protein, 100 aa, Glycine max
  Coding DNA Sequence Number=SeqID_108862
MSRGSGDLGDVRWGAIAQNQAWPIPTQPGHSQSVRTCDIPKQASSWQSTNKRTKCTKALVIDYQLCVIDYIVLPATGNRLPFMCNRLLSVAFRFHCAKAV

SEQ ID NO: 225641 - protein, 96 aa, Glycine max
  Coding DNA Sequence Number=SeqID_108863
  Gene Ontology: Mol. function=RNA-directed DNA polymerase activity; Biological process=RNA-dependent DNA replication
MVPHESFYARAIGARKTPYPHDVSKKRERDVYYLSKKFTTCEMNYYLLEMTCYALVWVAHRLRQYMLNYITWLVSKIDPVKYIFVKPTLTERIARW

SEQ ID NO: 225642 - protein, 66 aa, Glycine max
  Coding DNA Sequence Number=SeqID_108864
MKAGYTGFQWEESEKLLSIEGMEQWQVHLRDLHHQKVVEKLKRVHSFLFLNHKLDKIISMQVNSVS

SEQ ID NO: 225643 - protein, 68 aa, Glycine max
  Coding DNA Sequence Number=SeqID_108865
MPSQLLPQLSPPKLYVEVLESGEQIGLKHFRPIKPLGSGDTYWQPTKVLKEDAVSRGSDRIGVPSLPR

SEQ ID NO: 225644 - protein, 75 aa, Glycine max
  Coding DNA Sequence Number=SeqID_108866
  Homolog annotation: Hit_ID=Q6JAC8; Match level="QueryCoverage=89%, HitCoverage=66%, E-value=3e-07, Identity=39%"; Hit description =Putative auxin-induced protein family
  Pfam annotation: Domain name=Auxin_inducible; Domain location=1-73; Score=-24.6; E_value=0.017; Accession=PF02519.5; Description=Auxin responsive protein
MEEARSRRGYVPVLVGTGKEGMDEKIWVTIKAIQHLTIVELLEQSAKEYGYQNGLLKISCDADKFKVILHNICKK

SEQ ID NO: 225645 - protein, 155 aa, Glycine max
  Coding DNA Sequence Number=SeqID_108867
PLVQYFLLLHSAAIRSQEAKESIDEEDPRPTSSTWSYITYRFILHTGRRTSNLVPLDLEIEATLRRNRAERRRKLLQDRTIASILEEEAQSSDSTSSDPLSSRESAIYLLEASVMADEHQQRVTLEDYSSSSVPQFFTSICASEVKLTTSTIFIL

SEQ ID NO: 225646 - protein, 191 aa, Glycine max
  Coding DNA Sequence Number=SeqID_108868
  Gene Ontology: Mol. function=metallopeptidase activity; Cellular component=proteinaceous extracellular matrix; Biological process =proteolysis
  Homolog annotation: Hit_ID=O66267; Match level="QueryCoverage=66%, HitCoverage=74%, E-value=7e-69, Identity=95%"; Hit description =Insecticidal protein
MNGNETGWDSVNDLIHYHERGNGLTINNKPSYDINQAGLQIARGDKTWNGVHVTGKEATVTYSFPDWDYNELNLGHRSPERDTGLSAFTQQQQEQAKLSLQSWADVANIKFVEVAAGQPSNITFGNYEGTGQAYALKPFSYNGNDYRGFNSDGQSWYNIKNHSENLHPELGNYGRLTITHEVGHTLGLDHP

SEQ ID NO: 225647 - protein, 325 aa, Glycine max
  Coding DNA Sequence Number=SeqID_108869
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=1e-33, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DYTSLAFRGLHALTIRGLLALAYKGQHALAYRGLHVLTFRGLHSLTFRGLNALAFRGMHPLTFRGLHVLAFRRMHVLAFRVLHTLAFRGLHVLAFRGQHALAFRGLHALAFRGLHALTFRGQHVVAFRWLHALAFRGLHVLAFRGLHALAFRGLHSLAFRGLHVLAFRALHIFAFRGLHVLAFRALHALAFKGLHALAFRELTLTFRGLCALAFRGLCALAFRGLHAIAFKGLHALAFRGLNALTFRELHVLAFTSWILVLSPSEGYAPSPLEGYASSTSEVCTPLPLEGWAPLPLEDYTSSHSEGCTPSPSEDYTPSPSDGYTS

SEQ ID NO: 225648 - protein, 110 aa, Glycine max
  Coding DNA Sequence Number=SeqID_108870
  Gene Ontology: Mol. function=DNA binding; Cellular component=nucleus; Biological process=regulation of transcription
MQTERSESSGTEHNEHDDDDESESKRRKVKSLGSSIMQSASVLARALRSCEEKKEKRHREMIELEQRRIQMEEARNEVHRQGIATLVAAVTNLSGAIQSLINNSERHGQR

SEQ ID NO: 225649 - protein, 219 aa, Glycine max
  Coding DNA Sequence Number=SeqID_108871
  Gene Ontology: Mol. function=peptidyl-prolyl cis-trans isomerase activity; Cellular component=mitochondrion; Biological process =protein folding
  Homolog annotation: Hit_ID=Q7EYT3; Match level="QueryCoverage=55%, HitCoverage=51%, E-value=1e-37, Identity=63%"; Hit description =Peptidyl-prolyl cis-trans isomerase-related-like protein
  Pfam annotation: Domain name=Pro_isomerase; Domain location=53-216; Score=0.0; E_value=5.1e-07; Accession=PF00160.11; Description =Cyclophilin type peptidyl-prolyl cis-
MGYKRETTSNEVGMAPNGRGRCVRKGCCQRWKLAGKGIVMCQRTVTRKCCLARVLLDCSRRHDHHRVDRWMAMLMVGSTAGVVVGAVTVAGKRNFGNQKGHFKGMLFHKVIKHYVIQAGDNQGQGATEDWNLRGKQHTITSMKHEAFMLGTSKGKHHNKGFDLFITTAPIPDLNEKIIVFGQVIKGEDVVQEIEEVDTDEHYKPKVSIGILDVTLKQKV

SEQ ID NO: 225650 - protein, 85 aa, Glycine max
  Coding DNA Sequence Number=SeqID_108872
MTNHDKCPTTCTRKHTCMTLLIDTCLQGTLKSLYIYGFTMPPSTSNEARRERDCEVEIGARNSPLYLKKFVGASTGSSMAKLTTL

SEQ ID NO: 225651 - protein, 118 aa, Glycine max
  Coding DNA Sequence Number=SeqID_108873
MNERKNPHRPFLPYEQLVYLTFLYAINTSTATPCQNQPTLTARAPQLRGYILLRVQACFSSSKDDYYYNYDDSSRRHFASDEDRGRWVAEPGIDGKASAFIARFYASRVSDSEHQIAS

SEQ ID NO: 225652 - protein, 172 aa, Glycine max
  Coding DNA Sequence Number=SeqID_108874
  Homolog annotation: Hit_ID=Q153F8; Match level="QueryCoverage=41%, HitCoverage=20%, E-value=3e-28, Identity=84%"; Hit description =Pectin acetylesterase
  Pfam annotation: Domain name=PAE; Domain location=47-172; Score= -84.8; E_value=1.3e-10; Accession=PF03283.4; Description =Pectinacetylesterase
VILELDFAQLMRGREGPEFEQCESDGSEVQLCPASSSHVSCFEDANVTDLDMQYVSGRGFYRPLMVGFTLINGAAAKGAALFIWVDGECGRTNTEVIVAPQGAGLYFRGQRIWQAAMEDLMSKGMRYAKQALLSGCSAGGLATIIHCDEFRELFTRTTRVKCLSDAGLFLDS

SEQ ID NO: 225653 - protein, 207 aa, Glycine max
  Coding DNA Sequence Number=SeqID_108875
  Gene Ontology: Cellular component=cellulose and pectin-containing cell wall
  Homolog annotation: Hit_ID=Q153F7; Match level="QueryCoverage=89%, HitCoverage=44%, E-value=3e-52, Identity=67%"; Hit description =Pectin acetylesterase
  Pfam annotation: Domain name=PAE; Domain location=3-169; Score=13.1; E_value=1.1e-16; Accession=PF03283.4; Description=Pectinacetylesteras e
MAVKRLSQVTCMLENIFDALTTTTQINRCIFLWQGVQRSLPRSCTSRLNPILCYFPQHLIAGVRTPLFLLNAAYDTWQIQASLAPPSADYHWNWYECRKNYARCSAPQIQYLQGFRNQMLRSTRAFSRSYKNGLFINSCFAHCQSERQDTWFAHDSPRIGNRLRTWDLIDMFKVREICKVPSHSSNDCLNIQAGDRGVGWELVFWPS

SEQ ID NO: 225654 - protein, 150 aa, Glycine max
  Coding DNA Sequence Number=SeqID_108876
MGDYVPPIPLNMDCNPPIFQPDEFLSNDFGTDCGTPASTCEYTHSLQNEVGNFTPPSFNLMFSQDVEENNPSLHDIPYQRPHRNLGHNRRCPPCGTGTPLWRLSIIRHALLMQSYPARALDRKLQVDWARDAREGPRVLMSLRVDFGPMG

SEQ ID NO: 225655 - protein, 1824 aa, Glycine max
  Coding DNA Sequence Number=SeqID_108877
  Homolog annotation: Hit_ID=Q2HRU3; Match level="QueryCoverage=29%, HitCoverage=90%, E-value=1e-155, Identity=53%"; Hit description=TGF -beta receptor, type I/II extracellular region
  Pfam annotation: Domain name=MFS_1; Domain location=1275-1739; Score =0.4; E_value=0.0003; Accession=PF07690.6; Description=Major Facilitator Superfamily
  Pfam annotation: Domain name=PTR2; Domain location=1337-1727; Score =294.6; E_value=1.9e-85; Accession=PF00854.12; Description=POT family
  Pfam module annotation: Pfam domain module=MFS_1::PTR2; Domain location=1275-1739::1337-1727
MKQSEATSLAARKRGKWGYIWPMWTSLLLHLLAILLFTTGFLLTRTELPYHSHCSDVSHSPCFSSNNNGSCWTKPATNRLLIIVLDALRFDFVAPSTFFAVGYAMFYVTESKPWMDKLRVLKNAASTRPLSARIFKAIADPPTTSLQRLKGLTTGGLPTFVDVGNSFGAPAIVEDNFINQLVQNGKKVVMMGDDTWTQLFPHHFERSYPYPSFNVKDLHTVDNGCIEHLLPSLYEEDWDVLIAHFLGVDHAGHIFGVDSTPMIEKLEQYNTILESGPGSSHENTMLVVMGDHGQTLNGDHGGGSAEEVETAIFAMSFKKPLSSVPSEFDSCSCQLDLELATRRDKGLCYHCEEKWSQGHRCKPRLQMFIVEDDEDFPDEIPPLEMPSTPSTTSTTPQIPQLSLHALAGMPVPETFRAYGTINHHRVVVLIDGESTHNFLQDRIAKFLSLPSSTTPPMQVMVGNGTTMTCDRHYRQVPLHMQAHYYTSRYSTPAHTGLSPTTSPPVPHRERLGPIPTCHRHQTHSDNPSTPVIDPNPPPPPPALTSLLTRFATIFREPTTLPPSCPITHHIHLQPNSSLINVRPYRYPHSQKAELEKQVVAMLSTGLIRLSQSPFSSPVLLVKKKDDTWRCCVDYRALNSVTVRDKFPMPTIDELLDELGRACTMNLRYAFRFVQCTLYLPGDHERAPQAFSPQALTNGEFYLRRSKCLFARRQLQYLGHIVSTDGVAPDPEKIQTMVNWPRPLSTTELHGFLGLTGDGKNVCISTMQQLDFAVTVSALLGIPFPYGSIGHINPELYALGADSWNSDASQKLSESDIWMQNYANALCINSWQVKRYVDAYSTSSAVGFSHDDLSRIASVYAQVENHWSHSTKKLLLDRQNDSDTLVPALKRQIDAYFKFLTTVSELARSKWTEFDLNMMGTGIGIITLCRFAIEVGLSKQAATSAFMKDYTSWIINIASGLPVWDYAAEVIPMVVLILLAAWLYKATSGSLFDWPWKYVILGTILSYMLIIVHWITDSDRFGGTLMSQNIGRTYIPRIIYAIALGQLLLLTFGQLFKNSSLDCKTILVAKTMAILSAWSSTVILLSGKQGPMVAFASIVGGALSFCALMLYKLAISCCMILQIHLCHGFTYAANICRLAMGYFIMKFVNVEGGKDEPHRSFSIMQWSLFATCLFFCSGHWCAFDGLRYGAAFIGFEEFVLVRQAILLAIDTFGFSIILPVFGLPLLVATKYQANLGKHFIFTQLSQDLKAEANAGDTEFQAVKIPRQGGYRATYFIFAMMLLDNIGFVANMVSLVLYFMNVMHFDYSGSATTTTNWLGTTFLLTIVGGFISDTYMNRLNTCILFGIIQLLGYSLLVIQSHDKTLQPDPCLKSTCVHGTKALLLYASIYLLALGGGGIRGCVPALGADQFDENKPKEGVQLASFFNWFLFSITIGASLGVTFVVYVSTESQWYKGFIISMSCSATGLIFIALGKRFYRARVPGESPLLSVLQVLVVTVKNWRVKVPLDSDELYEIQSHESNLKKKLIPHTNQFRVLDKAAVLPEGIEARRWKVCTVTQVEEVKILTRMMPILLSTIIMNTSLAQLQTFSIQQGTLMNTYIGKLNIPAASIPIIPLVFMTLLIPVYEFAFVPLVRRITGHPNGITELQRVGVGLVLSAISMVIAGAIEVKRKHEFNDHNQHRISLFWLSFHYAIFGIADMFTLVGLLEFFYKEAPQGMRSLSTSFSFLSLSIGYYLSTAFVELINLVTGKIAKSKKGWLEGRDLNRNHVELFYWFLAILSIINFVIYLMCAKWYKYQSVVPFDTGMLLKDPPPRNDENVYSTSFVST

SEQ ID NO: 225656 - protein, 145 aa, Glycine max
  Coding DNA Sequence Number=SeqID_108878
  Gene Ontology: Mol. function=aspartic-type endopeptidase activity; Cellular component=lysosome; Biological process=lipid metabolic process
  Homolog annotation: Hit_ID=Q9FRW6; Match level="QueryCoverage=94%, HitCoverage=29%, E-value=5e-37, Identity=54%"; Hit description =Aspartic proteinase 4
  Subcellular localization annotation: CTP_CleavageSite=31; ConfidenceScore=5.13e-01
MGFKHLLLVTSVCAWFVSLAVTTSSGDGVTRVSLKRRSLDINSLNSARIKGVVNHLKADGVYLKNYLDAQYFGEIGIGSPPQSFRVVFDTGSSNLWVPSAKCVLSIACYFHSKYRSKLSNTYTKIGTPCKIPYGHGHVPWLHQPR

SEQ ID NO: 225657 - protein, 109 aa, Glycine max
  Coding DNA Sequence Number=SeqID_108879
MANNSTNGGVGDVAPCGDCRPWIFLINRVLYFLKINGNIMEKEERLLETLLQGEDESRTSSSPQEAMDKSFKIWFNPLLQDQVQYSPLSALRCHEACKAWTKCDYMMWQ

SEQ ID NO: 225658 - protein, 241 aa, Glycine max
  Coding DNA Sequence Number=SeqID_108880
  Gene Ontology: Mol. function=aspartic-type endopeptidase activity; Cellular component=lysosome; Biological process=lipid metabolic process
  Homolog annotation: Hit_ID=Q1SD40; Match level="QueryCoverage=92%, HitCoverage=62%, E-value=3e-65, Identity=49%"; Hit description =Peptidase A1, pepsin
  Pfam annotation: Domain name=Asp; Domain location=1-240; Score=85.3; E_value=1.8e-22; Accession=PF00026.14; Description=Eukaryotic aspartyl protease
  Pfam annotation: Domain name=SapB_1; Domain location=125-150; Score =13.5; E_value=0.029; Accession=PF05184.5; Description=Saposin-like type B, region 1
  Pfam module annotation: Pfam domain module=Asp::SapB_1; Domain location=1-240::125-150
MSEQGSMLSAVIVIGEQGLVTQKIFSLWLNQDPVAKLGGEIVFGGIDWRHFKGEHTYVPLTQKDYWQIEVGDIQIANNPTDLTYNIKLEFPGLCEGGCAAIIDSGTSLIAGPTKIVTQINHAIGAEGYLKQKNTKEKILKYVDELCEKLPNPVGQTFIDCNDIANMPQITFTIGNKSFPLSPEQYMLRIEEGCNTVCYGGFVPLDVPAPQGPLWVLGDLFLGAYHTVFDYGNLRIGFAEAA

SEQ ID NO: 225659 - protein, 290 aa, Glycine max
  Coding DNA Sequence Number=SeqID_108881
  Gene Ontology: Mol. function=metal ion binding; Cellular component =integral to membrane
  Homolog annotation: Hit_ID=Q28H82; Match level="QueryCoverage=67%, HitCoverage=61%, E-value=3e-26, Identity=40%"; Hit description=Novel protein containing rhomboid domain
  Pfam annotation: Domain name=Rhomboid; Domain location=69-218; Score =46.0; E_value=1.3e-10; Accession=PF01694.12; Description=Rhomboid family
  Pfam annotation: Domain name=zf-RanBP; Domain location=229-259; Score= 12.7; E_value=0.029; Accession=PF00641.9; Description=Zn-finger in Ran binding protein and others
  Pfam module annotation: Pfam domain module=Rhomboid::zf-RanBP; Domain location=69-218::229-259
MEVRIGQRVSRGMLPLLALHTVSEYYRSDHKPPFTAALIAANTLIYLRPSFLDPLIPPIEQVWFNPHLILKNKDLKRFLLSPFYHIGEPHLVYNMLSLLWKGFQLETSMGSVDFASIVASLLVLSQGVTLMLSKSLLLFFDYERSYYSEYSVGFSGVLFAMKVVLNSQSENYTSVYGIIVPSRYAAWAELVLAQLLVPGVSGIVDAVKWPFKFLRRRRGRITGRGTVGSNRAWRCQTCTYDNNNGSLRVCEMCGTIRVVNGVSSFQRSSRSDGLPLDELRRRRIDRFGGR

SEQ ID NO: 225660 - protein, 61 aa, Glycine max
  Coding DNA Sequence Number=SeqID_108882
MEMKGSIRGTSGCMRFIGVQNPDDVKSREVEPQRQSLINRQWLMPNLPTIIHGPVGQKLTF

SEQ ID NO: 225661 - protein, 34 aa, Glycine max
  Coding DNA Sequence Number=SeqID_108883
MVQLGAGRSGNMGRYFGGMNVGSLRQGGSGEFFK

SEQ ID NO: 225662 - protein, 139 aa, Glycine max
  Coding DNA Sequence Number=SeqID_108884
  Gene Ontology: Cellular component=microtubule organizing center; Biological process=microtubule cytoskeleton organization and biogenesis
  Homolog annotation: Hit_ID=Q9SC88; Match level="QueryCoverage=66%, HitCoverage=12%, E-value=2e-28, Identity=72%"; Hit description=Gamma- tubulin complex component 4 homolog
MKGYGNGYYMKVGQERLSALCPMQKFVDLDSLALISQTFLDIDFVSRILDSIMKLCLQFCWNIENQDNCSNTSELEHIIEEFNKKSSSLSTILCNSRLAGSQRAPFLRRFLLRLNLNSIFERNAEGYQYHYPINHKWSD

SEQ ID NO: 225663 - protein, 47 aa, Glycine max
  Coding DNA Sequence Number=SeqID_108885
  Homolog annotation: Hit_ID=Q1RT13; Match level="QueryCoverage=87%, HitCoverage=4%, E-value=2e-10, Identity=80%"; Hit description=Beta-1, 3-glucan synthase, putative
MDSKIRTLSMLRSRFQSLPGAFNTCLVPSDKKQKGRFSFSKKFAEAA

SEQ ID NO: 225664 - protein, 133 aa, Glycine max
  Coding DNA Sequence Number=SeqID_108886
  Gene Ontology: Mol. function=ubiquitin thiolesterase activity; Biological process=ubiquitin-dependent protein catabolic process
  Homolog annotation: Hit_ID=Q2R2A3; Match level="QueryCoverage=77%, HitCoverage=7%, E-value=1e-40, Identity=75%"; Hit description =Ubiquitin carboxyl-terminal hydrolase family protein, expressed
MSKLLGNICFRFKFDDERVSKEDPKRALEEQYGGEEELPRINPGFNHSPFKFTKHSNAYMLVYVRESDKDKIICNVDEKDIAEHLRMRLKKEQDEKELKRKEKAEAHLYTTIKVTTLSFFYFSVIFGPVKYFV

SEQ ID NO: 225665 - protein, 101 aa, Glycine max
  Coding DNA Sequence Number=SeqID_108887
  Subcellular localization annotation: CTP_CleavageSite=73; ConfidenceScore=5.30e-01
MVLVNDPLVAPVSFSLDLTIVTSLNLGLMSVFFLDLFLSSSKSDSHPNNPISFIPSTRIVPQPIASLSPSSISVASPTSINPTTTDSNSIPSPSVHAESYY

SEQ ID NO: 225666 - protein, 398 aa, Glycine max
  Coding DNA Sequence Number=SeqID_108888
  Gene Ontology: Mol. function=ubiquitin thiolesterase activity; Cellular component=nucleus; Biological process=ubiquitin-dependent protein catabolic process
  Homolog annotation: Hit_ID=Q9FG10; Match level="QueryCoverage=78%, HitCoverage=27%, E-value=1e-164, Identity=88%"; Hit description =Ubiquitin carboxyl-terminal hydrolase
  Pfam annotation: Domain name=UCH; Domain location=77-343; Score =106.7; E_value=6.8e-29; Accession=PF00443.19; Description=Ubiquitin carboxyl-terminal hydrolase
MAAKGESGFSCSRREERKHSQHQFNARESDWGFINFMPLAELYDPARGYLVNDTCVVEADISVRKDMDWSYDSKKETGYVGLKNQGATCYMNSLLQTLYHISYFRKAVYHMPTTENDMPSGSIPLALQSLFYKLQYSDTSVATKELTKSFGWDTYDSFMQHDVQELNRVLCEKLEGKMKGTIVEGTIQQLFEGHHMNYIECINVDYKSTRKESFYDLQLDVKGCKDVYASFDKYVEVERLEGDNKYHAENYGLQDARKGVLFIDFPPVLQLQLKRFEYDFTRDTMVKINDRYEFPLQLDLDRDNGKYLSPEADRSIRNFYTLHRFGGTEDKALKLINNYFQRYSEGIVIQCCQMAAMAERRGGFLKKRHRIAVAWRVANGGAMAVMTVMAAWRKIADF

SEQ ID NO: 225667 - protein, 354 aa, Glycine max
  Coding DNA Sequence Number=SeqID_108889
  Homolog annotation: Hit_ID=O64847; Match level="QueryCoverage=27%, HitCoverage=89%, E-value=8e-22, Identity=56%"; Hit description =UPF0136 membrane protein At2g26240
  Pfam annotation: Domain name=GRP; Domain location=42-109; Score= -26.4; E_value=0.038; Accession=PF07172.2; Description=Glycine rich protein family
  Pfam annotation: Domain name=TMEM14; Domain location=126-223; Score =117.9; E_value=2.9e-32; Accession=PF03647.4; Description =Transmembrane proteins 14C
  Pfam module annotation: Pfam domain module=GRP::TMEM14; Domain location=42-109::126-223
  Subcellular localization annotation: CTP_CleavageSite=56; ConfidenceScore=5.82e-01
MAESVGVAGFGVSGSFSLTRPTIFSRSSNNISLFRSQSHFPAAAFGSLTRSNPHVHAAVTSDSKAATSLDLTQPDLDNSGGGANGNGGGGGGGGGGGGGGEGGGDNSKGEEGSDGDKRKMALLMSQKFTLAYAALVGVGGVMGYLKSGSNKSLLAGGLSASLLYYVYTELPGSPVFASSVGLGISAALLGVMGSRFKKSGKVFPAGVVSLVSLIMTGGRLLSIPTKPNPDDAPASARWLVSLNFWGVLNTISSDLGGAPFGNVVSYSDGLPNESTGIPYFYLTTLDPTARNALQDDKASFTVSEYPLGTCGRRDPMNPTCSKISLTGKLKLVDEKSKEAEFARNALFSKHPEMK

SEQ ID NO: 225668 - protein, 750 aa, Glycine max
  Coding DNA Sequence Number=SeqID_108890
  Gene Ontology: Mol. function=solute:hydrogen antiporter activity; Cellular component=integral to membrane; Biological process =regulation of pH
  Homolog annotation: Hit_ID=Q9LUN4; Match level="QueryCoverage=98%, HitCoverage=90%, E-value=0.0, Identity=64%"; Hit description=Na+/H+ exchangeing protein-like
  Pfam annotation: Domain name=C4dic_mal_tran; Domain location=141-363; Score=-85.9; E_value=0.047; Accession=PF03595.8; Description=C4 -dicarboxylate transportermalic acid transport protein
  Pfam annotation: Domain name=Na_H_Exchanger; Domain location=3-363; Score=207.8; E_value=2.5e-59; Accession=PF00999.11; Description =Sodiumhydrogen exchanger family
  Pfam annotation: Domain name=TspO_MBR; Domain location=137-283; Score= -56.8; E_value=0.064; Accession=PF03073.6; Description=TspOMBR family
  Pfam module annotation: Pfam domain module=C4dic_mal_tran::Na_H _Exchanger::TspO_MBR; Domain location=141-363::3-363::137-283
MQGGILLGPSAIGRNEKFLSTVFPKKSITVLDTLGNVGLLFFLFLVGLELDMRAIRRTGHKALAIALCGITVPFVLGIGTSFALRATVSKGAEPVSFLVFMGVALSITAFPVLARILAELKLLTTDVGRIAMSAAAVNDVAAWILLALAIAISGSNGSPFVPLWVLLSGVAFVIFAVFAIRPLLVAMANRSPEGEPVKEVYICITLTLVLACSFVTDTIGIHALFGAFVIGTIMPKEGSFSVVMIEKIEDLVSGLFLPLFFVSSGLKTNVATISGGLSWAMLVLVIFNACFGKIVGTIVVSLTCKVPSQEAVALGFLMNTKGLVELIVLNIGKDRKVLNDQAFAICVLMALFTTFITTPIVMAVYKPARRGAPYKHRTIQRRDPDTELRMLACFHTTRNIPTLINLIESSRGIRKRGKLCIYAMHLMELSERSSAITMVHKARKNGMPFWNKKPDDKDQMIIAFQAYEKLRSVNVRPMTAISALNSIHEDICTSAHQKRAAMIILPFHKHQRVDGSMESLGHSLHVMNQLVLSHAPCSVGILVDRGLGGTSQVQASDVSYKVVVPFFGGRDDREALCYGMRMAEHPGILLNVVKFVPPPGASLAFGAKLVGMSSNKDKKAMEVVGGSYYDDKQQDDQLWSEFLSACNNNQESMKYEQKLVASKGDIEAALKEMNRSNLILVGRMPSVGPLVSRSDCPELGPVGSYMASSDFSTVTSVMVIQQYNPSTDIHPLVMEEFDYPDKLEPNAPRS

SEQ ID NO: 225669 - protein, 64 aa, Glycine max
  Coding DNA Sequence Number=SeqID_108891
MEEDHKKTLKFLDVTNATNFVTSKLIVLQRKNGLRKVIRKDGSEKEINLLTKNYESEENISQEG

SEQ ID NO: 225670 - protein, 108 aa, Glycine max
  Coding DNA Sequence Number=SeqID_108892
MSNHKSTESALKNLEVQVGQLAKQIADKSSNNFVANTKQNPKEECKVVMTRSKRFVEAEDEDSVVHKKETTDKKGTNCKKNEENIIMEGNCSAVIQKILPPKHKDPGS

SEQ ID NO: 225671 - protein, 74 aa, Glycine max
  Coding DNA Sequence Number=SeqID_108893
MADFKNSFYALSHSKNLRILHMCFLFALSTSNPKALTIQAFSEEIAKCTYRAKRVHPLRMNTHPLGELPVTKRG

SEQ ID NO: 225672 - protein, 125 aa, Glycine max
  Coding DNA Sequence Number=SeqID_108894
MTTLTQIWMALLLSKILPSDHNSDLPLLKWIAPTRHPVDPEKSNRALGFPTLIAGLCQFYEVLVAPSKVIRPPINKAFIEKYCTPRLAQGEAPQQPGDGQQQATDALPPLLESTSAHLQRLERGL

SEQ ID NO: 225673 - protein, 94 aa, Glycine max
  Coding DNA Sequence Number=SeqID_108895
  Subcellular localization annotation: CTP_CleavageSite=42; ConfidenceScore=5.04e-01
MANSHYSKTLHLPCKSFSMAILLVYLLLVGSCTAIRTGATMRLNEGSELLRRKQQQPRFPYKGLVFNFLPKGVPIPPSGPSKRHNSVVASTPKN

SEQ ID NO: 225674 - protein, 61 aa, Glycine max
  Coding DNA Sequence Number=SeqID_108896
  Subcellular localization annotation: CTP_CleavageSite=13; ConfidenceScore=5.06e-01
MKPSKAPTQKSLSSSNASSRKFVSTLHIHIVDLLQEQVFRKGKNSLQNGHSERKSPTDILV

SEQ ID NO: 225675 - protein, 81 aa, Glycine max
  Coding DNA Sequence Number=SeqID_108897
  Gene Ontology: Mol. function=peroxidase activity; Cellular component =vacuole; Biological process=response to oxidative stress
  Homolog annotation: Hit_ID=Q1T3U5; Match level="QueryCoverage=67%, HitCoverage=19%, E-value=6e-18, Identity=78%"; Hit description=Haem peroxidase, plant/fungal/bacterial
MASNIQTLLVLVLATLGTFMIPSNAQLTPNFYKKVCPQALPIIRSVVHRAIIRERRIGASLLRLHFHDCFVNTQLGTNIVV

SEQ ID NO: 225676 - protein, 303 aa, Glycine max
  Coding DNA Sequence Number=SeqID_108898
  Gene Ontology: Mol. function=zinc ion binding; Cellular component =intracellular; Biological process=intracellular protein transport
  Homolog annotation: Hit_ID=P40343; Match level="QueryCoverage=40%, HitCoverage=20%, E-value=1e-12, Identity=30%"; Hit description =Vacuolar protein sorting-associated protein 27
  Pfam annotation: Domain name=FYVE; Domain location=19-83; Score=59.4; E_value=1.2e-14; Accession=PF01363.12; Description=FYVE zinc finger
MKVKIIEREEKLMSTAEAPPPFQEAARCVVCNCSFNTFRRRHHCRSCGRTLCNEHSSDQMALPQFGIYSNVRVCADCFNNSRFNAFKELGRLHRSGKDEPQTSSDGVNSVTDTISKLDINTNVDSKSIPTAENKLVLGIKECKCGMPLCICEAPTPSSDALPQQKPNPVIAAPSNPKSKKTDTVPKNRSSSSTSKFSSMFNVGHVTNGTSDRPQIDYEVTGEGLREAIKNGDIAAVKKLLNEGVDANYRDKQGLSLLHLCPQYYHCLKVLRYQNKNFRLLYNCDRDGVQFIFLKWQTKYADLY

SEQ ID NO: 225677 - protein, 61 aa, Glycine max
  Coding DNA Sequence Number=SeqID_108899
MAGVNPEAGGWKAYPSVMETALDSGDGRSHHNMSDDGSVMHFSATSFYGDLVHEKKTDIHV

SEQ ID NO: 225678 - protein, 479 aa, Glycine max
  Coding DNA Sequence Number=SeqID_108900
  Gene Ontology: Mol. function=receptor activity; Cellular component =anchored to membrane; Biological process=protein amino acid phosphorylation
  Homolog annotation: Hit_ID=Q1SBD8; Match level="QueryCoverage=98%, HitCoverage=98%, E-value=1e-172, Identity=64%"; Hit description =Unnamed protein product; contains similarity to elicitor-inducible receptor EIR gene_id:T5M7.12
  Pfam annotation: Domain name=LRR_1; Domain location=147-170; Score =13.1; E_value=1; Accession=PF00560.23; Description=Leucine Rich Repeat
  Pfam annotation: Domain name=LRR_1; Domain location=172-194; Score =10.9; E_value=2.5; Accession=PF00560.23; Description=Leucine Rich Repeat
  Pfam annotation: Domain name=LRR_1; Domain location=196-218; Score =16.4; E_value=0.11; Accession=PF00560.23; Description=Leucine Rich Repeat
  Pfam annotation: Domain name=LRR_1; Domain location=220-242; Score =10.3; E_value=3.4; Accession=PF00560.23; Description=Leucine Rich Repeat
  Pfam annotation: Domain name=LRR_1; Domain location=244-266; Score =8.2; E_value=8.5; Accession=PF00560.23; Description=Leucine Rich Repeat
  Pfam annotation: Domain name=LRR_1; Domain location=268-290; Score =8.2; E_value=8.2; Accession=PF00560.23; Description=Leucine Rich Repeat
  Pfam annotation: Domain name=LRR_1; Domain location=292-315; Score =13.4; E_value=0.85; Accession=PF00560.23; Description=Leucine Rich Repeat
  Pfam annotation: Domain name=LRR_1; Domain location=317-339; Score =14.4; E_value=0.41; Accession=PF00560.23; Description=Leucine Rich Repeat
  Pfam annotation: Domain name=LRR_1; Domain location=341-363; Score =10.4; E_value=3.2; Accession=PF00560.23; Description=Leucine Rich Repeat
  Pfam annotation: Domain name=LRR_1; Domain location=365-390; Score =9.6; E_value=4.6; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=147 -170::172-194::196-218::220-242::244-266::268-290::292-315::317 -339::341-363::365-390
MKSTKAISHAIFVIFILSVSARCCGQEDLDNDILAPMEKAEQEALYSTIQGFVGDSWNGSDLYPDPCGWTPIQGVSCDLFDGFWYVTALNIGPVHDNSLSCAQELEFRRELFELKHLKALSFFNCFQSQDMFPATIPTGNWQKLAGSLESLEFRSNPGLIGNIPSSFSALKNLQSLVILENSVTGEIPSSIGNLIKLKKLVLAGNYLTGSIPDVFDGLNELLIFDLSSNSLSGSLPLTLGSLTSALKLDVSYNHLEGNLLNAFANLKYLTLMDLRNNRFTGGLTLSLQEMSSLEELVLSNNPLGGDIRFLKWENLNNLAILELSNMGLTGEIPESLSELKLLRFLGLSDNNLTGNLSPKLETLPCLNALYLSGNNLTGEINFSKDFFGKMGRRFGAWNNPNLCYQIGLMSSSHVPFGVKPCQKEVNLLESDSKTELINGDMNETFHFIASKGFSSCATDGFWWTFLEKILMMGLFLSLI

SEQ ID NO: 225679 - protein, 113 aa, Glycine max
  Coding DNA Sequence Number=SeqID_108901
MMTIDVDSVGNHGGGGDMVITLVVVIATTLLLLVAVTSGIDGDGSNVGDVEDEGGNCDDNIDSDNDSVSSGAMVSYNKSDIGSGGSDNDIDGSNSGNGSNSNGNNSKKCHNQI

SEQ ID NO: 225680 - protein, 356 aa, Glycine max
  Coding DNA Sequence Number=SeqID_108902
  Homolog annotation: Hit_ID=Q1WX71; Match level="QueryCoverage=59%, HitCoverage=91%, E-value=9e-08, Identity=24%"; Hit description =Glycosidases
  Subcellular localization annotation: CTP_CleavageSite=77; ConfidenceScore=5.54e-01
MAYLVGYDPCSHLSKAFSQYPSLSFSDRGSYLSFPFLRNLVYANVFGVSRSIGFGTRGCSFDTSGSCSGNSDRIFVRAKTRSRGFASNRRQPMLADLEQRNSVRSDESDATLVKVDNGSINGSPAKPPCFSDHRLSQKLVVAVDVDEVLGNFVSALNKFIADRYSSNYSVSEYHVYEFCKIWNCSRDEADIRVHEFFKTPYFKSGIHPLPGAQMALQKLSRFCSLSVVTYAFGIELSSTCKGILSRQNAIKDRTIEWIEKNYPGLFREIHFGNHFALDGVSRPKSEICRSLKAKVLIDDNPRYAIECADVGIRVLLFDYENSYPWCKNESVDQHPLVTKVKNWEEVEQQLVSLIAS

SEQ ID NO: 225681 - protein, 495 aa, Glycine max
  Coding DNA Sequence Number=SeqID_108903
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q84MU5; Match level="QueryCoverage=93%, HitCoverage=94%, E-value=1e-163, Identity=59%"; Hit description =Putative 1,3-beta-glucanase
  Pfam annotation: Domain name=Glyco_hydro_17; Domain location=28-347; Score=274.8; E_value=1.7e-79; Accession=PF00332.9; Description =Glycosyl hydrolases family 17
  Pfam annotation: Domain name=X8; Domain location=365-451; Score =124.2; E_value=3.6e-34; Accession=PF07983.3; Description=X8 domain
  Pfam module annotation: Pfam domain module=Glyco_hydro_17::X8; Domain location=28-347::365-451
MGLQHFTTCVLLALCILSQGLAKGAHGFACNWGTRLTHPLPPQITVKLMKDNGFKQVKLFEADPAALKALGNSGIQVMVGIPNDLLATLASNVDAAIAWVNQNVSSYISKNGVDIRYVAVGNEAFLKTYNGRFVNSTFPAIQNIQAALIKAGLGRQVKVTTPLNADVYQSDSSLPSGGNFRPDIHDQMISIIKFLSQNGGPLTFNIYPFLSLDADPHFPKEFAFFDGSAAPVVDGSITYTNVFDANYDTLISALEKNGFGQMPVIIGEVGWPTDGTANANIKNARRFNQGLIDRIVKRQGSPKRPSPPDIYLFGFIDEDAKSIEPGPFERHWGVFNFDGSIKYPLNLGGGKQLVGAKGVRYLPKQWCVMSTQANVDPNALAESMSKACTYADCTSLSPGSSCSGLDTRGNASYAFNMYYQAMNQQKGACNFNGLSVITNINPSPPQSSCQFKIMIDLGKHEKKSTSSSVAPERKLHSMVMLVSSFIFTVMLLLCV

SEQ ID NO: 225682 - protein, 1801 aa, Glycine max
  Coding DNA Sequence Number=SeqID_108904
  Gene Ontology: Mol. function=ARF guanyl-nucleotide exchange factor activity; Cellular component=intracellular; Biological process =regulation of ARF protein signal transduction
  Homolog annotation: Hit_ID=UPI000034EFAB; Match level="QueryCoverage =96%, HitCoverage=96%, E-value=0.0, Identity=66%"; Hit description =guanyl-nucleotide exchange factor
  Pfam annotation: Domain name=DUF1981; Domain location=1062-1133; Score=39.2; E_value=1.4e-08; Accession=PF09324.1; Description=Domain of unknown function (DUF1981)
  Pfam annotation: Domain name=HEAT; Domain location=1028-1064; Score =2.0; E_value=25; Accession=PF02985.12; Description=HEAT repeat
  Pfam annotation: Domain name=HEAT; Domain location=1073-1110; Score =9.8; E_value=2.8; Accession=PF02985.12; Description=HEAT repeat
  Pfam annotation: Domain name=HEAT; Domain location=1216-1251; Score =3.8; E_value=15; Accession=PF02985.12; Description=HEAT repeat
  Pfam annotation: Domain name=HEAT; Domain location=1324-1359; Score =1.7; E_value=27; Accession=PF02985.12; Description=HEAT repeat
  Pfam annotation: Domain name=Sec7; Domain location=556-751; Score =167.1; E_value=4.5e-47; Accession=PF01369.11; Description=Sec7 domain
  Pfam module annotation: Pfam domain module=DUF1981::HEAT::HEAT::HEAT:: HEAT::Sec7; Domain location=1062-1133::1028-1064::1073-1110::1216 -1251::1324-1359::556-751
MAGGAAGGFVTRAFDSILKECSSVKKFPELQKAIQNYTDITKQASQKKQSEVNQGAPSAESGSTNETEGGAATRTEADQFQKAEHASDDRPKIGNINVVLASAGNTLEGADAELVLNPLRLAFETKNLKILESALDCLHKLIAYDHLEGDPGLEGGKNVPLFTDILNMVCSCVDNSSPDSTILQVLKVLLTAVASTKFRVHGEPLLGVIRVCYNIALNSKSPINQATSKAMLTQMISITFRRMETDPVGHLNFLVEASSASSGHTISKAASAENLNSKSDESSTGDSNEKEMTLGDALSQAKDASPTSLEELQNLAGGADIKGLEAVLDKAVHTEDGKKITRGIDLESMSIVQRDALLVFRTLCKMGMKEDNDEVTTKTRILSLELLQGLLEGVSHSFTKNFHFIDSVKAYLSYALLRASVSQSPVIFQYATGIFLVLLLRFRESLKGEIGIFFPLIVLRPLDGLEFPVNQKLSVLRMLEKVCKDPQMLVDIFVNYDCDLEAPNLFERMVTTLSKIAQGTQNTDPNSAALSQTASVKGSSLQGLVSVLKSLVDWEQSHRELEKLKNNQQEGISAGDSSEIRSREDVTSDFEKAKAHKSTLEAAIAEATIGDYLGQHEEFPLAVMHAYVDSMKFSGFKFDTAIREFLKGFRLPGEAQKIDRIMEKFAERSVLVLVVYGRYCADNPGLFKNADTAYVLAYAVIMLNTDAHNPMVWPKMSKSDFVRMNARDDLDECAPKELLEEIYDSIVKEEIKMKDDTSLIGKSSRQKPEGEEGRLVSILNLALPKRKSSGDAKSESEAIIKKTQAIFRNKGVKRGVFYTAQQIELVRPMVEAVGWPLLATFSVTMEEGDNKPRVVLLMEGFKAGIHITFVLGMDTMRYAFLTSLVRFTFLHAPKEMRSKNVEALRTLLVLCDSDMNALQDTWNAVLECVSRLEFITSTPSISVTVMHGSNQISKDAVVQSLKELAAKPAEQVFMNSVKLPSDSVVEFFTALCGVSAEELKQTPARVFSLQKLVEISYYNMARIRMVWARIWSVLANHFISAGSHHDEKIAMYAIDSLRQLSMKYLERAELANFSFQNDILKPFVVLMRNSQSESKRRLIVDCIVQLLQMMNWNQLSRVHLKMLSRSKSTIAFVVYLTHGHFTVILEHFDQVVGDCFMDCVNCLIRFANNKTSHRISLKAIALLRICEDRLAEGLIPGGTLMPIDATLDATFDVTEHYWFPMLAGLSDLTSDQRQEVRSCALEVLFDLLNERGSKFSTAFWESIFHRVLFPIFDHVRHAGKEGFISPDDDWFRETSIHSLQLLCNLFNTFYKITHEESCFQEVCFMLPPLLGLLLDCAKKTDQTVVSISLGALVHLIEVGGHQFSESDWDTLLKSIRDASYTTQPLELLNVLSFENLRNHGSIISDSEGNAGDSGTTRSIDNEVIGDRQLDVNSNGKLSPLASSNTNADGVEDSISQTNVDQSEGLPSPSGRTPKAADGEGFQRSQTLGQRIMGNMENLFLRNLTKSKSHISDASQSSSPIKVADAVEPDTKNEESPLLVTVRGKCITQLLLLGAIDGIQVLEKCLYEEVPLHTVCEEKRENKKYWTKLKSQQKVSIMDILLSLLEFAASYNSSTNLRTRMHQIPDERTLRFTKLFLDRPPINLLRQELAGTGIYLDILQKATYGFETKKEKSPESVGFQDVDSTEVNGLSITQDSDSEVKFERLAEEKLVSFCEQVLREASDLQSITGETTNMDIHRVLELRAPIIVKIFTLPVNQIMPPHLFRNCFKLLLLMKSLNMVWHLLACRLHKLIVDHGSPLISK

SEQ ID NO: 225683 - protein, 720 aa, Glycine max
  Coding DNA Sequence Number=SeqID_108905
  Gene Ontology: Mol. function=oxidoreductase activity; Cellular component=mitochondrion; Biological process=electron transport
  Homolog annotation: Hit_ID=Q8H770; Match level="QueryCoverage=97%, HitCoverage=67%, E-value=0.0, Identity=73%"; Hit description =Bifunctional lysine-ketoglutarate reductase/saccharopine dehydrogenase
  Pfam annotation: Domain name=AlaDh_PNT_C; Domain location=178-382; Score=96.9; E_value=6.2e-26; Accession=PF01262.12; Description =Alanine dehydrogenasePNT, C-terminal domain
  Pfam annotation: Domain name=AlaDh_PNT_N; Domain location=9-138; Score=71.1; E_value=3.5e-18; Accession=PF05222.5; Description =Alanine dehydrogenasePNT, N-terminal domain
  Pfam annotation: Domain name=Saccharop_dh_N; Domain location=458-564; Score=143.6; E_value=5.5e-40; Accession=PF04455.3; Description=LORSDH bifunctional enzyme conserved region
  Pfam annotation: Domain name=ThiF; Domain location=565-692; Score= -47.3; E_value=0.033; Accession=PF00899.11; Description=ThiF family
  Pfam module annotation: Pfam domain module=AlaDh_PNT_C::AlaDh_PNT _N::Saccharop_dh_N::ThiF; Domain location=178-382::9-138::458 -564::565-692
MDEELGQLESVNKWERRAPLTPSHCARLLHGGTGVSRIIVQPSTKRIHHDALYEEVGAEISQDLSQCGLILGIKQPKLEMILPDRAYAFFSHTHKAQKENMPLLDKILAERASLYDYELIVGDNGKRLLAFGKFAGRAGMIDFLRGLGQRFLSLGYSTPFLSLGSSYMYPSLAAAKAAVISVGEEIATQGLPLGICPLVFVFTGSGNVCSGAQEIFKLLPHTFVDPSKLRDLHRTDKDQPRHASKRVFQVYGCVVTAQDMVEPKDHVIVFDKADYYSHPEHYNPTFHEKIAPYASVIVNCMYWEKRFPQLLSYKQMQDLMSQGCPLVGIADITCDIGGSIEFVNRATSIDSPFFRYDPLTNSYHDDMEGNGVICLAVDILPTEFAKEASQHFGNILSQFVINLASATDITKLPAHLRRACIANKGVLTSLYDYIPRMRSSDSEEVSENAENSLSNKRKYNISVSLSGHLFDQFLINEALDIIEAAGGSFHLVNCHVGQSVEAVSFSELEVGADDRAVLDQIIDSLTAIANPTENDRFSNQDSSKISLKLGKVEENGIEKESDPRKKAAVLILGAGRVCQPAAEMLSSFGRPSSSQWYKTLLEDDFECQIDIEIIVGSLYLKDAEQTVEGIPNVTGVQLDVMDHANLCKYIAQVNVVISLLPPSCHIIVANACIELKKHLVTASYVDSSMSMLNDKAKDAGITILGEMGLDPGIGRELFDN

SEQ ID NO: 225684 - protein, 516 aa, Glycine max
  Coding DNA Sequence Number=SeqID_108906
  Gene Ontology: Mol. function=aspartyl esterase activity; Cellular component=cell wall; Biological process=cell wall modification
  Homolog annotation: Hit_ID=Q43062; Match level="QueryCoverage=93%, HitCoverage=91%, E-value=0.0, Identity=67%"; Hit description =Pectinesterase PPE8B precursor
  Pfam annotation: Domain name=PMEI; Domain location=21-165; Score =65.9; E_value=1.3e-16; Accession=PF04043.6; Description=Plant invertasepectin methylesterase inhibitor
  Pfam annotation: Domain name=Pectinesterase; Domain location=203-500; Score=750.2; E_value=1.3e-222; Accession=PF01095.10; Description =Pectinesterase
  Pfam module annotation: Pfam domain module=PMEI::Pectinesterase; Domain location=21-165::203-500
  Subcellular localization annotation: CTP_CleavageSite=43; ConfidenceScore=5.47e-01
MAIPSLVNQPLAFSFSFLLFLALCTPLAANNTDFGGSACLKVSPTHFAGSVTEVITAIRQVASILSRFSPPFANFRLATALADCLDLLDLSSDVLSWALSASQNPKGKHNSTGNLSSDLRTWLSAALAHPETCMEGLEGTNSIVKGLVSAGIGQVVSLVEQLLAQVVPVQDQFDDASSKGQFPLWVKPKEKKLLQSIGMTAADVTVALDGSGNYAKIMDAVLAAPDYSMKRFVILVKKGVYVENVEIKRKKWNIMMVGEGMDSTIISGNRSVVDGWTTFRSATFAVSGRGFIARDISFQNTAGPEKHQAVALRSDTDLSVFFRCGIFGYQDSLYTHTMRQFFRECTITGTVDYIFGDATAVFQNCFLRVKKGLPNQKNTITAHGRKDPNEPTGFSFQFCNITADSDLVPWVSSTQSYLGRPWKSYSRTVFMQSYMSEVIRGEGWLEWNGNFALETLYYGEYMNTGAGAGLANRVKWPGYHPFNDSNQASNFTVAQFIEGNLWLPSTGVTYTAGLIL

SEQ ID NO: 225685 - protein, 84 aa, Glycine max
  Coding DNA Sequence Number=SeqID_108907
  Gene Ontology: Mol. function=enzyme inhibitor activity; Cellular component=cell wall; Biological process=cell wall modification
  Homolog annotation: Hit_ID=Q9MBB6; Match level="QueryCoverage=94%, HitCoverage=13%, E-value=6e-32, Identity=81%"; Hit description =Pectin methylesterase
  Pfam annotation: Domain name=Pectinesterase; Domain location=8-84; Score=-145.3; E_value=1.2e-10; Accession=PF01095.10; Description =Pectinesterase
MDNKPTPNVTVAKDGSGDFKTISECLNAVPQKYEGRYVIFVKEGVYDETVTVTKKMQNITMYGDGSQKSIITGSKNYRDGVRAS

SEQ ID NO: 225686 - protein, 520 aa, Glycine max
  Coding DNA Sequence Number=SeqID_108908
  Gene Ontology: Mol. function=enzyme inhibitor activity; Cellular component=cell wall; Biological process=cell wall modification
  Homolog annotation: Hit_ID=Q69Y54; Match level="QueryCoverage=87%, HitCoverage=82%, E-value=1e-120, Identity=48%"; Hit description =Putative pectin methylesterase
  Pfam annotation: Domain name=PMEI; Domain location=27-175; Score =54.8; E_value=2.8e-13; Accession=PF04043.6; Description=Plant invertasepectin methylesterase inhibitor
  Pfam annotation: Domain name=Pectinesterase; Domain location=210-506; Score=693.2; E_value=1.9e-205; Accession=PF01095.10; Description =Pectinesterase
  Pfam module annotation: Pfam domain module=PMEI::Pectinesterase; Domain location=27-175::210-506
  Subcellular localization annotation: CTP_CleavageSite=69; ConfidenceScore=5.75e-01
MAIPSPKIFLLLTFFFSHSIAVKSSNVSTTPTLHATFPFPEVSSFNSSKLSISININPNIINTLLQSLQAAISEATKLSDLLNNAGHNIIENKIGAVQDCRELQQSTLASLKRSLSGIRSQDSRKLVDARTYLSAALTNKDTCLESLDSASGTLKPVLVNSVINSYKDVSDSLSMLPKPERKASKGHKNRRLLWLSTKNRRLLQSNDGGELVVAADGTGNFSTITEAINFAPNNSVGRTVIYVKEGTYEENVEIPSYKTNIVLLGDGKDVTFITGNRSVIDGWTTFRSATLAVSGEGFLARDIAFENKAGPEKHQAVALRVNADFTAFYRCAMYGYQDTLYVHSFRQFYRECEIFGTIDYIFGNAAVVLQASNIITRMPMLGQFTVITAQSRDSPDEDTGISIQNCSILATTDLYSNSGSVKSYLGRPWRVYSRTVFLESYIDQFIDPMGWKEWSGDQGLDTLYYGEYANYGPGSGTDNRVNWAGFHVMDYDSAYNFTVSEFIIGDAWLGSTSFPYDDGI

SEQ ID NO: 225687 - protein, 69 aa, Glycine max
  Coding DNA Sequence Number=SeqID_108909
MTYTAKKGSEGAKRVNRTSPKISYDFWVASWLAGPGQIDPLILKGKIRPGRMELLLVLLQLLITLLTRE

SEQ ID NO: 225688 - protein, 176 aa, Glycine max
  Coding DNA Sequence Number=SeqID_108910
  Gene Ontology: Mol. function=enzyme inhibitor activity
  Homolog annotation: Hit_ID=Q4PT42; Match level="QueryCoverage=44%, HitCoverage=30%, E-value=9e-08, Identity=33%"; Hit description =Invertase
  Pfam annotation: Domain name=PMEI; Domain location=17-171; Score =80.4; E_value=5.6e-21; Accession=PF04043.6; Description=Plant invertasepectin methylesterase inhibitor
MASRKALNQWLVMPILLMNCFVLLGQCARPLNTEEGEDLSLLAKTSDLKVLAEIALNLSTTYAADTLSYVHELQSNSSAANGSNNNIYASRCLSDYAEEYSEAIENLKDSKEALANGDCDQVDTLVSAAMSDAETCEDGFKDMQSGDSDSTSPLTERNRYFSELCSNALAITKLLV

SEQ ID NO: 225689 - protein, 223 aa, Glycine max
  Coding DNA Sequence Number=SeqID_108911
  Gene Ontology: Mol. function=enzyme inhibitor activity; Cellular component=cell wall; Biological process=cell wall modification
  Homolog annotation: Hit_ID=Q9MBB6; Match level="QueryCoverage=98%, HitCoverage=36%, E-value=3e-80, Identity=63%"; Hit description =Pectin methylesterase
  Pfam annotation: Domain name=Pectinesterase; Domain location=1-208; Score=314.3; E_value=2.1e-91; Accession=PF01095.10; Description =Pectinesterase
MGFRNTAGPDGHQAVAARVQADRAVFANCRFEGYQDTLYTQAHRQFYRSCIIAGTIDFIFGAAVVFQNWMFQNCIMVVRKPLDNQQNMVTTQGRVDKQQATGIVLQKCTIKSDDSLVPVKDTIRSYLGRPWKEFSRTVVMESEIGDFIHPDGWTAWAGNFALKTLYYAEYANTGPGASTNARIKWPGYRVINKDEATQFTVGSFMKGTWIQNTGVPSTQGLYN

SEQ ID NO: 225690 - protein, 141 aa, Glycine max
  Coding DNA Sequence Number=SeqID_108912
  Gene Ontology: Mol. function=transcription regulator activity; Cellular component=nucleus; Biological process=regulation of transcription
  Homolog annotation: Hit_ID=Q10LR1; Match level="QueryCoverage=84%, HitCoverage=69%, E-value=1e-16, Identity=44%"; Hit description=BHLH transcription factor bHLH033, putative, expressed
MERIPCFIMQRPKASVLFQVSDYIQGLKQKLEELNQLTVATARKIVDYDPMPKLEVETQEEGFVIKVLSESSCQGLLVFILEAFEELGLDVLQARVSCAHSFSLEALGNKENNEDTRPLDAQLVEQVVSQAIQNWREVSQI

SEQ ID NO: 225691 - protein, 101 aa, Glycine max
  Coding DNA Sequence Number=SeqID_108913
  Gene Ontology: Cellular component=nucleus
  Homolog annotation: Hit_ID=Q6Z6T3; Match level="QueryCoverage=72%, HitCoverage=22%, E-value=2e-18, Identity=67%"; Hit description =Nuclear protein-like
MKTACSKHEIIIQTDPKNCEYVIISDSGAQRKTEDFDVEDAETFELPADEEREKLAEPVIVCLHVKRKELLQKKLLPASEGIDQCWLHLPRIISKNVSLEM

SEQ ID NO: 225692 - protein, 105 aa, Glycine max
  Coding DNA Sequence Number=SeqID_108914
RSFLIGAVVVSSFGYRKERDGSLVKNGAQPNDDERHLPVEGDSSLLQSILDRFDGLQTYVGERFDSLERQVDTRFEEMNSRIAKVEEDVTIIRDCLDLPPPPPSV

SEQ ID NO: 225693 - protein, 797 aa, Glycine max
  Coding DNA Sequence Number=SeqID_108915
  Gene Ontology: Mol. function=phosphatidylinositol phosphate kinase activity; Cellular component=mitochondrion; Biological process =phosphatidylinositol metabolic process
  Homolog annotation: Hit_ID=Q1RTC2; Match level="QueryCoverage=99%, HitCoverage=43%, E-value=0.0, Identity=57%"; Hit description =Chaperonin Cpn60/TCP-1; Phosphatidylinositol-4-phosphate 5-kinase; Zinc finger, FYVE/PHD-type
  Pfam annotation: Domain name=PIP5K; Domain location=536-771; Score =183.5; E_value=5.3e-52; Accession=PF01504.9; Description =Phosphatidylinositol-4-phosphate 5-Kinase
MGSFGKMVACFRYASIHLHSVYLPPPKLEFNYDSQDWLQKEANELHNKAEILFSEVCNVLHQISEKVSGPVLQEGGNRVSDFRNLVAELKGMLLYEKEEFEDSLQRLLHKEGKVGQPVIDILELNKLCRHIHIHSYVWDQRLIYASNLSKIILQENLKSLNHREKLLGSREKVIEADVATRPARGHSSCDSFLLGTKPDGNLNLENTSHLSHPVVKSEDKGKDTNHDKVDLSLSGGANINDKSDSVEFGGAVRRALSEGESPFVANLSDTLDAAWTGEGHPTNLSLKENGCLPPDAAAVAVHSPVANIVTSKSNSDIYSANIGGIEAGCTNYSKLLSKGLDTKWKGIPFANVFGSFNKTSSFNTEKLVEYNPVHILSFRELERQTGARLLLPASTNDTIVPVYDDEPTSVIAYVLVSMDYHMQMLEYDRPKESGDSSISLPLFDSTSLLSLNSFDETITNTYRSLGSFDENVLPTSGSRSLPAGDPFSYTKDLHARVSFTDDGSLGKVKYTVTCYYAKRFEALRRTCCPSELDFVRSLSRCKKWGAQGGKSNVFFAKTLDDRFIIKQVTKTELESFTKFAPAYFKYLSESISTGSPTCLAKILGIYQVTSKHLKGGKETKMDVLVMENLLYRRNIRRLYDLKGSSRSRYNPDTSGSNKVLLDQNLIEAMPTSPIFVGNKAKRLLERAVWNDTAFLASIYVMDYSLLVGVDEEKHELVLGIIDFMRQYTWDKHLETWVKTSGILGGPKNTSPTVISPQQYKKRFRKAMSLYFLMVPDQWSPPELHPSGSQSDICDENA

SEQ ID NO: 225694 - protein, 73 aa, Glycine max
  Coding DNA Sequence Number=SeqID_108916
MGVYASRVLSKEDLEVYAEELVQRARFAKRGDPLSTKESMFNAKKNPRKHEIRESRTRRAANSSKKVFVASRA

SEQ ID NO: 225695 - protein, 378 aa, Glycine max
  Coding DNA Sequence Number=SeqID_108917
  Gene Ontology: Mol. function=transferase activity, transferring glycosyl groups; Cellular component=intracellular; Biological process=protein amino acid ADP-ribosylation
  Homolog annotation: Hit_ID=Q9ZP54; Match level="QueryCoverage=86%, HitCoverage=32%, E-value=1e-81, Identity=50%"; Hit description=Poly [ADP-ribose] polymerase 1 (EC 2.4.2.30) (PARP-1) (ADPRT 1) (NAD(+) ADP-ribosyltransferase 1)
  Pfam annotation: Domain name=PADR1; Domain location=200-253; Score =110.1; E_value=6.4e-30; Accession=PF08063.2; Description=PADR1 (NUC008) domain
  Pfam annotation: Domain name=zf-PARP; Domain location=24-92; Score= -14.7; E_value=0.029; Accession=PF00645.8; Description=Poly(ADP -ribose) polymerase and DNA-Ligase Zn-finger region
  Pfam module annotation: Pfam domain module=PADR1::zf-PARP; Domain location=200-253::24-92
MVEHANQGSKSPEFWPLLLGLTGNLASSQFSSPSFDHEVRISTKQGGQGAKGLAWHHAKCLIDLSPSIEVDKLSGWNNLSSSDQSAVIDFAKKGGSDTKIETEEGKESTPQQTSKGGIKRGKDVDSERKSKVAKAKGDVSVGSAMSVKSGEACDLEKKMETQSKELWDLKDDLKKHVTTTELREMLEASGQDSTGSELDLRDRCADGMMFGALDLCPICSGFLRYSGGMYRCHGYISEWSKCSYSTCEPKRIEGKWKIPKETNNQYLKKWFKSQKGKKPVRILPLPSPRKSAESQMIASQHQSSNSGNLRDLKVAICGLPNDSIAEWKCKIDGICGMFHAKVNKDTNCLVVGGSLNYEAEMRKARYDALKLSISTLFD

SEQ ID NO: 225696 - protein, 227 aa, Glycine max
  Coding DNA Sequence Number=SeqID_108918
  Gene Ontology: Mol. function=deoxyhypusine monooxygenase activity; Cellular component=cellular_component; Biological process=hypusine biosynthetic process from peptidyl-lysine
  Homolog annotation: Hit_ID=Q94JW0; Match level="QueryCoverage=92%, HitCoverage=90%, E-value=9e-64, Identity=54%"; Hit description =Deoxyhypusine hydroxylase
  Pfam annotation: Domain name=HEAT_PBS; Domain location=191-217; Score= 11.9; E_value=2.2; Accession=PF03130.6; Description=PBS lyase HEAT -like repeat
  Pfam annotation: Domain name=HEAT_PBS; Domain location=33-59; Score =1.7; E_value=59; Accession=PF03130.6; Description=PBS lyase HEAT -like repeat
  Pfam annotation: Domain name=HEAT_PBS; Domain location=64-90; Score =27.5; E_value=4.8e-05; Accession=PF03130.6; Description=PBS lyase HEAT-like repeat
  Pfam annotation: Domain name=HEAT_PBS; Domain location=97-123; Score =26.4; E_value=0.0001; Accession=PF03130.6; Description=PBS lyase HEAT-like repeat
  Pfam module annotation: Pfam domain module=HEAT_PBS::HEAT_PBS::HEAT _PBS::HEAT_PBS; Domain location=191-217::33-59::64-90::97-123
MVMDSWNDVALVSSEMEKFLCELLLDSSQPISERFRAFFSLRNLKGASTRNALILATRDSSNLLAHEAAFALGHMQELEAIPALASVLNDLSLHHIVRHEAAEALGAIGSDGNVPLLKNSLDSDPAEEVRETCELALERIQNLKDAGNTDVLLRMMYLLLCLLIQLHQRPLVLLLINQDKCLLMKKQGMYERYAALFALRNDGGNDAVAAIIDSLGSKSALLCHEVR

SEQ ID NO: 225697 - protein, 283 aa, Glycine max
  Coding DNA Sequence Number=SeqID_108919
  Gene Ontology: Mol. function=mannosyl-oligosaccharide 1,2-alpha -mannosidase activity; Cellular component=membrane; Biological process=transport
  Homolog annotation: Hit_ID=Q7XZU2; Match level="QueryCoverage=83%, HitCoverage=28%, E-value=2e-87, Identity=70%"; Hit description=SAC domain protein 3
  Pfam annotation: Domain name=Syja_N; Domain location=122-280; Score= -42.1; E_value=1.3e-08; Accession=PF02383.9; Description=SacI homology domain
MNLVTLLLPLINPLLLLLLLPMSVCRNLGYMRLDRFESGLSLASHHALDPWMYVLSSLNFYMIGRDKSRTYWKVLKIDRLDPSELNLREDSTTYTESECSDLLRRIHEGNKSTGGLKFVTTCYGIVGFIKFLGPYYMLLITKRRQIGAICGHTVYAVSKSEMIPLPNSSVRSNINSKNENRYKRLLCMVDLTKDFFFSYSYHIMRSLQRNMCDDETGHILYETMFVWNEFLTRGIRNHLQNTIWTVALVYGFFKQVKTGNAYDIQTGVHTYAHCKTITSLCWH

SEQ ID NO: 225698 - protein, 58 aa, Glycine max
  Coding DNA Sequence Number=SeqID_108920
MDTRAVTKKGRKKLNPRAWVCRCWVDWSVVIAFGSIVLWGFAYDQAFATATTTKVMVT

SEQ ID NO: 225699 - protein, 511 aa, Glycine max
  Coding DNA Sequence Number=SeqID_108921
  Gene Ontology: Mol. function=zinc ion binding
  Homolog annotation: Hit_ID=Q6Z4J7; Match level="QueryCoverage=85%, HitCoverage=82%, E-value=1e-161, Identity=64%"; Hit description =LAs17 Binding protein-like
  Pfam annotation: Domain name=DUF500; Domain location=350-509; Score =212.3; E_value=1.1e-60; Accession=PF04366.3; Description=Family of unknown function (DUF500)
  Pfam annotation: Domain name=FYVE; Domain location=169-237; Score =87.2; E_value=5e-23; Accession=PF01363.12; Description=FYVE zinc finger
  Pfam module annotation: Pfam domain module=DUF500::FYVE; Domain location=350-509::169-237
MASSDGRVTYSSLSKLEKENTHFGYDDINHHVESVWSELMPGTPCGQLVPTLSNKETLYQFPSEDDDLFDGGYESGDDARGIVPSNRPPEVNLKNVLSGIFAILSGRTKAPSVTANQQLPSSNVSFFDSGKNGDVFLDSSVYTPSAPPLCLPNGIDYSSYKEVLEAEPPEWLPDSSTTVCMQCSAPFTAITRGRHHCRFCGGIFCRTCTKGRCLMPVGFRERNPQRVCDACYDRLDPLQGVLINTISNAVQGAKHDVTDWTCARGWINLPIGLSMEHEIYKASNTLRNYCQVAKSNPEKSIPLTVLKSAKGLAILTVAKAGALVSYKLGTGLVVARRSDGSWSAPSAIFSLGLGWGAQIGGELMDFIVVLRDMKAVKTFCSRMHFSLGAGCSAAAGPVGRVLEADIRAGDRGSGMCYTYSCSKALRGGAMIGTWMMFESIANDMECCQTVGAFVGVSLEGNIVATRMDANLCFYGDPYLTTSDILLGMVDRPKAAQPLYGSLQELYSCLRF

SEQ ID NO: 225700 - protein, 208 aa, Glycine max
  Coding DNA Sequence Number=SeqID_108922
  Homolog annotation: Hit_ID=Q9M2J7; Match level="QueryCoverage=63%, HitCoverage=61%, E-value=4e-45, Identity=65%"; Hit description=LOB domain-containing protein 29
  Pfam annotation: Domain name=DUF260; Domain location=7-108; Score =222.5; E_value=9.4e-64; Accession=PF03195.5; Description=Protein of unknown function DUF260
MTGSGSPCGACKFLRRKCVRGCVFAPYFCHEQGSTHFAAIHKVFGASNVSKHLAHLPVSDRCEAAVTISYEAQARLQDPIYGCVAHIFALQQQVVSLQAQLVYLREQASQIYLNGSATENPNEKYLGKPTTFPQDLQSWFQMENSNLASQFLPNLSTNPSTQYYGNTNTLVEPNPIGNYENSGTVEESISFSSFKESCNSMSYDMQRQ

SEQ ID NO: 225701 - protein, 199 aa, Glycine max
  Coding DNA Sequence Number=SeqID_108923
  Homolog annotation: Hit_ID=Q40538; Match level="QueryCoverage=20%, HitCoverage=71%, E-value=1e-07, Identity=80%"; Hit description =Nicotiana tabacum (clone 5) activating factor DNA sequence
MPGVISYLESCPDVTDLKIAAYPPCPHALVSRWTCTHGQNVLTLPSDLVQFLKCSDGLHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 225702 - protein, 106 aa, Glycine max
  Coding DNA Sequence Number=SeqID_108924
  Gene Ontology: Mol. function=nucleic acid binding; Cellular component= ribonucleoprotein complex; Biological process=nuclear mRNA splicing, via spliceosome
  Homolog annotation: Hit_ID=Q6PBZ6; Match level="QueryCoverage=79%, HitCoverage=36%, E-value=3e-22, Identity=58%"; Hit description =Snrpb2 protein
  Pfam annotation: Domain name=RRM_1; Domain location=16-88; Score =31.6; E_value=2.7e-06; Accession=PF00076.12; Description=RNA recognition motif. (a.k.a. RRM, R
MTAPATQTVITVGQTLYINNINDRIRKKELRESLYYLFSQHGRVLDIVALKTMKMRGQAFVVFDTAPAATVAMRELQGFPLYDKNMVRLEFCRSSCCIDISTGFGC

SEQ ID NO: 225703 - protein, 101 aa, Glycine max
  Coding DNA Sequence Number=SeqID_108925
MPISPYGRVMPTRHPVDPEEPNRALGFPALVSGLCQSYRVPVPPARSCHRDIGIAPARHPVDPEKSNGVLGFPALVTGRCQSYRVLVPPNKIIRPLLIGLS

SEQ ID NO: 225704 - protein, 282 aa, Glycine max
  Coding DNA Sequence Number=SeqID_108926
  Homolog annotation: Hit_ID=Q2R0W4; Match level="QueryCoverage=32%, HitCoverage=5%, E-value=9e-15, Identity=41%"; Hit description=AT hook motif-containing protein, putative
  Pfam annotation: Domain name=DUF889; Domain location=74-250; Score= -40.4; E_value=9.4e-09; Accession=PF05970.5; Description=Eukaryotic protein of unknown function (DUF889)
MLISNNIERLNHVWSETWEFLIDGIFHQQRRIRNILDLQLETEELQNLALLEIEEILQSNKNIKGLSNHAFSNTFGVVTFWYWEDLYMEDISICILFKSPTYLTLTNAQEIKSFSQWLINVGDEKLGKGDDERYEIEFSPNILITNFIDPIEAIVRRIYPNIQKKYKDEEFLKSRAATNEVVYQINDYILNIIPGEEKEYFSCDSIDMTDVATTECYEAVVATCPSAGGRRETRGRRVPRKEYARSRHQRLFEENVGKTGKDAIYELLSERFGSCIYARGRY

SEQ ID NO: 225705 - protein, 556 aa, Glycine max
  Coding DNA Sequence Number=SeqID_108927
  Gene Ontology: Mol. function=microtubule motor activity; Cellular component=microtubule associated complex; Biological process =microtubule-based movement
  Homolog annotation: Hit_ID=Q8S949; Match level="QueryCoverage=99%, HitCoverage=53%, E-value=1e-156, Identity=52%"; Hit description =Kinesin-like protein NACK2
GSNDCGPSSQIVRCLSFPEENKSANGKRTPERREAVGRQAMLKNLLASPDPSILVGEIRKLEDRQLQLCEDANRALEVLHQDFATHKLGNQETAETMSKVLSEIKDLVAASSTPEEIVAADKADLMEKITQLKNQGNTIASLERKLENVQKSIDKLVSAFNAEETPENKTTPLRRKKILPFTLSNSPNMQHIIRAPCSPLSSSRKAMEHDIENRAPENNIGISGSDSFAKFHKDTPRKDDKSCDSILSRAGSPATRKSKSVNVMKIQKMFKNAAEENIRSFRVYVTELKELVAKLHYQKQLLVCQVLELEANKSLNEEKDTPDRSPLPWHILFDQQRKQIIMLWHLCHISLVHRTQFFLLLGGDPSDQIYMEVELRRLTRLEQHLAELGNASPALLGDEPAGSVSARYARVFERHVSFLTIPASPALLGVFDNSLNQVSLIKLVYLKNSIRALKQEREHLARKVNTKLTAEERELLYAKWEVPPVGKQRRLQFVNKLWTDPYNMQHVQESAEIVAKLIDFSVSDENSKDMIELNFSSPFNKKTWAGWNFISNLLNL

SEQ ID NO: 225706 - protein, 352 aa, Glycine max
  Coding DNA Sequence Number=SeqID_108928
  Gene Ontology: Mol. function=calpain activity; Cellular component =intracellular; Biological process=proteolysis
  Homolog annotation: Hit_ID=Q1S3Q9; Match level="QueryCoverage=92%, HitCoverage=73%, E-value=4e-32, Identity=31%"; Hit description =Cyclin-like F-box; F-box protein interaction domain
  Pfam annotation: Domain name=F-box; Domain location=8-55; Score=33.4; E_value=7.7e-07; Accession=PF00646.23; Description=F-box domain
  Subcellular localization annotation: CTP_CleavageSite=36; ConfidenceScore=5.12e-01
MALVRMNPALAHFSLAMSLKILSWLPVKALLRFRCVCKSWKSLMLDLSFVKLHLQRSYCRDTPVLFTLLNSNSKEEQCSLHYYCSMQRLLDNPLSAIDDGDLPFNQNLWDYFAKRPCRFWNPATRLRSKKSPCIMCYIHTLIGFGYNDSSDTYKVVAVVKKSRAITELRVCCLGDNCWRKIATWTDFLRAIHTKGLFMSNTLNWVGRLYTTHQNAIFSFDIRKETYRYLSLPVDVDVLSDDTVIGVLGGCLCLSHDYKRTRLAIWQMKEFGVEKSRTPLKKVSYEHLQISTSSSWMAMHANGDVRLVASKSEFGLVLYNRRENRVKPNGMFSKTVILESTQYVESLVLPYRI

SEQ ID NO: 225707 - protein, 261 aa, Glycine max
  Coding DNA Sequence Number=SeqID_108929
  Homolog annotation: Hit_ID=Q1SMV2; Match level="QueryCoverage=28%, HitCoverage=39%, E-value=2e-07, Identity=40%"; Hit description =Cyclin-like F-box
  Pfam annotation: Domain name=F-box; Domain location=8-55; Score=21.4; E_value=0.0032; Accession=PF00646.23; Description=F-box domain
MNRGRYDDAVVVLPCELQVEIPPWLPEKTLLRLRCVCKFWKTLVFDPIFVKLHVEGSRRDTTPRYCSMQRLLDDHPSLMDEVGGHGFDQKCHNMVGVKIPKIGTWEAKMGFGYDDSSNTYKVVAAVQYSSMQLKTEPRVYCMGDNCWRNVASWTSFPRIVQGRRHRYLPLPVALDIPFGDLLEMVNHEALRKSVSPHWTSMHAAKGDVKLVVANIQELELVLCNIGGVKLNGIVFLETILADDLFPTPSVTMFNMQLCTIY

SEQ ID NO: 225708 - protein, 567 aa, Glycine max
  Coding DNA Sequence Number=SeqID_108930
  Gene Ontology: Mol. function=electron carrier activity; Cellular component=membrane of vacuole with cell cycle-correlated morphology; Biological process=electron transport
  Homolog annotation: Hit_ID=Q7XZU2; Match level="QueryCoverage=99%, HitCoverage=69%, E-value=1e-175, Identity=57%"; Hit description=SAC domain protein 3
  Pfam annotation: Domain name=Syja_N; Domain location=1-133; Score= -86.6; E_value=3.9e-06; Accession=PF02383.9; Description=SacI homology domain
YLRRGVNEKGRVANDVETEQIVFEDVAEGLPIQISSIIQNRGSIPLFWSQETSKLNIKPDIILSKKDQNYQATRLHFENLVKRYGNPIIILNLIKTHEKKPRESILRQEFANAIDFINKDLSEENRLSKATNVLQLLGKVAAYALTLTSFFYCQTTPTLRPEESLKWQSTDSVDEGTFSPTRHANDDNGDANNLERKPSEGNNDANENHSVKPPMLQRGVLRTNCIDCLDRTNVAQYAYGLAALGHQLHALGVIDHPKIDLDDPVADDLMGFYERMGDTLAHQYGGSAAHNKIFSERRGQWRAATQSQEFFRTLQRYYSNAYMDAMKQDAINVFLGHFQPQQGKPALWELGSDQLYDAGRHGDDDARSFFKRSFSDGNILNESSTPMSAPKAKHEKFPSQGGLPDRSEEGSKGLCESSPEISTTESDISFSRYTPSMPRRQLFGDMQRERCLESEHIYYSDHGDSFSCSNFVDLDWLSSSGNSCEEEPFERSSITNSPIAGVSSENVVNGIMVGEATASTSDWGASSLKGREQTESELSYGDARSNTPEEFPDTFVNWVTYGQTLCH

SEQ ID NO: 225709 - protein, 447 aa, Glycine max
  Coding DNA Sequence Number=SeqID_108931
  Gene Ontology: Mol. function=microtubule motor activity; Cellular component=microtubule associated complex; Biological process =microtubule-based movement
  Homolog annotation: Hit_ID=Q8LNZ2; Match level="QueryCoverage=96%, HitCoverage=41%, E-value=1e-153, Identity=65%"; Hit description =Kinesin-like protein
  Pfam annotation: Domain name=Kinesin; Domain location=40-394; Score =441.0; E_value=1.6e-129; Accession=PF00225.13; Description=Kinesin motor domain
  Subcellular localization annotation: CTP_CleavageSite=31; ConfidenceScore=5.13e-01
MTGTPVAVAAATPRSKIQRNASGTPGGPKVREEKIRVTVRMRPLNTKEQAMYDLIAWDCLDEHTIVFKNPNQERPTTPYTFDKVFAPTCSTHKVYEEGAKDVALSALSGINATIFAYGQTSSGKTFTMRGVTESAIKDIYDYIKNTPERDFILRISALEIYNETVIDLLKRESGPLRLLDDPEKGTIVEKLNEEVAEDRQHLRRLIGICEAQRQVGETALNDKSSRSHQIIRLTVESSLRESSGHVKSYIASLNFVDLAGSERISQTNTCGARMKEGSHINRSLLTLASVIRKLRFKSLKQSLYLQGDKTAYIYPFNISLGRSLMHQATLFVQTENGGKCGHIPYRDSKLTRILQSSLGGNARTAIICTISPSLSHVEQTRNTLAFATSAKEVINTARVNMVVSNKTLVRQLQKEVARLEGELRSPDLSVNSCLRSLLAEKELTIQQ

SEQ ID NO: 225710 - protein, 95 aa, Glycine max
  Coding DNA Sequence Number=SeqID_108932
  Subcellular localization annotation: CTP_CleavageSite=66; ConfidenceScore=5.07e-01
MTKPRFQCTSCSSFLLLGLFSPNRPVAALEFCALAVCKSCHKGGSETATLHLAPPSRLARLCLAVVATYPSAGGRREGSRVRLPWEKDARSRHQR

SEQ ID NO: 225711 - protein, 75 aa, Glycine max
  Coding DNA Sequence Number=SeqID_108933
MKCKNFPGKVGEVAFKIDISKAFDKMNDIFFGCDQVKKVWETAGLWNTVHTNMQGAQSTKALISKRIDALLDDLK

SEQ ID NO: 225712 - protein, 96 aa, Glycine max
  Coding DNA Sequence Number=SeqID_108934
  Homolog annotation: Hit_ID=Q4PSF4; Match level="QueryCoverage=74%, HitCoverage=18%, E-value=1e-07, Identity=37%"; Hit description=MATE efflux protein-related
MHNKHSILCRCDADTEKEEDGEVGSNDIGEAEAKAHDEEVVEGEVNADWVEEGVGEEIGEGEDKVGVGHSGDVEVLVQEINEDIGYVELRSDTRME

SEQ ID NO: 225713 - protein, 106 aa, Glycine max
  Coding DNA Sequence Number=SeqID_108935
  Homolog annotation: Hit_ID=Q3EGW2; Match level="QueryCoverage=45%, HitCoverage=14%, E-value=5e-09, Identity=59%"; Hit description=Amino acid permeases
  Subcellular localization annotation: CTP_CleavageSite=71; ConfidenceScore=5.82e-01
MAHATQAAANCGNTPSQLSVHASTFSTPKSSTRPIASGVRGRSAKRCCARRASSAGIITAHSVANRPAKPMAATKPCGHHSEASSGGKNVRQAVCSRARGECPQPR

SEQ ID NO: 225714 - protein, 298 aa, Glycine max
  Coding DNA Sequence Number=SeqID_108936
  Gene Ontology: Mol. function=catalytic activity; Biological process =cellular metabolic process
  Homolog annotation: Hit_ID=Q01RR7; Match level="QueryCoverage=98%, HitCoverage=98%, E-value=1e-87, Identity=56%"; Hit description=NAD -dependent epimerase/dehydratase
  Pfam annotation: Domain name=3Beta_HSD; Domain location=4-247; Score=- 144.6; E_value=0.027; Accession=PF01073.9; Description=3-beta hydroxysteroid dehydrogenaseisomerase family
  Pfam annotation: Domain name=3HCDH_N; Domain location=2-160; Score= -106.5; E_value=0.02; Accession=PF02737.8; Description=3-hydroxyacyl -CoA dehydrogenase, NAD binding domain
  Pfam annotation: Domain name=DapB_N; Domain location=1-102; Score= -38.9; E_value=0.087; Accession=PF01113.11; Description =Dihydrodipicolinate reductase, N-terminus
  Pfam annotation: Domain name=Epimerase; Domain location=3-220; Score =11.8; E_value=5.4e-07; Accession=PF01370.11; Description=NAD dependent epimerasedehydratase family
  Pfam annotation: Domain name=NAD_binding_4; Domain location=5-197; Score=-64.9; E_value=0.0002; Accession=PF07993.2; Description=Male sterility protein
  Pfam annotation: Domain name=NmrA; Domain location=3-219; Score= -94.6; E_value=0.01; Accession=PF05368.3; Description=NmrA-like family
  Pfam annotation: Domain name=RmlD_sub_bind; Domain location=2-291; Score=-181.7; E_value=0.023; Accession=PF04321.7; Description=RmlD substrate binding domain
  Pfam annotation: Domain name=TrkA_N; Domain location=3-129; Score= -5.7; E_value=0.041; Accession=PF02254.8; Description=TrkA-N domain
  Pfam annotation: Domain name=adh_short; Domain location=1-118; Score=- 64.8; E_value=0.1; Accession=PF00106.15; Description=short chain dehydrogenase
  Pfam module annotation: Pfam domain module=3Beta_HSD::3HCDH_N::DapB _N::Epimerase::NAD_binding_4::NmrA::RmlD_sub_bind::TrkA_N::adh_short; Domain location=4-247::2-160::1-102::3-220::5-197::3-219::2-291::3 -129::1-118
MRIFITGATGFIGSRVVSALLARGHQVTGLVRSEEAAQQLNDKGATAQRGTLEDPHAWIAGIDQCDAVIHTAFDHDFSRFVENCEKDRRVIRAIGSVLQGSQRPLLITSGTGMGDDGSGQPALEQNFNPAHPNPRVASELEGTKLLESGIDLRVVRLPQVHNTERQGLISYYIALAREKGAAAYIGGGENAWCAAHVDDVAGLYVKVLEQGERGKRYHAVAEESIASRLIAETVAAGLGIPAVSLKPDQAAEHFGWFAAFARLDLRASGAWTRQQLNWQPKGPGLIADLSRANYSTQS

SEQ ID NO: 225715 - protein, 1218 aa, Glycine max
  Coding DNA Sequence Number=SeqID_108937
  Homolog annotation: Hit_ID=O81060; Match level="QueryCoverage=99%, HitCoverage=68%, E-value=0.0, Identity=34%"; Hit description=Similar to late embryogenesis abundant proteins
MAVELGLLKGCHPLLTDIDVTVNPSKGSVVVEEVRSNKDAKVGTLLDLTRSGAFNGYSVDPTEDLLGENQNDTGLLFSSQQGLKQNFEQDDMSLQRNVVSVDSELGQVLQTAQVVINMLDVTMPGTLTEERKKKVLTAVGQGETLIKALEDAVPEDVRGKLTDAVTGILHARGSKLKIDRILNISQAPESLSGQKNQEKFRVSGAEVMVEEQPSVNQMKKTSSPIDGSDNAPDSIDKLAEETETEVIPIEKSPNSTNLAQSQESNDEVGSSGSLRKETDESNDNNDTNEESKGKAVPDVGHSKNGLETGSKPYSPGHPDGAGGFESAAVGEQKSQNSGIAQTDPKEENTILKDEQKSQDFSGDHSKNTSTDAKEGPSSPSMSSEHQTIEREGNDNEKKDNKNTHHVSHQTNSNNLASSAPAFSVSQALDALAGMDDSTQVAVNSVFGVIENMISQLEQSSENEDFKDGKDVEQKIEEKQKTNCQRKDSNTSADPSVDDHHNDMYLNNGSCHTEEQAAQSLGEINGNGIFNAKSCNSNDHLVQKENSTNTQLIDKRFLIGKWDGHRHMDRVPEFIAGGSYGTPPYNENFHKYLVSKIPIKPLDLDTTTALLLDYFPEEGQWKLFEQPQNMEIASSHTETSEEAGPKVKAPSSAKSSNAEQYIEPLYVILDTEKQQEPVKEFITTDTENRMTDISDDRSDELMQFVKHRVLHSLKMEVGRKLNAAEMIEMKSKLAEDMEHVANAISQAVVHSKVQQLYTESQGHNVEGAIEKVGTLEGEHVISVISSSIQQTDCLRKVVPVGVIVGSILASLRKYFNVTTLQDDHRRSLIHDDEEKPSTKNYGNEGVTDIDQVPDEKTSLDHPIQTETVESASKDTGKNNVMVGTVTAALGASALFMQQKDPQQENETAESSSTSLKMKNRHKKEPERLQEEASEKNQNNIVTSLAEKAMSVAGPVVPTKEDGEVDQERLVAMLADLGHRGGLLRLVGKIALLWGGIRGAISLTGRLISFLRISGRPLFQRIFGFAGMTLVLWSPVAIPLLPTIVQSWTTKTSSKIAEFACIVGLYTAIVILVMLWGERIRGYENAFRQYGLDLTSPQKLFLIVFERHTGNPSIPVLFEFLKGLVGGVIFIFSIHAVNALLGCASFSWPHIPTSLDAITWLKVYGHMDLVVVQGTVMASAIAVVEELLFRSWLPQEIEVDLGYHQGIIISGLAFSFLQSL

SEQ ID NO: 225716 - protein, 511 aa, Glycine max
  Coding DNA Sequence Number=SeqID_108938
  Homolog annotation: Hit_ID=O81060; Match level="QueryCoverage=52%, HitCoverage=14%, E-value=2e-90, Identity=61%"; Hit description =Similar to late embryogenesis abundant proteins
  Subcellular localization annotation: CTP_CleavageSite=21; ConfidenceScore=5.52e-01
MMVLALTSFAPAAKPFRFRPRSFWRRRLKINNSLPLPSPAPFENLFHSLITHFPSVNSLNLITPALGFASGVALSSSSSSSSRSNNYSSVSDIGEWLLFASPTPFNRFVLLRCPSISLEGGEDPSARLVREERHYVRGGRIQVRRGRERERELEELGYQRVCVSAADGGVVSLDWPDNLHLEEERGLDTTLLLVPGTPQGSMNANVRLFVVEALNRGFFPVVMNPRGCAASPLTTPRLFTAADSDDICTAITYINNARPWTTLMGVGWGYGANMLTKYLAEVGERTPLTAVTCIDNPFDLDEATRSSPYHIVTDQKLTDGLIDILQTNKALFQGKTKGFDVEKALMAKSVRDFEEAISMVHMPLSQLNPHLINHILYCWIEIQIRLYASKTILLGSPLPHSLSDSSPQDILSAYSPTIDIRSIPYEWILVTKELVLGHLKRQNNKQKQAKGSKPGFRKDSLRITMNIQCFADIIFICLKRTATRILNGEKGSKKKFHFLFISLDPIPNIEL

SEQ ID NO: 225717 - protein, 337 aa, Glycine max
  Coding DNA Sequence Number=SeqID_108939
  Subcellular localization annotation: CTP_CleavageSite=37; ConfidenceScore=5.39e-01
MGTLLQIVPINSGSQDMSSKFNLSPNLSDYCFQAIIMGNSSTGQITARTSTTFAVNNNAEPIVFITEMVQQMTIFILLNFGTSRMHGVCPGIESCLVKRRRVFYLLLRRLDSSVTLAAVKQLSRKDRSIVVVVEAKGCQLTFCSSLKVKTKPAAGVGRLLEWTSEMASSRAQNRSGLLVRRAMKPSSISDAFPSTHCDEELRTDYTEATNGRVPKEGRVLLVRLVEWGTTLFIEKCQNKGKGKAKYSNWEEDGYKDSNYNSMLGIGSNEMKRKWNFFFDPFSPFRIRVANKPIEYPEEKNRIGSEAGSAAEGAARTHFGGCVPAVTLGDRQGRLEKK

SEQ ID NO: 225718 - protein, 178 aa, Glycine max
  Coding DNA Sequence Number=SeqID_108940
MKLEAVGGGCKYHPNNKQLPGVCPSCLRDKLLKLYDNSNPTYPLPCPPPPPPPYLFRGHRRHSSLVMDSASSMVSFNYGLEKSNSIAFASRSQAIDREVNGSNRGTVQFNNYHVMATLIPIAPQVFYLSFLISTVITVYINEQNMRSVNDVQWRGMLIAKRVVKLDYESKQNKYLNAV

SEQ ID NO: 225719 - protein, 104 aa, Glycine max
  Coding DNA Sequence Number=SeqID_108941
MGWLYDAYDGPFGTRLRCCIPTQWVQGGVLSDQESHNLHTWSSWKNVKGPKMSRVLVRHRRLKILRTACVRMPKGPSSILSQRFSRAIYLEHCQCEYYLFKIFG

SEQ ID NO: 225720 - protein, 494 aa, Glycine max
  Coding DNA Sequence Number=SeqID_108942
  Gene Ontology: Mol. function=signal transducer activity; Cellular component=integral to membrane
  Homolog annotation: Hit_ID=UPI00004C15BA; Match level="QueryCoverage =40%, HitCoverage=27%, E-value=2e-17, Identity=32%"; Hit description =UPI00004C15BA related cluster
MKFLSETNFKEWRQVVTEINRFTKVDKGFSFRPMRYCATFDTHRASLPYVARFHAKRVLKFQDALLTSYHRNEVKFAELTLDIYRMIQCLEWEPSGVFYQKHTVKPKENGDIIDHSGASGIIDMNLTADMTDPTVPPNPRKASLYRPSVTHVIAVLATICEELPPDCVVLVYLSASGKAGLNNVSQVENFSGSSKYSRHKVLSQTSQGQNSEPSETQNNGKRELSYYDNYLWFGPKGNSGSNNLYPGDLIPFTRKPLFLIIDSDNSHAFKAENLALLNFFQQFEYECRTFSEDKVEWVERKNRCQQFMFTYKKNGKYSILLGYNDFVVLHGAERGETAALFLSPLRPIFKNPSDVNSNNGSQFTFFLTAPLSAFCQMIGLSPNESDTDVYNEAENIIANALTEWEIILCSSTTMDLVWAQVISDPFLRRLILRFIFCRSVISFFCPPEESELYLPLCLPHLPSSVAPTSEAVRSAVVQLAMHFDVADSFHFTET

SEQ ID NO: 225721 - protein, 95 aa, Glycine max
  Coding DNA Sequence Number=SeqID_108943
  Gene Ontology: Mol. function=zinc ion binding
  Homolog annotation: Hit_ID=A0FK64; Match level="QueryCoverage=54%, HitCoverage=20%, E-value=3e-11, Identity=61%"; Hit description=PHD4
MPKHIKNKPKVVKITFLRHFIDACFCLFRLCQIKLSKWGSHYKLNRRSNIFSLINDIPCVFEVVTNMKPLKDKPTTNSGSKSRGSAKQHSFKCTY

SEQ ID NO: 225722 - protein, 82 aa, Glycine max
  Coding DNA Sequence Number=SeqID_108944
MKTTTKNLLDNGCHHQKGKNVNHERFDDAKVLMMPERIYMIMVVIIKNGENSQTNYFQQPKALVIDYQRQIANGLFKKDFAI

SEQ ID NO: 225723 - protein, 138 aa, Glycine max
  Coding DNA Sequence Number=SeqID_108945
MWTTTGTYNESEKLGLSKIGEMLAAQLAQASRVASSRSNSLLEESSAGPKWAWLLFAPPFLLITKTYEFRNDTCFLSVMLRNLADYIIIPFLTYGMLRNLTNYATMLPFDFRGVTEPYGLCINNFFCFPACPGISQIA

SEQ ID NO: 225724 - protein, 185 aa, Glycine max
  Coding DNA Sequence Number=SeqID_108946
  Subcellular localization annotation: CTP_CleavageSite=76; ConfidenceScore=5.23e-01
MPISPYESIGWSVPFRHRDRAHKTPSGPRGAQQGPGVSSSGCGPLSVLQGSRPPSKDHTRKTPSGPEEAHQGPGVSSSGIAPARHPVDPKKSNRVLGFLALIMDLCQFYGVPVAPSKGSHPQDTQWTRRSPTGSTKFPSPPASSSGPLLTGLSSRSTAPPGRRKAKHHSSLGMAGSGQQMHYRHL

SEQ ID NO: 225725 - protein, 238 aa, Glycine max
  Coding DNA Sequence Number=SeqID_108947
  Gene Ontology: Mol. function=dihydrodipicolinate synthase activity; Biological process=metabolic process
  Homolog annotation: Hit_ID=Q0S0T5; Match level="QueryCoverage=93%, HitCoverage=75%, E-value=4e-55, Identity=49%"; Hit description =Dihydrodipicolinate synthase
  Pfam annotation: Domain name=DHDPS; Domain location=1-236; Score= -95.1; E_value=1.6e-05; Accession=PF00701.12; Description =Dihydrodipicolinate synthetase family
MVVLAAKQHAQGVPMMVGIGAMATDMILRLAEDAQQAGANAVLLPVLNYQPLTDDEVFTLFQTVNRHVSVPICIYDNPRTTHRAFSDALVERIASLSNIASIKIPGLPADQAGVRVATLRQRLPQRVSIGVSGDAFAAAGLNGGCNLWYSVCAGLFPQIAQNITAAALSGERQQASALSERLEPLWALFRQHGSLKVIAAAASILELAEVECLPRPLAPLSAEAINDVKSVMDKLDLR

SEQ ID NO: 225726 - protein, 139 aa, Glycine max
  Coding DNA Sequence Number=SeqID_108948
MGSYGGHSSTGEGDDRWMHFVEHVLPASELCLVPRQVSTDYMEWFFRISHPFMIPTQAGDQPIDGPAADPEEYIQPSNPQDDYDGYEVITQRLERVLNLRMVTVGTEYYEIMQDCLTIARGGANADGSVRARQRRRTEH

SEQ ID NO: 225727 - protein, 103 aa, Glycine max
  Coding DNA Sequence Number=SeqID_108949
QAFAKRNIQWLSARKNPEEDELSSSLSTSLQEVSGLWKAKSSVGSSLGNWSDSKVLGSMGLSCCAITRDRGIYGRGLFKTRLGYHEESGSSSPGDNIGTHEHC

SEQ ID NO: 225728 - protein, 63 aa, Glycine max
  Coding DNA Sequence Number=SeqID_108950
MAAACSGAVCRPMEETKGRRWSKVSCFLLKLFMVLPGGVDSAVSPCFVASSPDSMGRVASPTS

SEQ ID NO: 225729 - protein, 371 aa, Glycine max
  Coding DNA Sequence Number=SeqID_108951
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P09918; Match level="QueryCoverage=98%, HitCoverage=43%, E-value=5e-84, Identity=49%"; Hit description=Seed lipoxygenase-3
  Pfam annotation: Domain name=Lipoxygenase; Domain location=169-371; Score=-312.2; E_value=0.0017; Accession=PF00305.9; Description =Lipoxygenase
  Pfam annotation: Domain name=PLAT; Domain location=43-156; Score =58.1; E_value=3e-14; Accession=PF01477.13; Description=PLATLH2 domain
  Pfam module annotation: Pfam domain module=Lipoxygenase::PLAT; Domain location=169-371::43-156
MVKGKVVLIRKYVLQTISNAKELVGNGFNLIGSSVEYDITKSVFFNLISRTKSSKDNYSKDGKEACLENNASVLRSLGGKEEEFDIYFEWDATEMGIPGAFYVKNHMKDEFFLVSMTLEYPLPTCDRHKDKNSIIHFLCNSWVHNHGCYKTHHRIFFDNNPYLPGNQTPEALRKYREEELDNLRGDGTGERKEWDRIYDYDVYNDLGYLDSDEKDDHPILGGTLYPYPRRVRTGRKLLNDKNINGGKYEKPADNVIYVPRDENFSLEKTTDFLEFGKKSLSGKVEPLLLSLYLKLTPNEFNGFEEVQRLYDQEGGIKLPISTTMGTENVLKFPTPHVIQASTFAWMTDEEFAREMIAGVNPNVIRLLKEKD

SEQ ID NO: 225730 - protein, 92 aa, Glycine max
  Coding DNA Sequence Number=SeqID_108952
MTSDIEEVKEQMKADMEAMKEQMTTMMEAMMRMRKIMEAREVLQLHTLGDATKGQAFCDVPLLNTLRRPQYCPQPQPLHFAIGGGPPAMVER

SEQ ID NO: 225731 - protein, 328 aa, Glycine max
  Coding DNA Sequence Number=SeqID_108953
  Gene Ontology: Mol. function=zinc ion binding
  Homolog annotation: Hit_ID=UPI00001632AD; Match level="QueryCoverage =90%, HitCoverage=63%, E-value=5e-93, Identity=63%"; Hit description =protein binding / ubiquitin-protein ligase/ zinc ion binding
MKQFTTQIEGDVAALGWWDLFINFGIAQCFAFLVCTKWHNPTIHGGCHITEPCSSSNTIRYLDFRTGGLVVYTDEDRQQNGFCNLQDIGGHIMKIPFIGFQILLFMHLEGTPSSAKNLPHWVIFSPLFLLQGAGVLFAAYRLIEKIVLLLYCGDIPERYSAIASKSRECFGFFRRGSRLLGWWSIDEGSREEEARLFCAGSPGYNTFTPDTVKKMPRADLVEEVIFVHCLYLNDCQVYQDLTLFKLNGKCIRRRSYAEFASRSRLMWSYFPAGITFFAALAAKNVKGALSVVDQLKKGCQYMMCRLSSMKMYRYLTDHTACDFRRGKH

SEQ ID NO: 225732 - protein, 421 aa, Glycine max
  Coding DNA Sequence Number=SeqID_108954
  Gene Ontology: Mol. function=DNA binding; Cellular component=nucleus; Biological process=regulation of transcription
  Homolog annotation: Hit_ID=Q6ZI65; Match level="QueryCoverage=49%, HitCoverage=53%, E-value=9e-66, Identity=57%"; Hit description=No apical meristem (NAM)-like protein
  Pfam annotation: Domain name=NAM; Domain location=55-195; Score =123.4; E_value=6.4e-34; Accession=PF02365.6; Description=No apical meristem (NAM) protein
MSLEHVVKLYGKAILPELVQVVTIFYVSEYISQEHFFCIDIDIAIVHVAQEWPGLPLGVKFDPSDQEIIWHLLAKVGAGNSKPHPFIDEFITSLEVDDGICYTHPQHLPGVKQDGSASHLFHRAIKAYNTGSRKRRKICGQDFGDVRWHKTGRTKPVILNGVQKGCKKIMVLYISPVRGGKPEKTNWVMHQYHLGTEEDEKDGEYVISKVFYQQQQVKFGEKGDQDIPETTEATTVKVDPVTPKSVTPEPPRIENRWSNLDLGQESHHIPQHPQTDCLEDLQADCEDLAKDDLLIVETENNEGIDNIENNAEEDSKWWDSESQNLLSSQQLVEALFLCDDLLQSQSPKRDGENEHKKRSSLSVYANLGPEHLKKDIVECQNLVLDTANVVPETPPSEFQLSQLDFSSQDSFVSWCASKAFD

SEQ ID NO: 225733 - protein, 49 aa, Glycine max
  Coding DNA Sequence Number=SeqID_108955
MGSPSMGGSKRRLSSRGLGGALRERRARLYIIRSFPLISPFISFFAVAG

SEQ ID NO: 225734 - protein, 56 aa, Glycine max
  Coding DNA Sequence Number=SeqID_108956
  Gene Ontology: Mol. function=protein serine/threonine kinase activity; Biological process=protein amino acid phosphorylation
  Homolog annotation: Hit_ID=Q9SMQ4; Match level="QueryCoverage=99%, HitCoverage=14%, E-value=2e-12, Identity=75%"; Hit description =Putative serine/threonine protein kinase
MERYEIIKDIGSGNFGVAKLVKEKWSGELYAIKFIERGFKVPFSNSILMNTCKERL

SEQ ID NO: 225735 - protein, 519 aa, Glycine max
  Coding DNA Sequence Number=SeqID_108957
  Gene Ontology: Mol. function=protein kinase activity; Cellular component=intracellular; Biological process=mRNA editing
  Homolog annotation: Hit_ID=Q10MA5; Match level="QueryCoverage=93%, HitCoverage=74%, E-value=2e-49, Identity=28%"; Hit description =Pentatricopeptide, putative
  Pfam annotation: Domain name=PPR; Domain location=150-184; Score =24.5; E_value=0.00038; Accession=PF01535.11; Description=PPR repeat
  Pfam annotation: Domain name=PPR; Domain location=358-392; Score=0.4; E_value=6.7; Accession=PF01535.11; Description=PPR repeat
  Pfam annotation: Domain name=PPR; Domain location=424-458; Score =12.3; E_value=0.26; Accession=PF01535.11; Description=PPR repeat
  Pfam annotation: Domain name=PPR; Domain location=49-83; Score=25.5; E_value=0.00019; Accession=PF01535.11; Description=PPR repeat
  Pfam module annotation: Pfam domain module=PPR::PPR::PPR::PPR; Domain location=150-184::358-392::424-458::49-83
PQRHSFFVLATSSTHDAYHANLNIAALSRAGKADAARKLFDEMPIKDVVTWNSMLSAYWQNGLLQHSKALFHSMPLRNVVSWNSIIAACVQNDDLHDGVEGGIGRARALFEAMPRRNAVSLVVMINGLVENGLCEESWDVFVRMPQKNDVARTAMITGFCKEGKMEDARTLFQEIALLVIVFGVWFLVYDSPESELKLNDIFEFVGILTYDLDLRDDNEDCPENSNHQHAAMIEPIKSWLAKDWQVNLSHVWRECNHVADRLAAKGHELPLELKSNLVKGILRHLTAVLGDDDVARLRPKWERGRGTEFVSQMIRTANVVELLISEFTICVLSCWEDRESMNLFSLMVHNYGIPPRSEHYACLVEVLSRAGQLQRACKIINDMPFKADSSIWGAVLAACSVHLNVELGELAARIILNLDPFNPDAYVMLSNIYAAAGNWKHAHRIRVLMKEKGVKKQTAYSWLQIGNKTHCFVGGDPSHPNINDIHVALRRITLHMKVKGSWEGLRDDNIGKLMSSIFS

SEQ ID NO: 225736 - protein, 44 aa, Glycine max
  Coding DNA Sequence Number=SeqID_108958
  Gene Ontology: Mol. function=protein serine/threonine kinase activity; Biological process=protein amino acid phosphorylation
  Homolog annotation: Hit_ID=O24395; Match level="QueryCoverage=98%, HitCoverage=12%, E-value=3e-12, Identity=93%"; Hit description =Serine-threonine protein kinase
MEAQHHDLKSVTSSSVLHSQPKSTVGTPAYIAPEVLSRREYDGK

SEQ ID NO: 225737 - protein, 156 aa, Glycine max
  Coding DNA Sequence Number=SeqID_108959
  Gene Ontology: Mol. function=protein kinase activity; Cellular component=integral to membrane; Biological process=protein amino acid phosphorylation
  Homolog annotation: Hit_ID=Q2LJM3; Match level="QueryCoverage=86%, HitCoverage=24%, E-value=1e-28, Identity=44%"; Hit description =Putative receptor kinase
MTSNSFFHPPEFGVPRGRGDGHRAGEIVVGQVEEFQGGLVEGRKRAGEVVGVETERDEAVEEEGESEEAVEEEEGGREGAGEAVVVEEEGLEGVVAEAEDSELVQTCESVRREWASQAHGLGHEADHSALRALHALPLAVVVPLVEGVEELVVLVR

SEQ ID NO: 225738 - protein, 703 aa, Glycine max
  Coding DNA Sequence Number=SeqID_108960
  Gene Ontology: Mol. function=protein kinase activity; Cellular component=integral to membrane; Biological process=protein amino acid phosphorylation
  Homolog annotation: Hit_ID=Q2LJM1; Match level="QueryCoverage=96%, HitCoverage=96%, E-value=1e-143, Identity=49%"; Hit description =Putative receptor kinase
  Pfam annotation: Domain name=LRRNT_2; Domain location=33-72; Score =12.5; E_value=0.042; Accession=PF08263.3; Description=Leucine rich repeat N-terminal domain
  Pfam annotation: Domain name=LRR_1; Domain location=100-121; Score =15.4; E_value=0.21; Accession=PF00560.23; Description=Leucine Rich Repeat
  Pfam annotation: Domain name=LRR_1; Domain location=123-145; Score =15.9; E_value=0.15; Accession=PF00560.23; Description=Leucine Rich Repeat
  Pfam annotation: Domain name=LRR_1; Domain location=147-182; Score =7.7; E_value=10; Accession=PF00560.23; Description=Leucine Rich Repeat
  Pfam annotation: Domain name=Pkinase; Domain location=430-688; Score =56.1; E_value=1.2e-13; Accession=PF00069.15; Description=Protein kinase domain
  Pfam annotation: Domain name=Pkinase_Tyr; Domain location=425-688; Score=13.0; E_value=2.9e-13; Accession=PF07714.7; Description =Protein tyrosine kinase
  Pfam module annotation: Pfam domain module=LRRNT_2::LRR_1::LRR_1::LRR_ 1::Pkinase::Pkinase_Tyr; Domain location=33-72::100-121::123-145::147- 182::430-688::425-688
  Subcellular localization annotation: CTP_CleavageSite=25; ConfidenceScore=5.10e-01
MHHHPKTTTTATKLRPLFLCFFLTLASSAPPMLPSDAVSLLSFKRLADQDNKLLYSLNERYDYCEWQGVKCAQGRVVSFVAQSMGLRGPFPPHTLTSLDQLRVLSLRNNSLFGPIPDLSPLVNLKSLFLDHNSFSGSFPPSLLLLHRLLTLSLSHNRFSGPLPAKRHPPPPPHRAPSQLQQLLRHASFLQPDHLETPRPVLQQSHRPGARHPDSRQIKCTIVFSGISVSCESGLYKLVKSLQTHYVWFTREELQTQNAFGVARPDCITRIYMIPRFHLFSLLGNPGLCGEIVHKECDPRSHFFGPATSSSTTPLSQSEQSQGILVVPSSSTKTKHHIKTGLVVGFVVAVVLVTAFTLTVVSLVRKKQNGKAFRAKGVVLESPEVEGGGVVVAVEGEREVKMRKMEEAHRSGKLVFCCGEVQSYTLEMLMRASAEFLGRGNVGTTYKAVMDSRLIVTVKRLDGEKSAAAGSDGEVFERHMEVVGRLRHPNLVPLRAYFQAKGERLVIYDYQPNGSLFNLVHGSRSARAKPLHWTSCLKIAEDVAQGLAYIHQVSSLIHGNLKSSNVLLGVDFEACITDYCLALFADSSFSEDPDSAAYKAPEARSSSHKCTAKSDVYAFGVLLIELLTGKHPSQHPFLAPADLQDWVRAMRDDDGSEDNRLEMLTEVASICSATSPEQRPVMWQVLKMIQGIKDSATMEDTALT

SEQ ID NO: 225739 - protein, 56 aa, Glycine max
  Coding DNA Sequence Number=SeqID_108961
MTVATSGLSVAMDANGNDGGAARRRKRRRKKEADVNLSGPFRNTLFYCNDPIMTYL

SEQ ID NO: 225740 - protein, 362 aa, Glycine max
  Coding DNA Sequence Number=SeqID_108962
  Gene Ontology: Mol. function=pectinesterase activity; Cellular component=cell wall; Biological process=cell wall modification
  Homolog annotation: Hit_ID=Q9FKF3; Match level="QueryCoverage=85%, HitCoverage=78%, E-value=8e-90, Identity=50%"; Hit description =Pectin methylesterase-like protein
  Pfam annotation: Domain name=Pectinesterase; Domain location=38-354; Score=227.9; E_value=2.3e-65; Accession=PF01095.10; Description =Pectinesterase
  Subcellular localization annotation: CTP_CleavageSite=37; ConfidenceScore=5.15e-01
MMGHVESGATCLVALSLALHLVSATTTSSSLDVGAVRVVRVRRDGAGDFRTVTDAVNSIPSGNKRRVVVWIGRGVYREKITVDRSKPFVTFYGERNGNDNDNDSRDIMPIITYDATALRYGTVDSATVAVDADYFVAVNVAFVETEIRELENMQLRYNSSPRPEENSVGAQALAMRISGDKAAFFNCKFIGFQDTLCDDKGRHFFKDCYIQGTYDFIFGNGKSIYLRSTIESVANGLSVITAQGRESMAEDTGFTFLHCNITGSGNGNTYLGRAWKKSPRVVFAYTYMGSLINTQGWFNNQVAHAKSNNQTIYYGEYRCMGPGAVSSGRVKFRKILSKEEAKPFLSMAYIHGGTWVVPPPKL

SEQ ID NO: 225741 - protein, 127 aa, Glycine max
  Coding DNA Sequence Number=SeqID_108963
  Gene Ontology: Mol. function=protein phosphatase type 2C activity
  Homolog annotation: Hit_ID=Q9ZSQ7; Match level="QueryCoverage=79%, HitCoverage=26%, E-value=2e-10, Identity=37%"; Hit description =Protein phosphatase 2C homolog
MAPKLTLEIAKQVIANIAGVIGVIVAVVDADKGAEGAKGAELDLALVLDDLVGLDDGHGEIVGCKLFDVAEPEEVVLAFSSSDDVTGVVTVPKRLKTAHDKAHQCMEHPTSLKNPNPRPQHRNLFSQ

SEQ ID NO: 225742 - protein, 81 aa, Glycine max
  Coding DNA Sequence Number=SeqID_108964
MDAFVSSFKIGDIGYDNDINLFHGTLQSLAKMANKFVFQQHSFTKLYKGAMIEKHNFLSTMTTNNTTEEGSEQEQTQHFAD

SEQ ID NO: 225743 - protein, 484 aa, Glycine max
  Coding DNA Sequence Number=SeqID_108965
  Gene Ontology: Mol. function=dimethylaniline monooxygenase (N-oxide -forming) activity; Cellular component=intrinsic to endoplasmic reticulum membrane; Biological process=electron transport
  Homolog annotation: Hit_ID=Q9LMA1; Match level="QueryCoverage=96%, HitCoverage=95%, E-value=1e-170, Identity=58%"; Hit description =Probable flavin-containing monooxygenase 1
  Pfam annotation: Domain name=FMO-like; Domain location=14-481; Score=- 352.8; E_value=1.5e-07; Accession=PF00743.9; Description=Flavin -binding monooxygenase-like
MANRAENHPILVSKIGILGAGVSGIAAAKQLSHHNPIVFEASDSIGGVWSHCSYNSTKLQSHRRDYEFTDFPWPQRDNPDFPTHLEILNYLHSYAKHFDVLKNIRFNSKVVEIRYTGNREVTCSGSLLPGLPVWEVAVQTNHSDTIQLVVVCVGKYGDIARIPTFPQKKGAEVFKGKVMHTLDYCKLDQEAATQLLKGKKVVVVGFKKSGLDLAMECAQANQGPEGQPCTMVVRTLHWTVPHYWIWGLPFFLFFSTRSSQFIHERPNQGLLRTLLCLMCSPLLLQRRGISKFIESYLLWKLPLEKYGLKPEHPFVEDYASCQMAIMPENFFSEAEKGQIVFKKASKWWFWNGGIEFEDNTKLNADVVVLATGFDGKKKLKTILPEPFSSLLEYPSGIMPLYRGTIHPLIPNMAFVGYVESVSNLHSSELRSMWLSGLVDDKFKLPSVESMLSHTHKEIEVMKRKKNWISEVFGPYSIEEYAKED

SEQ ID NO: 225744 - protein, 101 aa, Glycine max
  Coding DNA Sequence Number=SeqID_108966
  Subcellular localization annotation: CTP_CleavageSite=76; ConfidenceScore=5.52e-01
MASAVSKVSGDLKSSSFDRVREAPPPPPDSSLLLATRPPRHLSLSLSASFLTLPYITSLQAVSYWTCSKLCAFCFVAGAVFGYSLRGRVKRWASKMLKKLS

SEQ ID NO: 225745 - protein, 90 aa, Glycine max
  Coding DNA Sequence Number=SeqID_108967
  Gene Ontology: Mol. function=2 iron, 2 sulfur cluster binding; Cellular component=mitochondrial matrix; Biological process=electron transport
  Homolog annotation: Hit_ID=Q7XIU2; Match level="QueryCoverage=73%, HitCoverage=37%, E-value=2e-29, Identity=91%"; Hit description =Putative ferredoxin
MLLEINFMFFEIPFSTYKRVESFVQDVEQYNKLEDPTDEENDMLDLAFGLTETSRLGCQVIAKPELDGIRLAIPAATRNFAVDGYVPKPH

SEQ ID NO: 225746 - protein, 74 aa, Glycine max
  Coding DNA Sequence Number=SeqID_108968
  Gene Ontology: Mol. function=metal ion binding
  Homolog annotation: Hit_ID=P09918; Match level="QueryCoverage=86%, HitCoverage=7%, E-value=7e-14, Identity=55%"; Hit description=Seed lipoxygenase-3
MFPECLKRLFSRSQKVKGRVVLMRKNVLDFNNLTSVVGIVGTSKSLIGSAVDGVTSLMGKSVCIQLISATKADG

SEQ ID NO: 225747 - protein, 438 aa, Glycine max
  Coding DNA Sequence Number=SeqID_108969
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=Q43440; Match level="QueryCoverage=99%, HitCoverage=48%, E-value=0.0, Identity=70%"; Hit description =Lipoxygenase
  Pfam annotation: Domain name=Lipoxygenase; Domain location=1-422; Score=624.5; E_value=9.1e-185; Accession=PF00305.9; Description =Lipoxygenase
MPYLRKINELDSAKAYATRTFLFLKDDGTLKPLAIELSKPHQCVYVLPHPPHMRPSPFLHYYFPSQVVLPADKGDDGTIWLLAKAYVVVNDTNYHQLISHWLHTHAVMEPFSIATHRQLSVLHPIYKLLHPHFRDTININALARQSLINAGSIIEQTFLPGKYSMEMSSAVYKNWVFTDQALPTDLIKRGLAVKDHTSPHGLRLMIKDYPYAVDGLEIWDAIKTWVQEYVNLYYSNDKAVEEDTELQAWWKEVVEKGHGDLKDNEWPKMKTCQELIDSCTIIIWIGSALHAAVNFGQYPYGGYILNRPTQSRRLLPEPKTKEYDEMVKNPQEAFLRTITPKFQTVIDLTVMEILSSHSSDEIYLGQRDTPNWTSDQNAKDVFETFTKTLAEIEKKISERNNNQELKNRTGPAKFPYTVLLPTSEPGLTFRGIPNSVSI

SEQ ID NO: 225748 - protein, 441 aa, Glycine max
  Coding DNA Sequence Number=SeqID_108970
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P09439; Match level="QueryCoverage=99%, HitCoverage=50%, E-value=0.0, Identity=72%"; Hit description=Seed lipoxygenase-2
  Pfam annotation: Domain name=Lipoxygenase; Domain location=9-441; Score=688.6; E_value=4.6e-204; Accession=PF00305.9; Description =Lipoxygenase
MTYVPSETPGPLVTYREAELQALRGNGTGKRKEWDRVYDYDVYNDLGNPDSGENFARPVLGGSLTHPYPRRGRTGRKPTKKDSKSEKPGHVYVPRDEIFGHLKSSDFLSYGIKSLSRSFLPAIKSIFDLKFTPNEFGSFEEVRELCEGGIKLPTDILSKISPLPVLKEIFRTDGEDNLLKFSIPHLIQVNKSAWMTDDEFAREMIAGVNPCVIRLLQEFPPQSKLDPSVYGDQTSKLTEEHLKINLEGLTAIEGQRLFILDHHDVFMPFLTRLNESKSTKVYATRTILFLKDDGTLKPLAIELSLPHSGGQHLGADSKVILPANQGVESTIWLLAKAYVVVNDSCYHQLISHWLNTHAVIEPFVIATNRNLSVLHPVYKLLFPHYRDTMNINALARQSLINADGIIEQSFLGGKYSMEISSEAYKAWVFPDQALPADLIKR

SEQ ID NO: 225749 - protein, 789 aa, Glycine max
  Coding DNA Sequence Number=SeqID_108971
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P24095; Match level="QueryCoverage=99%, HitCoverage=90%, E-value=0.0, Identity=79%"; Hit description=Seed lipoxygenase
  Pfam annotation: Domain name=Lipoxygenase; Domain location=104-773; Score=1637.7; E_value=0; Accession=PF00305.9; Description =Lipoxygenase
  Pfam annotation: Domain name=PLAT; Domain location=2-92; Score=100.5; E_value=5e-27; Accession=PF01477.13; Description=PLATLH2 domain
  Pfam module annotation: Pfam domain module=Lipoxygenase::PLAT; Domain location=104-773::2-92
KGNGKVGNETFLEKHLPTLPTLGDRRDAYDIHFEWDANFGIPGAFYIRNYTYDEFFLVSVTLEDIPNHGTIHFVCNSWVYNFKDYDKKDRIFFANKTYLPSATPGPLVKYREEELKILRGDGTGERKEHERIYDYDVYNDLGNPDEDVKLARPVLGGSSTYPYPRRVRTGRKATKKDPKSERPASELYMPRDEKFGHLKSSDFLTYGIKSLSQKLLPSLENVFDSDLTWNEFDSFEEVRDLYEGGIKVPTGVLSDISPIPIFKEIFRTDGESVLQFPPPHVVQVTKSAWMTDDEFAREMIAGVNPNVIRLLKEFPPQSKLDPSLYGDQSSTITKEHLEINMDGVTVEEALNGQRLFILDYQDAFMPYLTRINALPSAKAYATRTILLLKDDGTLKPLAIELSKPHPSGDNLGAESKVVLPADQGVESTIWLLAKAHVIVNDSGYHQLMSHWLNTHAVTEPFIIATNRRLSVLHPIYKLLYPHYRDTININGLARNALINAGGVIEESFLPGRYSIEMSSAVYKNWVFTDQALPVDLIKRGMAVEDPSSPHGLRLAVEDYPYAVDGLEIWDAIKSWVQEYVSLYYPTDLAIQQDTELQAWWKEVVEKGHGDLKDKPWWPKMQTRQELIQSCSTIIWIASALHAAVNFGQYPYGGFILNRPTLSRRWIPEPGTKEYDEMVESPQTAYLRTITPKRQTIIDLTVIEILSRHASDEIYLGERDNPNWTSDSKALEAFKKFGSKLAEIEGKITARNKDSNKKNRYGPVQLPYTLLLPTSEEGLTFRGIPNSISI

SEQ ID NO: 225750 - protein, 89 aa, Glycine max
  Coding DNA Sequence Number=SeqID_108972
MKRKKRKGKEGFPIEDQKKVKRKGSKEKQNNSRPIQETRKENRRSSDQINFRQAVLDWRYPAPHKQRGKDQHTQLPLQKHYPRENHIDP

SEQ ID NO: 225751 - protein, 167 aa, Glycine max
  Coding DNA Sequence Number=SeqID_108973
MDRARLVYELVTWMDMDVGSFISGQIWQMAQSNSFRLGFSALITALCIARGVVPDSLSFESQSPVINLAYIRKNCWNPDDPTITFPGTRKTRAQGPSDASAPSSSAPPAPAPTPSGTSMQTPDVIVLMLQSLHHSLCQVMQSIHDLAQHQPIMSMEAFMAQVAWPGV

SEQ ID NO: 225752 - protein, 61 aa, Glycine max
  Coding DNA Sequence Number=SeqID_108974
MDIEEDAEIPLILGCPYVNHQLCGGYGERLIRQVCEVLIFIRSLSQSSGLASHPLSATLLG

SEQ ID NO: 225753 - protein, 168 aa, Glycine max
  Coding DNA Sequence Number=SeqID_108975
MASRKRKATASRPQEPYDTTRFISEGAWERYEQNVHSRNILLERNINLYITKYDEFRQELERCMWPKALTRQPDGHIDVVLVKEFYANLYDPEDKSLRQVRVRGKLIKFDGDSLNTFLETPWFWSQGSATLHTPGSTARTQILRSLHPSSVFQGAVSFLMLKEHPRSS

SEQ ID NO: 225754 - protein, 88 aa, Glycine max
  Coding DNA Sequence Number=SeqID_108976
MARSVFAPCPYLRDLQGRELTRYLAITPQGSHISLDVESPTVATYPSAGGRRVTHGMRVPRKEYARSRHQRLFEENVGKTGKDAIYEL

SEQ ID NO: 225755 - protein, 192 aa, Glycine max
  Coding DNA Sequence Number=SeqID_108977
  Gene Ontology: Mol. function=RNA-directed DNA polymerase activity; Cellular component=intracellular; Biological process=RNA-dependent DNA replication
  Homolog annotation: Hit_ID=Q1T5Q8; Match level="QueryCoverage=94%, HitCoverage=26%, E-value=1e-15, Identity=30%"; Hit description=RNA -directed DNA polymerase
MGSIMNNGWEWKLIWRRPLFDAEVAMADTFLGEISQQQVDSHKEDTWIWKSDPSGDYSTKSGLIRDRLPTKNNLTRRQVTVEDMLCPFFRNREEEAAHLFFTCSNILPLWWETMSWVNLSTAMPQSPRDHYLQHGHSVAGTKKSTRWKCRWIALAFTIWQHRNKIVFQNATFDGGKLMDDAVLLIWSWIKTM

SEQ ID NO: 225756 - protein, 82 aa, Glycine max
  Coding DNA Sequence Number=SeqID_108978
  Subcellular localization annotation: CTP_CleavageSite=58; ConfidenceScore=5.08e-01
MTRQLCGLLIVATYPSAGGRPRANGCVFHGRKMHGVATNVYSRKTSKKPEKVWSTNFKCERFRSCIYAWGRVFLLLLRIPQL

SEQ ID NO: 225757 - protein, 49 aa, Glycine max
  Coding DNA Sequence Number=SeqID_108979
MANIALLSRYGRWCLASDVQQAGFVADLGVAFVDDWAFFADRVMGNEKG

SEQ ID NO: 225758 - protein, 98 aa, Glycine max
  Coding DNA Sequence Number=SeqID_108980
  Subcellular localization annotation: CTP_CleavageSite=77; ConfidenceScore=5.87e-01
MKDCRNTSSGDVSSTSRTSQSLTNSSQALRTASSSSSGGFVRAHALSALQNRLARISEFRLSATFLAQRIDRSGALSGMALRSGNKHNSSFFQILPRA

SEQ ID NO: 225759 - protein, 123 aa, Glycine max
  Coding DNA Sequence Number=SeqID_108981
  Pfam annotation: Domain name=NC; Domain location=12-87; Score=10.1; E_ value=0.003; Accession=PF04970.4; Description=NC domain
MLDRFHVSSPHHASRETPCPKCDYQTKTEAKARGGTCTTASSDPTEAVLCRASFLLKKGFGGYHLFKINCEDFAMYCKTGLLVVTDISVGQSGQATSLLAAVGTVVSSPFVFMSTSLCGLALV

SEQ ID NO: 225760 - protein, 119 aa, Glycine max
  Coding DNA Sequence Number=SeqID_108982
MSRNLMDYVIIPSLASGMLQNFTDCALTLPFDFRHVTELHELPNDGCQAQNDHNLSLRVLGHDRAWVARRRMTIICFCVRTRSPLDGEKVWGMTIICLRPPLDLLSLNEKGRRMTIICL

SEQ ID NO: 225761 - protein, 294 aa, Glycine max
  Coding DNA Sequence Number=SeqID_108983
  Gene Ontology: Mol. function=protein-N(PI)-phosphohistidine-sugar phosphotransferase activity; Cellular component=intracellular; Biological process=phosphoenolpyruvate-dependent sugar phosphotransferase system
  Homolog annotation: Hit_ID=Q6DAB2; Match level="QueryCoverage=93%, HitCoverage=53%, E-value=2e-75, Identity=55%"; Hit description =Probable PTS system regulatory protein
  Pfam annotation: Domain name=HTH_11; Domain location=112-171; Score =10.2; E_value=0.0069; Accession=PF08279.2; Description=HTH domain
  Pfam annotation: Domain name=HTH_11; Domain location=24-82; Score =50.7; E_value=4.8e-12; Accession=PF08279.2; Description=HTH domain
  Pfam annotation: Domain name=HTH_DeoR; Domain location=24-86; Score =1.2; E_value=0.045; Accession=PF08220.3; Description=DeoR-like helix- turn-helix domain
  Pfam annotation: Domain name=Mga; Domain location=87-186; Score=17.1; E_value=0.00047; Accession=PF05043.4; Description=M protein trans -acting positive regulator (MGA)
  Pfam annotation: Domain name=PuR_N; Domain location=109-169; Score= -28.1; E_value=0.1; Accession=PF09182.1; Description=Bacterial purine repressor, N-terminal
  Pfam module annotation: Pfam domain module=HTH_11::HTH_11::HTH _DeoR::Mga::PuR_N; Domain location=112-171::24-82::24-86::87-186::109- 169
MPQGKIPLGFTKIKGDRMQILTSRQHRLVKLLLQQAAPQPIGQLALQLGVSGKTIQRDLQWLESWLSNWALTLEKTPGRGVRLRVKDMQQRLQLEQQLNGDEAGDALSHNSRRIKIASQLLSDAPRATSISKLSERYFISHASIVNDLKVIEEWLQPLGLTLQRGPGGTHIEGHEQALRQAMVSLINDVMQQQVAGTPLLPRLDPGSQQALVHYFGEEDVAFVQTLLQQMEQQLSYPLGDAWYLNLCTHILIMMHRMAQGNALALDILTTAHDLDQSILTIARQMVVRIEQRIG

SEQ ID NO: 225762 - protein, 71 aa, Glycine max
  Coding DNA Sequence Number=SeqID_108984
  Gene Ontology: Mol. function=RNA-directed DNA polymerase activity; Biological process=electron transport
  Homolog annotation: Hit_ID=Q1STT2; Match level="QueryCoverage=80%, HitCoverage=12%, E-value=2e-12, Identity=53%"; Hit description =Lipocalin
MEFSKLNIIRRETSWVPLWVTTPTTHGVAFTLHRLWSKEAQDRDWVMGILQRFGPIHGLEILAILYCFSCD

SEQ ID NO: 225763 - protein, 112 aa, Glycine max
  Coding DNA Sequence Number=SeqID_108985
  Gene Ontology: Mol. function=RNA-directed DNA polymerase activity; Biological process=RNA-dependent DNA replication
  Homolog annotation: Hit_ID=Q1RVP6; Match level="QueryCoverage=88%, HitCoverage=83%, E-value=2e-15, Identity=38%"; Hit description=80C09_ 29, related
MISKSAKIDTSSQGLKGDWIRDGEANTKIFHANANSGKKRSFISKLFNENGVAISNQQDICLLAKKYLETLYAHSDVNIEVEKWEFKEAVFHVHSDKSPCSDGFNPAFYKRF

SEQ ID NO: 225764 - protein, 91 aa, Glycine max
  Coding DNA Sequence Number=SeqID_108986
  Gene Ontology: Mol. function=DNA binding; Cellular component=nucleus; Biological process=regulation of transcription
  Homolog annotation: Hit_ID=Q2LMF3; Match level="QueryCoverage=66%, HitCoverage=15%, E-value=1e-27, Identity=91%"; Hit description=MYB2
  Pfam annotation: Domain name=Myb_DNA-binding; Domain location=35-81; Score=54.4; E_value=3.7e-13; Accession=PF00249.21; Description=Myb -like DNA-binding domain
MEPEETAAAAADGSGDEGLLGLDSGSGGGGRDRVKGPWSPEEDVILSRLVSKFGARNWSLIARGISGRSGKSCRLRWCNQLDPAVKRKPFT

SEQ ID NO: 225765 - protein, 138 aa, Glycine max
  Coding DNA Sequence Number=SeqID_108987
MRFVGRDKNTTFSVDVVGPLHQRAVLTIRHHIFTIDVSEDMIQQNYQLVLPPEASIYLIASKKYMVVDRGSGRHQKWMITMNNGLSCVADVWIHYLDECHLKAGDEVIFFYNIDQHLWEVLYRKQVTWDDTKDEADSP

SEQ ID NO: 225766 - protein, 62 aa, Glycine max
  Coding DNA Sequence Number=SeqID_108988
MKGLTTSLYQTHIDALMIADCSPDYMDWFFGISHPFITPTQVVDQPKHPPVPQHEAYMEPDI

SEQ ID NO: 225767 - protein, 51 aa, Glycine max
  Coding DNA Sequence Number=SeqID_108989
MKDSLKQSWYIDSGCSKHMTGDASKFTHISPKNSGHMTYGDNNKDKTPNHA

SEQ ID NO: 225768 - protein, 139 aa, Glycine max
  Coding DNA Sequence Number=SeqID_108990
MGAKYLEVVKRGSHPNNGWSPNEIRCTAEIKRVGKKETNTQEFLYWFSNNPCLHPVPKRPAILEISFQPCKNPFTSKDPQGMYPPLSSLNNLVDVPSTRTDPQEMYPLLFSVNNPSRCTLYLYHKGCTLQCVKTKFSGG

SEQ ID NO: 225769 - protein, 53 aa, Glycine max
  Coding DNA Sequence Number=SeqID_108991
MENVEGLCILKMRVRESFTHREVETRFKQRKRSSMIEEGYEDSQRIKGTPKGP

SEQ ID NO: 225770 - protein, 68 aa, Glycine max
  Coding DNA Sequence Number=SeqID_108992
  Subcellular localization annotation: CTP_CleavageSite=42; ConfidenceScore=5.30e-01
MEDAPLAHPRGLYAPLARGQVVTPMKARTLSPMKVRTLSPMKARTLSPIQDKSRLQGRHLVLNSASNS

SEQ ID NO: 225771 - protein, 149 aa, Glycine max
  Coding DNA Sequence Number=SeqID_108993
PTFVDHPTFCYRDPRVRWHAETPDGNSHTPFAIQRPESPIACGDTLRLSAPHHSETPSPIDKQRPMCSSAPFPEMSASSGRYYFSLTPLSQVLGGRRRYPSGYPYKMISVNPDPRSQVAGKDTQVVIRASELVDTQRLTSSSAPLSSRD

SEQ ID NO: 225772 - protein, 169 aa, Glycine max
  Coding DNA Sequence Number=SeqID_108994
  Gene Ontology: Mol. function=hydrolase activity; Cellular component =integral to membrane; Biological process=metabolic process
  Homolog annotation: Hit_ID=Q1ZWD7; Match level="QueryCoverage=97%, HitCoverage=51%, E-value=4e-48, Identity=56%"; Hit description =Hypothetical inosine-uridine preferring nucleoside hydrolase
  Pfam annotation: Domain name=IU_nuc_hydro; Domain location=1-163; Score=-133.9; E_value=0.0044; Accession=PF01156.9; Description =Inosine-uridine preferring nucleoside hydrolase
MGGAFGHHDHCGNVTPFAEANFIGDPQAADKVITANWPTTIVGLDVTHQTVMSSRYIDHLRSRSERYGKFIYDITQFYTDFHRREAGIDGFYVHDSSAIAYAISPELFTTIKGKIRVVTEGPAIGHTMIKKDDRRYPIDEWSDYPAQRVCVDVDSAGLLELYASTLAAG

SEQ ID NO: 225773 - protein, 113 aa, Glycine max
  Coding DNA Sequence Number=SeqID_108995
  Gene Ontology: Mol. function=transcription factor activity; Cellular component=intracellular; Biological process=regulation of transcription, DNA-dependent
  Homolog annotation: Hit_ID=Q1ZMT4; Match level="QueryCoverage=85%, HitCoverage=29%, E-value=1e-18, Identity=46%"; Hit description =Ribose operon repressor
MYALYSSGKLPTAVMCHNDLMAVGVQNAASELGIKIPKDMSVMGYDDIETARMANPPLTTVRIPLENLATQAIDELIKKINEPGIPALISVNPVLVVRGSVDEPPMDKARKPE

SEQ ID NO: 225774 - protein, 101 aa, Glycine max
  Coding DNA Sequence Number=SeqID_108996
MVKPSKKHKGSSSRSQRHSKTQDTPIPYSISSSSLFSSEEQRALDDDWKFDFSVHDAHRLVCTNQAEMTGRLLAGSLALESRILHYLIVRILFPRSSNLAQ

SEQ ID NO: 225775 - protein, 292 aa, Glycine max
  Coding DNA Sequence Number=SeqID_108997
  Gene Ontology: Mol. function=transcription factor activity; Biological process=regulation of transcription, DNA-dependent
  Homolog annotation: Hit_ID=Q2JZT3; Match level="QueryCoverage=96%, HitCoverage=93%, E-value=3e-90, Identity=60%"; Hit description =Probable transcriptional regulator protein, LysR family
  Pfam annotation: Domain name=HTH_1; Domain location=10-69; Score =57.7; E_value=3.7e-14; Accession=PF00126.17; Description=Bacterial regulatory helix-turn-helix protein, lysR family
  Pfam annotation: Domain name=LysR_substrate; Domain location=89-288; Score=97.1; E_value=5.2e-26; Accession=PF03466.10; Description=LysR substrate binding domain
  Pfam module annotation: Pfam domain module=HTH_1::LysR_substrate; Domain location=10-69::89-288
MTLTGQLPPLNALRAFAISGRKESFRAAADEMCVTPGAVAQQVRALEQHLGITLFHRLPRGLALTPSGAAYLRDVTRAFDILTESTSKLLAQPNTVTISVTPTFAAKLLIPRLAEFHAELPEIELRTVATEALSDFERDQVDIAIRLTHMPFSSELETTLLFNQELVVVASPHLVRGLTLPLNVMQLQTLPLLHDMQNYWPFFLQSEEKQPGSAFNLTALALDAALAGQGVAVACRAFVNADIDAGRLVQVMDITKTLASSYFLVCKRAAAQRQIVRSVWEWCVKRLSLPFQ

SEQ ID NO: 225776 - protein, 148 aa, Glycine max
  Coding DNA Sequence Number=SeqID_108998
  Gene Ontology: Mol. function=oxidoreductase activity; Cellular component=membrane; Biological process=metabolic process
  Homolog annotation: Hit_ID=Q6N4G0; Match level="QueryCoverage=99%, HitCoverage=62%, E-value=4e-54, Identity=70%"; Hit description=3 -oxoacyl-acyl carrier protein reductase precursor
  Pfam annotation: Domain name=KR; Domain location=6-144; Score=-84.9; E_value=0.019; Accession=PF08659.1; Description=KR domain
  Pfam annotation: Domain name=adh_short; Domain location=5-141; Score =18.6; E_value=3.3e-07; Accession=PF00106.15; Description=short chain dehydrogenase
  Pfam module annotation: Pfam domain module=KR::adh_short; Domain location=6-144::5-141
MSVEKVALIIGGGSGMGAAIARKLACDGYHIAVLSSSGKGEALANELGGIGVTGSNQSNDDLQRLVDMAMAKWGRIDALINSAGHGPSAAVLDLSDEEWHQGLEIYFLNTVRAARLVTPIMEAQGAGAIVNISTAWAFEPLDMFPTST

SEQ ID NO: 225777 - protein, 157 aa, Glycine max
  Coding DNA Sequence Number=SeqID_108999
MPRNKKYFHGPMIKWIRGRLAFKDNIRAGREVGDQVRLSLFLSYPVWVWQKLLVLLEKQLASQENPTPFLANEFGGIKSHVKQEQIGRTLVKDRDTRVGINLGGKRNVFGLEHTSTIHYTAAIPGAEDYNDSTRRGASTTIVDPGLLVSSPNLALMC

SEQ ID NO: 225778 - protein, 73 aa, Glycine max
  Coding DNA Sequence Number=SeqID_109000
MLFAMLDIITSNLGDPIWAISSDTLNSLVGLSLNFFLILPFINFGFEYGFVGLVFGVVGWFSTGTASNLVPNS

SEQ ID NO: 225779 - protein, 81 aa, Glycine max
  Coding DNA Sequence Number=SeqID_109001
MVMKKASAHGHDIGFAGTVHFPLYLGFLHLVIETNLVNALFVHGKRSKAFVKIQGYWKIQCVKIEWKPLWFVKAVEKFDYD

SEQ ID NO: 225780 - protein, 175 aa, Glycine max
  Coding DNA Sequence Number=SeqID_109002
  Gene Ontology: Mol. function=transmembrane receptor activity; Cellular component=membrane; Biological process=defense response
  Homolog annotation: Hit_ID=Q1SGR7; Match level="QueryCoverage=85%, HitCoverage=12%, E-value=3e-55, Identity=68%"; Hit description=TIR; Disease resistance protein; AAA ATPase
  Pfam annotation: Domain name=TIR; Domain location=27-163; Score =193.1; E_value=6.5e-55; Accession=PF01582.10; Description=TIR domain
  Subcellular localization annotation: CTP_CleavageSite=14; ConfidenceScore=5.04e-01
FAVAIAMASNSMVPCSTSPAMIKKYEVFVSFRGKDTRNNFTDHLFGALQRKGILTFRDDTKLKKGERILSSLMQAIEGSQIFVIVFSKNYASSTWCLRELEKILDCVIVPGKRVLPIFYDVDPSEVRKQTGDYGKAFTKHEERFKDDVEKMEEVKRWRRALTQVANFSGWDMMNK

SEQ ID NO: 225781 - protein, 972 aa, Glycine max
  Coding DNA Sequence Number=SeqID_109003
  Gene Ontology: Mol. function=transmembrane receptor activity; Cellular component=membrane; Biological process=defense response
  Homolog annotation: Hit_ID=Q1SGR7; Match level="QueryCoverage=91%, HitCoverage=77%, E-value=0.0, Identity=51%"; Hit description=TIR; Disease resistance protein; AAA ATPase
  Pfam annotation: Domain name=LRR_1; Domain location=493-514; Score =6.3; E_value=19; Accession=PF00560.23; Description=Leucine Rich Repeat
  Pfam annotation: Domain name=LRR_1; Domain location=516-537; Score =8.7; E_value=6.6; Accession=PF00560.23; Description=Leucine Rich Repeat
  Pfam annotation: Domain name=LRR_1; Domain location=539-561; Score =3.7; E_value=59; Accession=PF00560.23; Description=Leucine Rich Repeat
  Pfam annotation: Domain name=LRR_1; Domain location=563-585; Score =9.9; E_value=4; Accession=PF00560.23; Description=Leucine Rich Repeat
  Pfam annotation: Domain name=LRR_1; Domain location=587-608; Score =8.9; E_value=6.2; Accession=PF00560.23; Description=Leucine Rich Repeat
  Pfam annotation: Domain name=LRR_1; Domain location=664-685; Score =8.9; E_value=6.1; Accession=PF00560.23; Description=Leucine Rich Repeat
  Pfam annotation: Domain name=LRR_1; Domain location=687-708; Score =15.0; E_value=0.28; Accession=PF00560.23; Description=Leucine Rich Repeat
  Pfam annotation: Domain name=LRR_1; Domain location=710-731; Score =7.3; E_value=12; Accession=PF00560.23; Description=Leucine Rich Repeat
  Pfam annotation: Domain name=LRR_3; Domain location=493-512; Score =35.4; E_value=2e-07; Accession=PF07725.3; Description=Leucine Rich Repeat
  Pfam annotation: Domain name=NACHT; Domain location=105-259; Score= -24.1; E_value=0.0044; Accession=PF05729.3; Description=NACHT domain
  Pfam annotation: Domain name=NB-ARC; Domain location=63-360; Score =114.3; E_value=3.6e-31; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_3::NACHT::NB-ARC; Domain location= 493-514::516-537::539-561::563-585::587-608::664-685::687-708::710 -731::493-512::105-259::63-360
MTERSSGTTNCVEVLLGSVTISLRLCPSCVALHNQSIVAALIGVVVHDLEPFNRSQYDEIEKIVQEILSKLGRNFSSLPNDLVGMESPVEELEKLLLLDPVEDVRIVGIFGMGGIGKTTLASVLYHRISHQYDACCFIDNVSKVYRDCGPTGVAKQLLHQTLNEENLQICNLHNAANLIQSRLRYVKTLIVLDNVDEVKQQEKLVLNREWLGAGSRIIIISRDMHNLKEYGVTSVYKVQLLNGADSLKLFCKKAFNCDDIVGGYKELTYDVLKYANSLPLAIKVLGSFLCGRSVSEWRSALVRLKENPNKDILDVLQISYDGLQELEKQIFLDIACFFSGYEELYVKKVLDCCGFHAEIGIRVLLDKSLIDNSHGFIEMHDLLKVLGRKIVKGNSPNEPRKWSRLWLPKDFYDMSKTTETTNNEAIVLDMSREMGILMTIEAEALSKMSNLRLLILHDVKFMGNLDCLSNKLQFLQWFKYPFSNLPSSFQPDKLVELILQHSNIKKLWKGIKYLPNLRALDLSDSKNLIKVPDFRGVPNLEWIILEGCTKLAWIHPSVGLLRKLAFLNLKNCKNLVSLPNNILGLSSLEYLNISGCPKIFSNQLLENPINEEYSMIPNIRETAMQSQSTSSSIIKRFIPFHFSYSRGSKNSGGCLLPSLPSFSCLHDLDLSFCNLSQIPDAIGSILSLETLNLGGNKFVSLPSTINKLSKLVHLNLEHCKQLRYLPEMPTPTALPVIRGIYSFAHYGRGLIIFNCPKIVDIERCRGMAFSWLLQILQVSQESATPIGWIDIIVPGNQIPRWFNNRCVGNSISLDPSPIMLDNNWIGIACSVVFVVFDDPTSLDNDWKSSISIGFETKSYSSRGSPLYIPILLDRNLVTVKLHHLWLLYLTRGEFFSYFKIEKMLDLYGIKMHAMVDNSQGLHLEVCSCGYQWVFEEDLQNLNPTIMRRGYSNIPVDDDFVNGGSILSLEAGS

SEQ ID NO: 225782 - protein, 432 aa, Glycine max
  Coding DNA Sequence Number=SeqID_109004
  Gene Ontology: Mol. function=nucleic acid binding; Cellular component= proton-transporting two-sector ATPase complex; Biological process=DNA integration
  Homolog annotation: Hit_ID=Q1S9K1; Match level="QueryCoverage=78%, HitCoverage=56%, E-value=3e-54, Identity=46%"; Hit description =Integrase, catalytic region; Zinc finger, CCHC-type; Peptidase aspartic, catalytic
  Pfam annotation: Domain name=rve; Domain location=170-324; Score =51.5; E_value=2.8e-12; Accession=PF00665.16; Description=Integrase core domain
MVGRNMEKFLDTNRTLDISLRPIKKSILHKAFIKRQVTWRRNCWHHWKPKLKWRKEKMLHNVTIVRNLDMWKRIAPIKTSIKQIPLKSMTISNMFSMLLEIPMIGQVEMGIWIAVAAITQPQSKFNWEMESWSKGKDTVVVETKKGMRFIKDVLLVPNLKENLLSIGQMMEKGYSFHFEGDMCTIYDKKNKRQEIAKNNLVYFFKEKLEVTGIFKKFETLVEKKSGKHTNIIGSGRRKEYNLHEFDKFCEDESIKQQLTIKYSLQQNGMSQRKNKTIAEMARSMLKEKGLPNTFWTKAIYIAVYVHNKCPTKAVQDKTPIEAWSGQNSSAKHLRVYGSICYIHHKRHELQDKSTREIFMGYNMQSKGYRVYDLQTKNASSIEMLRLMKIFLGWGSRKSSRSGRRSRYASVSSTTRFFTRVYSKMSKIIGGHI

SEQ ID NO: 225783 - protein, 121 aa, Glycine max
  Coding DNA Sequence Number=SeqID_109005
MKTFVLLSRFMGHCRRMIHCSYGHFNSYCNSKKELKENKQKDSRELYILQQAVDDVIFPRIMDATNVKDAWSTLQEEFQGSNKASQTKEIIICVSVMVQRWIVTPSVDGQMDMVEWGFWVT

SEQ ID NO: 225784 - protein, 215 aa, Glycine max
  Coding DNA Sequence Number=SeqID_109006
  Subcellular localization annotation: CTP_CleavageSite=67; ConfidenceScore=5.42e-01
MSSLVTGSWGANTFLVRKQLPNPHFQNTQTFVILVFLTFSSYKRWWRLHKFSFNGRHTLGPSERPFHALAKGQVATVGDSTGDLTIIIVIKRKERTLRCPYRSRRPVSVLGEVEEGKVVGGVPLPNTLEGPQFRPQPQPLHFVAGRIPPSIVERGKLDHIKVRLRAIEGGRDHAFADMTELYLVLDVIFPPKFRVPNFDKYKGTACPKNHQKLYY

SEQ ID NO: 225785 - protein, 174 aa, Glycine max
  Coding DNA Sequence Number=SeqID_109007
  Homolog annotation: Hit_ID=Q1SDG1; Match level="QueryCoverage=28%, HitCoverage=4%, E-value=2e-07, Identity=48%"; Hit description =Integrase, catalytic region; Zinc finger, CCHC-type
  Pfam annotation: Domain name=zf-CCHC; Domain location=70-87; Score =22.4; E_value=0.0002; Accession=PF00098.13; Description=Zinc knuckle
MVAGNTTIEKPRDQWDEDERRRVQYNLKAKNIIIVALGMDEYFRVSNCKNEKEMWDTHYKNKGEDSSSIPKCYECDQLGHLRVDCPIFKRRMEKSDKKTFKDKKGKKAYITWEDNDMDSSSDSENKIVNLSLMAKDYESEYEMMTKVMTKSSKVNQKNEFKIFKIESRTLQDSR

SEQ ID NO: 225786 - protein, 118 aa, Glycine max
  Coding DNA Sequence Number=SeqID_109008
MVTGNMHPQLKEKLVAQEYGDLNQLASKANQIEQSIHEKELKTTNKGQRSHLILLDNIDNKNSEAFEEVKFEIMGAKNLRGKSHLCPTLKPGKDKALLKMGRPSMILTYSRQIRFSTI

SEQ ID NO: 225787 - protein, 472 aa, Glycine max
  Coding DNA Sequence Number=SeqID_109009
  Gene Ontology: Mol. function=zinc ion binding; Biological process =protein folding
  Homolog annotation: Hit_ID=Q338Y6; Match level="QueryCoverage=82%, HitCoverage=93%, E-value=3e-81, Identity=42%"; Hit description =Expressed protein
  Pfam annotation: Domain name=DUF641; Domain location=60-192; Score =190.3; E_value=4.6e-54; Accession=PF04859.3; Description=Plant protein of unknown function (DUF641)
MESVKPSAVTPSKSKLARTFAKVLHVRAVTGIAPVDGLKNVKVDADLSNEANMCKSAINIEDEELQERKATEALLAKTFASISTVKASYAQLQNAQSPYDPDGIQVADQLIVSEFKTLSELKQCYFKKQFDPLPDRAILAAKLKELQSVNKTFEITGKKLESQAGLKDSEIIFLQEKLEEANVHNKSIEKRLNQSGSLSVLDNLHMSGLSPSHFVTVLRHTVRSIRSFVKLLVNEMRSAGWDIDASVNAIIEQNVVYLKEDHKCFAIESFVCREMFDSFNFPNFSLPNESLPDKNKRQLFFGRFNELKPVKAKDFLAGKPRSPFAKFCRNKYLRLVHPKMEASFFGNLNQRTLLNAGEFPDTNFFTSFAEMAKRVWLLHCLAFSFEPQASIFQVGKGCCRFSDVYMESVNENDEAALPVVESEPQVAFTVVPGFRIGKTVIQCQVYLSQHQRLTPACNRLLYCVEVEANVLS

SEQ ID NO: 225788 - protein, 93 aa, Glycine max
  Coding DNA Sequence Number=SeqID_109010
MNLKGEKVQAADISLSEAYALSEWHPLSEACSSLSVLGNPRRGSFRDVLAQCAASSPSESFVSSRAQCAQLAKPKFTYSRIASLQKLKHPSSL

SEQ ID NO: 225789 - protein, 212 aa, Glycine max
  Coding DNA Sequence Number=SeqID_109011
  Subcellular localization annotation: CTP_CleavageSite=62; ConfidenceScore=5.26e-01
MVQKQGENTLGMPTSLMTCPIATTFANPSIGNNFVVVSGQLAKIVKPMVQNEMQQTKELEVRMMNASKNYASSMTRNHEVSNQATQPNMIMSGIFNMVQPISNQVGFYPRPLVGNTSYMPVNVSNLFVATPKGKQDAKIPKGEGKMVILRLFLNPDSPRLASGSLGPPNNFMVKGVEMEVQRFRGEGLGKNKRKEEGRREKEAKSSPNRDCN

SEQ ID NO: 225790 - protein, 209 aa, Glycine max
  Coding DNA Sequence Number=SeqID_109012
MLVLLSEAVGCPRSINFLWSRSGLGSRMSLRTPESKKRGHKNLKVLKDKAEMVDLDRPRATSPVVFAPSSPSCQAVMVKQSSRAQAVSPLSRGHLVEPIWDIPQNSFKMLDVILTIRDWKSIQEEGFPMFSKAFDHMAFMGAQNAIFSRFLNTILPRMLIMNLSSMNLRCQVKNEVWLVYDKTKGKWVEGAPISTLDVEDDNNVVVVDV

SEQ ID NO: 225791 - protein, 544 aa, Glycine max
  Coding DNA Sequence Number=SeqID_109013
  Gene Ontology: Mol. function=transferase activity; Cellular component= mitochondrion; Biological process=metabolic process
  Homolog annotation: Hit_ID=Q7X9T6; Match level="QueryCoverage=57%, HitCoverage=74%, E-value=3e-35, Identity=30%"; Hit description =Fertility restorer homologue A
  Pfam annotation: Domain name=PPR; Domain location=155-190; Score =11.0; E_value=0.37; Accession=PF01535.11; Description=PPR repeat
  Pfam annotation: Domain name=PPR; Domain location=229-263; Score =32.2; E_value=1.8e-06; Accession=PF01535.11; Description=PPR repeat
  Pfam annotation: Domain name=PPR; Domain location=264-298; Score =27.6; E_value=4.5e-05; Accession=PF01535.11; Description=PPR repeat
  Pfam annotation: Domain name=PPR; Domain location=299-332; Score =20.3; E_value=0.007; Accession=PF01535.11; Description=PPR repeat
  Pfam annotation: Domain name=PPR; Domain location=333-367; Score =40.7; E_value=5e-09; Accession=PF01535.11; Description=PPR repeat
  Pfam annotation: Domain name=PPR; Domain location=368-402; Score =28.4; E_value=2.6e-05; Accession=PF01535.11; Description=PPR repeat
  Pfam annotation: Domain name=PPR; Domain location=84-118; Score=4.6; E_value=2.1; Accession=PF01535.11; Description=PPR repeat
  Pfam module annotation: Pfam domain module=PPR::PPR::PPR::PPR::PPR::PP R::PPR; Domain location=155-190::229-263::264-298::299-332::333 -367::368-402::84-118
  Subcellular localization annotation: CTP_CleavageSite=59; ConfidenceScore=5.23e-01
MSTSKPISPFRLTSLLRSTKDPSLALQLFLNPNPNPNPNPRPLRHSLRSYDLLITKLARAKMFPQMEQILHQLQTLTQFPVPEPLLCRVIISYARARLPSRALRTFLSIPSFRCTPTLKSFNSLLHALLLCRDFPSLPRLLPRLRHFSASGPDACTYNILIRACSLNNNDLAHARKLFDEMLTLGVRPTQVTFGTLINMLCKDPHLNLREAFSVKEDMERVFKLKPNVFVYTNLIKAVCEVGDFDCAFRLKDEMVRNNLRLDVVVYNTLTSAVFKAGKKGLGYRILEEMKSGGVKPDAVTCNVLIGEFCREGNLVEAYRVLDDGVEGVKPDVFGYNVVIGWLCKEGKWREADDLFRDMPRRQCVPDVVTYRTVFDGLCQWMQFEEAGLVLEEMVFKGYVPCSSSLNEFVGRLCQEGDFELLGKVLSGLGGGFFCNENVWKTVVSLIWFHQMHTQREILFQNTRKEICSLRPSLLDPHQKGVIKSATLASNSTTCGCGCSQTWRYMDLLAWHSHFHCNKLKILGWLIKLMMHGVTSKWMMVFLKC

SEQ ID NO: 225792 - protein, 103 aa, Glycine max
  Coding DNA Sequence Number=SeqID_109014
HVAHRRGWGRCGCRYWGESTEDGDGVDAVGGGDGVSSTSGGLTGIDTEDGDGVDNVRLSRGGNSLTAYHLFFVVVPFPLESCDGSRGGSTLLDDISIYRKIIL

SEQ ID NO: 225793 - protein, 83 aa, Glycine max
  Coding DNA Sequence Number=SeqID_109015
MPKDRGTCLDFRYCHHQKGGDCRQRIKLKVLMIPKDYMNHMLLKGIKLKVLMMPKDYMNHMLLKDLLKTKQLEIFKMDNQDSL

SEQ ID NO: 225794 - protein, 85 aa, Glycine max
  Coding DNA Sequence Number=SeqID_109016
MKSTKGHFEEIQSVTRLGAFNSPKLASCSGTSWIKRIKTMQQLKKEAKTEEEQREEESEKRNREVGAAVIDVEVTVDCILHHFIC

SEQ ID NO: 225795 - protein, 120 aa, Glycine max
  Coding DNA Sequence Number=SeqID_109017
MARRDQVWSFCTHDPRRYLTVICTPLLGRHSCVRWHAETKFGHSAPMIRGDTLRQTQLCPMARRDQVWSFCTHDTRRYLTVICTPLLGKHSCVRWHAETKFGHSAPMIRGDTLRLSAPLC

SEQ ID NO: 225796 - protein, 42 aa, Glycine max
  Coding DNA Sequence Number=SeqID_109018
MTSSAKRGRLQQRRKQGRGSDIFGLMMRGRVTKGERDLIHCD

SEQ ID NO: 225797 - protein, 90 aa, Glycine max
  Coding DNA Sequence Number=SeqID_109019
MEHASRESRVALPPKGRLRHLERENEMAPRKLASKRSRKDKAAEGTSSTPEYDSHRFRSAEHQQRFEAIKGWSFLRERRVQLRDDKYTNF

SEQ ID NO: 225798 - protein, 93 aa, Glycine max
  Coding DNA Sequence Number=SeqID_109020
MDFFNILRKHRDNEKILSLWFNDQAAKIMKGVFVLSSRIDKPFCKYDGFTTRKCVAKVYINIVDLSLVESVRIPYMKNLPPYYILDACGSVCI

SEQ ID NO: 225799 - protein, 68 aa, Glycine max
  Coding DNA Sequence Number=SeqID_109021
MEASIPSSLSRLRTLSEQLEKKIEESQELARDAAIAVERHVSPLRAFSQNTVTLIGLPMFLPSESDLT

SEQ ID NO: 225800 - protein, 290 aa, Glycine max
  Coding DNA Sequence Number=SeqID_109022
  Gene Ontology: Mol. function=nucleic acid binding; Cellular component= chromatin; Biological process=DNA integration
MSQPPGFKDSNSSLVWRLNRALYGLKQAPREWFERLQFTLIQFGFVASKHDPSLFIYAASVYLLVYVDDIIISGSSIQLIQQLTSQLNAKFSLKQLGQLDYFVGIEVKTLSDSSLLLTQSKYIRDLLQKTNMTQAQVISSPTTSSCKLTTTGSDLFTDPTMYRSVVGALQYLTITRPVISFAVNKVCQFMPNPLDTHWAAVKIILRYLKGMVLYGLHLRPAALGQPYSIRALCDADWHQTLMIDVLLLKVVARSSTEAEYRSLAETTAEISWIKTLLTELGVPFITPVIL

SEQ ID NO: 225801 - protein, 119 aa, Glycine max
  Coding DNA Sequence Number=SeqID_109023
  Gene Ontology: Mol. function=receptor activity
  Homolog annotation: Hit_ID=Q9LUQ2; Match level="QueryCoverage=56%, HitCoverage=11%, E-value=3e-16, Identity=61%"; Hit description =Leucine-rich repeat protein; contains similarity to elicitor -inducible receptor EIR
  Pfam annotation: Domain name=LRR_1; Domain location=56-77; Score =15.1; E_value=0.26; Accession=PF00560.23; Description=Leucine Rich Repeat
  Pfam annotation: Domain name=LRR_1; Domain location=80-99; Score=7.1; E_value=14; Accession=PF00560.23; Description=Leucine Rich Repeat
  Pfam module annotation: Pfam domain module=LRR_1::LRR_1; Domain location=56-77::80-99
MKIDIFFVHENVLTKQLIVHRIPALDQWADALSKPLSPARFVFLRGKLNGLKDLTSLKELDLSNNNISVLLPELGLLEPSLQALRLDGNPLRSIRRTVLDRGTKAVLQYLKDKLPEQEQ

SEQ ID NO: 225802 - protein, 118 aa, Glycine max
  Coding DNA Sequence Number=SeqID_109024
MKVYDDAVIYANAMHEYDAGVMHPLGCYEEMHDAIKEQARVSLLCAPELRNLMEMIQKSTSSDNNKGWFQVTLLASRDIILLEENSDEATLLSSVLETQHDHRPTSTPYGSRRPGYRA

SEQ ID NO: 225803 - protein, 182 aa, Glycine max
  Coding DNA Sequence Number=SeqID_109025
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2MV13; Match level="QueryCoverage=77%, HitCoverage=22%, E-value=5e-33, Identity=66%"; Hit description=Beta -mannosidase 4
  Pfam annotation: Domain name=Glyco_hydro_1; Domain location=43-182; Score=-276.7; E_value=8.2e-05; Accession=PF00232.9; Description =Glycosyl hydrolase family 1
MGAITSHTNKMKMLQRQLSVVMTLLCCVHFHVQCCDEVEDAISRSDFPEGFLFGTSTSSYQKQQQIEGAPFEDGRGLSNWDVFSHTPGKIKNDENGDIADDHYHRYLEDIELMSSLGVNVYRFSISWTRILPSKYLNLHTSSHNLSKFPHNLIFMNRNRRDIWGHKSKWDNVLQQDYRQSAA

SEQ ID NO: 225804 - protein, 566 aa, Glycine max
  Coding DNA Sequence Number=SeqID_109026
  Gene Ontology: Mol. function=receptor activity; Cellular component =intracellular; Biological process=small GTPase mediated signal transduction
  Homolog annotation: Hit_ID=Q9LUQ2; Match level="QueryCoverage=98%, HitCoverage=95%, E-value=1e-178, Identity=49%"; Hit description =Leucine-rich repeat protein; contains similarity to elicitor -inducible receptor EIR
  Pfam annotation: Domain name=LRR_1; Domain location=10-32; Score=0.2; E_value=2.6e+02; Accession=PF00560.23; Description=Leucine Rich Repeat
  Pfam annotation: Domain name=LRR_1; Domain location=116-137; Score =15.3; E_value=0.22; Accession=PF00560.23; Description=Leucine Rich Repeat
  Pfam annotation: Domain name=LRR_1; Domain location=177-195; Score =9.8; E_value=4.2; Accession=PF00560.23; Description=Leucine Rich Repeat
  Pfam annotation: Domain name=LRR_1; Domain location=201-222; Score =4.8; E_value=37; Accession=PF00560.23; Description=Leucine Rich Repeat
  Pfam annotation: Domain name=LRR_1; Domain location=224-245; Score =6.1; E_value=20; Accession=PF00560.23; Description=Leucine Rich Repeat
  Pfam annotation: Domain name=LRR_1; Domain location=247-268; Score =17.6; E_value=0.044; Accession=PF00560.23; Description=Leucine Rich Repeat
  Pfam annotation: Domain name=LRR_1; Domain location=270-291; Score =4.8; E_value=36; Accession=PF00560.23; Description=Leucine Rich Repeat
  Pfam annotation: Domain name=LRR_1; Domain location=292-310; Score =12.4; E_value=1.3; Accession=PF00560.23; Description=Leucine Rich Repeat
  Pfam annotation: Domain name=LRR_1; Domain location=333-355; Score =5.4; E_value=28; Accession=PF00560.23; Description=Leucine Rich Repeat
  Pfam annotation: Domain name=LRR_1; Domain location=415-436; Score =11.9; E_value=1.7; Accession=PF00560.23; Description=Leucine Rich Repeat
  Pfam annotation: Domain name=LRR_1; Domain location=438-460; Score =10.0; E_value=3.8; Accession=PF00560.23; Description=Leucine Rich Repeat
  Pfam annotation: Domain name=LRR_1; Domain location=462-484; Score =10.8; E_value=2.7; Accession=PF00560.23; Description=Leucine Rich Repeat
  Pfam annotation: Domain name=LRR_1; Domain location=47-68; Score =11.6; E_value=1.9; Accession=PF00560.23; Description=Leucine Rich Repeat
  Pfam annotation: Domain name=LRR_1; Domain location=486-508; Score =9.2; E_value=5.5; Accession=PF00560.23; Description=Leucine Rich Repeat
  Pfam annotation: Domain name=LRR_1; Domain location=510-531; Score =10.4; E_value=3.2; Accession=PF00560.23; Description=Leucine Rich Repeat
  Pfam annotation: Domain name=LRR_1; Domain location=533-551; Score =13.2; E_value=0.94; Accession=PF00560.23; Description=Leucine Rich Repeat
  Pfam annotation: Domain name=LRR_1; Domain location=70-91; Score =13.8; E_value=0.62; Accession=PF00560.23; Description=Leucine Rich Repeat
  Pfam annotation: Domain name=LRR_1; Domain location=93-114; Score =10.4; E_value=3.3; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1; Domain location=10-32::116 -137::177-195::201-222::...
  Pfam module annotation: Domain location=224-245::247-268::270 -291::292-310::333-355::415-436::438-460::462-484::47-68::486 -508::510-531::533-551::70-91::93-114
MDRLLKAARASGSLNLSNRSLTEIPDEVYRNLEGLGGGDDKWWEAVELQKLILAHNSIASLKEDLRNLPFLAVLNLSHNSLSQLPAAIGELPQLKMLDVSFNSIVNIPEEIGSAMSLVKLDCSNNQLTELPSSLGRCLELSDLKMLVEWLPYAAYLTKGGSNNLITSLPEDLANCSKLSKLDMEGNKLTVISENLISSWTMLTEFNASKNLLNGIPTSIGGLSRLIRVYVHQNRISAIPSSIIGCHSLTELYLGNNNISTLPVEIGALSRLGTLDLHSNQLKDYPVEACKLSLLVLDLSNNSLSGLPPEMGKTILFTDIESLPFVSCLGKMTTLRKLLLSGNPMRTFRSSLVSGPTPALLKFLRSRLSEDEDSEAVTTTKEVIAMATRLSITSKELSMEGLGLSAVPSEVWESGEVIKLNLSRNSIQELPVELSSCVSLQTLILSKNQIKEWPGSILKSLSSLSCLKLDNNPLKQIPLDGFEVVPKLQILDLSGNAASLLDVPAFSSLPYLQELYLRRMRLSEVPSDIVGLQQLRILDLSQNSLQSIPVYCKETCSYSTSVSVSFN

SEQ ID NO: 225805 - protein, 114 aa, Glycine max
  Coding DNA Sequence Number=SeqID_109027
MSLNLWGRHMKYPTTIKPTSNLTSDMQLRGRIPPAMGKLDHIEERLRAIEGSRDYAFANMQQLCLVPDVVIPPKFKVPDFDKYKETTCPKNHLKMYCRRMGEYAKDEKLLMHFF

SEQ ID NO: 225806 - protein, 436 aa, Glycine max
  Coding DNA Sequence Number=SeqID_109028
  Homolog annotation: Hit_ID=UPI00006A2CDF; Match level="QueryCoverage =55%, HitCoverage=67%, E-value=1e-102, Identity=75%"; Hit description= UPI00006A2CDF related cluster
  Pfam annotation: Domain name=DUF917; Domain location=195-430; Score= -216.1; E_value=0.00035; Accession=PF06032.3; Description=Protein of unknown function (DUF917)
  Pfam annotation: Domain name=LysR_substrate; Domain location=1-161; Score=43.1; E_value=9.4e-10; Accession=PF03466.10; Description=LysR substrate binding domain
  Pfam module annotation: Pfam domain module=DUF917::LysR_substrate; Domain location=195-430::1-161
MEQSLLTQQVELGVAYMPVNHPSLATRPLYENRIVAVLPAGHPLAARRQVTAAELAREPLIGYSADIPFGMLVHKLFGAEDAQPEPRIEVQQAHVACALVQAGAGVALVDEITVAGPIWSQVVTVPIADTVSAPVNVFHLQLQPLSRLAQAFIDVLLALDQPVPIGSYDALVHPAQNAAGAAKRNRERKGAAMGRILTMQDVEAAVRGGSVFACGGGGWAEHGRELGSLAVTIGRPELVSMDEVPDDAWIATAAAIGAPGGLTDWQMLGIDYVKAAERLQDALGERLYGLIIGQNGMSSTLNGWLPSAVLGTKVVDAVGDIRAHPTGDMGSLGLAGSPEPMIQCAVGGNRANNAYMELTVHGATGKVSPVLRKAADMAGGFIASCRNPIRASYVRRHAALGGISRALALGEAILAAQPKGGSAVIDAICKATQGEI

SEQ ID NO: 225807 - protein, 33 aa, Glycine max
  Coding DNA Sequence Number=SeqID_109029
MQLAKAGDGARQQRLAQARATGQAQLAFAVLGQ

SEQ ID NO: 225808 - protein, 289 aa, Glycine max
  Coding DNA Sequence Number=SeqID_109030
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2MV13; Match level="QueryCoverage=81%, HitCoverage=46%, E-value=2e-72, Identity=52%"; Hit description=Beta -mannosidase 4
  Pfam annotation: Domain name=Glyco_hydro_1; Domain location=2-282; Score=-28.6; E_value=2.9e-17; Accession=PF00232.9; Description =Glycosyl hydrolase family 1
MHYPKLYLNPGIEPFVTIHHHDLPQELEERYGGWISLLMQRDFVHFAEICFKSFGDRVKYWTTINEPALVANYAYMKGIYAPGHCSPPFGNCNTGNSDVEPLIVVHNMLLAHAKAVELYRKHFQAKQGGTIGIVAHSVMYEPLRDEECDRQAVNRALAFLIPWVLDPLVFGEYPAEMHSILGSQLPVFSLKEKSLLKGSIDFIGINHYGSLYVKDCSLSACSLEADHPITGFVEVTGIRDGVPIGDQVPLCPLAALFILLFTQMFDTGINRFFMVLCCSKGHAEACRLR

SEQ ID NO: 225809 - protein, 107 aa, Glycine max
  Coding DNA Sequence Number=SeqID_109031
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2MV13; Match level="QueryCoverage=73%, HitCoverage=15%, E-value=8e-21, Identity=55%"; Hit description=Beta -mannosidase 4
MRGIYPPGHCSPPFGNCNTGNSDVEPLIALHSMLLSHAKAVDLYRKNFQAKQGGTIGIVPHSLMYEPLRDEESDRQAASRALNGFPNFLFNGFLVSSTTLATPTNKT

SEQ ID NO: 225810 - protein, 440 aa, Glycine max
  Coding DNA Sequence Number=SeqID_109032
  Gene Ontology: Mol. function=urocanate hydratase activity; Biological process=histidine catabolic process
  Homolog annotation: Hit_ID=Q390J0; Match level="QueryCoverage=97%, HitCoverage=77%, E-value=0.0, Identity=78%"; Hit description =Urocanate hydratase
MSCLSNLRRRRVDTVDTLPAHFVQRLFVAGVGIAQHAAGGVVGQRQRQALRRRVGAIGHHRHAGAGHIAAVAAAARVNRHQVGAGRTVDHRVQQRPVGDGVGAVAHVLGHDVRMRHGAGVQVVAGEGHRRGQDAGAHHAVHLQRQFRALAVAEPGDARGQALERHRFARQPDPVGHDQVVGEAPQQEIVDLADVIGVVGQRDPAERADGAREQRAQEGLGKHRDLEGALDAALLRMGADQVAVVEHHGAAILETQHRGDVAHDRAAAGVHQAGHVVAAHARHLLQRVAGRHVAVDQVMRRGLVGDDVGHDAARQDLGIHVGGIAEQAHRQRTARRLRVADQRQRLVQRVGTALQEAGLDAFLDAFRIDLDRQDGGVGHAARQRLGAAHAAHARGQDEAAAQVVVEMALGDAREDLVGALDHALRADVLPVAGGQAVPADQ

SEQ ID NO: 225811 - protein, 409 aa, Glycine max
  Coding DNA Sequence Number=SeqID_109033
  Gene Ontology: Mol. function=protein binding; Cellular component =integral to membrane; Biological process=cation transport
  Homolog annotation: Hit_ID=Q66FB3; Match level="QueryCoverage=82%, HitCoverage=90%, E-value=1e-124, Identity=71%"; Hit description =Putative membrane protein
  Pfam annotation: Domain name=Band_7; Domain location=95-271; Score =180.2; E_value=5e-51; Accession=PF01145.15; Description=SPFH domain Band 7 family
MAWNQPGNNGQDRDPWGSSNNNGGNSGGNNKGGRDQGPPDLDDIFRKLSKKLSGFGGGKGSNSNSGGTGTSGPGFSGRIIGIAAVAVVVIWAASGFYTIKEAERGVVTRFGKFSHLVQPGLNWKPTFIDDVRPVNVESVRELAASGVMLTSDENVVRVEMNVQYRVTNPEAYLFSVVNADDSLSQATDSALRGVIGKYSMDRILTEGRTVVRNDTQRMLEETIRPYNMGITLLDVNFQAARPPEEVKASFDDAIAARENEQQYIREAEAYANEVQPRANGQAQRLLEDSKAYKDRTVLEAQGVGERQRQQPDGAAAGSDAARPRRGAGERQQGYQPDSPQSESCAGCQQQRPAHQRRYCPRGAGGAVRFAVRGAGRPARHRTALRQGSARRRKQAAGVCAGSAPQNPVH

SEQ ID NO: 225812 - protein, 201 aa, Glycine max
  Coding DNA Sequence Number=SeqID_109034
  Pfam annotation: Domain name=HLH; Domain location=50-98; Score=20.9; E_value=0.00086; Accession=PF00010.16; Description=Helix-loop-helix DNA-binding domain
  Subcellular localization annotation: CTP_CleavageSite=49; ConfidenceScore=5.29e-01
MQGHTETNSIMAPLSQIPPSSSSLHLSTDAETGNTTTPRKRVKKMDHTNCESLNVERERRSKMTQMFTQLQTTVPGVLPQATREVIINETIKYIKELEKKKQKLEELKESMKGVEGSILLACGNNMNCSVTVTVSANVAFFGIQSLPRPGLVTVIMKVFCKHRAEVLAANVSVNNGKFILAITATVQNVVVENIKREIMSL

SEQ ID NO: 225813 - protein, 342 aa, Glycine max
  Coding DNA Sequence Number=SeqID_109035
  Gene Ontology: Mol. function=calmodulin binding; Cellular component =integral to membrane; Biological process=response to biotic stimulus
  Homolog annotation: Hit_ID=Q9FI00; Match level="QueryCoverage=99%, HitCoverage=64%, E-value=1e-123, Identity=63%"; Hit description=MLO -like protein 11
  Pfam annotation: Domain name=Mlo; Domain location=1-279; Score=98.1; E_value=2.7e-26; Accession=PF03094.6; Description=Mlo family
MDRHNSLTEITKELTMRRQSTFVKSHASNPLNKNSSLIWVTCFFRQFGHSVVLADYLTLRKGFIMNHNLSFKYDFHSYMIRSMEEEFQRIVGVSGPLWGFVIAFMLFNIKGSNLYFWIAIIPVSLVLLVGTKLQHVIATLALENAGITRFFPEAKLRPRDELFWFNKPELLLSLIHFILFQWQFGYYSCFIRNHLLLYIRLILGLAGQFLCSYSTLPLYALVTQMGTNYKAALIPQRIRETIHGWGKAARRKRRHGMFTDDSTIHTDTSTVLSIEEDDQLIDTPEVELQPATAVTATPSPIANETSSRAVTPLLRPSASISSVQCSSKAEAIPRCSSMPSGR

SEQ ID NO: 225814 - protein, 285 aa, Glycine max
  Coding DNA Sequence Number=SeqID_109036
  Gene Ontology: Mol. function=GTP binding; Cellular component =intracellular; Biological process=biological_process
  Homolog annotation: Hit_ID=Q1SLV9; Match level="QueryCoverage=92%, HitCoverage=46%, E-value=1e-137, Identity=90%"; Hit description =GTP1/OBG
  Pfam annotation: Domain name=MMR_HSR1; Domain location=147-249; Score= 79.3; E_value=1.2e-20; Accession=PF01926.13; Description=GTPase of unknown function
AFEEKYGSSVSAEANDEDGFRDLVRHTMFEKGQSKRIWGELYKVIDSSDVVVQAVESMVLDARDPQGTRCYHLEKHLKENCKHKHMVLLLNKCDLVPAWATKGWLRVLSKEFPTLAFHANINKSFGKGSLLSVLRQFARLKRDKQAISVGFVGYPNVGKSSVINTLRTKNVCKVAPIPGETKVWQYITLTKRIFLIDCPGVVYHNNDSETDVVLKGVVRVTNLKDAADHIGEVLKRVKKEHLERAYKIKEWDDENDFLLQLCKSTGKLLKSFHDSIVVEANDQLY

SEQ ID NO: 225815 - protein, 90 aa, Glycine max
  Coding DNA Sequence Number=SeqID_109037
  Gene Ontology: Mol. function=RNA-directed DNA polymerase activity; Biological process=RNA-dependent DNA replication
MTATCGPIFKLLRKDQGVVWTEDCQKAFDSIKNYLLEPPILIPPVEGRPLIMYLTVLEDSMGCVLGQQDETGRKEHAIYYLSKKFTDCES

SEQ ID NO: 225816 - protein, 205 aa, Glycine max
  Coding DNA Sequence Number=SeqID_109038
  Gene Ontology: Mol. function=RNA-directed DNA polymerase activity; Cellular component=intracellular; Biological process=RNA-dependent DNA replication
LGIYEPVEHNNPALSPNFESPVYEAEEEEDDEIPEELARLLEYEKKTIRPHEEVVEVINLGTKEDKKEVKIGASLEATVKRRVIELLKEYADVFAWSYQDMPGLDPRIVEHCLPLKPECSPVKQKLRRTRPDMALKIKEEVQKQIDAGFLVTSEYPQWLANIVPVPKRDGKVRMCVDYRDLNKASPKDDFPLPHIDVLVDSAEEA

SEQ ID NO: 225817 - protein, 129 aa, Glycine max
  Coding DNA Sequence Number=SeqID_109039
  Gene Ontology: Mol. function=RNA-directed DNA polymerase activity; Cellular component=chromatin; Biological process=RNA-dependent DNA replication
MAVEDREKTSFITPWGTFCYRVMPFGLINAGATYQRGMTTLFHDMMHKEIEVYVDDMIVKSGTEEEHIEYLLKMFQRLRKYQLRLNPNKCTFGVRSGKLLGFIVSQKGIEVDPDKVKAIREMPIPQTEK

SEQ ID NO: 225818 - protein, 127 aa, Glycine max
  Coding DNA Sequence Number=SeqID_109040
MARTRGIGRAIGRLVCRDRPDDQDAADVPERRRPTASARRQRVHQMTANAHDMTDDVPDVAAEAPEMRADVEGLDHAEGSDADDAAEGFPGGPRDPSVLTSFADHERPDLKLVSHGEEGDTNWEASA

SEQ ID NO: 225819 - protein, 45 aa, Glycine max
  Coding DNA Sequence Number=SeqID_109041
TWHPSLGDSGSFVTCRKSKESIVAQFVEFRDMPKIKRKHRCTICE

SEQ ID NO: 225820 - protein, 137 aa, Glycine max
  Coding DNA Sequence Number=SeqID_109042
  Gene Ontology: Mol. function=transition metal ion binding; Biological process=proteolysis
LVATPHTFPPLGSAPVSPALARPRRARCDTVKLDELENEAATILCQLEMYFPHSRFDIMVHLIIHLVREIKCCGPIYLRWMYPVEQYMKILKGYTKNLQCLEAPIVERKNLLGFSSVGMTKRWKERVIEDCIVSLQV

SEQ ID NO: 225821 - protein, 101 aa, Glycine max
  Coding DNA Sequence Number=SeqID_109043
MLNIFNLLASSKSSYSICIYMDDAAEEVFQHVEEARVDAQDFPVIVWKGELSSLGRKVQKFGRPDAEIEGLVVATGLSPLIACSLHTGDRGLCWIKWPWNN

SEQ ID NO: 225822 - protein, 80 aa, Glycine max
  Coding DNA Sequence Number=SeqID_109044
  Homolog annotation: Hit_ID=Q940X6; Match level="QueryCoverage=45%, HitCoverage=44%, E-value=1e-17, Identity=94%"; Hit description =Anaphase promoting complex subunit 11
  Pfam annotation: Domain name=zf-C3HC4; Domain location=41-72; Score =5.7; E_value=0.041; Accession=PF00097.15; Description=Zinc finger, C3HC4 type (RING finger)
MNRVAVTNMPTDPPSNCLPLKTKLLLFILLILTIPLRFTAGTVWGVCNHAFHLHCILKWVNSQTSQAHCPMCRREWQFKG

SEQ ID NO: 225823 - protein, 341 aa, Glycine max
  Coding DNA Sequence Number=SeqID_109045
  Gene Ontology: Mol. function=choline transporter activity; Cellular component=integral to membrane; Biological process=transport
  Homolog annotation: Hit_ID=Q9LUQ4; Match level="QueryCoverage=98%, HitCoverage=48%, E-value=1e-148, Identity=76%"; Hit description =Arabidopsis thaliana genomic DNA, chromosome 3, P1 clone: MJK13
  Pfam annotation: Domain name=DUF580; Domain location=1-336; Score =377.7; E_value=1.9e-110; Accession=PF04515.3; Description=Protein of unknown function, DUF580
MIGEVRALIIFPIIPYGILAVFYMFWISAALHLFSSGRVVQNNCNSNCCAYDLLEKKVICDQCCGYSILYTPHIGVAILFHFFSCYWATQFLIACSSTVIAGSVASYYWAHGEASPEIPFLSVFSSMKRLLRYSLGSVALGSLTVSFVESIRFLLESIRRKLKGSSHVPDSWIGKAAHQSSQCFRRSIEWTIKSVNRNAYIMIAITGKSFFRASAIATELIMNNILRIGRVNVIGDVILFLGKLCVSLSSAAFAFLMLDAHKYRSAHNKISSPLLPVVVCWALGYIVATLFFAVVEMSIDTIILSFCQDSEEHGTAQYAPPLLIETLGDQNEMQRLTQGPQ

SEQ ID NO: 225824 - protein, 111 aa, Glycine max
  Coding DNA Sequence Number=SeqID_109046
  Gene Ontology: Mol. function=protein disulfide oxidoreductase activity; Cellular component=chloroplast; Biological process =glycerol ether metabolic process
  Homolog annotation: Hit_ID=Q95AH9; Match level="QueryCoverage=93%, HitCoverage=58%, E-value=3e-47, Identity=80%"; Hit description =Putative thioredoxin m2
  Pfam annotation: Domain name=Redoxin; Domain location=3-111; Score= -7.7; E_value=0.016; Accession=PF08534.1; Description=Redoxin
  Pfam annotation: Domain name=Thioredoxin; Domain location=7-110; Score=160.6; E_value=4.1e-45; Accession=PF00085.10; Description =Thioredoxin
  Pfam module annotation: Pfam domain module=Redoxin::Thioredoxin; Domain location=3-111::7-110
MCCRGRKLAPITDANWQSLVLESESPVLVEFWAPWCGPCRMIHPIIDELAKEYVGRLKCYKLNTDESPSTATRYGIRSIPTVIIFKNGEKKDTVIGAVPKTTLTSSIEKFL

SEQ ID NO: 225825 - protein, 239 aa, Glycine max
  Coding DNA Sequence Number=SeqID_109047
  Homolog annotation: Hit_ID=Q9LUQ4; Match level="QueryCoverage=95%, HitCoverage=32%, E-value=1e-107, Identity=75%"; Hit description =Arabidopsis thaliana genomic DNA, chromosome 3, P1 clone: MJK13
MRGPLGAVIGRYPSSDGTTHLGGIIRHNKKCRDIAVLVIFVAFWIALIVNSSFAFNRGNPLRLTYGLDYKGNVCGQKHAVQDLRELELRYWLSPNQVYQSGLKDSQFKLANARSICLLDCPIPSEDSLTWVCDYPEGDIRVSLNDWIDMNYDYFEFLTPEMRNSSLQLQGPCYPVIFPSVNVYWSCQFIVKASNVSLKHWRQMGGVNINEDIVIDKSIHEYINSHSAVLKGKHNTLSAS

SEQ ID NO: 225826 - protein, 78 aa, Glycine max
  Coding DNA Sequence Number=SeqID_109048
MTYVGWIGNDAISPIIGEHDPYIHVFVRELTHLRVVTVLMTFIMLVAILTSIAVVRRILMATSVLKASITLLYAIMKL

SEQ ID NO: 225827 - protein, 378 aa, Glycine max
  Coding DNA Sequence Number=SeqID_109049
  Homolog annotation: Hit_ID=Q9FHZ6; Match level="QueryCoverage=43%, HitCoverage=45%, E-value=6e-48, Identity=58%"; Hit description =Arabidopsis thaliana genomic DNA, chromosome 5, P1 clone:MGN6
MSRDENANGSQPESDDDDEAPARRYSRKSRENSDVDSEPDRKHINSRRGTSDSDDGDRRRRRERKSRRHYCSESDSGSGKAREDSDVDSETDRKQCNSRRKSQGGRSDSDDGDRTHRRKRKSRRRHSSDFGSEESESERSGSESESEEERKRREKRRRREKEDEREWKRRRREKERKRRRREKEKEEEERRKKEKLKKKKKKEKEERGKKGAVTNSWGKYGVIRETDMWTKRPEFTAWLAEVKQVNLENMSNWEEKQMFKEFMEDHNTATFPSKKYYNLDAYYRHQMEKEMKKGFKKVQATERTVFNDEEQRRQELLQAREKHKEEQVMALKHSMQTGMAQAMKEQTQLREEMAYQYKLGNFEAAAAIQRRLDPDAAI

SEQ ID NO: 225828 - protein, 98 aa, Glycine max
  Coding DNA Sequence Number=SeqID_109050
MKVLQSRSSFYQKNLLFKKVLPDEQFVLPEEPSSGSFPEEGFSIRTQIVLLEEGSSGRTQIVLLENFRKNLLPEAFRKNLLSEEEIIFLTQGQFCPFT

SEQ ID NO: 225829 - protein, 109 aa, Glycine max
  Coding DNA Sequence Number=SeqID_109051
  Gene Ontology: Mol. function=protein disulfide oxidoreductase activity; Cellular component=chloroplast; Biological process =glycerol ether metabolic process
  Homolog annotation: Hit_ID=Q95AH9; Match level="QueryCoverage=70%, HitCoverage=42%, E-value=3e-09, Identity=51%"; Hit description =Putative thioredoxin m2
  Subcellular localization annotation: CTP_CleavageSite=56; ConfidenceScore=5.69e-01
MATVQLQSLTLVRSSALPSATFSPPIALSGRRNSAALPRYACLRLRPAAETCFPTRAALRTAPRGGGVKCEAGDTAVEGSVWVQTLLAQAKCSAVFGLWTKSNPHQPGP

SEQ ID NO: 225830 - protein, 65 aa, Glycine max
  Coding DNA Sequence Number=SeqID_109052
MEESPYNSLEPIETDAKLYFRFRRYAPKELPGCARQKAQAKILKHIMITNLDHRWDHMLNREALW

SEQ ID NO: 225831 - protein, 332 aa, Glycine max
  Coding DNA Sequence Number=SeqID_109053
  Gene Ontology: Mol. function=sugar binding; Biological process =protein amino acid phosphorylation
  Homolog annotation: Hit_ID=Q1T2V3; Match level="QueryCoverage=99%, HitCoverage=100%, E-value=9e-95, Identity=56%"; Hit description =Concanavalin A-like lectin/glucanase
  Pfam annotation: Domain name=Lectin_legB; Domain location=28-232; Score=47.4; E_value=1.3e-13; Accession=PF00139.10; Description =Legume lectin domain
MAPFPTSHYYFRAFTFSILFLKTLAFDPIPLFYYAGFGKDLKFTPNVALFGNAKVLNEGSGIHFSGSGSSGDTGRVMYKKPIKLFQVSLEDGGGLAFVMAPKGSEGDMFYQSSYGLNSRKFEVVGVEFSASKGGRKGVSSSCHVNMNIGGFVAKKSNTSIGEKLHVWIDYEASSKRLEVRLSQHGKSRPSYPLLWQSIDLSNVLKEKEMLVGFSSVKGNDSQACFLYSWSFVLRNFPHSMHSEPLDPKVFVKNTESPVVKQRSDCFLRVLAAMIFGTGCGALTAFIVLYLWTIFGNNKRAVVPEESVVQPVDVEYRKNVRIVVDKTIEDGKK

SEQ ID NO: 225832 - protein, 1484 aa, Glycine max
  Coding DNA Sequence Number=SeqID_109054
HCASTVPDSTPTTKLSLKHFPLGDHHTGSYTGGDSIIDVGASWNRFSFYLSKRNTRATQTPNLFKLEGTVSFRSTNTFNDGGGSYYGGQRRYRKGYVTFKLEGFWHASSGKACMVGIGSGYSKKGNSLNVNAVFKLNNVFNASNITSLVSGSLESLSPQKDENYFEPISVLMFPKGNYSYTLDSIEVANEFSHGSDAEQGLALNLNSLSFCKPPLSWGIRRLQLEYSLDCRSSKNCTSISGSFGKLPSLMSLTSTGCSLTTEKHRLRVQVEFSDIGSYWINQSFDPKAMLVGEGWWDEKNNMLCVVVCHVMGNSSSLSGTHVGDCSIRLRLRFPSIWSIKNTISIVGQIWSNKRPNDSGHFKMVTFRNDEESGVGGHGLKYEYSQLEKVNKSCPKHKPNDKGKRYPEAYSDDMRFDMSIRESNKRVAWGYSAPLAVDDEFYESGMYASSYSFSSFSTEVPDGTLNINDNNGSLFNMSYKISLSVISYSKIGDNTSVFNLSSERVKISAEGVYDAGAGTLCMVGCRDLLSNTNTEIPIAHSVDCEILLKFQFPSLDTYDGGYIKGSIESTRHESDPLYFKRLDISAVAYYREAARRNVWRMDVEVMMALISTTLSCVFVGLQLNKVKKEPNLLPFISLIMMSILTLGFMIPLVLNFEALLTQNPNNTMRVFRNNGWLEVNEISVRLITMVAFLLQFRLLYLTWSARKSGESKKGLWIAERNSAYVTSLLYAAGLLIAWLLKLKNGDNKDSVYVPMYQPSPWENIKSYGGLVLDGFLLPQIILNLFLNMRDNVLSFSFYFGTTFVRLLPHAYDLYRTHSDAALDSRSYYYADPSEDFYSTAWDIAIPLGGILFAMIIYLQQRFGSHYILPHRFKGSKVYEKVPEKVPVVTESEAETGKYLNLDAVFKLDNVFDASNITRLVSGSLESLSSEKEIANEFSSGSDAMKGGLSLNSLSFCSRPLSRAIRRLPLEFSPECNSSKNCTPFSESSGEGWWDEKKNILCVVACHIIGNTSSLAGTHVGDCSIRLRLRFPSTWSINSTSSIVVQIWSNKSTNDSGYFNMIKFRNEEDGRVGIQATKYEYSLLNRVKMSCLKHKPVKNKGKRYPDAYSSDMRFDMAIRESNKRVAWGYSSPLAVGDEISTFDQNVSSSIVEAPEVVLNSGGLFNISYKILLWYNSTSNDKNSLLNQSSWSVRISAEGIYDSGAGSLCMVGCRDIHLNSLKPTAHSVDCEIVVKFQLPPLDAKSGIFIKGSIESTCKKSDSLYFKPLELSSAAFYTEAAEKAVWRMDMETIMVLISTTLACVFVGLQLYHHFLLKILTTKTVFANVGWLEVNEIAVRLITMATCVTLPLYAAGLLVALLLKLKKDGDGVPVITPLNQNHSSWENLKSYGGLVLDGFLLPQIILNLTHNYARVDSGSYFYADPSADFYSTAWDIVIPLGGILFAIIIYLQQRFGAHCILPQRLKGSKLYEKVPVVAESEAEVETTNL

SEQ ID NO: 225833 - protein, 284 aa, Glycine max
  Coding DNA Sequence Number=SeqID_109055
  Gene Ontology: Mol. function=metal ion binding
  Homolog annotation: Hit_ID=P0C034; Match level="QueryCoverage=27%, HitCoverage=29%, E-value=7e-13, Identity=42%"; Hit description=RING -H2 finger protein ATL1K
  Pfam annotation: Domain name=zf-C3HC4; Domain location=236-277; Score= 33.5; E_value=7.2e-07; Accession=PF00097.15; Description=Zinc finger, C3HC4 type (RING finger)
MAEFTELFPLGEPFDGLMHMYVYVITFDLPTLFIVLFIPTVLFFILYQVLNGLFFWLMEMRPIEHDIEEGITHLANYGDSVPSHHVTIFHALVHSNLHAWTLVTAFEGVFYEKRGQRLRASKKLPPLVNYGMHATIFSTIVLLLLLKIFETISDILLERLEDDVEEGTIRTLVVESFLTYQDAFNEISDGRERLQTYIQASEMRPIHKGPSIKLPQLVSYGQDQDDELRSFCSSDCVICLESFITGESCQILPPCNHLFHSYCIEHWLKDNATCPVCRNCLLET

SEQ ID NO: 225834 - protein, 61 aa, Glycine max
  Coding DNA Sequence Number=SeqID_109056
MFLIRQHRVRVQMLSMYLDVVSSFEAYYRARVWSGPVRIEKREESLERDSQVQGSIYEVQG

SEQ ID NO: 225835 - protein, 235 aa, Glycine max
  Coding DNA Sequence Number=SeqID_109057
  Gene Ontology: Mol. function=RNA-directed DNA polymerase activity; Biological process=RNA-dependent DNA replication
  Homolog annotation: Hit_ID=Q1S7B8; Match level="QueryCoverage=87%, HitCoverage=28%, E-value=4e-20, Identity=33%"; Hit description=RNA -directed DNA polymerase
MKCCVESSSTSVLVNGSPTKEFLVEKGFRQGPLVPFLFLMVAERLSGLVREAERKRLFEGAQVRSGNLKVSILQFVDDALFSEKLDRLPMVLNCRRMEVPFTYLGLPKVVLVLESLFRNFLWGGEGERKRTLLGKWGWRLLSEQQSFWVKVIKEKYGVSCGGVHEWEWNKGSLGWKDIGKLEDMAVYRKFRRLFDVSNEKQATIKEMGCWEGNVYLHGRKNKMTILLRYSIPTSA

SEQ ID NO: 225836 - protein, 78 aa, Glycine max
  Coding DNA Sequence Number=SeqID_109058
MESVKGLDSQKNSGRAQRYGEVDDERSNKLIGRSENVVSSFEAYYRARVWSGPVRIEKREESLERDSQVQGSIYEVQG

SEQ ID NO: 225837 - protein, 114 aa, Glycine max
  Coding DNA Sequence Number=SeqID_109059
  Gene Ontology: Mol. function=small conjugating protein ligase activity; Biological process=protein modification process
  Homolog annotation: Hit_ID=Q1RVR2; Match level="QueryCoverage=78%, HitCoverage=11%, E-value=1e-31, Identity=72%"; Hit description =Ubiquitin-conjugating enzyme, E2
MRQIPRDGEFAYPYEAVLNFEDFVKGHFCSRASDILVACKAYMEGAQVGCLVKGGVQDVDEGDRSCSQRFKDSLSGYMNMLVKEFAKVGAKDIEKLLPPATTPVVNKPSGLSIA

SEQ ID NO: 225838 - protein, 226 aa, Glycine max
  Coding DNA Sequence Number=SeqID_109060
  Gene Ontology: Mol. function=transcriptional elongation regulator activity; Cellular component=plastid chromosome; Biological process =regulation of transcription, DNA-dependent
  Homolog annotation: Hit_ID=Q1T2V4; Match level="QueryCoverage=91%, HitCoverage=62%, E-value=3e-73, Identity=64%"; Hit description=NusG
  Pfam annotation: Domain name=KOW; Domain location=171-204; Score =29.6; E_value=1.1e-05; Accession=PF00467.19; Description=KOW motif
  Pfam annotation: Domain name=NusG; Domain location=2-93; Score=28.4; E_value=2.5e-05; Accession=PF02357.9; Description=Transcription termination factor nusG
  Pfam module annotation: Pfam domain module=KOW::NusG; Domain location= 171-204::2-93
MQLQVLLVLLSNLNWNFTSEIYAPSVNVKRRLKNGSYSVKPKQLFPGCVFLRCVMNKELHDFIREYDGVGGFLGSKVGNTKRQINRPKPVSAEDMEAIFRQAKEEQEKTDQAFEQEEKKASLDSGIRNTELEPDDILNAIVDYKSKRGSRKASNQVKATDASSTRINYKLLVPGSTVRVLSGTFSGFTGTLKKLNRKTKLATVHFTLFGKENIADIDVNEIAIETN

SEQ ID NO: 225839 - protein, 145 aa, Glycine max
  Coding DNA Sequence Number=SeqID_109061
  Gene Ontology: Mol. function=monooxygenase activity; Cellular component=integral to membrane; Biological process=electron transport
  Homolog annotation: Hit_ID=Q1SJ90; Match level="QueryCoverage=95%, HitCoverage=31%, E-value=3e-41, Identity=55%"; Hit description=E -class P450, group I
MVMETDIDNLPYLQAIVKETLRLHPPSPFLLRESTGNCTIAGYDIPAKTQVFTNVWVIVRGQHYQLLPFGSGRKGCPGASLALKVAHTTLATMIQCFELKAEEKGGYCGSVDMEEGPSFILSRVEPLICVPKSRFMQFPLYHAKY

SEQ ID NO: 225840 - protein, 35 aa, Glycine max
  Coding DNA Sequence Number=SeqID_109062
MERTRRVGEVLTKGCNVISRNGGANSTPKQCYSRT

SEQ ID NO: 225841 - protein, 103 aa, Glycine max
  Coding DNA Sequence Number=SeqID_109063
MVPKYLFRSPGYYLFVWMRNLSASTPGRQIREEFTSITQQESPTEGLAFHSKQAPFTIRRGIKRNYLLTKEWGCDMNDSRMEKEEREETPFQGEDESRRSSPP

SEQ ID NO: 225842 - protein, 121 aa, Glycine max
  Coding DNA Sequence Number=SeqID_109064
MAPKKLSTKRSRKDATGEGFNAALEFDNHQFRSAEHQQRFEAIKGWLFHWERRNSMPTPDPLRRGFGTCARGRNQADGFDEEAIAQMLCIPRQYFAQTAAGRRHDYPDPDMDDTAAQQRLA

SEQ ID NO: 225843 - protein, 158 aa, Glycine max
  Coding DNA Sequence Number=SeqID_109065
  Gene Ontology: Mol. function=helicase activity; Biological process =viral genome replication
  Homolog annotation: Hit_ID=Q9FHV5; Match level="QueryCoverage=98%, HitCoverage=10%, E-value=6e-41, Identity=53%"; Hit description =Helicase
MAYDKEMLAEQYNTAYQLLTDEQKTIVDTIMSVVNTQSAAVYFLYGYGGTGKTFVWTTLSSGIRSNGGIVCTVASSGIASLLLPGGRTAHSKFAIPVPATENSTCNIHQGSELAELLKVTKLIVWDEAPMCHKFAFEALDKSLKDIMQNNLPFGGKIM

SEQ ID NO: 225844 - protein, 185 aa, Glycine max
  Coding DNA Sequence Number=SeqID_109066
  Gene Ontology: Mol. function=oxidoreductase activity; Cellular component=membrane; Biological process=electron transport
  Homolog annotation: Hit_ID=Q2MJ18; Match level="QueryCoverage=92%, HitCoverage=33%, E-value=1e-79, Identity=84%"; Hit description =Cytochrome P450 monooxygenase CYP72A59
MQHMRDFLPAPGTSDVIARTAFGSSYEEGRRIFQLQKELAELTMKVIMNVYIPGWRFVRTATNRRMKEIDRDIKASLTDMIKKRERALKTGEATKEDLLGILLESNHKEIQEHGNNKNVGMNLNDVMEECKLFYFAGQETTSVLLVWTMVLLSRYPDWQARAREEVLQVFGKQAPNFDGLSHLKI

SEQ ID NO: 225845 - protein, 583 aa, Glycine max
  Coding DNA Sequence Number=SeqID_109067
  Homolog annotation: Hit_ID=Q5XWK4; Match level="QueryCoverage=53%, HitCoverage=78%, E-value=1e-63, Identity=42%"; Hit description =Expressed protein-like
  Pfam annotation: Domain name=DUF616; Domain location=207-522; Score =662.7; E_value=2.8e-196; Accession=PF04765.4; Description=Protein of unknown function (DUF616)
  Subcellular localization annotation: CTP_CleavageSite=59; ConfidenceScore=5.42e-01
MTGVSLGVRTGSYGTLQQNGTVSPKPMLVRRPSKTLLYNPREKERGFFFFCRLLGRGKVAMLLMLALGLCVFVFGCFTVYRGGNINSEIEDTRSYAITRYEFLKPRGVIEDKSEDSNSSRVFSLTSRHRSTARPPPAPNSLSLSKPTRKKGYFPTWGHRCDHFAFPPPPPADRRRPGPRPCPVCYIPVEQAIASMPSSPSESPILRTLTYVHDENPIESEPHGGSDFGGYPSLEERDAAFNIKETMKVHCGFVKGSRPGRQTGFDFDEADLLELDQYHDVIVASAIFGNYDVIQQPRNISSEAKKNIPFYMFIDEETEMYMKNASILSSSRRVGLWRIIIVRNIPYADSRRNGKVPKLLLHRIFPNVRYSIWIDGKLELVVDPYQVLERFLWRQNATFAISRHYRRFDVFVEAEANKAAGKYENASIDHQIQFYKYHDGLTHYSRAKLPITSDVPEGCVIIREHIPITNLFTCLWFNEVDRFTSRDQLSFSTVRDKIMAKTDWSINMFMDCERRNFVIQAYHRDILEQMPPPAVVTRRPGQPASYTSRPQMKSHPRRGKVDKRSGSKRHHRVVGTVLTNHMLI

SEQ ID NO: 225846 - protein, 104 aa, Glycine max
  Coding DNA Sequence Number=SeqID_109068
  Subcellular localization annotation: CTP_CleavageSite=56; ConfidenceScore=5.09e-01
MWVAGKRGNDNLVGGVAVAFWNGLGRRIGDGGSRRSVNGGKRQWQIFRRRRRRKCRCTHTEIFGMGPLAQQNVLPKTKVQRLLLNHVNGPFIHVKQCFISYKED

SEQ ID NO: 225847 - protein, 554 aa, Glycine max
  Coding DNA Sequence Number=SeqID_109069
  Gene Ontology: Mol. function=4 iron, 4 sulfur cluster binding; Cellular component=mitochondrion; Biological process=biotin biosynthetic process
  Homolog annotation: Hit_ID=Q6D3B9; Match level="QueryCoverage=61%, HitCoverage=99%, E-value=1e-163, Identity=83%"; Hit description =Biotin synthase
  Pfam annotation: Domain name=Aminotran_1_2; Domain location=369-554; Score=-57.0; E_value=0.00016; Accession=PF00155.11; Description =Aminotransferase class I and II
  Pfam annotation: Domain name=BATS; Domain location=218-310; Score =188.6; E_value=1.5e-53; Accession=PF06968.3; Description=Biotin and Thiamin Synthesis associated d
  Pfam annotation: Domain name=Radical_SAM; Domain location=45-207; Score=88.0; E_value=2.9e-23; Accession=PF04055.11; Description =Radical SAM superfamily
  Pfam module annotation: Pfam domain module=Aminotran_1_2::BATS::Radica l_SAM; Domain location=369-554::218-310::45-207
MANRWTLAQAQALFDKPFLELMFEAQQVHRQHFDPRQVQVSTLLSIKTGACPEDCKYCPQSARYKTGLETERLMEVEAVLESARKAKAAGSSRFCMGAAWKNPHERDMPYLEQMVQGVKAMGMETCMTLGTLDHDQAQRLASAGLDFYNHNLDTSPEFYGSIITTRTYQERLDTLDKVRNAGIKVCSGGIVGLGETVNDRAGLLVQLANLPTPPESVPINMLVKVKGTPLADNDDVEPFDFIRTIAVARIMMPTSHVRLSAGREQMSEQTQAMCFMAGANSIFYGCKLLTTPNPEEDKDLILFRKLGLNPHQTEVLAGDNEQQQQLEQQIINADTDQFYNAAARRAADAFRVRRVVENGAGRFLTRENRQFCNFSSNDYLGLSQHPAIIRAWQQGAEQYGVGSGGSGHVSGYTTAHQALEETLADWLGYPRALLFISGFAANQAVITALMGKNDRIVADRLSHASLLEAANLSPAQLRRFAHNDAGQLAALLGKPCDGQQLVVTEGVFSMDGDSAPLAALHDAAKRQNAWLLVDDAHGIGVMGDEGRGSAHQQQ

SEQ ID NO: 225848 - protein, 154 aa, Glycine max
  Coding DNA Sequence Number=SeqID_109070
  Gene Ontology: Mol. function=adenosylmethionine-8-amino-7 -oxononanoate transaminase activity; Cellular component=cytosol; Biological process=biotin biosynthetic process
  Homolog annotation: Hit_ID=P53656; Match level="QueryCoverage=98%, HitCoverage=35%, E-value=5e-63, Identity=73%"; Hit description =Adenosylmethionine-8-amino-7-oxononanoate aminotransferase
  Pfam annotation: Domain name=Aminotran_3; Domain location=29-154; Score=-135.7; E_value=7.7e-05; Accession=PF00202.11; Description =Aminotransferase class-III
MFTQDDLRFDRQHIWHPYTSMRDPLPCYPVVAAHGCTLQLADGRELVDGMSSWWAAIHGYNHPRLNQALQQQMAQMSHVMFGGITHPPAVELSRQLIAMTPEALECVFLADSGSIAVEVSMKMALQYWLGRGETRQKFLTLQRGYHGDTFAAMS

SEQ ID NO: 225849 - protein, 126 aa, Glycine max
  Coding DNA Sequence Number=SeqID_109071
  Gene Ontology: Mol. function=ribonuclease H activity; Biological process=DNA integration
MEAANKNIKKIIQKMIVSYKDWHEMLPFALHEGKRLVAMSHGHLYHKRVKNTFDKKVRPRRFSEGDLVLKKVSQALKANRGKWAPNYEEPFVVKRAFSGGALMLTNMDGEELPSPVNSDVVKRYYA

SEQ ID NO: 225850 - protein, 150 aa, Glycine max
  Coding DNA Sequence Number=SeqID_109072
  Gene Ontology: Mol. function=protein serine/threonine kinase activity; Cellular component=nucleus; Biological process=protein amino acid phosphorylation
  Homolog annotation: Hit_ID=Q6ZCC7; Match level="QueryCoverage=63%, HitCoverage=12%, E-value=1e-40, Identity=85%"; Hit description =Putative CRK1 protein
  Pfam annotation: Domain name=Pkinase; Domain location=15-144; Score= -113.3; E_value=0.083; Accession=PF00069.15; Description=Protein kinase domain
  Pfam annotation: Domain name=Pkinase_Tyr; Domain location=13-135; Score=-154.2; E_value=0.0052; Accession=PF07714.7; Description =Protein tyrosine kinase
  Pfam module annotation: Pfam domain module=Pkinase::Pkinase_Tyr; Domain location=15-144::13-135
  Subcellular localization annotation: CTP_CleavageSite=41; ConfidenceScore=5.17e-01
IFPQLSFSIISGYSNVNTSPIGQGTYSNVYRARDLEQRKVVALKKVRFDNLEPESVRFMAREIHILRRLDHPNVIKLEGLVTSRMSCSLYLVFEYMEHDLAGLASHPGLKFTEAQLMAGTPIYFLMSSLKFNSFFLLPLKMRLMKISGRN

SEQ ID NO: 225851 - protein, 121 aa, Glycine max
  Coding DNA Sequence Number=SeqID_109073
MRDKDINFIHFNIVTVVYNNGTNLKILMSHLETSNNNFQNCLMCGISCQCQDVHTILLKFQPASIRPCTLRFRALQCSMETPRLLHDKHTLHSSRILGEMEVDEPWLGLWLPLNYQVDMGA

SEQ ID NO: 225852 - protein, 334 aa, Glycine max
  Coding DNA Sequence Number=SeqID_109074
MSPESVWAWHSSRVYIKTSALTSSIDGRLVKRHLSSCVIRLGMTLLTKVFYLSCCHQQIAIDIYLFYFSSKVENKNFENDATIESNVVCHMLSKGGLMLVIYGDRKWGEGQTRLAIFMIATFLFQDLLRDLLAIQGDSKASLLFSAGRFPQLSELVQKLGICQWWDEYLSRRMEQKAHYFWCEFREISWDPIRHERETSDTTENLGDMLHSKEWASMHKAEDTNPIQNFDKYLDTLDDLLGMPHTGITPCDDVTRDINLSVDELAKLKLVEQILLLSDAFMEAKGKFKEAHKLLADLKEKLKVCRLKNDYVQLKEKVTQTEAIIEGLVLNIQRN

SEQ ID NO: 225853 - protein, 115 aa, Glycine max
  Coding DNA Sequence Number=SeqID_109075
  Subcellular localization annotation: CTP_CleavageSite=54; ConfidenceScore=5.13e-01
MDSSGALSGIIPCSANMHNSFFFQILPRAQRRELCDARFNGASRPRIFFIKGILCFLEEERQRNGKRKRERRRHFKEKMSLEVAHHHSRPWIRAWRKKEMNEGRGREEHEILCSK

SEQ ID NO: 225854 - protein, 145 aa, Glycine max
  Coding DNA Sequence Number=SeqID_109076
MVEKEKFDHIEERLRAIERGGDYAFIDMEMLCLVPDIIIPLKFKVPNFNKYKGIICLNNHLKMYCMKIGAYVKDEKLLMHFFQESLVGAAITWYTVHAPVLLVIVELKYQLSYPNFVWGPSVVGMRPSLTTLRYLAPIVRQFVKF

SEQ ID NO: 225855 - protein, 83 aa, Glycine max
  Coding DNA Sequence Number=SeqID_109077
MCSYANWEYACLAEEEIVNVDQENGEAFDEEVESMVTKILIGKPYLCSALKQGKNTGIVGDGKFEYDKGLANLAERGTQDHIS

SEQ ID NO: 225856 - protein, 204 aa, Glycine max
  Coding DNA Sequence Number=SeqID_109078
MPPAPIIAQSSAYTHPVLPNITEEAFQERLNKRIADLTAELGRIKKELVELNPKITLLNTKLKGNLDQCIPLYALANSLDPNITHLLHQQERLEKDLSTSEIGIVEGRKICDDLRQCLSVSIPPVPSTSAPPSVSIPPVGIMDHIVKIVLKVSNAHVAAIAQNAIIVAPTIDVGLVDQDEGDGGNLNTSSTESNNMITDSIANP

SEQ ID NO: 225857 - protein, 84 aa, Glycine max
  Coding DNA Sequence Number=SeqID_109079
MVDAQKEVDHKKELFPIERKSPSFEAQNPLEEINIETSNKLRMTKDYHEMLGLSRELVEHWIPNKEGAKPHWQPPRKSNPQLLQ

SEQ ID NO: 225858 - protein, 139 aa, Glycine max
  Coding DNA Sequence Number=SeqID_109080
  Pfam annotation: Domain name=DUF1723; Domain location=100-139; Score =15.2; E_value=0.0081; Accession=PF08330.1; Description=Protein of unknown function (DUF1723)
MASTNSSQSKPHEYGDGSDDESLSSSSSFLNSQEYQEQFVALGGFINLLKAHKGHFYLHPCVDDVIDIITFLEHYIHHDSYLIPITSWFQISFIPSNLGTCFCSTTMNMFVFPFGFMTITLQDVATMLGFLIVGDEIPS

SEQ ID NO: 225859 - protein, 83 aa, Glycine max
  Coding DNA Sequence Number=SeqID_109081
  Homolog annotation: Hit_ID=Q9SU40; Match level="QueryCoverage=40%, HitCoverage=5%, E-value=1e-11, Identity=82%"; Hit description =Putative monocopper oxidase precursor
MVISFNGTRIGFGFGVGCGFGIVGGFGGVTRFVFSELKSYGIFMRKVYSSTKEDFVARWHSWHKLSYSCKVELDLPVSSEGSN

SEQ ID NO: 225860 - protein, 104 aa, Glycine max
  Coding DNA Sequence Number=SeqID_109082
MLKEEIGRIYRTGVYVCEGNRGLSWIYVPSRFFHHGQNFSFICSMNMDTTVAIRTLEATYKSLADAAAVETFLNTEKVSVTGGNSEVEAAKVGRLVASSSLVKG

SEQ ID NO: 225861 - protein, 132 aa, Glycine max
  Coding DNA Sequence Number=SeqID_109083
  Subcellular localization annotation: CTP_CleavageSite=52; ConfidenceScore=5.23e-01
ALSTKEGRTPATNSNTQTAQVKTAAETTTVLATKPSIVAVVVLVEAEPEAMEAEMGDSVGTWTMGNDSRGDNSVGGLEKMEKLLKVTTTEEVAWKLEMLTLWSLCDRELVAKARVKGRLGISKYIHATVTIM

SEQ ID NO: 225862 - protein, 130 aa, Glycine max
  Coding DNA Sequence Number=SeqID_109084
  Homolog annotation: Hit_ID=Q1S1S0; Match level="QueryCoverage=28%, HitCoverage=9%, E-value=7e-07, Identity=70%"; Hit description=GAT; ENTH/VHS
MAENHENAAAEVNPIHAKRKYTRWTEEEHRNERIVSRAIELNEQVQKFLARHDSLLSGRPTTIANHLECEEAEEVVLCCTSLPAKSSQYPPKSSKGQLLAIMGPSGCGKSTLLDTLAGIYIITSSEPYEF

SEQ ID NO: 225863 - protein, 114 aa, Glycine max
  Coding DNA Sequence Number=SeqID_109085
  Homolog annotation: Hit_ID=Q1SN45; Match level="QueryCoverage=38%, HitCoverage=2%, E-value=3e-08, Identity=59%"; Hit description=AAA ATPase
MHTIEFQKRGLPHVHLLLFLHPDNKYPSSTDIDEIISAEISSHEDDPELYRLVENHMIHGPCGILQPNSPYTFLPVKLLGEYLLFQSTTKSLLLRDCIFIFQINTTFFMKIMMI

SEQ ID NO: 225864 - protein, 126 aa, Glycine max
  Coding DNA Sequence Number=SeqID_109086
  Gene Ontology: Mol. function=peroxidase activity; Cellular component =vacuole; Biological process=response to oxidative stress
  Homolog annotation: Hit_ID=Q1SAT8; Match level="QueryCoverage=97%, HitCoverage=41%, E-value=1e-34, Identity=68%"; Hit description=Haem peroxidase, plant/fungal/bacterial
  Subcellular localization annotation: CTP_CleavageSite=60; ConfidenceScore=5.60e-01
MVGKGNWFSGSVAFDSRESFRPRRRSKVGPPTATMRSRRRQGTQARGRLGARHCVKPVPREGEVDGCVTLRLVEGVGGDEDGSVAAANHTVVEEEAEHGASSGWRRQLLVGDGFSDDVEEFGTVFW

SEQ ID NO: 225865 - protein, 145 aa, Glycine max
  Coding DNA Sequence Number=SeqID_109087
  Gene Ontology: Mol. function=peroxidase activity; Cellular component =vacuole; Biological process=response to oxidative stress
  Homolog annotation: Hit_ID=Q1SAT8; Match level="QueryCoverage=98%, HitCoverage=43%, E-value=2e-55, Identity=69%"; Hit description=Haem peroxidase, plant/fungal/bacterial
  Pfam annotation: Domain name=peroxidase; Domain location=1-105; Score= -78.4; E_value=0.0033; Accession=PF00141.13; Description=Peroxidase
MVALVGAHTIGLSHFNQFSHRLFNFNKNSEIDPAYNPDYAAGLKKLCQNYTKDPSMSAFNDAITPTKFDNMYYKNLRKGMGLLVTDSAMFDDSRSRPFVDRYADDEKKFFQDFARAMEKLSVLQVKTEGKGEVRSRCDSFNTLNN

SEQ ID NO: 225866 - protein, 119 aa, Glycine max
  Coding DNA Sequence Number=SeqID_109088
MKNKELKGYMSYANGEIELSKWIINKDTLGYSGWRGAEDPPLQPKTFQEQILEHLRRMFMWISRYRYSYTMEEEDTTIKVYEEVGDFIDDEDLMTSEMAFYLRCLGEKDIQGRGGFIRR

SEQ ID NO: 225867 - protein, 142 aa, Glycine max
  Coding DNA Sequence Number=SeqID_109089
MEDVMQELQEMKEQHEDWRSIALEALSANQALQTRIRRSRGKQMTPKRRLEDWRKKDQSIMGFKEFSRIEVRRIIKRFPCKEIVGSEKSYNHGRSLLIPRDMPDRSEGNHGKEEIMREEGHEFQFGIQTDHQILSPTKAKLE

SEQ ID NO: 225868 - protein, 96 aa, Glycine max
  Coding DNA Sequence Number=SeqID_109090
MNKTGDGEETIGGGHMRKRWDALVYPRLCKRSILGLNWGCTKEGWARRIKEEDEASPPVFTRRHHLWSVNPKGHHGQNPIHQREKGLSKNPSPIPL

SEQ ID NO: 225869 - protein, 232 aa, Glycine max
  Coding DNA Sequence Number=SeqID_109091
  Homolog annotation: Hit_ID=Q1S1X7; Match level="QueryCoverage=43%, HitCoverage=8%, E-value=2e-25, Identity=63%"; Hit description =Integrase, catalytic region; Zinc finger, CCHC-type; Peptidase aspartic, catalytic
MGYKEIFSPVVRHTSIRVLLALMAILNMELENLDVKTSFFHGRLEEEILMQQPEGFEEETNNLQVSGTRDLMSSLSLMGTSEVPMTHVFIIARHTTDMVKSTSIMVESDTDALGLCGLTTVLMIDHDPYELTMVMLSKDINLKGHTMVVVKSTTVVVERDAKAMRRCGLITPSKDISLKRHTTAVVKSTTVVIEIDAKALRRCGLITVLMVDHDPHELAMVVVNLPQLLSDC

SEQ ID NO: 225870 - protein, 314 aa, Glycine max
  Coding DNA Sequence Number=SeqID_109092
  Gene Ontology: Mol. function=peptidase activity; Biological process =proteolysis
  Homolog annotation: Hit_ID=Q0WVZ7; Match level="QueryCoverage=49%, HitCoverage=25%, E-value=2e-22, Identity=69%"; Hit description=24 kDa vacuolar protein-like
  Pfam annotation: Domain name=Peptidase_M28; Domain location=156-300; Score=2.3; E_value=3.3e-06; Accession=PF04389.7; Description =Peptidase family M28
NVSFARRTYLRTELSFVRNVTLKNYLDAQYCGEIAIGTPPQNSSSEGSSSGEASEEESSSNGAEIRTTAYVGNPRRSSFVWLALLLIITYFCSSIYHYQFQSMPVPLTAEEAGKRGFSEIETFKHVRALTQLGPHPVGSEALQGRGDDFLVGSIVGALIFMEKGVMLELARGISQWPDGLERAVIFLFNTGEEEGLNGAHSFITQHPWSKTIRVAIDLEAMGIGGKSIIFQMSLYVDNNDIDHPRTRLCNNPSLLGSISTLGTPKTRRCCGPFQRRVRLTPVFVGFPFQHRWRAHPSLFDSMSTSVGEYTVVVL

SEQ ID NO: 225871 - protein, 126 aa, Glycine max
  Coding DNA Sequence Number=SeqID_109093
MAEINQGTDASGARVTTDRLLPLPGDKQAENIAARQPKMAPRKLASKRSRKDKAAEGTSSAPEYDSHHFRSAEHQQRFEAIKGWSFLRERRVQLRDDEYTDFQEEIVRRRWAPLVTPMAKFDRGIL

SEQ ID NO: 225872 - protein, 331 aa, Glycine max
  Coding DNA Sequence Number=SeqID_109094
  Gene Ontology: Mol. function=DNA-directed DNA polymerase activity; Cellular component=membrane; Biological process=DNA replication
  Homolog annotation: Hit_ID=UPI00005F766F; Match level="QueryCoverage =99%, HitCoverage=97%, E-value=1e-101, Identity=56%"; Hit description= COG0470: ATPase involved in DNA replication
  Pfam annotation: Domain name=DNApol3-delta_C; Domain location=212 -325; Score=128.0; E_value=2.7e-35; Accession=PF09115.1; Description =DNA polymerase III, delta subunit, C
MNWYPWLNQPYRQIIARHQSGQAHHALLIQAIDGMGDDALVWGVSRWLMCQQPQGLKSCGECHGCQLMQAHTHPDWYRLEAEKGKASLGIDAVRDVTEKLYHFAQQGGAKIVWLPDATQLTEAAANALLKTLEEPPANCWFFLSVREPSRLLATLRSRCMTWHLSPPEETHSLQWLQKQQPQPQPEAILRAALRLSNGAPAAALALLQPDRWQARQTLCDSLNSALSGDILQLLPALNSDDVAVRLGWLLSLLVDAMKVQQGASNWLSNGDRPDVVTQLAQQFSSSALNASVQQWLQCREQLLHVAALNRELILTDCLLAWGRLLSPATIG

SEQ ID NO: 225873 - protein, 74 aa, Glycine max
  Coding DNA Sequence Number=SeqID_109095
MDSGRFKISVPCDGCPNKALLKEMHQQLFIFHEGLVPPQNARVMVVGKTEGPPKCLAGVHHQLLALQWCIQGKA

SEQ ID NO: 225874 - protein, 2364 aa, Glycine max
  Coding DNA Sequence Number=SeqID_109096
  Homolog annotation: Hit_ID=Q9FIN7; Match level="QueryCoverage=96%, HitCoverage=98%, E-value=0.0, Identity=48%"; Hit description =Arabidopsis thaliana genomic DNA, chromosome 5, TAC clone:K16H17
  Pfam annotation: Domain name=Sec39; Domain location=578-1191; Score= -272.5; E_value=0.019; Accession=PF08314.2; Description=Secretory pathway protein Sec39
MGMNRSGSHRLCALECGAVFEEELPLYETRHHASNQLYQNQHQQQQENDSAKGSLLSLLSSRGTFRFSFDFVEFRPINACLDPTNVRLVSYFEGVSQLKEKWTEYNQPKRLRRLVSLFVSATAKHVAVASGNRITILSKEDDYQNPCAIFTTIGSLGSSFGTFSVGAWSEDEDVLGVADDSDTLYFIKFSGEVVAEIWKKHLKVSSPIVALFSDIDLDTRESYLFSIVTSDGSLQRIEISHGQSGSTFPKYISNHTSLICNNIFCFDCHGELNLFVAVHKNSGMVLAYFKLDKEGFTLSRFVLGERNDSPVSDNLSNGRNRSLVGFMDFTWWCDHILAVVDRVGMVMLIDILNGSKVPEEDPAYYLPVLERAPKYKGYAFLLASQSSIERNNPSDFGSTEKLHQTEWIIEDRLNQFHLSRLLWNLVSFTEKSVPEIYGILISKKKYQAALDFADSHGLDKDKVLKSQWLNSSHGVNEINIFLSNVKDRDFVLSECVDRIGPSEDAEKALLAYGLRITDHHRFSEVDDDNSSQVWDSRLARLQILQFRDRLETYLGINMGRFSVQEYSKFRIMPINEAAIALAESGKIGALNLLFKRHPYSLSPYMLEILAAIPETVPVQMYGQLLPGRSPPSGVAVRKDDWVECEKMFHFINTSVKNHDMQIQVKTEPLVKHFLGFPWPSIDELSNWYTNRAKAMDDFSGQLDNCLSLLEFALRKGISELQLFHQDVLYLHQIIYSNDDSSEMSFNMSLAMWGELSDYEKFKFMLKGVKEENVTERLHNRGIPFMREKIHKETSLENKLDICLVVIEEGCRNFQSNDYFKTEVEAVDCALQCIYLSTVTDRWSIMAAILSKLPQLHVGAIQVEDLERRLRIAECHIEAGRLLAFYQVPKPLNFFLGAQLDEKAVKQIIRLILSKFIRRQPSRSDSEWASMWRDMQYLREKAFPFLDPEYILTEFCRGLLKAGKFSLARNYLKGTSSVALASEKAENLVIQAAREYFFSASSLSCSEARECLNLYPSSGNVKAEADIIDALTVKLPNLGVNILPMQFRQIKDPMEIIKIAITNQTGAYFHVDELIEVARLLGLRSSDGISAVEEAIAREAAVSGDLQLAFDLCFGLARKGHGNIWDLCAAIARGPALDNMDLDSRKQLLGFSLSYCDEESIGELLHAWKDLDMQGQCETLMISTGTDPSKFSVQGSSVNSLPKQNFQNILDENGCFREFDSISADNEDVQLEKTRDMLSIVAKTLAIGDRTDWASILTENGKVLSFAALQLPWLLELSRKGDHHKKFRTGKLYLNIKTQAVLTILSWLARNGFAPRDNLIASLAKSIMEPPVTEEEDIMGCSYLLNLVDAFSGVEIIEEQLKMRKDYQEICRIMSVGMAYSLLHNSGIGIDPSRRKELLKRRFKEKHASPSSDDIDKLGKVQSSFWKEWKLKLEEQKHLTEHSRALEKIIPGVETERFLSRDSIYIENVIISLIESVKLEKKHILKDILKLADTYDLNCTEVLLRYLSIVLVSDVWTNDDITAEVAGYKGEIIGNSVKTIETISTIVYPAIDGCNKIRLAYVYGLLSECYLQLENTRNLSPIVQADHVNANLSLGQYYKVIEQECKNSSFINNLNFKNIAGLHGLNFEYISDEVYACIEESSLSALSKLVQTLVNMYGDSLPDDFMSWQDVYKYYILSLLRALETKVTTDSGIRTPEYLQGFINKLEQSYDLCRVYIRLLSQSDALGIMKQYFAVIMPLYSSYGLLPDNSTWQECLIVLLNFWMRLTDDMKEIALEENSGETSSFNPQCLMSCLKVFMKLVMEDIISPSQGWGSIFGYVNCGLNGDSSAEIYNFCKAMIFSGCGFAAVAEVFSVASSETGSASGCGTCSQDLPHFYLDVLEAVLSELIKGSHESQNLYHILSSLSKLEGDLKFMQCVRHVIWERMVQFSDNLQLPSSVRVFVLELMQFISGKNIKGFSAEILANVQPWEEWNELIYASRKSETDVDKHLPDHKDSSSRVTNTLVALKSSQLVASISPSIEITPDDLLNADTAVSCFMRLCGEASEDLHFDALLTILEEWDELFTAGKDGETTAEASDGGNDWNNDDWDEGWENLVEVDNPEKEKIEDSVFVHPLHLCWAEILRKFISLSRFTDVLRLIDQSSLKPNAMLLDEDDASSLTRIALGIDCFLALKMTLLLPYKTLQLQCLGAVEDSTRQGIPQTRSKDYELLILILSSGILTSIMIDSTYGTIFSYICYLVGNLCNQCQQALVSGRGTNNNEDNENQLLLFTRILFPNFISELVKADQHILAGFLVTKFMHSNESLSLFNIAGASLNRYLKMQLHMLQVNEFPVEKTCKTLKNTVGRLRGKLSSLIQSILPMLSASVS

SEQ ID NO: 225875 - protein, 87 aa, Glycine max
  Coding DNA Sequence Number=SeqID_109097
MAAEWRRKRVERRRHFKEKMSQEEAHHHRKPWIRAWRTCTKCDYMMWQWGVASKCSPPDVNLTRSGSLDIGYNVWMMPLPKREDKSG

SEQ ID NO: 225876 - protein, 51 aa, Glycine max
  Coding DNA Sequence Number=SeqID_109098
MEQSLELGQEMRVFDYSVVQHDNTTTMTTTTTTRVAQRESFWRVSSLNKVE

SEQ ID NO: 225877 - protein, 53 aa, Glycine max
  Coding DNA Sequence Number=SeqID_109099
MVVVAGQGGRAQKYLGGGWLRDVGGFCGWGKGCRAWMTAWVSGACDRVCGGAV

SEQ ID NO: 225878 - protein, 78 aa, Glycine max
  Coding DNA Sequence Number=SeqID_109100
MPNYVSGVVYSCEMMSASTQKLLDMRVVLEGTNSHQATQKLLLMTYKGLATACNSVEEWSPPRKKANKGDKGGDHKST

SEQ ID NO: 225879 - protein, 151 aa, Glycine max
  Coding DNA Sequence Number=SeqID_109101
MGTARGRPRDNVDFLGVTFRRDVLRLQLIPLPLSTSQLQSAELPHELASTGESHSRRLCGGSGVHEQENRAHEVGGVQVDAVGTRWRTTSQVCFHSLFEFPFFSFSLLSTDLVFPLVVSGVLQPALSPNVVKKVGEKYSLVRDLNGKLRLL

SEQ ID NO: 225880 - protein, 65 aa, Glycine max
  Coding DNA Sequence Number=SeqID_109102
MALIHITEVLRVTDVYISQALLDKYDMVVHNLAIMTYQLQSLFGLIDPYMNQLCDPYRTEVESNP

SEQ ID NO: 225881 - protein, 331 aa, Glycine max
  Coding DNA Sequence Number=SeqID_109103
  Gene Ontology: Mol. function=transcription regulator activity; Cellular component=nucleus; Biological process=regulation of transcription
  Homolog annotation: Hit_ID=Q2HVX8; Match level="QueryCoverage=53%, HitCoverage=20%, E-value=5e-52, Identity=57%"; Hit description=Helix- loop-helix DNA-binding
  Pfam annotation: Domain name=HLH; Domain location=131-181; Score=5.7; E_value=0.036; Accession=PF00010.16; Description=Helix-loop-helix DNA- binding domain
MKSVEMSDEISTSQLTSESCPEHLLEAMLANFSHSNNDVNSELSFCKSKQSAIVSAKNHEASIHNVHTINSEGYSIDQLSLVREDKHHSLSSSSGICGVMSSKGISSTFHSSNSGQLERSSEPSKNSKKRARPGESCRPRPRDRQLIQDRIKELRELVPNGAKCSIDSLLERTIKHMLFLQSITKHADKLTDFSDTKSKLHHKEADILGSSSYEQGSSWAMEVGGHLKVHSILVENLSKNGQMLVEMLCEECNHFLEIAEAIRSLGLTILKGATKAHGEKMWICFVVERRASGQWGTKFLRASPGAAVKLCLGDLLVMGSNPETASLHMQG

SEQ ID NO: 225882 - protein, 188 aa, Glycine max
  Coding DNA Sequence Number=SeqID_109104
  Homolog annotation: Hit_ID=P93384; Match level="QueryCoverage=91%, HitCoverage=80%, E-value=2e-24, Identity=39%"; Hit description =Nicotiana tabacum ORF
  Pfam annotation: Domain name=HR_lesion; Domain location=1-161; Score =103.9; E_value=4.7e-28; Accession=PF05514.2; Description=HR-like lesion-inducing
FNAYGVDGGPTAKALRPKFDAFAHQVHSKAGFQLPDIDECDMELDTACEFMHFSAIKCRVSRFGLDTYCLTATSSTYPILTSQQMKILVAGAIALKGLGGILFILGSSFGAFLLLLHQMIATPILYDFYYYDSEDKEFIQLFIKFTQNMALFGALLFFIGMKNSIPRRQPKKKDLTLGVCLVQNECTS

SEQ ID NO: 225883 - protein, 378 aa, Glycine max
  Coding DNA Sequence Number=SeqID_109105
  Homolog annotation: Hit_ID=Q2VWB7; Match level="QueryCoverage=30%, HitCoverage=16%, E-value=7e-11, Identity=39%"; Hit description=Prf interactor 30137
MHGVVSDNMIAVDGQWWITLCVKCGCVLVREKRKKVGSFGWWGGGNCHGCGSSDTANSWTAIKTASRVAEEAGWKRVLQRELGVSEILTWEDAYYNNPDDFDSSENKHCQKTLEQIGCGKFSHSALGLAVAKMSYHAYSLGEGIVGQVAVTGKHRWICADNQVASSGLSFEFADGWQSQFSAGIRTIAVVAVVPLGVVQLGSLNKHYTVGFDNVLANMVQEGIYHLFMVIEDMGFVTHIRNLFLSTQNYSIQCPSQIQGSLKSSSQKSMKSETADVLMPLQCSGTGRNCTPPSACEKMSDNVAKQEGPELYNDESSILLQSISNMMNVDCQEFEEMKPLYGTKYEGGSSGCKDMRLESEKNVSSFLNDFVTDNASFND

SEQ ID NO: 225884 - protein, 93 aa, Glycine max
  Coding DNA Sequence Number=SeqID_109106
  Homolog annotation: Hit_ID=Q0PN09; Match level="QueryCoverage=80%, HitCoverage=43%, E-value=2e-14, Identity=47%"; Hit description =Lateral organ boundaries domain protein
  Pfam annotation: Domain name=DUF260; Domain location=2-84; Score= -17.4; E_value=0.00053; Accession=PF03195.5; Description=Protein of unknown function DUF260
MSCNECRVLRKGCIESCILRLCLQWIDTHEASMIFFSSLFQSLLCEACGRTMNPVNSAEIHWSGSPSMNSKEFETMTSCLESGIEDNYAPDED

SEQ ID NO: 225885 - protein, 864 aa, Glycine max
  Coding DNA Sequence Number=SeqID_109107
  Gene Ontology: Mol. function=identical protein binding; Cellular component=integral to membrane; Biological process=protein transport
  Homolog annotation: Hit_ID=Q3T8Z5; Match level="QueryCoverage=85%, HitCoverage=99%, E-value=0.0, Identity=85%"; Hit description =Autophagy protein 9
  Pfam annotation: Domain name=APG9; Domain location=197-575; Score =708.7; E_value=4.1e-210; Accession=PF04109.6; Description=Autophagy protein Apg9
MFSRQRGASAFSIFKWKHPGASSLTTALLQEDLPEIELSDYGKIPSPGSESPSGLLNGESLNVEPISDLDLFSERLYSYYCEKGLWCIVIKWIVELLSLGFTICFSGFFLLYVDWNGLRNAKCGMDAVESGIKPCDLAKEALHQHPLTPLTLTKSIIVGYLGIFSIYLIFCFLRFFAQLKDTLEIRHFYYNNLHVTDNEIQTMPWATILEKVVLVQRSRQLCVVKDLSAHDIVMRLMRKENYLIGMLNKGVLAFPISQWFPGAGPTVNSSSNGTQNRVILTKTLEWTLNWCILQSMFDRRDFVSNPKTLRKRLMVVGLAMLLVSPFLVIFMLVYLFLRHAEQFYNHPSTASSQRWSNLSRWIFREFNEVDHLFKHRINCGVLHASDYLKQFPSPIISIIAKFISFVSGGFAAILIIIAFLEESLLEGHVFGRNLFWYAAVFGTITAISRAAITNEVLVLDADGAMSMVVQHTHYMPKRWRGKESTEMVHVEFETLFQYTGMMLLEEMASIFLTPYLLLCIVPKRVDDILQFIADFTVNVEGVGHVCSFSAFDFQEHGNSHYGSPCNAPRSRRSSQGKMEKSLLSFQSSYPSWEPSALGKRFLLNLRRFREETLPVHGNVHAPSPPRMWRGSPNIGDRYRFISREMLYSTRDNHLGSLWLVEANQNNHPYLLDWYYTSRSHDTNPGDVPLEEPFGSHDVNLGDVHLEPFGVIKHSSREFLMAPSNLTQNESGYEEYSDEFHDGWAASHLGTSTSAPIFRKSVIHNQSYNELSHTTSSHWWARSDPRGGQTQTSIFEPPAFNHQTYDYHDKFSDRESEDQDHEQSMYSRDDHRLSRTYTDDLGAGEFNLHFDDIYSRPPETPPASF

SEQ ID NO: 225886 - protein, 280 aa, Glycine max
  Coding DNA Sequence Number=SeqID_109108
  Gene Ontology: Mol. function=metal ion binding; Cellular component =integral to membrane; Biological process=ubiquitin cycle
  Homolog annotation: Hit_ID=P93823; Match level="QueryCoverage=97%, HitCoverage=80%, E-value=6e-48, Identity=39%"; Hit description=RING -H2 finger protein ATL1A
  Pfam annotation: Domain name=PHD; Domain location=127-172; Score= -1.4; E_value=0.078; Accession=PF00628.19; Description=PHD-finger
  Pfam annotation: Domain name=zf-C3HC4; Domain location=128-169; Score= 24.3; E_value=0.00043; Accession=PF00097.15; Description=Zinc finger, C3HC4 type (RING finger)
  Pfam module annotation: Pfam domain module=PHD::zf-C3HC4; Domain location=127-172::128-169
MALNHNPSGKLVYQAPHANTIIHHTPQPASDLPIIAIIVPSIFVTAFILITYLTLVNKCCSNWHQLNPLRWISTLRAPQNEDQDPFIALSLSPRMRNHGLDESAIKEIPTLEYKKEEAEKNIQSVCSCVVCLTEFQEHDMLKALPICKHAFHLHCIDIWLQTNANCPLCRSSIISGKKHCPMDHVIAPSSSPQDSQLLSYMGSDEDFVVIELGGENVATLPQMMQQERSDTREIRIVEYSRSHSTRKCHRVSIMGDECIDARKKDGQFSIQPIRRAFSMD

SEQ ID NO: 225887 - protein, 123 aa, Glycine max
  Coding DNA Sequence Number=SeqID_109109
MRHREGEVLEFRTPQHPSLGTNNWGGSSPLLARNVPKESLDQKYSRLNTVRTKDEIFPADDDYYVVNPSNESGASVSSAKRWNKGREDGYREWILRLGGHKVGVDASLFHAFHMLMSLAASAL

SEQ ID NO: 225888 - protein, 353 aa, Glycine max
  Coding DNA Sequence Number=SeqID_109110
  Gene Ontology: Mol. function=nucleic acid binding; Biological process= DNA integration
  Homolog annotation: Hit_ID=Q1RWP6; Match level="QueryCoverage=83%, HitCoverage=52%, E-value=1e-31, Identity=43%"; Hit description=Zinc finger, CCHC-type; Polynucleotidyl transferase, Ribonuclease H fold
MRDIEVASLNLLVNKVIVQEDVLHPRVKNKAGKLEVLTLFLGKPGYRVAAKEDDEREGGGSVVNIPSSICIRAFEVLEVKGGGLCINWEILLMEKDRSGLVMVKVRYCKAPMMLQYRVAPTVGVPSFKMKVAIGDKGVGDGFASAISDLENWWDRVAMKVFMRLMLMPMRKRHIFLEGALKEGIVDVKLMHGLVMVKSNGEDNFDASNRAVEMSFDTEEPLATRNVMILGCKNKSEWAWDECGWGGVIWEDVVMEGNMARCVYFVGNREDAWCGSWLEFVVGVWANKPWEIKATKGVTRNIGISVHGVEGLNQFQLCGDDIAQLLHLVQVLKSYLWLLAVLHEMHGWVELDLI

SEQ ID NO: 225889 - protein, 76 aa, Glycine max
  Coding DNA Sequence Number=SeqID_109111
  Gene Ontology: Mol. function=transcription factor activity; Cellular component=nucleus; Biological process=regulation of transcription, DNA-dependent
  Homolog annotation: Hit_ID=Q9LTC6; Match level="QueryCoverage=62%, HitCoverage=34%, E-value=4e-15, Identity=72%"; Hit description =Similarity to ethylene response element binding protein EREBP
  Pfam annotation: Domain name=AP2; Domain location=30-74; Score=56.3; E_value=1e-13; Accession=PF00847.10; Description=AP2 domain
MGPRQVKDSFISVTKMEDLKEKVNEGEPTQIKYRGVRRRPWGKFAAEIRDSARHGARVWLGTFNTAEEPQELMIGP

SEQ ID NO: 225890 - protein, 171 aa, Glycine max
  Coding DNA Sequence Number=SeqID_109112
  Gene Ontology: Mol. function=nucleic acid binding; Biological process= DNA integration
  Homolog annotation: Hit_ID=Q1SIQ0; Match level="QueryCoverage=91%, HitCoverage=67%, E-value=3e-27, Identity=40%"; Hit description=Zinc finger, CCHC-type
MKFVADRSSLPMFLIVLAYDLLGGTGGCGTSIGRGGVVLGFEAPMYVSKSVRRSWSSVKPIGFSREQSATVTSLYLVTRPSHLGRGKEKELIREGLDAMKVVHKGDNGVSEELILMTPIVIVRMACGGARGGAINEPEKVMAGEESIELDLPRGVIRTLVKLVAYKRLSFS

SEQ ID NO: 225891 - protein, 118 aa, Glycine max
  Coding DNA Sequence Number=SeqID_109113
MDLDLGSFISLQISQITQSSTSRLGFPALITALCDIQGVTSDTLIFESLSPMINLAYIKKNYWNPADLSIIFPRTRHTRTRVAAPAPDAPPPSQVAPRPQVSTSAPSDMHSQTLRSLY

SEQ ID NO: 225892 - protein, 68 aa, Glycine max
  Coding DNA Sequence Number=SeqID_109114
MDFSYRRFLFTVVQLLLIMLNIFVASPESRVACRPLLLHRQWSREYGLHLQSLPNGPAPPSGGFRIHT

SEQ ID NO: 225893 - protein, 62 aa, Glycine max
  Coding DNA Sequence Number=SeqID_109115
MILPLCMSNNRDFFMLKFTRNADDEYQTILYNQRDGSFRTLLWCNFKIFTKTLVISNALSDV

SEQ ID NO: 225894 - protein, 211 aa, Glycine max
  Coding DNA Sequence Number=SeqID_109116
  Gene Ontology: Mol. function=transcription factor activity; Cellular component=intracellular; Biological process=regulation of transcription, DNA-dependent
  Homolog annotation: Hit_ID=Q38895; Match level="QueryCoverage=88%, HitCoverage=79%, E-value=2e-16, Identity=37%"; Hit description =Transcriptional regulator SUPERMAN
  Pfam annotation: Domain name=zf-C2H2; Domain location=29-51; Score =21.5; E_value=0.003; Accession=PF00096.16; Description=Zinc finger, C2H2 type
MEGNFLTRNTHNKGDRFGFEEHSWPARNYACSFCKREFKSAQALGGHMNVHRRDRARLRSCLTPSSWVSSEFPNKPNPSIEPNPTHLSSSSPSSSCISNNLLNCAHTSPLYIPSLTLSSSLTPASPNGDKKPRRVSPHLLPLLIHQRCEEIKMSKNKASGLGVEEVRGCAIGEELKFFKSSTSEHNIKLELGIGLIKQPEKLDLELRLGHC

SEQ ID NO: 225895 - protein, 268 aa, Glycine max
  Coding DNA Sequence Number=SeqID_109117
  Homolog annotation: Hit_ID=Q6Z856; Match level="QueryCoverage=94%, HitCoverage=62%, E-value=6e-61, Identity=48%"; Hit description=Kelch repeat containing F-box protein family-like
  Pfam annotation: Domain name=F-box; Domain location=16-63; Score =25.3; E_value=0.00021; Accession=PF00646.23; Description=F-box domain
  Pfam annotation: Domain name=Kelch_1; Domain location=104-158; Score =23.3; E_value=0.0009; Accession=PF01344.15; Description=Kelch motif
  Pfam annotation: Domain name=Kelch_1; Domain location=162-214; Score =26.6; E_value=9e-05; Accession=PF01344.15; Description=Kelch motif
  Pfam annotation: Domain name=Kelch_2; Domain location=104-158; Score =11.5; E_value=1.2; Accession=PF07646.5; Description=Kelch motif
  Pfam annotation: Domain name=Kelch_2; Domain location=160-214; Score =6.8; E_value=4.8; Accession=PF07646.5; Description=Kelch motif
  Pfam module annotation: Pfam domain module=F-box::Kelch_1::Kelch _1::Kelch_2::Kelch_2; Domain location=16-63::104-158::162-214::104 -158::160-214
MNSYWDTGAGGGGGATLIPGLPNDVAASILSMVPYSHHGRLKATCKSWKLLLSSKFFLASLNGKNHLLCIFPQDPSIASPFLFDPNALAWCPLPLMPCNPHVYGLCNFAAVSLGSHLYVLGGSLFDTRSFPIDRPSPSSATFRFSFHDFSWEPRAQMLSPRGSFACAVVPARGSIYVAGGGSRHTMFGAAGSRIRSVERYEVGRDRWVPMENLPGFRAGCVGFVGEEGREFWVMGGYGASRTISGVFPVDEYYRDAVVMGVESGAWRE

SEQ ID NO: 225896 - protein, 72 aa, Glycine max; identical to SEQ ID NO: 222414
  Coding DNA Sequence Number=SeqID_109118

SEQ ID NO: 225897 - protein, 159 aa, Glycine max
  Coding DNA Sequence Number=SeqID_109119
  Homolog annotation: Hit_ID=Q6CQF3; Match level="QueryCoverage=35%, HitCoverage=59%, E-value=2e-08, Identity=72%"; Hit description =Kluyveromyces lactis strain NRRL Y-1140 chromosome D of strain NRRL Y- 1140 of Kluyveromyces lactis
HTGRDPKDGELCLSGAKPEELWWRPAAILTIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAG

SEQ ID NO: 225898 - protein, 174 aa, Glycine max
  Coding DNA Sequence Number=SeqID_109120
  Gene Ontology: Mol. function=nucleic acid binding; Cellular component= intracellular; Biological process=chromatin modification
  Homolog annotation: Hit_ID=Q9FIY6; Match level="QueryCoverage=42%, HitCoverage=54%, E-value=3e-11, Identity=45%"; Hit description =Arabidopsis thaliana genomic DNA, chromosome 5, TAC clone:K9D7
  Pfam annotation: Domain name=zf-C2H2; Domain location=28-50; Score =16.6; E_value=0.088; Accession=PF00096.16; Description=Zinc finger, C2H2 type
MDLNYPEECYSKSSCEETNDDMGIGRSYECIFCKRGFTTAQALGGHMNIHRKERANKTKASFSSHPSSSNNVDGINNYADLGFYSQIPSLSTAPDANSYREVFFPTAAPSVIRPSSHEVLCVENQRGHHVFEQDWRKRNLSLYTNPLGFHEIKDKFEESEDNGLDLELRLGHHP

SEQ ID NO: 225899 - protein, 204 aa, Glycine max
  Coding DNA Sequence Number=SeqID_109121
MTKGLTSHWRRFIHPISRRCKWIELQMKQLQSQARKYEKELAAYNYTKQLDFAHFTSEDSNIKSIPISDRMHRNKVMKRNKRKRVEEQCDIELYMSNHSLFSYYEKTDCTAVLKDVCDVGIGGVNDRDKEFKLNNEWSFGEYGNVDKSLNDIIQKIEAIQSQVQQLKTRIDMVISESGGKFCSIIQLSIHGPSDGLIILILLSP

SEQ ID NO: 225900 - protein, 248 aa, Glycine max
  Coding DNA Sequence Number=SeqID_109122
  Gene Ontology: Mol. function=nucleoside-triphosphatase activity; Cellular component=membrane; Biological process=cell division
  Homolog annotation: Hit_ID=Q1SK92; Match level="QueryCoverage=99%, HitCoverage=32%, E-value=4e-96, Identity=70%"; Hit description=AAA ATPase, central region; DEAD/DEAH box helicase, N-terminal
  Pfam annotation: Domain name=AAA; Domain location=1-172; Score=178.7; E_value=1.4e-50; Accession=PF00004.19; Description=ATPase family associated with various cellular activities (AAA)
MIAKAIANEAGASFINVSMSTITSKWFGEDEKNVRALFTLAAKVAPTIIFVDEVDSMLGQRTRVGEHEAMRKIKNKFMTHWDGLLTGPNEQILVLAATNRLFDLDEAIIRRFERRILGCLPSVENREMILKTLLAKEKHENLDFKELATMTEGYTGSDLKNLCITVAYRPVREIIKQERMKDMEKKKREAEGQSSEDASNNKDKEEQESGREAASFASEGSVMNELKHWNDLYGEGGSRKKQQLTYFL

SEQ ID NO: 225901 - protein, 126 aa, Glycine max
  Coding DNA Sequence Number=SeqID_109123
MSWVALQDFAWWVKDNGSAEGGFARWVRSNGSDEDPFHCPRSFSKLTLVTGRAHSRKLTLITAIAPDPPCKATLCAAIVLDPPRGVLQSHPGHALVAKPPFSLRSAIGTKALFAPLLVSVASTVSW

SEQ ID NO: 225902 - protein, 91 aa, Glycine max
  Coding DNA Sequence Number=SeqID_109124
  Gene Ontology: Mol. function=protein binding
  Homolog annotation: Hit_ID=Q70YJ5; Match level="QueryCoverage=82%, HitCoverage=45%, E-value=8e-16, Identity=43%"; Hit description =Putative Cf2/Cf5 disease resistance protein
  Pfam annotation: Domain name=LRRNT_2; Domain location=15-53; Score =59.8; E_value=8.9e-15; Accession=PF08263.3; Description=Leucine rich repeat N-terminal domain
MDQVVVSAQDHIMCIQTEREALLQFKAALVDPYGMLSSWTTSDCCQWQGIRCSNLTAHVLMLDLHCLGLRGEIHKSLMELQQLNYLNLSSI

SEQ ID NO: 225903 - protein, 84 aa, Glycine max
  Coding DNA Sequence Number=SeqID_109125
MALPGKHYDAPTHDDIENYYETRTKSEEAQKKEAFIKFVTENVNQSKADESMMISGIVTPPVAMEAKKTGQTVPQLSIIKAVPD

SEQ ID NO: 225904 - protein, 179 aa, Glycine max
  Coding DNA Sequence Number=SeqID_109126
  Gene Ontology: Mol. function=protein binding
  Homolog annotation: Hit_ID=Q1T435; Match level="QueryCoverage=53%, HitCoverage=19%, E-value=2e-11, Identity=44%"; Hit description =Leucine-rich repeat; Leucine-rich repeat, cysteine-containing type
  Pfam annotation: Domain name=LRR_1; Domain location=102-125; Score =9.5; E_value=4.7; Accession=PF00560.23; Description=Leucine Rich Repeat
  Pfam annotation: Domain name=LRR_1; Domain location=29-50; Score =12.2; E_value=1.5; Accession=PF00560.23; Description=Leucine Rich Repeat
  Pfam annotation: Domain name=LRR_1; Domain location=52-74; Score=0.8; E_value=2e+02; Accession=PF00560.23; Description=Leucine Rich Repeat
  Pfam annotation: Domain name=LRR_1; Domain location=78-100; Score =9.0; E_value=5.8; Accession=PF00560.23; Description=Leucine Rich Repeat
  Pfam module annotation: Pfam domain module=LRR_1::LRR_1::LRR_1::LRR _1; Domain location=102-125::29-50::52-74::78-100
MLSLDLSGNKFSEELTVIFNNLSGCFGYSLQELNLGWNKIHGILPEFSMFLKLETLVQSGNQLKGGVPKSLQNAMFPSLRRLYLYRNKLNGTISEDVGFPARLEQLDLSSNALSDNSLALEFSQNWAPCLIELDRIEILQVRSDISQMTLAILTFQKLEYQILFQSGSGLNELWKSGWK

SEQ ID NO: 225905 - protein, 541 aa, Glycine max
  Coding DNA Sequence Number=SeqID_109127
  Gene Ontology: Mol. function=protein binding; Cellular component =integral to membrane; Biological process=protein amino acid phosphorylation
  Homolog annotation: Hit_ID=Q1T435; Match level="QueryCoverage=95%, HitCoverage=74%, E-value=2e-70, Identity=33%"; Hit description =Leucine-rich repeat; Leucine-rich repeat, cysteine-containing type
  Pfam annotation: Domain name=LRR_1; Domain location=102-129; Score =5.2; E_value=30; Accession=PF00560.23; Description=Leucine Rich Repeat
  Pfam annotation: Domain name=LRR_1; Domain location=131-154; Score =7.4; E_value=12; Accession=PF00560.23; Description=Leucine Rich Repeat
  Pfam annotation: Domain name=LRR_1; Domain location=157-179; Score =12.6; E_value=1.2; Accession=PF00560.23; Description=Leucine Rich Repeat
  Pfam annotation: Domain name=LRR_1; Domain location=182-204; Score =10.1; E_value=3.8; Accession=PF00560.23; Description=Leucine Rich Repeat
  Pfam annotation: Domain name=LRR_1; Domain location=206-228; Score =7.5; E_value=11; Accession=PF00560.23; Description=Leucine Rich Repeat
  Pfam annotation: Domain name=LRR_1; Domain location=22-44; Score =21.3; E_value=0.0035; Accession=PF00560.23; Description=Leucine Rich Repeat
  Pfam annotation: Domain name=LRR_1; Domain location=236-257; Score =17.2; E_value=0.06; Accession=PF00560.23; Description=Leucine Rich Repeat
  Pfam annotation: Domain name=LRR_1; Domain location=259-281; Score =9.0; E_value=5.9; Accession=PF00560.23; Description=Leucine Rich Repeat
  Pfam annotation: Domain name=LRR_1; Domain location=283-305; Score =15.3; E_value=0.22; Accession=PF00560.23; Description=Leucine Rich Repeat
  Pfam annotation: Domain name=LRR_1; Domain location=307-329; Score =11.4; E_value=2.1; Accession=PF00560.23; Description=Leucine Rich Repeat
  Pfam annotation: Domain name=LRR_1; Domain location=336-357; Score =12.0; E_value=1.6; Accession=PF00560.23; Description=Leucine Rich Repeat
  Pfam annotation: Domain name=LRR_1; Domain location=359-380; Score =12.8; E_value=1.2; Accession=PF00560.23; Description=Leucine Rich Repeat
  Pfam annotation: Domain name=LRR_1; Domain location=383-405; Score =11.3; E_value=2.2; Accession=PF00560.23; Description=Leucine Rich Repeat
  Pfam annotation: Domain name=LRR_1; Domain location=407-429; Score =11.1; E_value=2.4; Accession=PF00560.23; Description=Leucine Rich Repeat
  Pfam annotation: Domain name=LRR_1; Domain location=436-457; Score =8.5; E_value=7.5; Accession=PF00560.23; Description=Leucine Rich Repeat
  Pfam annotation: Domain name=LRR_1; Domain location=459-481; Score =12.5; E_value=1.3; Accession=PF00560.23; Description=Leucine Rich Repeat
  Pfam annotation: Domain name=LRR_1; Domain location=483-506; Score =9.4; E_value=5.1; Accession=PF00560.23; Description=Leucine Rich Repeat
  Pfam annotation: Domain name=LRR_1; Domain location=508-528; Score =8.5; E_value=7.2; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1; Domain location=102-129::131 -154::157-179::182-204:...
  Pfam module annotation: Domain location=:206-228::22-44::236-257::259- 281::283-305::307-329::336-357::359-380::383-405::407-429::436 -457::459-481::483-506::508-528
HLDLSVNRFEGNIPSQIGNLYQLQHLDLSYNSFEGSIPSQLGNLSNLHKLYLGGTDDGRALKIDDGDHWLSNLISLAHLSFHSISNLNTSHSFLQMIAKLPKLRELSLIHCSLSDQFILPLRPSKFNFSSSLSVLDLSINSFTSSMILQWLSNVTSNLVELDLSDNLLEGSTSNHFGRVMNSLEHLDLSYNIFKGEDLKSFANICTLHSLYMPANHLTEDLPSILHNLSSGCVKQSLQELDFQYNQITGSLPDLSVFSSLRSLFLDQNQLRGKIPEGIRLPFHLESLSIQSNSLEGGIPKSFGNSCALRSLDMSGNNLNKELSVIIHQLSGCARFSLQELNIRGNQINGTLSDLSIFSALKTLDLSRNQLNGKIPESTKLPSLLESLSIGSNSLEGGIPKSFGNACALRSLDMSNNSLSEEFPMIIHHLSGCARYSLEKLDLGMNQINGTLPDLSIFSSLKKLYLDGNKLNGEIPKDYKFPPQLEQLDMQSNSLKGVLTDYHFANMSKLNYLELSDNSLVTLAFSQNWVPPFQLTYHRIAI

SEQ ID NO: 225906 - protein, 127 aa, Glycine max
  Coding DNA Sequence Number=SeqID_109128
  Gene Ontology: Mol. function=nucleoside-triphosphatase activity; Cellular component=integral to membrane; Biological process=protein catabolic process
  Homolog annotation: Hit_ID=Q2HUS2; Match level="QueryCoverage=94%, HitCoverage=18%, E-value=2e-35, Identity=65%"; Hit description =Peptidase S26A, signal peptidase I; AAA ATPase; Peptidase M, neutral zinc ...
  Homolog annotation: Hit description=metallopeptidases, zinc-binding site; Peptidase M41, FtsH extracellular
  Pfam annotation: Domain name=Peptidase_M41; Domain location=4-125; Score=-43.1; E_value=5.6e-08; Accession=PF01434.8; Description =Peptidase family M41
MKKLDKDVSLSVISMRTSEFSGADLANLMNQQNSGGLTWFIPGEDPSLISKNQLLARIVGGLRERAEEEVIFSETEITTGAAVDLQQITQIARQMVTKFGMSEIGPWALIDPTVQGHHVVLRMLARN

SEQ ID NO: 225907 - protein, 88 aa, Glycine max
  Coding DNA Sequence Number=SeqID_109129
  Subcellular localization annotation: CTP_CleavageSite=41; ConfidenceScore=5.39e-01
MTFVGNNRRDNRLTSMKNETTKARGRTGMRGRRRATCRERRCTSRKKDEPEAGGRRRNASRIDAQLAKEGMGMRRRRKGWVHKNVLKN

SEQ ID NO: 225908 - protein, 103 aa, Glycine max
  Coding DNA Sequence Number=SeqID_109130
MKNKKVAAAGVSLSEAYALSEQHPLSETSTHLASKDNLEENLPRMHALSTPSAHPEKKPLKAEVGEKKGRRESLAFGRIEIYVRDAAGQRSTKNLSFQEDSRF

SEQ ID NO: 225909 - protein, 118 aa, Glycine max
  Coding DNA Sequence Number=SeqID_109131
  Gene Ontology: Mol. function=unspecific monooxygenase activity
  Homolog annotation: Hit_ID=O04892; Match level="QueryCoverage=95%, HitCoverage=26%, E-value=2e-31, Identity=60%"; Hit description =Cytochrome P450 like_TBP
  Subcellular localization annotation: CTP_CleavageSite=51; ConfidenceScore=5.48e-01
VSKCGTASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 225910 - protein, 152 aa, Glycine max
  Coding DNA Sequence Number=SeqID_109132
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=66%, E-value=3e-73, Identity=71%"; Hit description =Apocytochrome f precursor
  Pfam annotation: Domain name=Apocytochr_F_C; Domain location=93-152; Score=53.7; E_value=2.5e-14; Accession=PF01333.10; Description =Apocytochrome F, C-terminal
VLPDTVFEAVVRIPYDMQVKQVLANGKKGALNVGAVLILPEGPVPGQKYKEITFPILSPDPTTKRDVHFLKYPIYVGGNRGRGQIYLDGSKSNNNVYNATAAVIDIIPPGPELLVSEGESIKLDQPLTSNPNVGGFGQGDAEIVLQDPLRVQ

SEQ ID NO: 225911 - protein, 294 aa, Glycine max
  Coding DNA Sequence Number=SeqID_109133
  Gene Ontology: Mol. function=binding; Biological process=proteolysis
  Homolog annotation: Hit_ID=Q2K9Y8; Match level="QueryCoverage=99%, HitCoverage=38%, E-value=4e-85, Identity=56%"; Hit description =Hypothetical conserved protein
  Subcellular localization annotation: CTP_CleavageSite=38; ConfidenceScore=5.35e-01
MAQLAQSSTPPVTVPATEPRPLPQTGAQTMQTQTAQAPAARVAEPASGDMPEVDLSALRYFAARGDTQRLQAEIARLRTLYPNWTPPADPLAVPENGDAKLDAMWQLYTDGRYAEVRKAIADRQQTEPGWQPPDNLTGMLSLAEARQRLINASDLKQYATVVDTAANNSGLLTCSEVDVLWRVADAFANTDRMARARDAYLYILNNCTVASDRLATVQKASALLPAEMMGELLAKEKPGADGQLEFEPVKNDLARQFVAKAGEKEGITVPSAYLMRLERLAETEKLASDALLLG

SEQ ID NO: 225912 - protein, 92 aa, Glycine max
  Coding DNA Sequence Number=SeqID_109134
  Gene Ontology: Mol. function=protein domain specific binding; Cellular component=barrier septum; Biological process=regulation of progression through cell cycle
  Homolog annotation: Hit_ID=Q96299; Match level="QueryCoverage=96%, HitCoverage=34%, E-value=9e-25, Identity=64%"; Hit description=14-3 -3-like protein GF14 mu
MSTSYIDPYFSLRGNELNAKQIKEYRQKVELELSNICNDVIRVIDEHLIPLAAAGMLKCFACKKGDYYCYLAEFKSGNEKKEAADQSMKAYE

SEQ ID NO: 225913 - protein, 92 aa, Glycine max
  Coding DNA Sequence Number=SeqID_109135
MGLTEEEFYAKQFEINNDIPEPLMKPQPSSSPVSLSVQRVFLFSLFASCCYTIGRLVASMDQEELAFIRKAHKVQARRVMLEEVESFGYWIG

SEQ ID NO: 225914 - protein, 48 aa, Glycine max
  Coding DNA Sequence Number=SeqID_109136
MEGVWDLRVIPGKRKGRERRPQHHHLNKAVSGPRSPGVIGERGSRESE

SEQ ID NO: 225915 - protein, 153 aa, Glycine max
  Coding DNA Sequence Number=SeqID_109137
  Gene Ontology: Mol. function=nucleic acid binding; Biological process= DNA integration
  Homolog annotation: Hit_ID=Q1S3Z1; Match level="QueryCoverage=60%, HitCoverage=8%, E-value=1e-21, Identity=59%"; Hit description =Integrase, catalytic region; Zinc finger, CCHC-type
MECQYESHLGVARMCRSLEGKDTHVYHFITKGEERHDQQVKTVTAMWANLESLYMTKSLASKLCLKQQLYFFKMTKSRSIIEQLADFNKILDDLEETLELKEGGGVLVGNNKSSRVQGMSIVKLKMFDNWEMLLQNVRFVPGLKRESFVYKHF

SEQ ID NO: 225916 - protein, 103 aa, Glycine max
  Coding DNA Sequence Number=SeqID_109138
MLLRPYARNEVRYNRYKVVVDADEGLRTERSLALLDYDHTPSLSKLRALSPTPTRTCQQQRLCHQAQVFLSKPKTKSSELKTDFVNLKRIAWELDVGFEAITS

SEQ ID NO: 225917 - protein, 72 aa, Glycine max
  Coding DNA Sequence Number=SeqID_109139
MDDCEEGQERRGCQFQRKPLNPNQSTMPMIRRENKDKVVMNVRNTIEGRNPQKERGKEAIAGNKIVKIEKGG

SEQ ID NO: 225918 - protein, 116 aa, Glycine max
  Coding DNA Sequence Number=SeqID_109140
MSEEDDHLKRSSKKVKTKDNDIVVDGSMEDSHGVENEGTIEEKVDKTPKGDGINNVKSYMENLLMTEGDRVFTYYQSLLKKMEVLEEKYAKSLEARVEDEGELDPCPTIPRDSGGV

SEQ ID NO: 225919 - protein, 102 aa, Glycine max
  Coding DNA Sequence Number=SeqID_109141
  Subcellular localization annotation: CTP_CleavageSite=47; ConfidenceScore=5.05e-01
FGLLPHPSPHITFVLLPFSLGWSQKSLTHGPHHPQRICSRHSYIVVVFFVGVSFCDHATVGVDYPNQVDGGVAASARRYWRGKHRCAEVVGVICSNGSYGSS

SEQ ID NO: 225920 - protein, 60 aa, Glycine max
  Coding DNA Sequence Number=SeqID_109142
MRGCHGEEFFKCSKAEVSWGGIRNDRVKNKGWANGNTKGTNSDEQLQQICNFVPKGARNQ

SEQ ID NO: 225921 - protein, 384 aa, Glycine max
  Coding DNA Sequence Number=SeqID_109143
  Homolog annotation: Hit_ID=Q5XM22; Match level="QueryCoverage=23%, HitCoverage=85%, E-value=4e-14, Identity=43%"; Hit description =Resistance-like protein HAAS-2
MVRTRGLGHALGHVTSRVHDESVLPAPDVEADVFSDDPMAPADVKDTGEDIPTDTGAQATNDEHEGFSGGPGDPSVLTQYADHIACSERPELKLSSHGRKVHSLGRPVLAIEGVVAGIGLSPLIACDDHARQRLITSAFARGLRQGSVMDRTYSCNGYVISTSVDARQALRDLSQTGRYAWGVAALVHIYVQLNDASISSSRQLGGYITLLQCWIYKHFPSIVESTADQDYDEDSPCACRWIATKKTVKSIRTSAYRERLDRLWIPNGPVAVYYRPERVMRQFGYTQTILALPVNSWVSYDDIHDRWMHYSDHMVPTGEVCVMPVVPQAPQTDIPHVPEPGAPSTSARPAVEEPRHAVKFAMGLLREVGASSEPKGGHARLIDT

SEQ ID NO: 225922 - protein, 45 aa, Glycine max
  Coding DNA Sequence Number=SeqID_109144
MGWDFHRTLKDSYFGNQTLIRPRQPLLKHHILPLQQPQPLRLPQI

SEQ ID NO: 225923 - protein, 208 aa, Glycine max
  Coding DNA Sequence Number=SeqID_109145
  Gene Ontology: Mol. function=helicase activity; Biological process =viral genome replication
  Homolog annotation: Hit_ID=Q1SN45; Match level="QueryCoverage=98%, HitCoverage=12%, E-value=4e-40, Identity=40%"; Hit description=AAA ATPase
MNINQAFVEGQSLTYSEFVTKFVYNQKQRCWQLMKKGYTIVRLQWVPPTTGELFYLRMMLTISRGPISFEDIRTVDGVEYPTYRETCFAMGFLQDDREFIAAIKEAKDWSSAPYLRNLFVLLLLTGTMNKPEQVWEKTWHWLSDDILYSHCRSSSTPGLHIDDSNMMNLVLLEVEQLLQANQRSLKDYPSMPYPENANLLTHADNGLI

SEQ ID NO: 225924 - protein, 57 aa, Glycine max
  Coding DNA Sequence Number=SeqID_109146
MTSPMTTTMHASKLPHIGRVTVDTATKPGGLIQICSKKVLVEEQIYTVDTWGKILEE

SEQ ID NO: 225925 - protein, 71 aa, Glycine max
  Coding DNA Sequence Number=SeqID_109147
  Subcellular localization annotation: CTP_CleavageSite=6; ConfidenceScore=5.04e-01
MTTMITSNTTKAKDFSVAMTTIVRVDFDHMHKRRNLTNVKGFKKHTKESFLGSSAPVTRVIKGQVSNLTKK

SEQ ID NO: 225926 - protein, 119 aa, Glycine max
  Coding DNA Sequence Number=SeqID_109148
MPHARLLLTCLINGIVPTLSLSFRDHESRHRAVPRSLLPVQELRFSLHFLIGPSLSHLLPHTYIKIIGRPARVTMFCENASTIWDQHRLKGALKPGDPQGLHFGRVPSGPLPPDSRPNP

SEQ ID NO: 225927 - protein, 219 aa, Glycine max
  Coding DNA Sequence Number=SeqID_109149
  Gene Ontology: Mol. function=nucleic acid binding; Biological process= RNA-dependent DNA replication
MGEESTNAKRILEDHASFMGSFQSNTIMKPKLEYVRNFEIKPAPKHLIQANQFNGRVHESLYDHLSTFNDICNTMKINNVSDDALKWCLFPFSLTSDTISQLRSFPPNSLSSWEDVAAMFLHRYFPKSKTFKGKPTISSFQQQHDEALIEAWEWYQSLLQKMQTHGFDRVLQINIFLGGLQAQSKLMLDAATKGNIVLKTPEKISEIIENIAYNDYEFQ

SEQ ID NO: 225928 - protein, 148 aa, Glycine max
  Coding DNA Sequence Number=SeqID_109150
MGDEIPFNVFDVMTRPNDDLNCFGVDMVNEAIDNKCNQMQSSNPLQCALINSCDNIDEEDVEEVHDILLQLDNSKEIPPNKEVFEELKVESEKEEKAKLISSSIGKNATSWFKSVILGHKISSRGIEVDPAKVEVIAKHPSPVGVGER

SEQ ID NO: 225929 - protein, 411 aa, Glycine max
  Coding DNA Sequence Number=SeqID_109151
  Gene Ontology: Mol. function=peptidase activity; Biological process =proteolysis
  Homolog annotation: Hit_ID=Q0WVZ7; Match level="QueryCoverage=90%, HitCoverage=46%, E-value=7e-93, Identity=46%"; Hit description=24 kDa vacuolar protein-like
  Pfam annotation: Domain name=Peptidase_M28; Domain location=1-115; Score=-45.3; E_value=0.0093; Accession=PF04389.7; Description =Peptidase family M28
MQKPLKNKQGGSSYHIEETRRGKRVYCTLKTIIQSSFAGPHPWAIENFALVAKYPSGQVIAQDLFSSGAIKSATDFQVYKEVAGLSGLDFAYLDNTAVYHTKNDKLELLKTGSLQHLGENMLAFLLHIGASSHIPEGNSTESEEDISKNNAIYFDILGMYMVVYRQKFANMLHNSVIMQSLLIWVTSLVMGGIPAAASLALSCLSVLLIPMLVVGLFGAPAFLGALTGQHFGFLLLQKYLSNTLSKGRQLTPIIKAAVVKMEAERWLYKAGSFQWLILLILGNYFKIGSSYLALVCNTNPSQATKATQTGNHNSGVSHSDFIFCRHIYSAGCYTYRGNPGGTPEWLGNFVIAAFIASLLSLTLVYLLSYVHLSGAKRAIILATLVLFSLSLAVVLTGVVPPFSEDTARAVN

SEQ ID NO: 225930 - protein, 271 aa, Glycine max
  Coding DNA Sequence Number=SeqID_109152
  Gene Ontology: Mol. function=peptidase activity; Biological process =proteolysis
  Homolog annotation: Hit_ID=Q0WVZ7; Match level="QueryCoverage=66%, HitCoverage=20%, E-value=7e-44, Identity=48%"; Hit description=24 kDa vacuolar protein-like
MDYCIPMSFMWRIKEFVYFIHCKVDAWTMTPYPDRSMALGSIGVSEGLAPINPVSFDVRYILSLGNYKAFLDCATPIPKKYPQGNGKLDQGQNPISYVSLFSNTPGNLNKEVKQIDEGFVCGRDKTVDFVTFSVKYGCWTYNDTTNDWTEMDIPTMNVVSDAKGNGRITQVSINTKGSIRWVLAINIEEIEDFEFKDARNSEELISVDKKSSVDGWHIIQFSGGKNAPTLFDLTLYWRSGSTHNSDSPLLKLRTDVNRLTPITERVLEKLP

SEQ ID NO: 225931 - protein, 202 aa, Glycine max
  Coding DNA Sequence Number=SeqID_109153
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=2e-25, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GTSTLTLRGLHALAIRGLHVLAFKGLHVLAFRGLHALTFRGLHVLTLEDYTGQLALTFRGLRVLAIRGLHVLTFRGLHVLTFRGLHVLALRGLHTLAFRGLHALAFRGLDVLTFRGLHALTFKRLYVIPLRALHALNFRGLYVLPLRGLHVVPLRGLHDLAFGGLHALTFRGLHVLPFRGLHALAFRGLQVLAFKGLHALAI

SEQ ID NO: 225932 - protein, 356 aa, Glycine max
  Coding DNA Sequence Number=SeqID_109154
  Homolog annotation: Hit_ID=Q7VLY9; Match level="QueryCoverage=43%, HitCoverage=32%, E-value=2e-46, Identity=56%"; Hit description =Conserved hypothetical oxoglutarate/malate translocator
  Pfam annotation: Domain name=Na_sulph_symp; Domain location=1-167; Score=-254.7; E_value=0.00031; Accession=PF00939.9; Description =Sodium:sulfate symporter transmembrane region
MGAALLFNIIGWSDVQKNKGGWNTLMWYGGIIGLSATLSKEGFFRWLADFLSAHLDFLSAGNMTIVIIVFLSVLVRYFFASGGAYVAAMVPVFATVGLVTGTAPVLLALAILFSNSYGGCITHYGGAAGPIIFAFGYNDIKSWWTIGTIVALGTTVCCSINRPVAATPYRAYSPRGGITRRHVDMEIVLRNKFSSLGMFLGGIALILSIVQFSFGPFSPKPPAIEVIVAEKVSAVKQGVIAGLKGERPAARTEKTKVDIDSILLNAGIILAVVALGLSFIGGMCKESRWGISGALLFSGLTLTFHAVLLAFGLIVAVLLLPVAVMPYRAWRNRNVGRVRRSRHSTKSSAISGNTRP

SEQ ID NO: 225933 - protein, 92 aa, Glycine max
  Coding DNA Sequence Number=SeqID_109155
MRKFGDDKSWIQVINFSDVHRNIRPYEEKSMILPLCMSNNRDFFMLKFTRNADDEYQTILYNQRDGSFRTLLWCNFKIFTKTLVISNALSDV

SEQ ID NO: 225934 - protein, 158 aa, Glycine max
  Coding DNA Sequence Number=SeqID_109156
  Gene Ontology: Mol. function=protein prenyltransferase activity; Biological process=protein amino acid prenylation
MENQNSVEETISCGHNADIVQALKDELDWNEALIKRYVGREALWLHRRFLSMCWINNFLLDSGDASYHSKEAISMHHDFGTFLRNELCLLHSSTFVDDDFVDVQAQAVYSASYILWLKVQVPKSLENKLLQKIKDVDLKILLDKSCPERSSLFNYFMN

SEQ ID NO: 225935 - protein, 77 aa, Glycine max
  Coding DNA Sequence Number=SeqID_109157
MANPLVLVLFASITGSIGSGEEPPDDNGVSVQPQQKMSFRDKTMVNKEKPSPRQRVDLLRQNLEKIKIEYEDETPSN

SEQ ID NO: 225936 - protein, 823 aa, Glycine max
  Coding DNA Sequence Number=SeqID_109158
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9M4N3; Match level="QueryCoverage=99%, HitCoverage=85%, E-value=0.0, Identity=83%"; Hit description=H+ -ATPase
  Pfam annotation: Domain name=E1-E2_ATPase; Domain location=1-186; Score=194.8; E_value=2e-55; Accession=PF00122.10; Description=E1-E2 ATPase
  Pfam annotation: Domain name=Hydrolase; Domain location=190-475; Score=75.2; E_value=2.1e-19; Accession=PF00702.16; Description =haloacid dehalogenase-like hydrolase
  Pfam module annotation: Pfam domain module=E1-E2_ATPase::Hydrolase; Domain location=1-186::190-475
VLRDGKWSEEDASVLVPGDIISIKLGDIIPADARLLEGDPLKIDQSALTGESLPVSKHPGDGVYSGSTCKQGEIEAVVIATGVHTFFGKAAHLVENTTHVGHFQKVLTSIGNFCICSIAVGMIFEIIVIYGIHKKKYRNGVDNLLVLLIGGIPIAMPTVLSVTMAIGSHKLAQQGAITKRMTAIEEMAGMDVLCSDKTGTLTLNKLSVDKNIIEVFAKGVDNDMVVLMAARASRLENQDAIDCAIVSMLADPKEARAGIKEVHFLPFNPTDKRTALTYLDAAGKMHRVSKGAPEQILNLAHNKSEIQQRVHAIIDKFAERGLRSLAVARQEVPEGTKDSPGGPWEFVGLLPLFDPPRHDSAETIRRALDLGVSVKMITGDQLAIGKETGRRLGMGTNMYPSSSLLGENKDGLGAVTVDDLIENADGFAGVFPEHKYEIVKRLQARKHICGMTGDGVNDAPALKIADIGIAVADATDAARSASDIVLTEPGLSVIISAVLTSRAIFQRMKNYTIYAISITIRIVLGFMLLNSFWKFDFPPFMVLVIAILNDGTIMTISKDRVKPSPLPDSWKLSEIFTTGIVLGSYLALMTVIFFYIVVETNFFPDHFGVKHFSYNPDADIKDPTKRMLGSAVYLQVSTISQALIFVTRSRGWSYTERPGLLLVTAFIIAQAIATVVSATVTWQLAGIKSIGWGWTGVIWLYNTITYLFLDPLKFAVRYALSGRAWNTVINQRTAFINKNDFGKEAREAAWATEQRTLHGLQSAESKGFTDKHTFREINTLAEEARRRAEIARLRELHTLKGRVESFAKLRGLDIDAMNGHYTV

SEQ ID NO: 225937 - protein, 107 aa, Glycine max
  Coding DNA Sequence Number=SeqID_109159
  Gene Ontology: Mol. function=DNA binding; Cellular component=nucleus; Biological process=DNA integration
MEAMNEEIESLQKNHTWDLVELLEGKRFVGCQWIFKKKFDLSSTEIIKYKARLVAKGYSQKEGFEVKGKEDSISRLKKSLYRLKQSPRHRYKRFDQFIIFHRYKRFD

SEQ ID NO: 225938 - protein, 88 aa, Glycine max
  Coding DNA Sequence Number=SeqID_109160
MTRVQIEVVHRVGGWLFRLACVSGNARSRAGNGDEATAEKNMGGEECTTVNVHDDTVMVERSCACRASKVEIMHGWRLRASRGSAWQG

SEQ ID NO: 225939 - protein, 91 aa, Glycine max
  Coding DNA Sequence Number=SeqID_109161
  Gene Ontology: Mol. function=hydrolase activity, acting on acid anhydrides, catalyzing transmembrane movement of substances; Cellular component=integral to membrane; Biological process=proton transport
  Homolog annotation: Hit_ID=Q9M4N3; Match level="QueryCoverage=100%, HitCoverage=9%, E-value=2e-29, Identity=65%"; Hit description=H+ -ATPase
  Pfam annotation: Domain name=Cation_ATPase_N; Domain location=9-90; Score=98.7; E_value=1.8e-26; Accession=PF00690.16; Description =Cation transporterATPase, N-terminus
MGEGSVELEAIVKEAVDLENIPLEEVFDNLKCTREGLSSEQVQQRLDLFGYNKLEEKKESKILKFLGFMWNPLSWVMEAAALMAIGMAHGG

SEQ ID NO: 225940 - protein, 228 aa, Glycine max
  Coding DNA Sequence Number=SeqID_109162
  Gene Ontology: Mol. function=L-lactate dehydrogenase activity; Cellular component=glyoxysome; Biological process=tricarboxylic acid cycle intermediate metabolic process
  Homolog annotation: Hit_ID=P37228; Match level="QueryCoverage=56%, HitCoverage=36%, E-value=2e-58, Identity=87%"; Hit description =Malate dehydrogenase, glyoxysomal precursor
  Pfam annotation: Domain name=Ldh_1_C; Domain location=78-217; Score= -28.3; E_value=0.00023; Accession=PF02866.8; Description =lactatemalate dehydrogenase, alphabe
  Pfam annotation: Domain name=Ldh_1_N; Domain location=1-76; Score =5.8; E_value=1.7e-06; Accession=PF00056.13; Description =lactatemalate dehydrogenase, NAD bind
  Pfam module annotation: Pfam domain module=Ldh_1_C::Ldh_1_N; Domain location=78-217::1-76
MDLVIIPAGVPHKHGLTKDDLFNINVGIVKTLCEAIAKCCPKAIVNVLSNPVNSTVLITAEVFKRVGTYDPKRLLGVTMLDVVRANMFVAEVLGVDLRYVDVPIIGGHVGITILPLLSQIKPPCSFTLKRKCLGCNIEAITLEATAKTMLPLERMADDKVFQTKHILLGMTLKGNFRASWQHILLSKIPSMMIVDFQGGNKDIQLLVHVHALGMQKSSDMPQGATRTW

SEQ ID NO: 225941 - protein, 44 aa, Glycine max
  Coding DNA Sequence Number=SeqID_109163
MVEHKKMYKLFGCTAQSDETGDVGGDLAAMGDLDGAGDNDSDGG

SEQ ID NO: 225942 - protein, 155 aa, Glycine max
  Coding DNA Sequence Number=SeqID_109164
  Gene Ontology: Mol. function=transcription factor activity; Cellular component=nucleus; Biological process=regulation of transcription, DNA-dependent
  Homolog annotation: Hit_ID=Q8LLR3; Match level="QueryCoverage=92%, HitCoverage=69%, E-value=3e-22, Identity=42%"; Hit description =Ethylene-responsive element binding protein 1
  Pfam annotation: Domain name=AP2; Domain location=79-144; Score =139.8; E_value=7.3e-39; Accession=PF00847.10; Description=AP2 domain
MNNFNTTLESDDFALLESIQRYLLDDNEDFNSLTEVLATPNNNVNAVNSPLSSLGHATTAATEGRGASSAEARGGHVRNQNYKGVRRRPWGKFAAEIRDPNRNGARVWLGTYNSAEDAALAYDRAAFEMRGSKAKLNFPHLIGCSDAEPSRRSNG

SEQ ID NO: 225943 - protein, 276 aa, Glycine max
  Coding DNA Sequence Number=SeqID_109165
  Gene Ontology: Mol. function=RNA-directed DNA polymerase activity; Cellular component=intracellular; Biological process=RNA-dependent DNA replication
LTIYQAIRGDEFDIDPRDETSDRGPKPIKELVKLQLGPKLGQCTRLSRDLTNHEHRRIADLLQRNADAKPISQKKMKMRKERRKAVREEVDKFFNANFSREVRFFSWLANVVMVQKANEKWRMCIDYIDLNRACPKDAYSLPSNDRLVDGVSGFQVLSFLGAYSEYNQIRMHPPNKEKTTFITEDVNFCYRVMPFGLKNACATYQRLMDHDLEEVIGELRKYDMCLNPEKCTFGVGRGKFFSFMITYWGIEANPEKCTAIIEMRSPTNIQEVQKLN

SEQ ID NO: 225944 - protein, 334 aa, Glycine max
  Coding DNA Sequence Number=SeqID_109166
  Gene Ontology: Mol. function=intramolecular transferase activity, phosphotransferases; Cellular component=membrane; Biological process= carbohydrate metabolic process
  Homolog annotation: Hit_ID=Q7XHZ2; Match level="QueryCoverage=82%, HitCoverage=48%, E-value=1e-113, Identity=75%"; Hit description =Putative phosphoglucomutase, chloroplast
  Pfam annotation: Domain name=PGM_PMM_II; Domain location=136-240; Score=68.5; E_value=2.1e-17; Accession=PF02879.6; Description =Phosphoglucomutasephosphomannomutase, alphabetaalpha domain II
  Subcellular localization annotation: CTP_CleavageSite=41; ConfidenceScore=5.10e-01
MDHMTSFNAVKNQSFRNIIKSEISLDNFLRCLFWSLFSPFSQAKNMQSTLLADTSCGHLSSHLPFNRNGFKFFTNAGGFGKADIKDILERAADIYNQFTEESLPNSERKASLSIKKVDYMIVYTSDLVKAVRKAAGNIGMTLLKYFYNKKPLEGFHIVVDAGNGAGGFFAAKVLEPLGAITSGSQFLEPDGLFPNHIPNPEDKTAMKAITQAVLDNKADLGIIFDTDVDRSAAVDFTGREFNRNRLIALMAAIVLEEHPGTTIVTDSVTSDGLTTFIEKKLGGRHHRFKRGYKNVIDEAIRLNSIGEESHLAIETSGHGALKENHWLDDGAYLM

SEQ ID NO: 225945 - protein, 101 aa, Glycine max
  Coding DNA Sequence Number=SeqID_109167
  Gene Ontology: Mol. function=chromatin binding; Cellular component =signal recognition particle, endoplasmic reticulum targeting; Biological process=chromatin assembly or disassembly
  Homolog annotation: Hit_ID=O22265; Match level="QueryCoverage=76%, HitCoverage=20%, E-value=2e-17, Identity=57%"; Hit description =Signal recognition particle 43 kDa protein, chloroplast precursor
MSPTAKSKASPEAEPWTVPPEWRLGSKPCMKLLAEVGANLNHCDRSGSLEVLHMVTRYVRLKVAKVLLDPSADPEVADNRGRTTLDLAREILEVTPKGNPM

SEQ ID NO: 225946 - protein, 100 aa, Glycine max
  Coding DNA Sequence Number=SeqID_109168
  Gene Ontology: Mol. function=intramolecular transferase activity, phosphotransferases; Biological process=carbohydrate metabolic process
  Homolog annotation: Hit_ID=Q7XHZ2; Match level="QueryCoverage=60%, HitCoverage=11%, E-value=4e-18, Identity=75%"; Hit description =Putative phosphoglucomutase, chloroplast
MTVYSRVFYRKLLATQIPSSFLLRWLAFIRSYILYTDFDIRGVAVDGVEGELVNLTEPVAEAIGAAFAAWLMEKKKADASQHLRVSIGHDSRISAKLLQV

SEQ ID NO: 225947 - protein, 41 aa, Glycine max
  Coding DNA Sequence Number=SeqID_109169
EYESDVVVTWENRCGDLYFTIVFFSARRLAMILRWTHILHR

SEQ ID NO: 225948 - protein, 421 aa, Glycine max
  Coding DNA Sequence Number=SeqID_109170
  Gene Ontology: Mol. function=protein dimerization activity; Cellular component=nucleus; Biological process=regulation of transcription, DNA-dependent
  Homolog annotation: Hit_ID=Q7XDB4; Match level="QueryCoverage=90%, HitCoverage=50%, E-value=1e-90, Identity=50%"; Hit description=Auxin response factor 16, putative, expressed
  Pfam annotation: Domain name=Auxin_resp; Domain location=90-173; Score=163.2; E_value=6.8e-46; Accession=PF06507.4; Description=Auxin response factor
DGAFRDQKRLVAGDSIVFLRAENGDLCVGIRRAKKGIGGGTEFSSGWNNPLFGGGGGFLCGSESSFVSGAKSGGDHEIVGRVAPESVVEAVTCAVNGRPFEVVYYPRASSPEFCVKASVVKAAMQIQWCSGMRFKMPFETEDSSRISWFMGTISSVQVADPIRWPDSPWRLLQVVWDEPDLLQNVKCVNPWLVELVSNMPTFNLSAYSPPRKKQRFLQDPYFQVINQLPMPSFSSNLLNYTNSLCTIQDSNSSGGIQGARHAQFGLSPSDFPFNKLPADMLLGGFSRLDHAAAQPIRPPCGTYKNNTTTKANVGISCLLTVGNPGQNFKESNETKAPHILLFGKLIQTEQKSSNTSSANTNGNSVSEGNSHKTSNASDGVGSGLHQGSPIENNSDGGSPWYKDQHKSDLGTDNVNTLCIAL

SEQ ID NO: 225949 - protein, 133 aa, Glycine max
  Coding DNA Sequence Number=SeqID_109171
MYLLCCTGIGFYLGIGIVREEKVTEKQKPVSVSPSWQLKEALSVSATLVTFTWQQQHQGRLSKMFLFHTATNRIHGVEGTIIVLALLRWGSWHGLTLPCNCALYSNPRIILVSREIFTAMVCSRLSFIQVDMK

SEQ ID NO: 225950 - protein, 68 aa, Glycine max
  Coding DNA Sequence Number=SeqID_109172
MVLYKRAMSRRQSLGENINILIKGRNIDHFQQLAKDQLTKNRSSYSNNEDFGKEVVGEVKRKIEVLLF

SEQ ID NO: 225951 - protein, 1133 aa, Glycine max
  Coding DNA Sequence Number=SeqID_109173
  Gene Ontology: Mol. function=protein binding; Cellular component =integral to membrane; Biological process=defense response to fungus
  Homolog annotation: Hit_ID=Q1T2W9; Match level="QueryCoverage=90%, HitCoverage=96%, E-value=0.0, Identity=54%"; Hit description=Leucine- rich repeat; Leucine-rich repeat, cysteine-containing type
  Pfam annotation: Domain name=LRRNT_2; Domain location=11-53; Score =35.0; E_value=2.6e-07; Accession=PF08263.3; Description=Leucine rich repeat N-terminal domain
  Pfam annotation: Domain name=LRR_1; Domain location=107-129; Score =10.8; E_value=2.8; Accession=PF00560.23; Description=Leucine Rich Repeat
  Pfam annotation: Domain name=LRR_1; Domain location=131-158; Score =2.2; E_value=1.1e+02; Accession=PF00560.23; Description=Leucine Rich Repeat
  Pfam annotation: Domain name=LRR_1; Domain location=164-186; Score =1.1; E_value=1.7e+02; Accession=PF00560.23; Description=Leucine Rich Repeat
  Pfam annotation: Domain name=LRR_1; Domain location=191-213; Score =14.7; E_value=0.33; Accession=PF00560.23; Description=Leucine Rich Repeat
  Pfam annotation: Domain name=LRR_1; Domain location=215-237; Score =11.6; E_value=1.9; Accession=PF00560.23; Description=Leucine Rich Repeat
  Pfam annotation: Domain name=LRR_1; Domain location=239-261; Score =6.2; E_value=20; Accession=PF00560.23; Description=Leucine Rich Repeat
  Pfam annotation: Domain name=LRR_1; Domain location=263-285; Score =8.9; E_value=6.3; Accession=PF00560.23; Description=Leucine Rich Repeat
  Pfam annotation: Domain name=LRR_1; Domain location=287-309; Score =12.1; E_value=1.5; Accession=PF00560.23; Description=Leucine Rich Repeat
  Pfam annotation: Domain name=LRR_1; Domain location=311-333; Score =14.7; E_value=0.35; Accession=PF00560.23; Description=Leucine Rich Repeat
  Pfam annotation: Domain name=LRR_1; Domain location=335-356; Score =12.5; E_value=1.3; Accession=PF00560.23; Description=Leucine Rich Repeat
  Pfam annotation: Domain name=LRR_1; Domain location=358-381; Score =23.7; E_value=0.00067; Accession=PF00560.23; Description=Leucine Rich Repeat
  Pfam annotation: Domain name=LRR_1; Domain location=383-405; Score =11.8; E_value=1.8; Accession=PF00560.23; Description=Leucine Rich Repeat
  Pfam annotation: Domain name=LRR_1; Domain location=407-427; Score =5.8; E_value=24; Accession=PF00560.23; Description=Leucine Rich Repeat
  Pfam annotation: Domain name=LRR_1; Domain location=431-453; Score =12.6; E_value=1.2; Accession=PF00560.23; Description=Leucine Rich Repeat
  Pfam annotation: Domain name=LRR_1; Domain location=455-478; Score =7.4; E_value=12; Accession=PF00560.23; Description=Leucine Rich Repeat
  Pfam annotation: Domain name=LRR_1; Domain location=480-496; Score =9.1; E_value=5.8; Accession=PF00560.23; Description=Leucine Rich Repeat
  Pfam annotation: Domain name=LRR_1; Domain location=507-527; Score =4.7; E_value=37; Accession=PF00560.23; Description=Leucine Rich Repeat
  Pfam annotation: Domain name=LRR_1; Domain location=530-552; Score =18.2; E_value=0.03; Accession=PF00560.23; Description=Leucine Rich Repeat
  Pfam annotation: Domain name=LRR_1; Domain location=554-575; Score =15.2; E_value=0.24; Accession=PF00560.23; Description=Leucine Rich Repeat
  Pfam annotation: Domain name=LRR_1; Domain location=578-597; Score =7.8; E_value=9.7; Accession=PF00560.23; Description=Leucine Rich Repeat
  Pfam annotation: Domain name=LRR_1; Domain location=599-621; Score =10.1; E_value=3.7; Accession=PF00560.23; Description=Leucine Rich Repeat
  Pfam annotation: Domain name=LRR_1; Domain location=624-647; Score =9.1; E_value=5.7; Accession=PF00560.23; Description=Leucine Rich Repeat
  Pfam annotation: Domain name=LRR_1; Domain location=648-667; Score =17.0; E_value=0.067; Accession=PF00560.23; Description=Leucine Rich Repeat
  Pfam annotation: Domain name=LRR_1; Domain location=673-695; Score =10.7; E_value=2.9; Accession=PF00560.23; Description=Leucine Rich Repeat
  Pfam annotation: Domain name=LRR_1; Domain location=697-719; Score =14.2; E_value=0.47; Accession=PF00560.23; Description=Leucine Rich Repeat
  Pfam annotation: Domain name=LRR_1; Domain location=721-743; Score =5.8; E_value=23; Accession=PF00560.23; Description=Leucine Rich Repeat
  Pfam annotation: Domain name=LRR_1; Domain location=745-766; Score =1.7; E_value=1.4e+02; Accession=PF00560.23; Description=Leucine Rich Repeat
  Pfam annotation: Domain name=LRR_1; Domain location=771-794; Score =7.4; E_value=12; Accession=PF00560.23; Description=Leucine Rich Repeat
  Pfam annotation: Domain name=LRR_1; Domain location=83-105; Score =14.4; E_value=0.41; Accession=PF00560.23; Description=Leucine Rich Repeat
  Pfam annotation: Domain name=LRR_1; Domain location=845-867; Score =7.1; E_value=13; Accession=PF00560.23; Description=Leucine Rich Repeat
  Pfam annotation: Domain name=LRR_1; Domain location=869-891; Score =14.7; E_value=0.34; Accession=PF00560.23; Description=Leucine Rich Repeat
  Pfam annotation: Domain name=LRR_1; Domain location=893-915; Score =16.8; E_value=0.081; Accession=PF00560.23; Description=Leucine Rich Repeat
  Pfam annotation: Domain name=LRR_1; Domain location=917-936; Score =4.3; E_value=45; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1; Domain location=11-53::107 -129::131-158::164-186::191-213::215-237::239-261::263-285::287 -309::311-333::335-356::...
  Pfam module annotation: Domain location=358-381::383-405::407 -427::431-453::455-478::480-496::507-527::530-552::554-575::578 -597::599-621::624-647::648-667::673-695::697-719::721-743::745 -766::771-794::83-105::845-867::...
  Pfam module annotation: Domain location=869-891::893-915::917-936
IYISVTAGKCLEDQQLLLFQLKSNLTFNPENSSKLRLWNQSVECCDWSGVSCDDEGRVIGLDLGGEFISGGFDDSSVIFSLQHLQELNLASNNFNSVIPSGFNKLDKLTYLNLSYAGFVGQIPIEISQLTRLVTLDISCLSYLTGQELKLENPNLQKLVQNLTSIRQLYLDGVSIKVPGHEWCSAFLLLRDLQELSMSHCNLSGPLDPSLATLKNLSVIVLDQNNLSSPVPDTFSHLKNLTILSLVYCGLHGTFPQGILSIGSLSVIDISFNYNLQGVFPDFPRNGSLQILRVSNTSFSGAFPNSIGNMRNLFELDFSYCQFNGTLPNSLSNLTELSYLDLSFNNFTGQMPSLGRAKNLTHLDLSHNGLSGAIPSSHFEGLDNLVSIGLGYNSINGSIPSSLFTLTRLQRILLSYNQFGQLDEVTNVSSSKLNTLDLSSNRLSGSFPTFILQLEALSILQLSSNKFNGSMHLDNILVLRNLTTLDLSYNNLSVKVNVTNVGSSSFPSISNLKLASCNLKTFPGFLRNQSRLTTLDLSDNHIQGTVPNWIWKLQTLESLNISHNLLTHLEGPFQNLSSHLLYLDLHQNKLQGPIPVFPRNMLYLDLSSNKFSSIIPRDFGNYMSFTFFLSLSNNTLSGSIPDSLCNALYLEVLDLSNNNFSGTIPSCLMTVSENLGVLNLRKNNLTGLIPDKFSASCALRTLDLHHNKLDGKIPKSLSNCTTLEVLDFGKNEIKDVFPCLLKNITTLRVLVLRQNKFYGQIGCPKTNGTWHRLQIVDLAINNFNGKLPANCFTRWEAMMSDENLAESKAHHIQYQFLQFGSQIYYQDSVTVTIKGNRMDLVKILTVFTSIDFSSNHFEGEIPKELFDFKALYILNLSNNAFSGQIPPSIGNLMELESLDLSNNSLEGNIPTELATVSFLSFLNLSLNHLFGKIPTGTQIQSFQETSFIGNKGLCGPPLTANCTSNTSPATTESVVEYDWKYIVTGVGFGVGSGVAVATLMIWERGRKWSNDTIDKCLMQVFPLFGLAYTPIEDDDAEANNDDSSEEEEEEEEDYLDYPSFRGSWIKKKQGSRVIRVPLTLIIVVISTTIALIITIVVIIVLAITIIIVVDITLIINGIVYATTSTIILLSPPPI

SEQ ID NO: 225952 - protein, 105 aa, Glycine max
  Coding DNA Sequence Number=SeqID_109174
  Gene Ontology: Mol. function=structural constituent of ribosome; Cellular component=small ribosomal subunit; Biological process =translation
  Homolog annotation: Hit_ID=Q1S8Y4; Match level="QueryCoverage=61%, HitCoverage=26%, E-value=9e-22, Identity=84%"; Hit description =Ribosomal protein S3
MFSAPSSISDNGDPNEQEEKADGVFFVELNEVLTRELAKDGYSGVEVRVTPMRTKIIIKATKTQVVLASCEKGRRIRELTSVFQKTASMVVVAGTGEGVFIVRET

SEQ ID NO: 225953 - protein, 47 aa, Glycine max
  Coding DNA Sequence Number=SeqID_109175
MSFISTTLNSNKGYSRMVNEGGESSWDEDLSLEQLEKEQQSIPVRKC

SEQ ID NO: 225954 - protein, 81 aa, Glycine max
  Coding DNA Sequence Number=SeqID_109176
MEAFGLLAGNSKEKTKKNHFSYLLRLVGPRPIARVHLVGCVQSRMSYCPTVSGDDRSNGHCVAPESYPHACPVRVRRGTRR

SEQ ID NO: 225955 - protein, 50 aa, Glycine max
  Coding DNA Sequence Number=SeqID_109177
MWQARYLVGGGMGNGSSSRFVTLYVSSVGWKSVNGGEKMETEGMWGPRFI

SEQ ID NO: 225956 - protein, 670 aa, Glycine max
  Coding DNA Sequence Number=SeqID_109178
  Gene Ontology: Mol. function=DNA binding; Cellular component=beta -galactosidase complex; Biological process=DNA integration
  Homolog annotation: Hit_ID=Q1SJY5; Match level="QueryCoverage=53%, HitCoverage=43%, E-value=8e-97, Identity=44%"; Hit description =Integrase, catalytic region
MEFQVGNSIGFSRELTRSLTKKDPTQQGHMTRDKSKFMSLKAKEEGFLTYGDNNKGRILGVESPKESSPTSKKAVNNNPFEGYSLQHNCLPKEWKEPKDLSIENIIGYNQQEGIDFGETYALVARLEDMRLLLAFACIMDFKLYQMDVKNAFLHIYIKEEVYVSQPPGFEDHKNPTHVYKLKKALYGLKTNTKTIGQVDKTFFIKKSSHDILLMQVYADDIIFGSTNKFLCEDFMHKLQGEFEMSMMGELNYFLVFQVKQMNHGTFLHQTKYCKELLKKFDMDKSKEETTTPMTINCYLSADEKTKLIDKTKYKVKRVMKYLRGTLDVNLLYPKGLGLVSWNIKKQARVALSTAMAEYIVVGTCCAQILWLKQQLSDFGLHLEHIPLRCDNTSAINLTKNPTMHSKTNHIEIRHNFIRDHIHKSDCDIEFVDTDLQLVVFTKPLARDRFFHLRNELGIVSQSNLKPIREYSFIALDTNPQPPEQRRMRNYHRLVLQLEENGMSVWRGSEVKASTFSELIEYHELKKLVEMKDTYYTNMEKVFCSVTHIDGDTRFLCVEVKGQRILMAPKEVFGFVEVEFEGKTKVLKQMEYVKFEEAGIGRIEKSREDHTKQEKAEEKPMSPFEQMMLAKMDELMRILKEDYVELNECFESISKKLDGVDAMGAPHVDDI

SEQ ID NO: 225957 - protein, 139 aa, Glycine max
  Coding DNA Sequence Number=SeqID_109179
MEGYILCNTSRRYIYLGCYIENKRGYISCGSVQVECTSTWLFKENKGGYIPCGSLTCKGFYKARIVNECKAKLNFPHLIGSHVPLERLSVVVALKSNSSEPCLTVMEDSSKPQGSKKRRNLADLLNRLAKNRSQRMGLN

SEQ ID NO: 225958 - protein, 956 aa, Glycine max
  Coding DNA Sequence Number=SeqID_109180
  Homolog annotation: Hit_ID=Q10NJ8; Match level="QueryCoverage=92%, HitCoverage=91%, E-value=4e-40, Identity=29%"; Hit description =Expressed protein
MPINIHPSNGFLKPAEDMGFGLEFRKSSTKQHSSSKTVKESLVLPHSKRSSKDADKLKPKSDLKQKGKMDAEGKIQNSETVRRRATERDELVKHMSNLPGYLLRTDKVENFQEKAFNVGVLDWSRLEKWKHKQKHIPVLASSFTSLNSSELLSRTATKPSTSVGGKEKLSDKKSLPSSGIIKSSYRESLPESAKLPFYDVKRFESSKSVTKSIGDEKSLTPRAFESFGNKTHLDISLEKKRRNGYSKRSSHAKNFESKAKLHGISYLPNENGRDDGAKQNMEDLQEHKHKKKERNHKSSSDMGHPSVKSKGKGASSSSKKMSSSCSETRKKVDQLQELDFDGGQKHCHSKPSNIVLLCPGEIPQSSSSEDFQLSESRTSSVENFSESTKSSLSYVSLPDEDYTADGCSEIPPSGPPCSAVEFSSSETMQHSISTDMGVDHSSVVSKTPSSIIHKMSSLQPASGCFEKDMLDSKLRDQYAFSKLKESLDQETAELTAQKEMNPSHNRRFSFSLSRIGRSFSFKEGPTLPQYSSVYVSAKSGPVTPQSSVRWDNPSKEKVNSHIRNRSSPLRRLLDPLLKHKASDIHNSAQSSQALEGGSANSSFRTIGVNESLLAEKSKGSSVQGLLQLTIKNGVPLFKFVLNNERKIFAATRNSLASLEKGDLGSCFTFYLVNEIKKKSGGWISHGNKEKSCGYAYNVIAQMKFSSSKIAEPTNQNSSRKCMVKEYVLVSVEIGQTDQGPPKFIQSVELAAVVVETSCEKTTEGLHDDNNMLKKGCSKCLTDERCLCSSGENEASDCTTVILPGGVHGSPNKGEPTPLIYRWKTGGSCDCGGWDIGCRLLVLSNQNQNSSIPKSYKPYNDRFQLFVKEGTEKDTSLFTLLPLKDGFYSVEFDSTITHLQAFFISVVALSCQKLPGSLEMGSMHEEVLNLKEPSSMNNRKLQGKAPLKYAPIPPLSP

SEQ ID NO: 225959 - protein, 97 aa, Glycine max
  Coding DNA Sequence Number=SeqID_109181
MVASFAYRKERDGSCVKKGAQPNDDEGQLPVEGDSSLLQSILDRFDGLQTYVGERFDALERQGDTRFDEMDSRITKVEEDVTIIHDCLDLPPPPPSI

SEQ ID NO: 225960 - protein, 57 aa, Glycine max
  Coding DNA Sequence Number=SeqID_109182
MTRGGNPVSLNNNIGLRTVFEGQLFYIGCVATTDVECFYIGYQSIDVEWIGMGRFLH

SEQ ID NO: 225961 - protein, 87 aa, Glycine max
  Coding DNA Sequence Number=SeqID_109183
  Homolog annotation: Hit_ID=Q9SAK4; Match level="QueryCoverage=38%, HitCoverage=6%, E-value=5e-08, Identity=79%"; Hit description =Succinate semialdehyde dehydrogenase, mitochondrial precursor (EC 1.2.1.24) (At-SSADH1) ...
  Homolog annotation: Hit description=(NAD(+)-dependent succinic semialdehyde dehydrogenase)
MELLVHMKVAPFGGFKQSGLGREGSKYGMDEYLELGDCVELLIALLDVLGQWVWADTWDPRRMHCVMDSIPATAIEIGGVAPIQTDG

SEQ ID NO: 225962 - protein, 476 aa, Glycine max
  Coding DNA Sequence Number=SeqID_109184
  Gene Ontology: Mol. function=nucleoside-triphosphatase activity; Cellular component=membrane; Biological process=defense response
  Homolog annotation: Hit_ID=Q1SI25; Match level="QueryCoverage=96%, HitCoverage=50%, E-value=0.0, Identity=74%"; Hit description=NB-ARC domain, putative
  Pfam annotation: Domain name=NACHT; Domain location=65-219; Score= -21.5; E_value=0.0027; Accession=PF05729.3; Description=NACHT domain
  Pfam annotation: Domain name=NB-ARC; Domain location=26-322; Score =176.4; E_value=7.2e-50; Accession=PF00931.13; Description=NB-ARC domain
  Pfam module annotation: Pfam domain module=NACHT::NB-ARC; Domain location=65-219::26-322
MDEPNGEQQTLVQLNESEAIKTIVENITRLLNKTELFVADNPVGIEPRVQEMIELLDQKQSNDVLILGMWGMGGIGKTTIAKAIYNKIGRNFEGKSFLAHIREVWEQDAGQVYLQEQLLFDIKKETNTKIRNVESGKVMLKERLRHKRVLLILDDVNKLHQLNVLCGSREWFGSGSRIIITTRDMHILRGRRVDKVFRMKGMDEDESIELFSWHAFKQASPREDFIELSRNLVAYSAGLPLALEVLGSYLFDMEVIEWKNVLEKLKKIPNDEVQEKLKISYDGLTDDTEKGIFLDIACFFIGMDRNDVIHILNGCGLCAENGIRVLVERSLVTVDYKNKLGMHDLLRDMGREIIRSKTPMELEERSRLWFHEDALDVLSKETGTKAIEGLALKLPRNNTKCLSTKAFKEMKKLRLLQLAGVQLVGDFKYLSKDLRWLCWHGFPLACIPTNLYQGSLVSIELENSNVNLLWKEAQNI

SEQ ID NO: 225963 - protein, 454 aa, Glycine max
  Coding DNA Sequence Number=SeqID_109185
  Gene Ontology: Mol. function=nucleoside-triphosphatase activity; Cellular component=membrane; Biological process=defense response
  Homolog annotation: Hit_ID=Q19PJ3; Match level="QueryCoverage=33%, HitCoverage=9%, E-value=2e-40, Identity=54%"; Hit description=TIR -NBS-LRR type disease resistance protein
  Pfam annotation: Domain name=TIR; Domain location=36-171; Score =167.7; E_value=3e-47; Accession=PF01582.10; Description=TIR domain
MSSAYSFDSDLHDEEMEMEMDFLRERYQEDNRNYDVFLSFRGEDTRASFTSHLYTALHNAGVFVFKDDETLSRGNKISPSLQLAIEESRVSVVVFSRNYAESRWCLKELEKIMECHRTTGQVVVPVFYDVDPSEVRHQTGHFGKAFRNLENRLLKVEEEELQRWWKTLAEAAGISGLSVVRNCKEIGDKICLLAQHWREALREAAGILGDSVSEFGRGMLIAEKLIDLLVKHWRETLCEALCEAVGFSDGADLYYRGKFANEISLLMKHWREALCEHNGIPLVFLLNFSVEEEIIRDFKDLMMSWKEALREAAGISRVVVLNYRAPFWNSAVHSLRKMPSCNNLNANNPSSTLNPVQDPMSLFYVNPNENPAASIVSSPLTALITKNKQKFVDGSIGKPDRCDPIDKTWERCNNSLEEFSRKRFSQADLELEPKKATEQPVVTGLNGEEYKTLI

SEQ ID NO: 225964 - protein, 73 aa, Glycine max
  Coding DNA Sequence Number=SeqID_109186
MELAIPDLKTLKKVLDNEKRRFDTVWHTMVRVSTQGVSDEGFDASWWRQWSGYRSGAAMMKDNIGDSGRDKAY

SEQ ID NO: 225965 - protein, 223 aa, Glycine max
  Coding DNA Sequence Number=SeqID_109187
MKNMKDVDFEEEGEIVKIPEVGERSKDEGFCPQVSFLTNTKVEIEGELEEPLRLEEVLWKKRLKVEWLMYVDRNTTFFHRKTSHQKQVNTTKKIQDDDGNVYRNAEDIGEYYYGLKGYNEGRVLWRIGDGRSVEVYEDKWLQSGDVSLYHVPHESQVNPLLVADLINHEARQWKGGLINMLFLSHVKEEIHRIPLTETGKEDKLNGDILWMGGTMSNPVAGVR

SEQ ID NO: 225966 - protein, 136 aa, Glycine max
  Coding DNA Sequence Number=SeqID_109188
MFVFISPTHQLGCAASSAPINSCCGGGATGDPVLRAGEAELHPSPLIEPPTTSTSDSEEDLPPPAVSKNPPPLQPQHFSSESETESGSETKYLLGFWAFAYYCGGGCVIVKVFVAGGDCDGRSGYEGEEDQKGGDE

SEQ ID NO: 225967 - protein, 41 aa, Glycine max
  Coding DNA Sequence Number=SeqID_109189
MKATMLVASAQLGTNDVVVAGGMQSMSNVPKWWLKQCQYCL

SEQ ID NO: 225968 - protein, 65 aa, Glycine max
  Coding DNA Sequence Number=SeqID_109190
  Gene Ontology: Mol. function=actin binding; Cellular component=F -actin capping protein complex; Biological process=actin cytoskeleton organization and biogenesis
  Homolog annotation: Hit_ID=Q9M9G7; Match level="QueryCoverage=90%, HitCoverage=39%, E-value=1e-15, Identity=48%"; Hit description =Probable F-actin capping protein subunit beta
MDNIIDGSKTGQGRRGYLEEGAWDAIHVIEMSMKLSVVNGHLCNMGRMIEEMESKLRNSLDQVKF

SEQ ID NO: 225969 - protein, 99 aa, Glycine max
  Coding DNA Sequence Number=SeqID_109191
MTTLAQRWSFLSYFNLAPTSHTSDLNMDKARLIYGIIMKMDMDSGKPSRSFYGFFGDQEDSRSCYSGGSYSTAASRHPSMPYPSSLVLHPSGSQATKHP

SEQ ID NO: 225970 - protein, 111 aa, Glycine max
  Coding DNA Sequence Number=SeqID_109192
  Gene Ontology: Mol. function=catalytic activity; Cellular component =endoplasmic reticulum; Biological process=metabolic process
  Homolog annotation: Hit_ID=Q2HW64; Match level="QueryCoverage=84%, HitCoverage=19%, E-value=6e-32, Identity=66%"; Hit description =Sterol desaturase
MASKPGILTDWPWKPLGSFKYVILAPSVVHSLYSMLAKDKSERDITNFLILPFLLWRMLHNQIWITLSRHRTAKGNGRIVDKGIEFDQVDRERNWSVSVNQDVFNLKTNIL

SEQ ID NO: 225971 - protein, 504 aa, Glycine max
  Coding DNA Sequence Number=SeqID_109193
  Gene Ontology: Mol. function=dolichyl-diphosphooligosaccharide -protein glycotransferase activity; Cellular component=cellulose and pectin-containing cell wall; Biological process=protein amino acid glycosylation
  Homolog annotation: Hit_ID=Q9ZUA0; Match level="QueryCoverage=88%, HitCoverage=88%, E-value=1e-153, Identity=61%"; Hit description =Putative ribophorin I
  Pfam annotation: Domain name=Ribophorin_I; Domain location=26-463; Score=582.1; E_value=5.3e-172; Accession=PF04597.5; Description =Ribophorin I
MVPQPLLTLFLFFSLLSIANSSPSQHLQIANAERRIDLTSHIIKVYLTLKHHLRNLQILYFKELSFQVENLGTSPASEVHIAFSPTEVEHLAIVKAAATSGKRKKKTYVPLDVKSAELPDGPNGTKFFSITLLTPLSKGETTTLEVLYILTHSLEPFPVEISQSESQLVYFRDSAILLSPYHVKQQTTFIKTPSTRVESFTVVDPTKRAGTELKYGPYENHPPYSYSPVLIHFENNNAFAVVEELEREIEISHWGSIQVTEQYSLVHAGARHKGVFSRVEYQTKPGGTGVSSFKHLLAKLPPRVHSVYYRDGIGNISSSHLRTDSWKSELEIEPRYPLFGGWKSTFVIGYGLPLQDFLFESPDGRRYLNFTFGCPLVETVVDKLIVKVGLLLLTENCASTASVVLPEGSKDPTVEIPFEVKQHLENYMVIWPFLDLCIVFVYIVKISHYMPKWDLALSILYSNAILSECREEEDKHKIYTGSATNHAYIQSPSNLRFLRFLSTL

SEQ ID NO: 225972 - protein, 96 aa, Glycine max
  Coding DNA Sequence Number=SeqID_109194
MPHQKRKILGEASLLSSKSETQHDHRSTSTLYGSHRPSCHVCIEQSKNYPTLLAKQTDDSQVDAISSSHVVYPRIQWHKLFLTTKVIDRQIHTKRQ

SEQ ID NO: 225973 - protein, 460 aa, Glycine max
  Coding DNA Sequence Number=SeqID_109195
  Gene Ontology: Mol. function=signal transducer activity; Cellular component=membrane; Biological process=response to light stimulus
  Homolog annotation: Hit_ID=Q1SGZ1; Match level="QueryCoverage=97%, HitCoverage=73%, E-value=1e-127, Identity=53%"; Hit description =BTB/POZ; NPH3
  Pfam annotation: Domain name=BTB; Domain location=16-133; Score=15.1; E_value=0.00018; Accession=PF00651.21; Description=BTBPOZ domain
  Pfam annotation: Domain name=NPH3; Domain location=208-459; Score =263.2; E_value=5.2e-76; Accession=PF03000.5; Description=NPH3 family
  Pfam module annotation: Pfam domain module=BTB::NPH3; Domain location= 16-133::208-459
MASMKLGSKSEMFYLYGQSWLCSTGLPSDVIIEIGDTSFHLHKFPLISRSKVLESMMKEISSEHEKSVLELHDLPGGAKAFLLVAKFCYGVKMELTAPNVVGLRCAAEHLQMTENYGEGNLITQTEHFLNHVFSYWTDTLEALKTCEEVLPFAEELHITSRSIHSLVLKVADQSLVSFPVSTSQSVTQSPDDAEVWNGISLTPKTSGEDWWFEDVSSLSLPLYKRFMQGASARQMKPKRIAESLVYYAKKHIPLLRSQASSQNGNSSSFKSTISTPSEADQRNLIEEIVELLPNEKGIAPTKFLLGCLRTAMALYASSSCCANLEKRIGAQLDEADLEDLLIPNIGYSMETLHDIDCVQRMLDYFMIVEHDVIDSTSNDIEEEGRIVGCSQPESPMAKVANLIDSYLAEVAPDVNVKLPKFQSLAAVLPDYARTLDDGIYRAIDIYLKLVIRSLKVELVA

SEQ ID NO: 225974 - protein, 155 aa, Glycine max
  Coding DNA Sequence Number=SeqID_109196
MAPLLAFRERGEGTERDKATTKTGASASTMFPLSTFRFSMETLLATNIQGFGSRGVETGIIEGVEKDEKHILLPIQEDVYKSCESISTLASDLFEDVRASIQKSSKKSTPSTSNIKVSSSPSVPLFQTHDCMSLSPLCVFSIDPCYLFVNCEEHL

SEQ ID NO: 225975 - protein, 80 aa, Glycine max
  Coding DNA Sequence Number=SeqID_109197
MCMIQLGLLALNRYGCGVVDILIQSVYNIEWCIVGRQAIWWEGMLTLDLHKMGAACTSQSFGSLSYHIRDWTIYLIEARL

SEQ ID NO: 225976 - protein, 422 aa, Glycine max
  Coding DNA Sequence Number=SeqID_109198
  Gene Ontology: Mol. function=catalytic activity; Cellular component =endoplasmic reticulum; Biological process=metabolic process
  Homolog annotation: Hit_ID=Q2HW67; Match level="QueryCoverage=96%, HitCoverage=66%, E-value=1e-143, Identity=58%"; Hit description =Sterol desaturase
MAVFGYVTYIDFMNNMGHCNFEIVPMWLFNIFPCLKYLMYTPSFHSLHHTQFKTNYSLFMPFYDYIYDTLDKASDQLHDSASKREEEIPDVVHLTHLTTPESIYHLRLGFAYLACKPCTSKWYLCLMWPMTAWSMILTLAYGRTFIVEGNHFDKLKLQSWAIPKYSQQYFIRSQKMPINKMIEEAILDADKKGIKVLSLGLLNQGEDLNSYGGFYVSKHPNLKVKVIDGSSLATAIVLNSIPNGTTQVLLRGKLTKVAYTIAFTLCQQGVQVATMHKDDYVKLKNSFSSFGKNFIIEKSYTQKTWLVGEGLTEEEQLKAPKGTLFITYSQFPPIKYRKDCSYHFTPAMLVPSSIQNVHSCENWLPRKVMSAWRIAGIVHCLEGWSEHECNYTMHNIDKVWRSTLQHGFQPLSVPINKELAHY

SEQ ID NO: 225977 - protein, 123 aa, Glycine max
  Coding DNA Sequence Number=SeqID_109199
  Homolog annotation: Hit_ID=Q1SGC9; Match level="QueryCoverage=99%, HitCoverage=33%, E-value=1e-18, Identity=49%"; Hit description=HPr serine phosphorylation site
MPSLTVNKIGLERVEEGKENNNNKKQRRDGSEIDLQLLKGMCFWIRRDLEIVEKENREMKHLLDEMKLKLSESNGEVQRWRSYKSERQEEEKKVQQPNKPQSVATNDVESELEKAIKAATSTS

SEQ ID NO: 225978 - protein, 240 aa, Glycine max
  Coding DNA Sequence Number=SeqID_109200
  Gene Ontology: Mol. function=transcription factor activity; Cellular component=nucleus; Biological process=regulation of transcription, DNA-dependent
  Homolog annotation: Hit_ID=Q8L9K1; Match level="QueryCoverage=76%, HitCoverage=76%, E-value=8e-37, Identity=43%"; Hit description =Ethylene-responsive transcription factor 13
  Pfam annotation: Domain name=AP2; Domain location=118-183; Score =134.0; E_value=4.1e-37; Accession=PF00847.10; Description=AP2 domain
  Subcellular localization annotation: CTP_CleavageSite=28; ConfidenceScore=5.41e-01
MSPHALNTNVNALHDIGLPVSTPFKDASASVPSTAVFGRNSSFRNIFLAKNWAELPLKEDNAEDMVIYGVLREAATMGWLPANGNGVSKVGMAVKMENESQNSDKAAACGTHVPPRRGLSFRGVRRRPWGKYAAEIRDAKRNGVRVWLGTYETAENAALAYDRAAFKMHGSKAKLNFPHLIASAHHHVEPIRIALKKHSFDVSLSSSEVAAKRSKNGTASTNLELNDSNMLQFPMDNRWQ

SEQ ID NO: 225979 - protein, 160 aa, Glycine max
  Coding DNA Sequence Number=SeqID_109201
  Homolog annotation: Hit_ID=Q1T1F7; Match level="QueryCoverage=86%, HitCoverage=27%, E-value=2e-07, Identity=33%"; Hit description=IMP dehydrogenase/GMP reductase
MSDGFCGTHLQIMVRTRGLGRALGQRVAVTAEHVDEPVIADPDVQDDPMEAPAAVEDIPADAGAEAAEDQPQGFPDGPSDPSVLTAYADHVACSVWTGEERPELKLSSHGRKVHSLGRHVPAIEGLIADTGLSPLIACSVDTGDRGLLSAFVERWHWETS

SEQ ID NO: 225980 - protein, 67 aa, Glycine max
  Coding DNA Sequence Number=SeqID_109202
  Subcellular localization annotation: CTP_CleavageSite=30; ConfidenceScore=5.40e-01
MAPRKLSIKRSRKDARPKGLVPLPSSIAIVSGALSTCSVSKPSRDGPSTERDASSSGTMSTQVSRRR

SEQ ID NO: 225981 - protein, 100 aa, Glycine max
  Coding DNA Sequence Number=SeqID_109203
MDGEELPLPVNSDVGFPSTVYLLSQSFKGREHGFEASVLALGHNRLRPQSEVETKLKVETNQGVVGDGLRPMLHPEAMGHATLPPLSCYSCLNMRPPSAR

SEQ ID NO: 225982 - protein, 274 aa, Glycine max
  Coding DNA Sequence Number=SeqID_109204
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=41%, E-value=1e-116, Identity=68%"; Hit description =Photosystem I P700 chlorophyll a apoprotein A1
  Pfam annotation: Domain name=PsaA_PsaB; Domain location=18-274; Score= -162.0; E_value=0.00066; Accession=PF00223.9; Description=Photosystem I psaApsaB protein
DRDPIKTSFEEWAKPGHFSRTIAKGPDTTTWIWNLHADAHDFDSHTNDLEEISRKVLVPIFGQLSIIFLWAEWHGEGSEEIQITPRFFSDLESIWNNLVNYNSICTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHK

SEQ ID NO: 225983 - protein, 111 aa, Glycine max
  Coding DNA Sequence Number=SeqID_109205
GQGRPVRRWGISFIAERGNSPDHQLRPLNDRSVIKEREGPARAVLDESGSENVGLSTANVGENPMPRKPKGFLRKGPKIRPKGVVDGQQEARFSRKMGIGFKDAGCPCFFR

SEQ ID NO: 225984 - protein, 251 aa, Glycine max
  Coding DNA Sequence Number=SeqID_109206
  Gene Ontology: Mol. function=monooxygenase activity
  Homolog annotation: Hit_ID=Q6N8E6; Match level="QueryCoverage=99%, HitCoverage=74%, E-value=1e-110, Identity=77%"; Hit description =Alkanal monooxygenase
MAEDAGAADLIANGRLQLGLSRGSPEQVIEGYRYFGFNPREGETDADMGRRHTEELLEVLRGEGFAKPNPQPMFPNPPGLLRLEPYSEGLRERIWWGSGSNATSIWAAQLGMNLQSSTLKDDETGEPFHVQQAKQIRAYKEAWQAAGHQRAPRVSVSRSIFALMNDTDRAYFGRSGQEQDSVGFLDEKTRAIFGRSYAAEPEQLIKQLAQDEAIAEADTLLLTIPNQLGVDYCAHVIDSILTHVAPELGWR

SEQ ID NO: 225985 - protein, 136 aa, Glycine max
  Coding DNA Sequence Number=SeqID_109207
  Gene Ontology: Mol. function=DNA binding; Biological process =regulation of transcription, DNA-dependent
  Homolog annotation: Hit_ID=Q7N448; Match level="QueryCoverage=98%, HitCoverage=99%, E-value=6e-34, Identity=53%"; Hit description =Similar to hypothetical phage protein
  Pfam annotation: Domain name=UPF0150; Domain location=2-50; Score =85.2; E_value=2e-22; Accession=PF03681.5; Description=Uncharacterised protein family (UPF0150)
MFYPIAIEAGDETTAYGVTVPDLPGCFSAGDTLEEAVKNAKEAITGHLELMVELGQDIPAVSDLKSLMKSAEFAGYVWVLVDVDVTRILGGSEKINVTLPKLLIDRIDRCVATHPEFKTRSGFLAQVALERIANTR

SEQ ID NO: 225986 - protein, 89 aa, Glycine max
  Coding DNA Sequence Number=SeqID_109208
MLGLTHDSPQISASPHQLDLAPYASGPYNAQGNALGLLHDKQTSCSSRILGEMEVEEPWLGLWLPLNYQVDMGARMAFVDDRVVGNEKG

SEQ ID NO: 225987 - protein, 80 aa, Glycine max
  Coding DNA Sequence Number=SeqID_109209
MVGYTPSSFADMFFAGKRIEVGLKRGKFGHLALMKTGASEEGENEGETRVVTVIPVQSSFPPTQQCHYPANNNPSPYAPP

SEQ ID NO: 225988 - protein, 91 aa, Glycine max
  Coding DNA Sequence Number=SeqID_109210
MPHQKRKILGEASLLSSKSETQHDHRSTSTLYGSHRPRCSGRQRRRGERRRHPLGNKPWKKELHHQEYALDKKLEEDALMEEKEERRGARN

SEQ ID NO: 225989 - protein, 109 aa, Glycine max
  Coding DNA Sequence Number=SeqID_109211
  Subcellular localization annotation: CTP_CleavageSite=34; ConfidenceScore=5.52e-01
MSHHIRALCPNVLQHKVPLSNSPSHLLSQTQSSRSSQDPNTNNTQGGDQSESRCFARMLQPCGIDTGLKEHPKRVTPKDYISKSPSGSLPPDSDTTNELYNTHDLTLVF

SEQ ID NO: 225990 - protein, 157 aa, Glycine max
  Coding DNA Sequence Number=SeqID_109212
MTGERCMFQCLTPYHGGTVTFGQNQKGRITRVACLSKLIPLGLSISSLGRASPAPKWLFPINNHAEGRVQELEKEREREKEEEEGRKMKLKRYRIVIVIIPYIVLLLCVPRAIVGVRVMQSYPARALDNRLQVDWARDPREGPRVLMSLRIDFEPMG

SEQ ID NO: 225991 - protein, 92 aa, Glycine max
  Coding DNA Sequence Number=SeqID_109213
MPDTRQYSSTPGGLTNSSPSACQDYYPSRQIDSLDEGQSTSTLDNLFRPHSSSELGGLMYYSGPTKSMWHPTWHPETCVHPPCQPYYRSANA

SEQ ID NO: 225992 - protein, 545 aa, Glycine max
  Coding DNA Sequence Number=SeqID_109214
MRAKEVVQCRSRLPLIEGIYLTTGECCRSMWLVKPPSLDMCCLGCFYQVVRDGRVFGMLGACGTRTRVMVVCDWVNVMVISIGGSSSEVTRQGASYSKSSSSERVKTSRGTRRASGDGDVRSSPRVRPSVSVRSLSSILVVVGYEWATSVAALQRQVKLANPEDSCKMVVQACKSDDFPFFRAAPVCSAGALEYGLFPAPPNQLGNGREPHFLFYWQSDPTRFKSYDEDLLTLVKRVVKVILEQLLASLDTWAILSLPLESGFAGIMSDFAWRPLVKQVELVGGIVPPSVAAPSAGEGGQPTGKVGPVFVVVEVALSAPSSILVKRKGDYAARPLGRKKSKAPMSLHALRQATELGPITGHLTIVQDVPPASPVVEALAPLSPPATVVQQVSFTVVETVVPATKAESVVVPLSIVATPLLSVNIATIGAPMVPPFSSLTLVALLVAVLVTMASHSSSSHRRISLDHLYTSNDADSLWGATYKLKQKTPADFVSAFDKNLIKLVVVQNATDYAKVFLQRSLAILEENGLRHREAVQKVASIKYRKE

SEQ ID NO: 225993 - protein, 355 aa, Glycine max
  Coding DNA Sequence Number=SeqID_109215
  Gene Ontology: Mol. function=transporter activity; Cellular component= integral to membrane; Biological process=transport
  Homolog annotation: Hit_ID=Q4ZUE8; Match level="QueryCoverage=47%, HitCoverage=45%, E-value=9e-35, Identity=47%"; Hit description=Major facilitator superfamily
RHRAADPLAGVARCLSGHCRAVVPGGAAGLPVCATGAAHAIHTKSHATAYRTEFAGPHAVLAAVQHLYPRVGDHDGDIGAVDYSAAGERAFAERRAGDQHAAGAVPGGVAHCRYGVQTRPSHLDHFLLSRAGGAGITAAGLLSRVGAGEYGAVRCRKWLAGYRARYVAAGDGKTGRVRHCGWPHGATGADWSGAHAADWRLYFPAFRRAGYAVAVMRAGAHQRAFGGGAEAEIAGRRSGIRRLKSPLTANGQRWPLLRFSGDPSDIAAGNTTRLTAECSQPRQRKAAVPFVRIAIRSVAHTARHPCRNNRPFVTTSFTSPQLQRWGQKSDTSRILLRKAQSAKAVSGMPCWNILI

SEQ ID NO: 225994 - protein, 222 aa, Glycine max
  Coding DNA Sequence Number=SeqID_109216
  Subcellular localization annotation: CTP_CleavageSite=55; ConfidenceScore=5.09e-01
MTEPRVFLCAPSKIVGAPNNNIEVTKMPFSKNLKKLSPSLPLQRAVVATIHLFLCASRVPPLGCESILVIVSVISVTLPTPLVIMVRTRGLGQALGRVIGRAPGREVNRDLDEASQRRRPTTSACRQWEAALVAEDVQQVDHVANEIHEQPEEAAVDDVVPDAKGFLGGPHDTSVLIDYVDHVAMIVWNGEECPELKLSSHGRKVWKFGRPALEIEGLMIAT

SEQ ID NO: 225995 - protein, 188 aa, Glycine max
  Coding DNA Sequence Number=SeqID_109217
  Gene Ontology: Mol. function=protein kinase activity; Cellular component=coated vesicle membrane; Biological process=intracellular protein transport
  Homolog annotation: Hit_ID=P93078; Match level="QueryCoverage=84%, HitCoverage=99%, E-value=2e-78, Identity=90%"; Hit description=Ap19 protein
  Pfam annotation: Domain name=Clat_adaptor_s; Domain location=28-169; Score=254.2; E_value=2.6e-73; Accession=PF01217.10; Description =Clathrin adaptor complex small chain
PKSVTLLSKSDVYIAPEKYLVLACACPHINFVLLISRQGKVRLTKWYSPYSQKERSKVIRELSGMILSRAPKQCNFVEWRGHKVVYKRYASLYFCMCIDQDDNELEVLEIIHHFVEILDRYFGSVCELDLIFNFHKAYYILDEILIAGELQESSKKTVARLIAAQDSLVENAKEEVSSLSNIIAQATK

SEQ ID NO: 225996 - protein, 763 aa, Glycine max
  Coding DNA Sequence Number=SeqID_109218
  Gene Ontology: Mol. function=protein serine/threonine kinase activity; Cellular component=cytoplasm; Biological process=protein amino acid phosphorylation
  Homolog annotation: Hit_ID=Q5I6E9; Match level="QueryCoverage=86%, HitCoverage=93%, E-value=0.0, Identity=77%"; Hit description=AvrPto -dependent Pto-interacting protein 3
  Pfam annotation: Domain name=Pkinase; Domain location=367-700; Score =238.2; E_value=1.8e-68; Accession=PF00069.15; Description=Protein kinase domain
  Pfam annotation: Domain name=Pkinase_Tyr; Domain location=367-694; Score=-24.1; E_value=5.5e-11; Accession=PF07714.7; Description =Protein tyrosine kinase
  Pfam module annotation: Pfam domain module=Pkinase::Pkinase_Tyr; Domain location=367-700::367-694
MERVAEPTVLPRTLPILVEVSNSCTVAARDSSQRLNRQEVSGVGGISLREVNQMSRTRDVRVPITHLASLREVAQLTNARIYLVQEDTGFDARSSEESLTFEPTMAWKGNGSSPEEAKEFVPDVETLKGSSDSFEDGGLSLFAGASHPPEPVDTDLMRMVFVPIGQNKSEAGCLIKNLPTKGPFLEDLSIRVPAKKPSPAVLSSEESLVEELNGIGTLSFLGPRASQNTENSILLLDAEEKECVWDASLPPSGNVSPLSSIDSIGVVTAMSIANSCASTYRSDAVTSDGMLSLDRNCDSTKGSVRGDSLESAKTSVSRPSDSSGLSDDSNWSNITGSANKPHKGNDPRWKAILAIRLRDGILGMSHFRLLKRLGCGDIGSVYLSELSGTRCYFAMKVMDKASLASRKKLTRAQTEREILQLLDHPFLPTLYTHFETDRFLCLVMEYCPGGDLHTLRQRQPGKHFSEYAARFYAAEVLLALEYLHMLGVVYRDLKPENVLVRDDGHIMLSDFDLSLRCAVSPTLIRTSYDGDPSKRAGGAFCVQPACIEPSSVCIQPACFIPRLFPQKNKKSRKPRADPGLPSSTLPELVAEPTQARSMSFVGTHEYLAPEIIKGEGHGSAVDWWTFGIFLHELLYGKTPFKGSGNRATLFNVVGQQLRFPESPATSYASRDLIRGLLVKEPQHRLGVKRGATEIKQHPFFEGVNWALIRCSTPPEVPRPVENEVPAGKVVGPVDPVGVGSTSKRIVGTDNMKSGGKYLDFEFF

SEQ ID NO: 225997 - protein, 384 aa, Glycine max
  Coding DNA Sequence Number=SeqID_109219
  Gene Ontology: Mol. function=protein transporter activity; Cellular component=membrane; Biological process=protein secretion
  Homolog annotation: Hit_ID=Q69HW3; Match level="QueryCoverage=92%, HitCoverage=92%, E-value=1e-125, Identity=65%"; Hit description=OqxA
  Pfam annotation: Domain name=Biotin_lipoyl; Domain location=31-98; Score=-19.1; E_value=0.099; Accession=PF00364.12; Description=Biotin- requiring enzyme
  Pfam annotation: Domain name=HlyD; Domain location=66-360; Score =165.2; E_value=1.7e-46; Accession=PF00529.10; Description=HlyD family secretion protein
  Pfam module annotation: Pfam domain module=Biotin_lipoyl::HlyD; Domain location=31-98::66-360
MHLQTYGVRRAVSLSGVMLLGSLLAGCDRGVAQNAPPPPPEVSVAQVVQQKVSQWDSFNGRIEAVQSVQLRPRVSGYIDQVNYREGDEVKKGQVLFTIDDRTYRATLEQAQAELASARSQAALARSESARTDKLIGTQVVSREEWEQRRSTASQAQASVLAAQAAVDMAQLNLDFTRVTAPIDGRASRAMITTGNLVTAGDSASVLTTLVSQDRMYVYFDVDEAIYLQYQAMARQGQNRGSLPVEIALTGEQGYPHRGTVDFLDNQLTASTGTIRMRATLDNQQRQFTPGLFARVRLPGSAEFNALLVDDRAVLTDQDRKYVYVVDAQGKAERRDVQLGDLANGLRIVQQGLKPGDKVIVNGLQKVFMPGMPVKAQPVAMRSAQ

SEQ ID NO: 225998 - protein, 216 aa, Glycine max
  Coding DNA Sequence Number=SeqID_109220
  Gene Ontology: Mol. function=endoribonuclease activity
  Homolog annotation: Hit_ID=UPI00005F9637; Match level="QueryCoverage =56%, HitCoverage=78%, E-value=3e-42, Identity=65%"; Hit description =COG4290: Guanyl-specific ribonuclease Sa
  Pfam annotation: Domain name=Barstar; Domain location=130-216; Score =2.7; E_value=0.0018; Accession=PF01337.8; Description=Barstar (barnase inhibitor)
  Pfam annotation: Domain name=Ribonuclease; Domain location=48-144; Score=56.4; E_value=9.2e-14; Accession=PF00545.10; Description =ribonuclease
  Pfam module annotation: Pfam domain module=Barstar::Ribonuclease; Domain location=130-216::48-144
MSKKLWIGLLFALVVCWIGLKPHLSGTAPEKQTDIAQLTDAHRVARWLQQHHRLPDFYLTKSAARRQGWNPAQGNLCEVLPGRAIGGDRFSNRERRLPMQAGRQWYEADVNYDCGHRDADRLLYSSDGLIFLTTDHYRSFTPAFYQALVDQSGCGERFGYNLDALWDWLTGGMALPATLHLQHVAEVSASAEFAPVLALLEEAAQQLAGELRLITH

SEQ ID NO: 225999 - protein, 123 aa, Glycine max
  Coding DNA Sequence Number=SeqID_109221
  Gene Ontology: Mol. function=sequence-specific DNA binding; Cellular component=intracellular; Biological process=regulation of transcription, DNA-dependent
  Homolog annotation: Hit_ID=Q6IUW8; Match level="QueryCoverage=90%, HitCoverage=83%, E-value=4e-38, Identity=68%"; Hit description=SdeR
  Pfam annotation: Domain name=HTH_AraC; Domain location=16-62; Score =41.8; E_value=2.3e-09; Accession=PF00165.13; Description=Bacterial regulatory helix-turn-helix proteins, araC family
  Pfam annotation: Domain name=HTH_AraC; Domain location=68-112; Score =39.3; E_value=1.3e-08; Accession=PF00165.13; Description=Bacterial regulatory helix-turn-helix proteins, araC family
  Pfam module annotation: Pfam domain module=HTH_AraC::HTH_AraC; Domain location=16-62::68-112
MATGENGMMSDAFIHDLIDWIDNNIEARLDLDTVAGRAGYSKWHLQRMFKEHTGYPLGEYIRAKKLKKSADRLTTTNEPILNVAISLGFDSQQSFNRSFKRQYGVAPGAWRRHAAHTPSAMQQ

SEQ ID NO: 226000 - protein, 447 aa, Glycine max
  Coding DNA Sequence Number=SeqID_109222
MAPKRSDLVRVSTINNIEEVKKKFLKIGSFLENGICLIVLAGPSSLKCSVPSTMGVTLYYGEQPGLVFDRDWENEITQEMMDFMLYGKQCRESSDKKGLIKFLRTTNLFYMHKLIHNFLFNIVMPIVGPRDYVSDKDRFCMYNIMVGGKILRNNKVDVFVMESSLGTTQLKGMSFVKMGTTNNFQEYVENHIKRKVNKEEPQSVEEQLEQIQPQSVDPKFRAPSKQTQGEQVEILDIPTPQPSPFLALPPQLEPKHPYPITSKKEVTALAKETRLSLAESRRKYEFALKAKQAELKELKRLQSAVENGIEDEQQATKWLLPSRSLPPSIPSQNVLDPEMQSLLKLWKERFIKIDPFSYPTWDTIHEEEQHHLPPKRKVYPLGTIIWKSREASYANTPFSTSMDLQQLMGLLCTFSVVLPWDHFQSDMTFQTEDILLVDPEASPYFPN

SEQ ID NO: 226001 - protein, 153 aa, Glycine max
  Coding DNA Sequence Number=SeqID_109223
MLIPLKEVDLDIDVASSSMVVQVYDPSPSRNYVQLHKKELIKTREALKDHSFAKNRAHKWSLIGDFFYKKAYGWKPCRSSTPPSSPLTISFDFEDFGDEFLRKLDEEAAKQKKEKNVKFESSLGKRKMSTFEGSTIQGGAPMGEIVESKDAYI

SEQ ID NO: 226002 - protein, 321 aa, Glycine max
  Coding DNA Sequence Number=SeqID_109224
  Gene Ontology: Mol. function=nucleic acid binding; Biological process= DNA integration
  Homolog annotation: Hit_ID=Q1SAD3; Match level="QueryCoverage=44%, HitCoverage=56%, E-value=3e-46, Identity=55%"; Hit description =Integrase, catalytic region
  Pfam annotation: Domain name=rve; Domain location=105-261; Score =51.2; E_value=3.5e-12; Accession=PF00665.16; Description=Integrase core domain
MAKEIWDSRSINYEGIKDVQLRKVITLTRHYESYHMEEGEFVDDMLGRLQVLLNKLEALGQNFTKAQINLQILNSFPRVWEHKTTTIQEARNFKTLALDKLLGILRVHEVHLQNMDHLPKRNFVALKTRETSSKREERKSPSRVLKVHMNEFDASDNNFEISIDDEMALISDHGTEFENAEFRSFCEKNGIFHNFSSLRTPQQNGVAERKNITLQEMARTMLYENSLPKHLWVEAINTTCYVQNGILIRPFIEKTPYELWKARRSNMSYFHPFGCKCFILNTMDQLGKTLVMEESIHVKFNDELTFGRKLLDLEDDIHICR

SEQ ID NO: 226003 - protein, 416 aa, Glycine max
  Coding DNA Sequence Number=SeqID_109225
  Gene Ontology: Mol. function=kinase activity; Cellular component =integral to membrane; Biological process=meiosis
  Homolog annotation: Hit_ID=Q7XA06; Match level="QueryCoverage=98%, HitCoverage=75%, E-value=1e-152, Identity=64%"; Hit description =Synaptotagmin C
  Pfam annotation: Domain name=C2; Domain location=134-218; Score =117.2; E_value=4.7e-32; Accession=PF00168.20; Description=C2 domain
  Pfam annotation: Domain name=C2; Domain location=299-381; Score=65.8; E_value=1.4e-16; Accession=PF00168.20; Description=C2 domain
  Pfam module annotation: Pfam domain module=C2::C2; Domain location =134-218::299-381
MKVLETNEKELVMEQVIKWAGNPNIVVSLYVSSLKITIQLVDLQIFAAPRITLRPLVPTFPCFANIVVSLMEKPHVDFGMNVSGGDIMSIPGLYRFVQETIKKQVANLYLWPQTLEIPILDESTVAIKKPVGILHVNVVRAQKLLKMDLLGTSDPYVKLSLTGDKLPAKKTTVKRKNLNPEWNEKFKIVVKDPQSQVLQLQVYDWDKVGGHDKLGMQLVPLKVLNPYENKEFILDLLKDTNLNETPHKKPRGKIVVDLTFVPFKEDSNKFGGPSEGYSRKESGIDIVSDDEVQEGAGLLSIVIQEAEEVEGDHHNNPFAVLTFRGEKKRTKTMKKTRHPRWNEEFQFMLEEPPLHEKIHIEVMSKRKNFSFLPKESLGHVEINLRDVVHNGRINDKYHLINSRNGVMHVEIRWKVV

SEQ ID NO: 226004 - protein, 159 aa, Glycine max
  Coding DNA Sequence Number=SeqID_109226
  Homolog annotation: Hit_ID=Q655F0; Match level="QueryCoverage=78%, HitCoverage=18%, E-value=8e-25, Identity=41%"; Hit description =Putative CLB1 protein
MGFLSSFLGVFGFAVGIPLGLLVGFFLFVYSETKRVKDPVVRPISELGPNSLQELLPEIPLWVKTPDYERVYDDYDDDVTVLLILFLHVIQVDWLNKFLLDMWPFLDTAICKIIRSTTQPIFAEYIGKYQIKAIDFDELSLGTLPPTVCDMNEKQRRLC

SEQ ID NO: 226005 - protein, 61 aa, Glycine max
  Coding DNA Sequence Number=SeqID_109227
  Gene Ontology: Mol. function=nutrient reservoir activity; Cellular component=apoplast
  Homolog annotation: Hit_ID=Q84PL9; Match level="QueryCoverage=79%, HitCoverage=26%, E-value=3e-10, Identity=64%"; Hit description =Putative germin E protein
MAYILMLLEAMSKGMLFVNGKLCQDPKLAKAEDFFFSGLGPGDTSNPLGSKVAAVTVNEIL

SEQ ID NO: 226006 - protein, 162 aa, Glycine max
  Coding DNA Sequence Number=SeqID_109228
  Gene Ontology: Mol. function=transferase activity
  Homolog annotation: Hit_ID=Q1SE38; Match level="QueryCoverage=99%, HitCoverage=36%, E-value=6e-73, Identity=80%"; Hit description =Transferase
MRRRIGEPFSRYTIGNILWPVMVFSETVNADTSVRYLVSIAREKFGKLSRELFLRVKSDPNILGSTQCVDLPQGIETISPIPIVLTSWCGLNFSELDFGFGKPLWVGVRGGDQETLPNVAVIMETDEGMEAWLTMEMQHIANLERDVEFLRLALPNPSVSNI

SEQ ID NO: 226007 - protein, 111 aa, Glycine max
  Coding DNA Sequence Number=SeqID_109229
MISFYKSVTCNDIDVGIEFLHQGHINALLWQLGELPILVPPLELLQELIRVSVGQLHVPLRKDVSEMNVVDVFMLGDLRCELGGIPDWFCFLRVALRCGGLTFLRDHLQKE

SEQ ID NO: 226008 - protein, 182 aa, Glycine max
  Coding DNA Sequence Number=SeqID_109230
  Gene Ontology: Mol. function=ammonia ligase activity; Cellular component=cytoplasm; Biological process=L-phenylalanine catabolic process
  Homolog annotation: Hit_ID=Q1SE36; Match level="QueryCoverage=99%, HitCoverage=19%, E-value=8e-40, Identity=51%"; Hit description =Phenylalanine/histidine ammonia-lyase
MEYSKEIHSNGNANGSLNLCNGSTDPLNWGMAAEALKGSHLDEVKRMVEDYRNPVVTLGGKSLTVSQVAAVATHHHGGVTAMQMGSHLDEVKRMVEDYRNPVVTLGGKSLTVSQVAAVATHHHGGVTVKLAKETHRGVKASSDWVMDSMVKGTDSYGVTTGFGATSHRRTKQGGALQTELIR

SEQ ID NO: 226009 - protein, 58 aa, Glycine max
  Coding DNA Sequence Number=SeqID_109231
MGADGLVENVRWPLDRHGNGGLRLWDVDVGEVWWRQCWVQVIERGGFSLLVNIEEKDR

SEQ ID NO: 226010 - protein, 711 aa, Glycine max
  Coding DNA Sequence Number=SeqID_109232
  Gene Ontology: Mol. function=nucleic acid binding; Cellular component= intracellular; Biological process=chromatin modification
  Homolog annotation: Hit_ID=Q1SE31; Match level="QueryCoverage=95%, HitCoverage=46%, E-value=0.0, Identity=67%"; Hit description =Transcription factor jumonji, jmjC; Transcription factor jumonji, JmjN; Zinc finger, C2H2-type
  Pfam annotation: Domain name=JmjC; Domain location=326-459; Score =151.5; E_value=2.2e-42; Accession=PF02373.13; Description=JmjC domain
  Pfam annotation: Domain name=JmjN; Domain location=17-58; Score=40.4; E_value=6e-09; Accession=PF02375.7; Description=jmjN domain
  Pfam module annotation: Pfam domain module=JmjC::JmjN; Domain location=326-459::17-58
MGSVEIPNWLKGLPLAPEFRPTDTEFADPIAYISKIEKEAANFGICKIIPPFPKPSKKYVFSNLNRSLLKCPDFGPDNSSLGVCNSSKTSSGDGSSDGVLRAVFTTRHQELGQSQSVKKAKGTVQNPLSGVHKQVWQSGEAYTLEQFESKSKSFAKSVLGSVKDVSPLVIESMFWKATLEKPIYVEYANDVPGSAFEESKGQFHYSHRRQRKRTYYKSRLDSSDCKQTETGCVRDTQTDETKVASVQSHSDTCLQMAKSSTTVSTFSSNDDSQSSKEKSSDASNEMQGTAGWKLSNSPWNLQVIARSSGSLTRFMPDDIPGVTSPMVYIGMLFSWFAWHVEDHELHSMNFLHTGSSKTWYAVPGDYAFAFEEVIRTEGYSGNIDHLAALKLLGEKTTLLSPEVIVASGIPCCRLTQHPGEFVVTFPRAYHVGFSHGLSAICATEICLTCGFNCGEAANFGTPQWLRVAKEAAVRRAAMNYLPMLSHQQLLYLLTMSFISRVPRTLLPGVRSSRLRDRQKEEREFLVKQAFIEDMLQENKLLSILLGKEATKKAVLWNADLLPDSSKDFQLPDLTSTTGSSMAHMSNISSAEKSGHYLLDEMSLYMENLTNLDLGGDDLPCHFQTDSGALACVGCGILGFPFMTVIQPTEKLIMELLPDNHLVQVSSPDSTACVHSSISSFYAFFVFSGKIELVNYYGCAKVDEQRLISSMK

SEQ ID NO: 226011 - protein, 118 aa, Glycine max
  Coding DNA Sequence Number=SeqID_109233
  Gene Ontology: Mol. function=adenosine kinase activity; Cellular component=nucleus; Biological process=purine ribonucleoside salvage
  Homolog annotation: Hit_ID=Q2XPV0; Match level="QueryCoverage=82%, HitCoverage=34%, E-value=1e-28, Identity=54%"; Hit description =Adenosine kinase isoform 1T-like protein
MPYIDYVFVYGVEARTFSQAHGWKTDNNVIIQDPVLPVVLAEDGKIKLFSAVPLPKEKIVDTNGVADAFVGGFLSQLVQEKAIEECVKAGCYAAILIVCLVSHPVCKISMALPKWPRM

SEQ ID NO: 226012 - protein, 95 aa, Glycine max
  Coding DNA Sequence Number=SeqID_109234
  Gene Ontology: Mol. function=catalytic activity; Biological process =auxin mediated signaling pathway
  Homolog annotation: Hit_ID=Q1SE32; Match level="QueryCoverage=96%, HitCoverage=99%, E-value=3e-33, Identity=62%"; Hit description=Auxin responsive SAUR protein
  Pfam annotation: Domain name=Auxin_inducible; Domain location=1-92; Score=88.6; E_value=1.9e-23; Accession=PF02519.5; Description=Auxin responsive protein
MKLKLLKCCIREFYKFIRKSHSYVPKDVPKGHLVVYVGEDCKRFVIKVGMLNHPLFQALLDHAEDVFGFTNDSKLRIPCNENIFLLVLHNAGDLV

SEQ ID NO: 226013 - protein, 90 aa, Glycine max
  Coding DNA Sequence Number=SeqID_109235
MSSGSLGHASLSHLKNIKTIVISEDEDAHDLKKCSTFVMGKFNCDHKKNKDKPFMSNYNKVIHFKGKIPMEATLPPQKLTYSVGSSVGRP

SEQ ID NO: 226014 - protein, 844 aa, Glycine max
  Coding DNA Sequence Number=SeqID_109236
  Gene Ontology: Mol. function=protein kinase activity; Cellular component=nucleus; Biological process=protein amino acid phosphorylation
  Homolog annotation: Hit_ID=Q9LJR3; Match level="QueryCoverage=97%, HitCoverage=93%, E-value=0.0, Identity=61%"; Hit description =Photomorphogenesis repressor protein-like
  Pfam annotation: Domain name=Pkinase; Domain location=56-294; Score= -97.3; E_value=0.0092; Accession=PF00069.15; Description=Protein kinase domain
  Pfam annotation: Domain name=Pkinase_Tyr; Domain location=28-293; Score=-174.3; E_value=0.089; Accession=PF07714.7; Description =Protein tyrosine kinase
  Pfam annotation: Domain name=WD40; Domain location=516-554; Score =19.4; E_value=0.013; Accession=PF00400.22; Description=WD domain, G -beta repeat
  Pfam annotation: Domain name=WD40; Domain location=566-604; Score =3.6; E_value=14; Accession=PF00400.22; Description=WD domain, G-beta repeat
  Pfam annotation: Domain name=WD40; Domain location=608-647; Score =43.6; E_value=6.8e-10; Accession=PF00400.22; Description=WD domain, G-beta repeat
  Pfam annotation: Domain name=WD40; Domain location=658-696; Score =13.3; E_value=0.86; Accession=PF00400.22; Description=WD domain, G -beta repeat
  Pfam annotation: Domain name=WD40; Domain location=701-738; Score =33.0; E_value=1.1e-06; Accession=PF00400.22; Description=WD domain, G-beta repeat
  Pfam annotation: Domain name=WD40; Domain location=748-786; Score =10.7; E_value=2.1; Accession=PF00400.22; Description=WD domain, G -beta repeat
  Pfam annotation: Domain name=WD40; Domain location=803-842; Score =0.7; E_value=30; Accession=PF00400.22; Description=WD domain, G-beta repeat
  Pfam module annotation: Pfam domain module=Pkinase::Pkinase _Tyr::WD40::WD40::WD40::WD40::WD40::WD40::WD40; Domain location=56 -294::28-293::516-554::566-604::608-647::658-696::701-738::748 -786::803-842
LLAQGGQPKNLGGGFSGLCEDEVEVDPFFCAVEWGDISLRQWLDKPERSVDAFECLHIFRQIVEIVSVAHSQGVVVHNVRPSCFVMSSFNHISFIESASCSDTGSDSLGDGMNNQGGEVKTPTSLCPHDMHQQSLGSEDFMPIKTSTTPARSDSSCMLSSAVYAARASLIEETEENKMKDRRKDEEVEGKKQSFPMKQILLMEMSWYTSPEEGAGESSSCASDVYRLGVLLFELFCPLSSREEKSRTMSSLRHRVLPPQLLLKWPKEASFCLWLLHPDPKSRPTLGELLQSEFLNEQRDDTEEREAAIELRQRIEDQELLLEFLLLLQQRKQEVAEKLQHTVSFLCSDIEEVTKQHVRFKEITGAELGSDERSASSFPSMTFVDSEDSAFLGTRKRVRLGMDVKNIEECDDDVGDDQKSNGSFLSKSSRLMKNFKKLESAYFLTRCRPAYSSGKLAVRHPPVTSDGRGSVVVTERSCINDLKSKEQCREGASAWINPFLEGLCKYLSFSKLKVKADLKQGDLLHSSNLVCSLSFDRDGEFFATAGVNKKIKVFECDSIINEDRDIHYPVVEMASRSKLSSICWNTYIKSQIASSNFEGVVQLWDVTRSQVISEMREHERRVWSIDFSSADPTMLASGSDDGSVKLWSINQAIPFLHLGVSVGTIKTKANVCCVQFPLDSARFLAFGSADHRIYYYDLRNLKMPLCTLVGHNKTVSYIKFVDTVNLVSASTDNTLKLWDLSTCASRVIDSPIQSFTGHANVKNFVGLSVSDGYIATGSETNEVFIYHKAFPMPALSFKFQNTDPLSGNEVDDAVQFVSSVCWHGQSSSTLLAANSTGNVKILEMV

SEQ ID NO: 226015 - protein, 47 aa, Glycine max
  Coding DNA Sequence Number=SeqID_109237
MAQHATRHNSAVCWFYCRDETNDLRPDAERGALILLLLLFHFACVNK

SEQ ID NO: 226016 - protein, 383 aa, Glycine max
  Coding DNA Sequence Number=SeqID_109238
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q1EP29; Match level="QueryCoverage=98%, HitCoverage=95%, E-value=1e-136, Identity=60%"; Hit description =Glycosyl transferase family 14 protein
  Pfam annotation: Domain name=Branch; Domain location=49-267; Score =382.7; E_value=5.5e-112; Accession=PF02485.11; Description=Core-2I -Branching enzyme
  Subcellular localization annotation: CTP_CleavageSite=34; ConfidenceScore=5.04e-01
MDLVSSIHSINSLFFFLPSHLRPNQTEPGFVERKASPAPAPARPVLPRFAYLISGSKGDLEKLWRTLHALYHPLNHYVVHMDLESPLEERMEIAHRIERQHVFAEVGNVFVITKANMVTYRGPTMVANTLHACAILLKRSKDWDWFINLSASDYPLVTQDDLDRGLNFIEHTSRLGWKFDKRAMPLIVDPGLYMSTKSDVFWVNPKRPLPTAFKLFTGSAWTVLSHDFVEYIVWGWDNLPRTLLMYYTNFLSSPEGYFQTVACNAPEWAKTLVNSDLHYIAWDVPPKQHPHVLNINDTDKMVESGAAFARKFKQDDPALDWIDKMILRKRNGLFPLGGWCTGRPKCSEIGNIYKLKPGPGSQRLHRLVAGLTLKAKSGEDQCK

SEQ ID NO: 226017 - protein, 116 aa, Glycine max
  Coding DNA Sequence Number=SeqID_109239
  Homolog annotation: Hit_ID=Q8H6Q8; Match level="QueryCoverage=98%, HitCoverage=3%, E-value=8e-21, Identity=42%"; Hit description=CTV.20
MCLRDIRHNKFEDSLIGTVETSLGHGPVYFNCYPNKIVSLMDRNILDSLFLNIHFHGLDMKEGSIPAALIYRIQYKVMNTCASRFLLKPQRGETTLFIIDMTKANVSLPRTIKWDE

SEQ ID NO: 226018 - protein, 105 aa, Glycine max
  Coding DNA Sequence Number=SeqID_109240
MRLNLEVLKGAIVLSGPCGLSAHPPLSAASLAKRDVCLLPDSTHDWRQAQIHLLTLSARVALSVTLRFQSLFKPELLELGYDFKRPELHKKRRRDCAEKPRVLHF

SEQ ID NO: 226019 - protein, 306 aa, Glycine max
  Coding DNA Sequence Number=SeqID_109241
  Gene Ontology: Mol. function=RNA binding; Cellular component=plasma membrane-derived thylakoid photosystem II; Biological process =aromatic amino acid family biosynthetic process
  Homolog annotation: Hit_ID=Q4C0K5; Match level="QueryCoverage=69%, HitCoverage=76%, E-value=1e-49, Identity=49%"; Hit description=RNA -binding S4
  Subcellular localization annotation: CTP_CleavageSite=60; ConfidenceScore=5.39e-01
MAVTASSFGTTWCLRRAAQAFAISHSHILRNNVKLSLQRNFCSHLLSVSTSLASGVSQTVQALKGEVDLLLKGVGERSVTKEVKHILEMARRASLKREILHTDFLTPPVLKESMQVLEKLADVKAIAQGGYPQAERCRISVGHPEELTSDPDIISALSITGNFQFEPCSHGDFLGSILGTGIVREKLGDIILQGEQGAQIIVVPELVEFLMSTLVKVRNVPVSCTKIPLISLDYEPPRTKSFKTIEASLRVDALASAGFKVSRSKLVDMISSNVISTHYNLLTLIPQVIEAKSLNPTPNPLGSAVK

SEQ ID NO: 226020 - protein, 104 aa, Glycine max
  Coding DNA Sequence Number=SeqID_109242
MPQYSFQVPSRPNVFEGLSQGLCTTLNTLPSAYNAPTSTLYYRPSLPNEMHDMGDDHVDEYGHNNNTNNNNDADDGQGTEHVGEQQQPISCHHPRTRGGRTRTR

SEQ ID NO: 226021 - protein, 169 aa, Glycine max
  Coding DNA Sequence Number=SeqID_109243
MESMGLPCDHNVSILLCLNITNFPKSLLADRWLKYAKEPIKGKYPDASSYWESEDIARYATLLLKSKDINAGPENEMDTEVETKNAFDGVLDPSVVQAKGCGQTMNNESDSRRRIQTCDIYGATDHNRQKCSAGSQNSQHVVGRGGIPPSQQTCNASKAMDEYNYHLVS

SEQ ID NO: 226022 - protein, 131 aa, Glycine max
  Coding DNA Sequence Number=SeqID_109244
  Gene Ontology: Mol. function=galactosylgalactosylxylosylprotein 3 -beta-glucuronosyltransferase activity; Cellular component=membrane
  Homolog annotation: Hit_ID=Q50HU9; Match level="QueryCoverage=95%, HitCoverage=30%, E-value=1e-43, Identity=62%"; Hit description =Glycosyltransferase
MIAICIGAVSVGILVHSGGVDESSTLQGEEGAPPMPVQGPAFYIDDLAPVLPRKLEWAGFVLNSKLLWKDLDDKPEWIKDLEVFDGVDDIESPLYLLGDTSVVEPLGSCGRQVLLWWLRVEARTDSKFPAQ

SEQ ID NO: 226023 - protein, 41 aa, Glycine max
  Coding DNA Sequence Number=SeqID_109245
  Homolog annotation: Hit_ID=Q9M0H8; Match level="QueryCoverage=71%, HitCoverage=5%, E-value=5e-07, Identity=83%"; Hit description =Predicted proline-rich protein
MGFRGDHVASVIQRMEESGQAIDFNSVLDREEDGQGDEELF

SEQ ID NO: 226024 - protein, 56 aa, Glycine max
  Coding DNA Sequence Number=SeqID_109246
  Homolog annotation: Hit_ID=Q8H902; Match level="QueryCoverage=98%, HitCoverage=6%, E-value=2e-20, Identity=84%"; Hit description =Putative DNA binding domain containing protein
MEYGEDYMKPDTETYNWVIQAYTRAESYDRVQDVAELLGMMVEDHKRIQPNAKTHA

SEQ ID NO: 226025 - protein, 90 aa, Glycine max
  Coding DNA Sequence Number=SeqID_109247
  Subcellular localization annotation: CTP_CleavageSite=33; ConfidenceScore=5.12e-01
MVVTVAKFVPTTMMTTIMVLNCSPQPQCQGSPQCDRNRSGGNSGNGDGYSDSGANDNNSGDGNSGSGNNDHGGYNIGGVTATAALMEVAH

SEQ ID NO: 226026 - protein, 331 aa, Glycine max
  Coding DNA Sequence Number=SeqID_109248
  Gene Ontology: Mol. function=hydrolase activity, acting on ester bonds; Cellular component=nucleus; Biological process=lipid metabolic process
  Homolog annotation: Hit_ID=Q8LB81; Match level="QueryCoverage=97%, HitCoverage=79%, E-value=1e-109, Identity=65%"; Hit description =Putative GDSL-motif lipase/acylhydrolase
  Pfam annotation: Domain name=Lipase_GDSL; Domain location=29-331; Score=74.6; E_value=3.1e-19; Accession=PF00657.12; Description=GDSL -like LipaseAcylhydrolase
MASCLVCCIIVTSLFMSLSFASAQQGRAFFVFGDSLVDSGNNDFLATTARADAPPYGIDFPTHRPTGRFSNGLNIPDIISENLGLEPTLPYLSPLLVGERLLVGANFASAGIGILNDTGFQFVQYTGPKLNIIHIYKQLKLFAHYQQRLSAHIGKEGAWRHVNQALILITLGGNDFVNNYYLVPYSVRSRQFSLPDYVTYIISEYRLILRKGPTCLKLANECDHAGDIKNLRLYDLGGRRVLVTGTGPMGCVPAELALRSRNGECDVELQRAASLFNPQLVEMVKGLNQEIGAHVFIAVNAYEMHMDFVTNPQDFGTICYIKDSLLWARPV

SEQ ID NO: 226027 - protein, 95 aa, Glycine max
  Coding DNA Sequence Number=SeqID_109249
  Homolog annotation: Hit_ID=Q1RSZ9; Match level="QueryCoverage=95%, HitCoverage=6%, E-value=7e-12, Identity=45%"; Hit description =Polynucleotidyl transferase, Ribonuclease H fold
  Subcellular localization annotation: CTP_CleavageSite=50; ConfidenceScore=5.58e-01
MVAIVVASRAAVMVAAVATAIMAVSSSLASNNRSTSSGLPGNSSGHRCLRLFHIAHTPHPMAHPFSHIGSDPIFSKPNSAKQTSLGQNHHRTTRW

SEQ ID NO: 226028 - protein, 303 aa, Glycine max
  Coding DNA Sequence Number=SeqID_109250
  Homolog annotation: Hit_ID=Q6Z1P7; Match level="QueryCoverage=68%, HitCoverage=46%, E-value=4e-63, Identity=57%"; Hit description =Carboxyl-terminal peptidase-like
  Pfam annotation: Domain name=DUF239; Domain location=202-298; Score= -9.2; E_value=5.6e-08; Accession=PF03080.5; Description=Arabidopsis proteins of unknown function
MGIIIGRKRRCSCSAPREDHHLLLLTFFVAILLQKAVVESTTLNYTRHRQTSTLRLERISKHLNKINKPHVLTIESPDGDLIDCIHKRKQLALDHPLLKNHKIQKMPTEMPKGMKVKKEENDNSTSEVAWQMWHLNGTRCPKGTVPIRRSTVHDVMRAKSLYDFGKKRSRVDSLSRRHDAPDILSGNGHEHAIAYTGSSQEMYGAKATINVWDPSIQVINEFSLSQLWILSGSFDGTDLNSIEAGWQVSPELYGDNRPRLFTYWTDETKLKNKQRIPKTSFQNYRRRLLPLPNQNVIAEAPFG

SEQ ID NO: 226029 - protein, 67 aa, Glycine max
  Coding DNA Sequence Number=SeqID_109251
  Homolog annotation: Hit_ID=Q6ZL19; Match level="QueryCoverage=51%, HitCoverage=8%, E-value=5e-08, Identity=57%"; Hit description =Putative carboxyl-terminal proteinase
MGIFFSIDIENRTTPYDQLTDWSIPRALNLPDGALRIVPRPTIVEVSAPFVAVVALDVVTVCVFGQG

SEQ ID NO: 226030 - protein, 525 aa, Glycine max
  Coding DNA Sequence Number=SeqID_109252
  Gene Ontology: Mol. function=ammonium transporter activity; Cellular component=membrane; Biological process=transport
  Homolog annotation: Hit_ID=Q7Y1B9; Match level="QueryCoverage=97%, HitCoverage=96%, E-value=0.0, Identity=70%"; Hit description =Ammonium transporter
  Pfam annotation: Domain name=Ammonium_transp; Domain location=44-490; Score=578.1; E_value=8.5e-171; Accession=PF00909.11; Description =Ammonium Transporter Family
  Pfam annotation: Domain name=MFS_1; Domain location=48-413; Score= -52.8; E_value=0.082; Accession=PF07690.6; Description=Major Facilitator Superfamily
  Pfam module annotation: Pfam domain module=Ammonium_transp::MFS_1; Domain location=44-490::48-413
MASLSCSANDLAPLINDTAAANYLCAQFDSISRKLVETTYAVDNTYLLFSAYLVFAMQLGFAMLCAGSVRAKNTMNIMLTNVLDAVAGGLSYYLFGFAFAFGGPSNGFIGRPNFRLRDYPMGSSISSFFLYQLVLAIADAGITISPFGDYSFFLYQWAFAIAAAGITSGSIAERTQFVAYLIYSSFLTGFVYPIVSHWFWSSDGWASATRSHGNVLFGSGVIDFAGSGVVHMVGGIAGLWGALIEGPRIGRFDRSGRSVALRGHSASLVVLGTFLLWFGWYGFNPGSFVTIDKGYESGGYYGQWSAIGRTAVTTTLAGSTAALTTLFSKRLLVGHWNVIDVCNGLLGGFAAITSGCAVVEPWAAIVCGFVAAWVLIWLNKLAAKVEYDDPLEAAQLHGGCGAWGVFFTGLFAKKVYVEEIYGVGRPFGALMGGGGRLLAAQVIQILVVCGWVTATMAPLFYGLHKMKLLRISRDDETAGMDLTRHGGFAYAYHDDEDGSSRGVGFMMLRIEPAGTSPSPPAAPQV

SEQ ID NO: 226031 - protein, 141 aa, Glycine max
  Coding DNA Sequence Number=SeqID_109253
MKLTAMRNHREPPRNLTAARHDKDGDPALAPLRPPSCATDVRHQQHGEMGQPWKFNLRKHRRSLRFWGWEEQQTKKPESVVCTKPYLVAQVTWLEDRPSPSTVNGDGTVYMASADGRIKVWRTEGEAKGHKFDGGGGAVGR

SEQ ID NO: 226032 - protein, 101 aa, Glycine max
  Coding DNA Sequence Number=SeqID_109254
MAEQPHSTAVIPPPSASLPEESLPGSSQTPLRSGRGGWSIRDGSAAIFRDDTCSCFVVVFSLWFFVSMTMILGVYGSMTVVLGPKSSTVFQPSPVFVQSVK

SEQ ID NO: 226033 - protein, 140 aa, Glycine max
  Coding DNA Sequence Number=SeqID_109255
  Homolog annotation: Hit_ID=Q9SZ28; Match level="QueryCoverage=46%, HitCoverage=42%, E-value=7e-15, Identity=49%"; Hit description=STIG1 like protein
MANTILNLTTIIILLISLALHNSHFVVSSTDIDQDHDFNEEEEEEYVLDTPIPHLGPRSRGETFFSAARSIAAMFLVTRTTAVCVATSASKEKDAAMGFVPMFYPMCATVASATSSVHLEIHVGMEFVAMHETDVRKLLK

SEQ ID NO: 226034 - protein, 192 aa, Glycine max
  Coding DNA Sequence Number=SeqID_109256
  Homolog annotation: Hit_ID=Q4VZ79; Match level="QueryCoverage=39%, HitCoverage=15%, E-value=1e-20, Identity=64%"; Hit description =Glycosyltransferase
RIPGLPPSRSIEHQVDLLPKASLPNRPTYNSKPQETQHKDAHAKVEYVKRLYDQVKVRIAKKNESYAKQANKKRKEVVLEPDDDPVHLRANVFQEGGNDENPETGQMQAKGPSGEGWVIDPPLDITIPSKHTPWPDAPPQLPINEKELIATQERTTKHSTKTKISRSRCSRSKRKHDTKVIGVQVSTHSEQN

SEQ ID NO: 226035 - protein, 91 aa, Glycine max
  Coding DNA Sequence Number=SeqID_109257
MTEVSHGLSATVCTQQRRALRVKMKVQQWCLVCLQSRKREGEEEDDLFVFGWWVAPNCTCPTIQSCLTNSDTPNTHHVAHESCLNLYSVQF

SEQ ID NO: 226036 - protein, 88 aa, Glycine max
  Coding DNA Sequence Number=SeqID_109258
MEMNWGLKIAEAAGTCPVCRRNMKKLMVSAGEGRIDHCRNTWEGVFPSKEGRRGEAKRDIIVWFGSRKREKRGKGHLVWLVRREEKYG

SEQ ID NO: 226037 - protein, 371 aa, Glycine max
  Coding DNA Sequence Number=SeqID_109259
  Homolog annotation: Hit_ID=Q69IX0; Match level="QueryCoverage=26%, HitCoverage=60%, E-value=2e-23, Identity=66%"; Hit description =Putative AtRer1A
MDQAIQNHESMTIIMPNEDVSLPVFQMKTNTGTSNALKKVITKAMQNAFVIEYLHEPELELGEAANEGTKFVGSGGGEGRTKRRRSLAPSTRAARTKAQPPRTPATGVPRAASIYPAGAGTAATPQTSTATWWLSVTMLRLLRQYPSSVGPALNIWLRVWAQEKENCVEFLGENKGEHLVTQLPPKPTEVVGGEGAMRVVDISFMFGHKKENCVEFLGENKGEHLVTQLPPKPTEVVGGEGAMRVIDISLMGGDYGPWLTVKRNSRKKRVNGGTGKELGNGGKDKEVHDKEAEVVVVGSTKHAEKEHMNKPLVVKLITGSSTHEKGFKKDATPTIKYREKAKEALETHIEPKITRVLAEKEIFWYQKSKAK

SEQ ID NO: 226038 - protein, 239 aa, Glycine max
  Coding DNA Sequence Number=SeqID_109260
  Gene Ontology: Mol. function=molecular_function; Cellular component =integral to membrane; Biological process=retrograde vesicle-mediated transport, Golgi to ER
  Homolog annotation: Hit_ID=Q69IX0; Match level="QueryCoverage=57%, HitCoverage=69%, E-value=2e-19, Identity=39%"; Hit description =Putative AtRer1A
  Pfam annotation: Domain name=Rer1; Domain location=3-162; Score =127.4; E_value=4e-35; Accession=PF03248.4; Description=Rer1 family
MMDTGGGGGASSPTATMSRWKFAAWRQFQHLLDKSTPHVGRRWLGFAAVALLYALRVYLVQGFYVVSYGLGIYILNLLIGFLSPQVDPETVILDADVPTLPSTASDEFRPFVRRLPEFKFCQDVEVCGLSALPLWPDLATIFCVVLRIVMKWHVCLQPQQFKTLVFCMIIAGAYLALTVQSRKGRLRCGQIAKFHSHCKLKYRHNMNSKVHLARLAKNDKRAHAAMTTLTAIVAEVAIC

SEQ ID NO: 226039 - protein, 187 aa, Glycine max
  Coding DNA Sequence Number=SeqID_109261
  Gene Ontology: Mol. function=protein dimerization activity
  Homolog annotation: Hit_ID=Q9ZWT4; Match level="QueryCoverage=98%, HitCoverage=23%, E-value=6e-54, Identity=58%"; Hit description =Transposase
MEIVLRFVDKDGHVQKRFFDLIHVVDASSLTLKKEISSVLSRHCLDIQNICGQGHDGASNMCGEWNGLQALFLKDCPYIQCLAHCLQLALVAAAREVSHVHQLFSSLSLFVNVVAASTKWHDQLQAPHATIIANLIASDDIETGSGLNQIGTLQRTIDTQWGSHLNSVQSLLMLLVKFFKMLVKMIY

SEQ ID NO: 226040 - protein, 84 aa, Glycine max
  Coding DNA Sequence Number=SeqID_109262
MQTLGCYALFFSSPTTRNHLSSKDNNSKEEEHLREESMEDEVFNVESHKKLLEHQLGFLRERLRQFINDQEIQQLQEEQELILG

SEQ ID NO: 226041 - protein, 131 aa, Glycine max
  Coding DNA Sequence Number=SeqID_109263
MKVMPSNVCKMLLISTLVVSVLENYINIIFQAWTTSQAEALHVLIKKFVGSRQMEYDFNSSYGNPMLVTSFPQLERSVAKFYTKEIFALFMKVLFRASWFRVINFRHTLGYTIYKVMKYKVIGKAFIISSP

SEQ ID NO: 226042 - protein, 92 aa, Glycine max
  Coding DNA Sequence Number=SeqID_109264
  Subcellular localization annotation: CTP_CleavageSite=62; ConfidenceScore=5.12e-01
VIGMRNMSRLHSGVDMSSYMSQGHSSTDMSSYTFRVHNGIHISRRWVRFEFLLKSERELSSEGMTRSEYEAAVDGGGDGRFITAGGVSNGQN

SEQ ID NO: 226043 - protein, 250 aa, Glycine max
  Coding DNA Sequence Number=SeqID_109265
  Gene Ontology: Mol. function=DNA binding; Biological process =regulation of transcription
  Homolog annotation: Hit_ID=Q69V46; Match level="QueryCoverage=84%, HitCoverage=59%, E-value=2e-19, Identity=30%"; Hit description =Putative transfactor
MGSKQRLRGSATAKERLRWTQELHDRFVEAVNRLGGPEICLKHRENGQHQKDIEKYNPAILLCANNPALDSYINSMGIKNKYRISKLIPESPTRGKLEKRSMSDILPNFSSITALQLKEVLQMQTGMQNRLRDKTEVQRSLKLKIEAQGKYFERIGQSNHSKTIIGKACKPFASTIASLPSLFEESESLKTQPEEEHQSAKKQKISGEGVFPTSFDHESSTPPECYNETWDFSWSQLAAACQSPLVPSFL

SEQ ID NO: 226044 - protein, 70 aa, Glycine max
  Coding DNA Sequence Number=SeqID_109266
MIIKKDFMVRQKVLLYNSRLGLMSVEIKSDSTNKSFKVNRHRLKPFLTNLSLVDAMVEETSLLHPTFPPP

SEQ ID NO: 226045 - protein, 160 aa, Glycine max
  Coding DNA Sequence Number=SeqID_109267
MKDKRDEEEKLEKQKKKKDSKALSSKAKGKEKKKRIPPRRLETSHSTGIPHELEVIPQVKEVLDEGFVRKSLTPCALLVPKIAPLIELVRNHVPLWENAQERGFQTLPYYNMPNTTNIYIIILFTGVEGRISEFQEPLHLRSNPFQGEGNDAILPPKGIG

SEQ ID NO: 226046 - protein, 154 aa, Glycine max
  Coding DNA Sequence Number=SeqID_109268
MVSRGIIPFDKHIAAVGTTSNNMLSKRKTLDEGSVLSSKSKTRHEHRFTSTPYVPLDPGIGPLFNSTPNSLKTVPSGVANCRNLPFGGRATRGLTGASSMGGKCAESPPTFIRGKRRKNRKGEMREVVAAQLAQASWVASTRKHHLLLEHPRRS

SEQ ID NO: 226047 - protein, 564 aa, Glycine max
  Coding DNA Sequence Number=SeqID_109269
  Gene Ontology: Mol. function=protein binding; Cellular component =nucleus; Biological process=ubiquitin cycle
  Homolog annotation: Hit_ID=Q84QE1; Match level="QueryCoverage=78%, HitCoverage=80%, E-value=1e-151, Identity=60%"; Hit description =Avr9/Cf-9 rapidly elicited protein 189
  Pfam annotation: Domain name=F-box; Domain location=29-75; Score =25.7; E_value=0.00017; Accession=PF00646.23; Description=F-box domain
MGQAPSTPVSSTDLSHRDIFTTDESIGRDYTADIPDECLAGIFQFLSSVDRKTCSAVCRRWLRVDGENRQRLSLNAKASLVDFVPSLFSRFDSVTKLALRCDRKSTSVNDDALVLISLRCRNLVRLKLRGCREVTEHGMADVAKNCTNLKKLSCGSCAFGAKGVYAFVNNSIVLEEVSIKRLRGVEKDNNDGVDGAESLPLSVTSSSLRSICLKELVNGHCFAPLIVNSKKLETLKLIRCLGDWDVTLESVGKLNSGLVEIHLEKVQVSDVGLLGVSKCLKLESLHLVKTPECSDVGLCEVAERCKMLKKLHIDGWRTNRIGDCGLMSVAKHCPNLQELVLIAMYPTSLSLAAIVSGCQGLERFALCGICTVGDAEIESIVAKCGALRKLCIKGCPVSNAGIAALASGCPNLVKLKVRKCRRVNGEVVEWLRERRSSLVFSIDYSTEVEALDGSGSDVGAQESSMASPPIDTTQVSMVDDPPSSSNNSSSNNNNNRLSMFRNKFGFLAVTTERNSLDPAAAPFAKNPRDIEGLTEGASIIEVVKKIRSHVLLGLSGVGGIFNEE

SEQ ID NO: 226048 - protein, 142 aa, Glycine max
  Coding DNA Sequence Number=SeqID_109270
  Gene Ontology: Mol. function=phosphoprotein phosphatase activity
  Homolog annotation: Hit_ID=Q8ZNY9; Match level="QueryCoverage=97%, HitCoverage=62%, E-value=1e-43, Identity=61%"; Hit description =Serine/threonine-protein phosphatase 1
MALDARASGEMALWTMNGGDWYQTASQEQKRLADLLFIRCLELPLIIELRCQDDTTHVIAHADYPASVYRWQLPVAEHQVLWSRQRLTDHLAGRHGEIAGADHFWFGHTPLKHRYDSDNQHYIDTGAVFGGELTLVQLQSAV

SEQ ID NO: 226049 - protein, 83 aa, Glycine max
  Coding DNA Sequence Number=SeqID_109271
MTRYDIVTDNSLHSSCTLQQRSNLIADLVMGRITPAPIWQKRNYRLKFLLRTALFYQPTREMLDTLSARGDFRQLLAAQATLP

SEQ ID NO: 226050 - protein, 495 aa, Glycine max
  Coding DNA Sequence Number=SeqID_109272
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=98%, E-value=1e-38, Identity=26%"; Hit description =UPI00006A17C9 related cluster
  Subcellular localization annotation: CTP_CleavageSite=34; ConfidenceScore=5.06e-01
GLHALASPTEDSTSSPSVDYMSSPSQGLHALTFRGQHVLAFRGLHVLALRGLHPLTVIRVHQIFAIRGLHVLAFRGLHDDTSSPSEDNTPLPSDGRTSSPFEDYTGLHIVAFRGLQVFTFRGLQALTFRGQHILTFRGLDFLAFRGLHALASTTKDSTTTHPRLQMATHPHHQRATYPRLAFGGEYILAIRGLHVLAFRGLQVLAFRGLHVPAFRGLYVPALRGLQILAFRVPHVLALRGLHVLAFKGLHVLAFRGLQALAFKELHALTIRRLPALTMLSEDNTSSPSEDYTSKPLVELHVVAFRGLHVLAFRGLHVIAFRGLHVLSFRGLHILAVIGLHVLAFKGLHVLAFRGLHVIAFIGLHALAFIGLHVLAFRGLHVLAFRGLHVLSFRGLHVLAFRWLHAFTFRAQQILTFRGPDVLAFRGLHALARLQRTTRSRIQRTTHPRLQMATRPHHQKATRPRLAFRGQHILAFRGLHVLAFRGLHVPAFRELH

SEQ ID NO: 226051 - protein, 294 aa, Glycine max
  Coding DNA Sequence Number=SeqID_109273
  Gene Ontology: Mol. function=nucleoside-triphosphatase activity; Cellular component=membrane; Biological process=carbohydrate transport
  Homolog annotation: Hit_ID=Q6D3M5; Match level="QueryCoverage=100%, HitCoverage=89%, E-value=1e-107, Identity=51%"; Hit description=ABC transporter, ATP-binding protein
MRRTRRPGLPAQFAALKLHGAGAEQRFAQLGFAGSRQPGDAENFALMQPQRNVAQLVAIAQALHLQQRSLGVRRARRRENIVQPVAEHLLDDLFAAQPAHGVFADATAVAQHRQPIANVAQFVDAVGNKYDADAFGLQAANHVKQALALGAIERGGRFVEHQKTAAVRQRARQQHLLFFRQRAVRQPPARVERQRPLLQQLRGAAVQLRPVQPVARFVQPVQHDVFRHRQRGDQRDVDLLLHHVNTVAARLQRGVDRHRLAVDQDLAAIMIVGAGEDRHQRRLARAVGADQRVD

SEQ ID NO: 226052 - protein, 104 aa, Glycine max
  Coding DNA Sequence Number=SeqID_109274
MASMMDAMLRMRQLMENNAATVAAVSSAVDADPTLPATAHHPIPNVSDEVHEDRREHAHGDIDSYSPVLVKGPTPNTPPQPNLTGEPQNLLAQPIFLSAEGPPP

SEQ ID NO: 226053 - protein, 76 aa, Glycine max
  Coding DNA Sequence Number=SeqID_109275
MHMKAEIRKNKTERDAGEASYPTSADRVCKKDCNECQVQIVGKKARTPAVRHFMVQWFFHVPYLDVDDWGRTFACV

SEQ ID NO: 226054 - protein, 70 aa, Glycine max
  Coding DNA Sequence Number=SeqID_109276
MASSIFIQTHIVDAAARRACNRVTRGGVVGWQQSHHVKVAAATTLRACEWRQSQCVKVAMLFTEVPLGRG

SEQ ID NO: 226055 - protein, 294 aa, Glycine max
  Coding DNA Sequence Number=SeqID_109277
  Gene Ontology: Mol. function=methyltransferase activity; Biological process=metabolic process
  Homolog annotation: Hit_ID=Q1SBM2; Match level="QueryCoverage=55%, HitCoverage=38%, E-value=7e-42, Identity=51%"; Hit description =Putative methyltransferase, putative
MSRPLHRGVSIRIPDSNNNDLWDSQSKDKSEKEGLDRRGSSGHPSPLRSPFRLLFSDNSNSKYGISENGFSSDPFIIGTPRSRLKLVLLFLRFSLVFIVILALAGSFWWTISISTASRGHIYHGYRRLQEKLVSDLLDIGEISYAPSRLKELEFCSEEFENYVPCFNVSDNLALGFSDGNEFDRQCRHELRQNCLVLSPPNYKIPLRWPTGRDIIWIANTKITAQEVLSSGSFTKRMMMLDEEQISFRSASLMFDGVEDYSHQIAEMIGLRNESSFIQAGISSLNYLEGIFFEQ

SEQ ID NO: 226056 - protein, 871 aa, Glycine max
  Coding DNA Sequence Number=SeqID_109278
  Homolog annotation: Hit_ID=Q0IEN4; Match level="QueryCoverage=47%, HitCoverage=46%, E-value=2e-35, Identity=27%"; Hit description =Breast carcinoma amplified sequence
MWLMCLQLQSWTPQNLDGCGRNCDIEPIFENLDIMCDLAIRMSLLRHVSLLSECACLVIWAGFDKLEGEGEVIQQVLLLGYRSGFQVWHVDESNNVRDLISRHDGPVSFMQMVPNPIASKRSQDKYANSRHLLVVCTDGFFAGGNNVQGGSTIPYNGSTSNSHDQINGNYLPTTVRFYSMKSQSYVHVLKFRSVIYSVRCSSRVVAVSQSTQIHCFDATTLEREYTLLTNPIVMSCPGSGGIGYGPLAVGPRWLAYSGSPIAISNSGHVCPQQLTPSARFPGFSSNGRLIAHYAKESSKHLASGIVTLGDMGYKKLSRYCSDSNGSLQSVNSGSKGNGTVNGHSTDADNIGMVIVKDIVSKDVIAQFLAHKSPISALCFDPSGTILVTASIQGHNINVFKIMPASGTLSASVVGRSYVHLYRLQRGFTNAVIQDISFSDDSKWIMISSSRGTSHLFAINPQGGHVNIQPFDDSFTAKNSGLGTTTNHAVCQSHSSAMQMPKQQSLFATGPPITLSVVSRIRNGANGWRGTVSGAAAAATGRKNALSGAIASSFCNYKGNEGNFSKAKYQLLVFSPTGSMVQYALRTITGQDSAVVSGLSPAYESIPQADTRLVVEAIHKWNICHIRREREDNVDIYGENGISDVNKIYPEEVREKIDTISPKIKNGVMKVNPCLEEEHHLYISEAELQMHQAQTPLWAKPEIYFHSMLQESTIMDEEAAASGGEFEIERIPTCMIEARSKDLVPIFDYIQTPKVQQTRIPAMDGKTNEQLLHYSSSQVAGNGRISPRTILESPECVTNAGDAVSEFRSGIEGTEWDNHVVPSETVNFVNNNDTFRQNTQHEIVNNRMEHLNTGAHLMYVNSDGKPENEESF

SEQ ID NO: 226057 - protein, 206 aa, Glycine max
  Coding DNA Sequence Number=SeqID_109279
  Gene Ontology: Mol. function=chitin binding; Cellular component =extracellular region; Biological process=chitin metabolic process
  Homolog annotation: Hit_ID=UPI000044A8F0; Match level="QueryCoverage =84%, HitCoverage=99%, E-value=4e-19, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDTSEPYTGAMGGTVHEPQVLVPIFFRVLRVLAIRGLHVLAFRGLHVLTVRGLQVLTIRGLHVLTFRGLHVLAVRGLQVLIIRGLHVLTFRGLYVLTFRGLHILAFRGLHVLAFRGIRALAFEGLHTLILRGLHVLTFRGLHILAFRGLHALTFRGLHSLAFRGLYVLSFRRLYVLTFRGLHVLTFRGLHSLAIRGLHALSIRGLH

SEQ ID NO: 226058 - protein, 675 aa, Glycine max
  Coding DNA Sequence Number=SeqID_109280
  Gene Ontology: Mol. function=zinc ion binding; Cellular component =cellulose and pectin-containing cell wall
  Homolog annotation: Hit_ID=Q6Z692; Match level="QueryCoverage=52%, HitCoverage=54%, E-value=1e-141, Identity=65%"; Hit description =Putative early-responsive to dehydration stress protein
  Pfam annotation: Domain name=DUF248; Domain location=1-387; Score =207.1; E_value=4e-59; Accession=PF03141.7; Description=Putative methyltransferase
  Pfam annotation: Domain name=DUF860; Domain location=339-664; Score =385.3; E_value=9.4e-113; Accession=PF05898.4; Description=Plant specific of unknown function (DUF860)
  Pfam annotation: Domain name=Methyltransf_11; Domain location=5-100; Score=10.4; E_value=0.0052; Accession=PF08241.2; Description =Methyltransferase domain
  Pfam annotation: Domain name=Methyltransf_12; Domain location=5-98; Score=9.3; E_value=0.064; Accession=PF08242.2; Description =Methyltransferase domain
  Pfam module annotation: Pfam domain module=DUF248::DUF860::Methyltrans f_11::Methyltransf_12; Domain location=1-387::339-664::5-100::5-98
VRTILDIGCGYGSFGAHLFQSQLLTMCIASYEPSGSQVQLTLERGLPAMVASFTSKQLPYPSLSFDMLHCARCGIDWDRKDGILMIEADRLLRPGGYFVWTSPLTNARDKDSQKRWKIIQSFAENLCWDMLSQQDETVVWKKTIKRNCYSSRKNSSPPPLCGKGYDVESPYYRELQNCIGGTHSSRWISVKERQTWPSRDHLNKKELAIFGLQSDEFAEDSESWKAAVRNYWSLLSPLIFSDHPKRPGDEDPPPPYNMLRNVLDMNAHVGGFNSALLQAGKSLWVMNVVPLSGLNYLPLIQDRGYVGVLHDWCEAFPTYPRTYDLVHAAGLLSLEFAQQRRCTMLDMFIEIDRLLRPEFLSAQPEHVLRLDDAGKLHRELGFPRGRKVSRFIQRHPLLFQTYRHTDAKTWLGFTDLMDDLLAEERSLMDTLELNRVEKVRKLLMMSSRNRIPLSKIHHCRTLFGIPDDFRDRVSKYPNFFRIVVENDGRRVLELVNWDPLLAVSALEKEFVVDEDSAKRKFRFPVKYGKDLDLELDDSRKLNLLNALPLVSPYSDGSKIDGWTLEAEKYRVGVIHEFLSLTLEKRASIHHLVEFKEEFSLTKHTYQMLRKQPQVFYLAGTEMNWGVFLKDAYDGNGDLIEKDPQAVFNEKLYKYAQVDQMEPGCDDDGVEVQHLT

SEQ ID NO: 226059 - protein, 701 aa, Glycine max
  Coding DNA Sequence Number=SeqID_109281
  Gene Ontology: Mol. function=protein binding
  Homolog annotation: Hit_ID=Q7XAK8; Match level="QueryCoverage=40%, HitCoverage=35%, E-value=3e-61, Identity=46%"; Hit description =Protein phosphatase regulatory subunit-like protein
  Pfam annotation: Domain name=LRR_1; Domain location=481-499; Score =6.8; E_value=15; Accession=PF00560.23; Description=Leucine Rich Repeat
  Pfam annotation: Domain name=LRR_1; Domain location=503-523; Score =13.0; E_value=1; Accession=PF00560.23; Description=Leucine Rich Repeat
  Pfam annotation: Domain name=LRR_1; Domain location=525-546; Score =17.5; E_value=0.049; Accession=PF00560.23; Description=Leucine Rich Repeat
  Pfam annotation: Domain name=LRR_1; Domain location=548-568; Score =8.2; E_value=8.3; Accession=PF00560.23; Description=Leucine Rich Repeat
  Pfam annotation: Domain name=LRR_1; Domain location=570-590; Score =10.8; E_value=2.7; Accession=PF00560.23; Description=Leucine Rich Repeat
  Pfam annotation: Domain name=LRR_1; Domain location=596-619; Score =6.6; E_value=17; Accession=PF00560.23; Description=Leucine Rich Repeat
  Pfam module annotation: Pfam domain module=LRR_1::LRR_1::LRR_1::LRR _1::LRR_1::LRR_1; Domain location=481-499::503-523::525-546::548 -568::570-590::596-619
MTETNIRGALKSCGVDIYNNSGQLSSHIFPNCSRCLSFLTGKREKNKGTEQSSTGDLNTQLGEVLHPKISSESRDLKPATVDVTVPSGVQKNSRGNVRVMSLESPVKTEVEEAYEGEDEHEESPSIKRELSDFDLQVHEAAVIQGRYHPSSEEIKCPSLYEHQANIQLEDRDHKYSKKSDDIIQSGHVSDPGIGKADFCASPKLKRSCSDLERRDVLRKTSHLFPSSKSQSFENLQGLSAYQMVNLESPRSVMTHGSADRVMLKKHSSSQVLPSRSKRLWWKLFLWSHRNIHRMQLGKLKTIHPASAALKSQCGYSSDTLEAKHGKALRHVELPSPSSSYGEYFHNSCDDGNIDKQRWSRFQKENFGFWPQNQWVAFSTESSSFSRVDEWVKDLEIQQPPPEDDFDDDNIGTIAFPPSPDAIPQFIASSSTAQSVRHPDANLSKEILNANSVVQSLNPASTAAHISGIGIKAIPSISHFSTLRSVNLSSNLIVHITPGFLPKGLHTLNLSRNKISTIEGLRELTRLRVLDLSYNRISRIGQGLSNCTLIKELYLAGNKISDVEGLHRLLKLTVLDLSFNKISTTKALGQLVANYNSLQALNLLGNPIQSNISDDQLRKVVCGLLPKLVYLNKQSIKPQRGREILTDSVAKAALGNSSRNSYRRALKKGGGQGGSSSSSVHRSSASVSQKSRNRSRSRTKHH

SEQ ID NO: 226060 - protein, 311 aa, Glycine max
  Coding DNA Sequence Number=SeqID_109282
  Gene Ontology: Mol. function=isomerase activity; Biological process =cell redox homeostasis
  Homolog annotation: Hit_ID=Q5EUC7; Match level="QueryCoverage=92%, HitCoverage=95%, E-value=4e-51, Identity=39%"; Hit description =Adenosine 5'-phosphosulfate reductase 3
  Pfam annotation: Domain name=Thioredoxin; Domain location=109-204; Score=-17.6; E_value=0.0045; Accession=PF00085.10; Description =Thioredoxin
LVPNFVTPSDVKGEGKGMRIWGSEIVFAILLCGTLSCTAQAHHITASTCPARSILDFVLGFSDFTCQLPNSLGSIAVTESQELGVDYVCLPPLFVSPCGADGDEVSLQKVLNMVHKNNHEHVAVLFYASLCPFSQVSRPVFSILSALYPSILHLAIEESSVWPSTLSKYGVHSFPTLYILNSTMRVRYHGSRTLGSLIGFYNDVTGIRIDSLDELSLEEIGRSSADKSHGNSESESSPFSQARSPENLLYQETYLALATTFRLTQSFNRLKEPYKRSNLQEGAMNARAWASKSLATVSIGEESSSSRGTHQ

SEQ ID NO: 226061 - protein, 105 aa, Glycine max
  Coding DNA Sequence Number=SeqID_109283
MAMVPAVEEGKGLGGNPSILHLPQNYATLVAILILDKDGGSVFIESKTTFHVAIILQYFSRYQITKMAHLVGFPNMVHDRSRAFVLEIGTKEMPPQNVVDASKCN

SEQ ID NO: 226062 - protein, 237 aa, Glycine max
  Coding DNA Sequence Number=SeqID_109284
MVVAMLNGTKHKTHLVEESCYSPCRYKCHLGNMFGSSGKIILGDSEVESMVLSEPKSPKDGKAMTIRQQDDDHNRWNNITQRIDGQSNEARPMGSNHWSLSLSQINIVIGQIAAMESNKVESQPRVQQSLTKKHFTQKPAGFNHELDIQKKISRIESEINSLESDGDGRQLDDQEIQLRKKLQEDLWVTATSYESLLRQKARSKWIKEEDCNSKFFHIIVNGNRRYNSLRALHVEKC

SEQ ID NO: 226063 - protein, 904 aa, Glycine max
  Coding DNA Sequence Number=SeqID_109285
  Pfam annotation: Domain name=AT_hook; Domain location=169-181; Score =19.6; E_value=0.0095; Accession=PF02178.9; Description=AT hook motif
MATPEPEPSSDHRIGSLPLVDLRLLSQPELYTLSLSGATHRHRRNSDDDSVIPKIDRSNFNESAGSRKQTYSKLRLNKRKQNPAVPASSSFHIPLHISEPEEEENSRIIALLHQLFGVEPLRNNAPRNNDAPERRLVPVHVEFKQPPPISVALFQNVPIDVVPDGSQRKRKRGRPRKDENSVTVFVEEPTKVTKEENSLTVFVEEPKKVTNEEKSVKVNGNGEGNAAVATATVNESVGLDEDLFEVELKRRAQGLETESQVMEFLETLNGEWASQRKKRRIVPATELGDMLPAGWKIVIIVMRRAGRASAVCRRYAPTAPGCCGAVVTFPVTPKIVNVSVGGRDNPKVVVFGLFEDRSHLKSSYTDGAQQLSSSMNRASESSVGHVPTGDMKTVANASYLSSAGAPIDSSHEKQPLVSSSIGSENFISDLALGCKLGDATGGAFRDFDHQTEDKQLSKADKNDENSVQECSLVEDRACNENSEKLVGVVESSDAACNLYIPLVFSTPFSNNNSDNGQLSDEINASTCMKGGVSNFASHDRNTGCHETVSCGNVRAHVDNNGLGLSVKLVEENIQKPSFESSMLAPNSEGKILAGKNLEDTNHISSLEDTEIRDGKAVKDDKQQIICSRDQTEIKDVSTDVKLQSSSEGCSLVSSHNELNTSKNNMDKTQTSELKDSAEENIFDSDLFSSSIDERTHVHSGYISNVSFSSCTHASEYGGFDFASDLKLAKDVSDNHILSNEEAVTRCLQERSSLNDQNSMMDNMLHRSSESNLFALTGNQHSCAFHDNVNISDGTFDALKAVDAGCMEPQLGIVSCSNIAVDAYTTASIMQGKPQGCVSVPLGGNILNFEKPSDDGVNKANKSCLPETAQNEVEIFQTESMECAGNHKALLVYSQFPIEDDMLEK

SEQ ID NO: 226064 - protein, 135 aa, Glycine max
  Coding DNA Sequence Number=SeqID_109286
MAAFFVVDRFSWWCWWLLRSRGPLLAHDGCVAQLVVVKIESSFNIVDIAQHKINLANVPLANKFLTGFSLKGEIKVWPIGFDKQEVQVVQWRHASLPYLIAMEAFLELQPVNGGIFRHNAICQRTCCWTEGSSVH

SEQ ID NO: 226065 - protein, 223 aa, Glycine max
  Coding DNA Sequence Number=SeqID_109287
MSEAGGVVLLLGFFTPLPPAPVPLPTLGLSQLVWDSVVIESCKAELHKCQTNFQKLRKQNVKLALKNGQMLAELNSSRQKQRELQLEQEAKMLVFTPFLMAPQQFTFFSITARYTFQRQSLGLKAKKLEQQKIPWSWLKSKMIFHIYKKIWPMKIGPTSLGSKVHDEAKEATQSSTPTNIEQVHVKKNIDKKRQSMRRQTNRFRPGDFQDLLLMVPRVIGDPV

SEQ ID NO: 226066 - protein, 81 aa, Glycine max
  Coding DNA Sequence Number=SeqID_109288
MPPPNLLRRFFRDSRRSCQNKLLQACTWTIAEEVLRRPHDKFPLHNIQTWCRSYGLLGGCLNCSIKGGGLVLHQLENKDIA

SEQ ID NO: 226067 - protein, 297 aa, Glycine max
  Coding DNA Sequence Number=SeqID_109289
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9LDA7; Match level="QueryCoverage=92%, HitCoverage=95%, E-value=2e-86, Identity=61%"; Hit description =Protein phosphatase type 2C
  Pfam annotation: Domain name=PP2C; Domain location=48-289; Score =243.0; E_value=6.5e-70; Accession=PF00481.12; Description=Protein phosphatase 2C
MARRTLKGSICMIGAVNDYSISVLVALQLVAARSSSSTGKGKNHEGSIKYGFSLVKGKANHPMEDYHVAKFAQIKDNELGLFAIYDGHLGDRVPAYLQKHLFTNILREEEFWEDPTLSISKAYESTDQEILSHSSDLGRGGSTAVTAILINGRRLWIANVGDSRAVLSRKGQAVQMTTDHEPNKERGSIETRGGFVSNLPGDVPRVNGQLAVSRAFGDRSLKSHLRSDPDVQYTDIDVDTEILILASDGLWKVMTNQEAVDIARRTRDPQKAAKQLTAEALKRDSKDDISCVVVKFR

SEQ ID NO: 226068 - protein, 58 aa, Glycine max
  Coding DNA Sequence Number=SeqID_109290
FANFEGKQHGLSESKYKLNPLSILIGLVVILDTGSGFLFKFELKVSAKWFVLKISCKY

SEQ ID NO: 226069 - protein, 165 aa, Glycine max
  Coding DNA Sequence Number=SeqID_109291
  Gene Ontology: Mol. function=isomerase activity; Biological process =cell redox homeostasis
  Homolog annotation: Hit_ID=Q5EUC7; Match level="QueryCoverage=72%, HitCoverage=37%, E-value=3e-27, Identity=55%"; Hit description =Adenosine 5'-phosphosulfate reductase 3
MAPHLTSPRSPDPRDISPGIMIDSLDQLSLEKISRSSADESHGSTEPESCPFSWARSPENLLRQETYLALATTFVVFRLLYLFFPTLLICIRYAWRRVIQSIRIWCLLEHPLIYLKRLTQSFNCLKVPCKRRNLQEGAMNARAWASKSLATVSIGEESSSRGMHQ

SEQ ID NO: 226070 - protein, 130 aa, Glycine max
  Coding DNA Sequence Number=SeqID_109292
  Gene Ontology: Mol. function=transcription factor binding; Cellular component=intracellular; Biological process=regulation of transcription, DNA-dependent
  Homolog annotation: Hit_ID=Q40569; Match level="QueryCoverage=96%, HitCoverage=62%, E-value=2e-49, Identity=74%"; Hit description=Ras -related GTP-binding protein
  Pfam annotation: Domain name=Arf; Domain location=1-127; Score= -102.3; E_value=0.072; Accession=PF00025.11; Description=ADP -ribosylation factor family
  Pfam annotation: Domain name=Miro; Domain location=3-82; Score=-9.7; E_value=0.048; Accession=PF08477.3; Description=Miro-like protein
  Pfam annotation: Domain name=Ras; Domain location=3-129; Score=147.4; E_value=3.9e-41; Accession=PF00071.12; Description=Ras family
  Pfam module annotation: Pfam domain module=Arf::Miro::Ras; Domain location=1-127::3-82::3-129
MLKFALLKRMGRQLNYRLYWDTAGQERFRTITSSYYREAHGIIIVYDVIDEDRFNNVKQWLSEIDRYASDNVNKLLVGNKSDMTTNRVVSYDTAKEFADQIGIPFMETSAKDATNVEDAFMAMSTAIKNS

SEQ ID NO: 226071 - protein, 98 aa, Glycine max
  Coding DNA Sequence Number=SeqID_109293
MPYADLPPYMLDNAMTIISPTKISQPMFPKGYNPNVTCAYHGGVSGHYIEHCMTLKHKFLSFFLPTRSGQKLAIDTSEPYTGAMRGTMYELQANLGAD

SEQ ID NO: 226072 - protein, 92 aa, Glycine max
  Coding DNA Sequence Number=SeqID_109294
MWHDVEFGAMSRFVAHNNVCGGGGGGRGRSGSFGVVWRHWVMVFGCDNGCWWSRGGRLPWRFVREEARILLGRRIKRDIRKFGSAPSKNRMR

SEQ ID NO: 226073 - protein, 108 aa, Glycine max
  Coding DNA Sequence Number=SeqID_109295
MRNCPTCGVSRYKVKYDECSDDVATNSDRPAKDPRNLRVVLASNGINPFGKKGWFEMSSRFGRHGYMAAVARTNPFCVINRHRSMIMIVQCKEDFMVLMIWILVVRVV

SEQ ID NO: 226074 - protein, 150 aa, Glycine max
  Coding DNA Sequence Number=SeqID_109296
MGSYWNNNGDPCDGDDLGAVPPFWATIHPPFHMTPEDKIFYRNDTANFPYLAYHYYCVPDNAKHLEQPVSTCDPNNNPKAQEIVQLLSDPIWDACDYPTKKGDGCGLGIQGFGNLMLVECLDPGTPPAKRIWTSIDTQTEIFVSAQDEVA

SEQ ID NO: 226075 - protein, 141 aa, Glycine max
  Coding DNA Sequence Number=SeqID_109297
  Gene Ontology: Mol. function=metal ion binding; Biological process =metal ion transport
  Homolog annotation: Hit_ID=Q1SBG7; Match level="QueryCoverage=62%, HitCoverage=40%, E-value=2e-20, Identity=57%"; Hit description=Heavy metal-associated domain, putative
MKLYLNSDHGYILSKYLFVQQKIVLQMQLDSDKSRSKALKIAAQEIGVSSVALEGDNKDKLTVTGDVDAVHLGRVLRKKFQCVTLVSVEEVKKKDDNKCKIEIEDDKGCYYYTPYCAPPPCGPSPYCHPVYDSYDSTCSIM

SEQ ID NO: 226076 - protein, 141 aa, Glycine max
  Coding DNA Sequence Number=SeqID_109298
MQHKLVGIYRIMKLPLLTLHSEITIEYAQLPTSQKTSLLGRMNIVKHAKNDTLLWHMASRHFTAFPISHSPSRGILRVPIALPSPLPSKRDSASIQTRSSFSMEWNTGERNKRGDMEKRKRREEKEERGTDTRRNECEGKE

SEQ ID NO: 226077 - protein, 105 aa, Glycine max
  Coding DNA Sequence Number=SeqID_109299
  Gene Ontology: Mol. function=RNA-directed DNA polymerase activity; Biological process=RNA-dependent DNA replication
  Homolog annotation: Hit_ID=Q1SD42; Match level="QueryCoverage=83%, HitCoverage=14%, E-value=4e-12, Identity=36%"; Hit description=RNA -directed DNA polymerase
MAFSTSGPISLGRGLRQGNPLLSYLFIIYTESLSCLLKKYESKGELHGIKDSTQAINFNKLEVFFSTNTLSSTKAQISSSLGVIECIGIGKYLARMEAHLEANDL

SEQ ID NO: 226078 - protein, 254 aa, Glycine max
  Coding DNA Sequence Number=SeqID_109300
  Gene Ontology: Mol. function=RNA-directed DNA polymerase activity; Cellular component=extracellular region; Biological process=RNA -dependent DNA replication
MTESGNLLQMDFILFRSVYHNIMDSLLVNDNYKIDANWKKLWSLQTPPKVKHLLWRILRQCLPSRQRLCTKGAHCPATCAFWETNLENDWHVFFGCEKAILVWQQAGLWSTISSNVHQAEGITYFLSNLRNSIASESLCSKISIILWSLWRQRNDKVSNNLEMLPNIADNQAFQFLSEWQQALSRNNNLIQLHDHEPAQVWQKPEPGKVKCNIGNCNFQRASEFCYWHLHETTTANSWQPKHRGSEAFQKQQEA

SEQ ID NO: 226079 - protein, 727 aa, Glycine max
  Coding DNA Sequence Number=SeqID_109301
  Gene Ontology: Mol. function=sequence-specific DNA binding; Cellular component=nucleus; Biological process=regulation of transcription, DNA-dependent
  Homolog annotation: Hit_ID=Q2PF41; Match level="QueryCoverage=99%, HitCoverage=100%, E-value=1e-127, Identity=42%"; Hit description =BEL1-like homeodomain transcription factor
  Pfam annotation: Domain name=POX; Domain location=234-377; Score =247.5; E_value=2.8e-71; Accession=PF07526.2; Description=Associated with HOX
MATYFHGSTSEIPSSAEGLQTLYLMNPNYVPYSDAAQHPTQNMLLVNPNNNNTSNTSPTSTNALNLGNFSHAPPPPSPNNNNNHREQQQHHLIGVTIPSSNILGSNAAATDPARSSFLGQHEFSSFHGGAAATSTVTASRGNYNLWGSIIDQSALNIMAATTHTPSSNMGCVASSVMSTQIGFHRPNHLSLSLSSQQTPYRSLSGEIHAISPASRGGGGDDMRGLHNGVSSMHSVALGSKYLKATQELLDEVVNVGKGISKGEESMEGAKKEKMKGNIESTSGVGDGSSCGRENNDRAKQGVELSTAQRQELQMKKSKLVTMLDEVEQRYRQYHHQMQVVLTSFEQAAGVGAAKSYTALALKTISKQFRCLKDAISSQIKTTSKTLGEDNCLGVKVEGSRLRYVDHQQRQQRALQLGMIQHNAWRPQRGLPERAVSVLRAWLFEHFLHPYPKDSDKVMLAKQTGLTRSQPMVEEMYLEEVKQEPNNSSQDNNNTKGSNESSKELWSEANAAAQESGAMRFDQINILQSKAESFKNNQTTSPTEISNSNSLQSGFHLADMQSPNKPKSTSEMHQNSPGSILSVDMEMKPHHHGETNNITREGQNNNTTTKFGIESHGGGFGAFPNMEDIGRFHHHVTEQLAPRFHGNGVSLTLGLPHSTENNLSLSGTTQHGFLSQNMHLGMRNSENDEFCGAINTTPPSSHSGISYESIDIQNRKRFAAQLLRDFVA

SEQ ID NO: 226080 - protein, 175 aa, Glycine max
  Coding DNA Sequence Number=SeqID_109302
  Gene Ontology: Mol. function=DNA binding; Biological process=DNA integration
  Homolog annotation: Hit_ID=Q1SDG1; Match level="QueryCoverage=52%, HitCoverage=7%, E-value=8e-30, Identity=64%"; Hit description =Integrase, catalytic region; Zinc finger, CCHC-type
  Pfam annotation: Domain name=rve; Domain location=1-131; Score=58.1; E_value=2.8e-14; Accession=PF00665.16; Description=Integrase core domain
MRLGGNYYSLVIVDDYSRFTWTLFLKTKNEAFDVFRKLTKVIQNEKGLNIFSISSDHGGEFQNESYENFCEENGIHHKFSTPRTPQQNGVVERKIDLLKKGTSFVVQVEGTSTWVVVTENKRGYISCGSVQVKGTSTWLFKENKGGYIPCGSLLVKDFTRLKRNLKDRMSLRNWM

SEQ ID NO: 226081 - protein, 304 aa, Glycine max
  Coding DNA Sequence Number=SeqID_109303
MDRARLVYRLVTGMDMNIRALISGQISTIAQSNSSRLGFPTLITAICRARGVISDILTYESLSPTINLAYIKKNCWNVDDLTVNFRGARKVVAPPGSIMSVEQFIEKVSWPGTLPSVVREGEGPSAQVPQQVQDASFEATIPRDFDFSGAGVEMRPDEDVLPEPIVPVIHETVEADPPTPVHERQVDPPTPIMEMPEDPTTPLNKQVCGSADFEPLAKPIIWFSEPSAKHRSSWLRRESSLKRKLSCKALDEILSDCEVSRASLLWRAKSSIGSSYGVLDMHAQLGSFNIGKCLVQQEGSEDDA

SEQ ID NO: 226082 - protein, 174 aa, Glycine max
  Coding DNA Sequence Number=SeqID_109304
MSPIQSQDSSNVLNVVFKFGIIKAKKEEIVRDRGSNMSKTEKADQATTIATKAAGGLTTPVTPPLNVVSMMEKTHISKKRAWTKANDETYIQVDFEDLDARSGTILQMQLATTIDKVEEVKAKVIVANTELVVQFVEGFNSTMEQVKVLADDMDYGVVNPFKEVVNRDIVEVVD

SEQ ID NO: 226083 - protein, 71 aa, Glycine max
  Coding DNA Sequence Number=SeqID_109305
MVGAFSQNIMTLTGLPMILLSESDLTNPLCGVSCYVLLSAPGWFFTDMMNRWMTMKNLMLEDTGTPRSDRM

SEQ ID NO: 226084 - protein, 38 aa, Glycine max
  Coding DNA Sequence Number=SeqID_109306
MARSSLCSISVPFLIDLLIIAFTFLAHLTPISAVHVGV

SEQ ID NO: 226085 - protein, 70 aa, Glycine max
  Coding DNA Sequence Number=SeqID_109307
AVEVVTCEEEGGVMVEPQYPRDTNDDIINGKVKVFVGASALEGCMCLKFPCARKEFSCSSTMLWYLEKGG

SEQ ID NO: 226086 - protein, 125 aa, Glycine max
  Coding DNA Sequence Number=SeqID_109308
  Gene Ontology: Mol. function=transferase activity
  Homolog annotation: Hit_ID=Q6EP89; Match level="QueryCoverage=60%, HitCoverage=16%, E-value=2e-10, Identity=54%"; Hit description =Membrane bound O-acyl transferase-like
MIEEHGDIAKEHVDEEVEVGGEAEGEVGEGDANDGGVEVLGEAAGEEAQRKLRGTMAAKQRRKQSMGIETPMEATIESTNFLLFLIMSSSDIFMAVDMFAGSELGFIRIIAMKRGEKRSSGDLFP

SEQ ID NO: 226087 - protein, 627 aa, Glycine max
  Coding DNA Sequence Number=SeqID_109309
  Gene Ontology: Mol. function=transferase activity; Cellular component= nuclear pore; Biological process=DNA integration
  Homolog annotation: Hit_ID=Q1S0E3; Match level="QueryCoverage=70%, HitCoverage=47%, E-value=2e-77, Identity=35%"; Hit description =Peptidase S8 and S53, subtilisin, kexin, sedolisin; Zinc finger, CCHC- type; Peptidase ...
  Homolog annotation: Hit description=aspartic, catalytic; Polynucleotidyl transferase, Ribonuclease H fold
  Pfam annotation: Domain name=rve; Domain location=315-450; Score =101.7; E_value=2.2e-27; Accession=PF00665.16; Description=Integrase core domain
  Pfam module annotation: Pfam domain module=RVT_2::rve; Domain location=551-627::315-450
QRNQQNTLQAVRNAYKDSKKKDAKAIFFLHQSVDDAWDKHEKCYAGGDRIKKVKLQVFQRQFDSMTMEENEKIADFFARVKVVINQMATQELRLLERNKQKIVEHALLAQSSNKNSGNSNKGRSGFRGRVVVGTIEEEVAMFLVVEEARIMLKINLISRREAGAEATIEVVAMVEEEVVEKGDEANLAKCDDEENELVMLMVTTADETCTIDEWYLDTGCSTHMTGHKEWLVNFDSSKKNRIKFADGRAMLAEGVGNVMIKMPNGGKNSLIFDVSMSRNRTFRANLEALCHKCLAAIVSEDDWHREPFKKFVETKAREKLEVIYSDVCGPMKCESLGESRYFLSFLDDFTRKMWVYILKRKSEVPGVFKKFKRMVERQTSFLIKIIVTDGGGEYTSNEFDEFCVLEGIVHDVTPPYTPQHNSAAVSIAVYVLNRSPTKRLNKITPEEAWSGCKSVDWSWDKEMVEKPTKVVIEAPIDESSDSSAVVIDDTDQGGVRKSQRARQVSSRLHDYELIQDLAIGEECELVHLALFAESESVSLEEAMNDTKWINAMKEELKAIEKNNTWQLARLVAKGFFQKAGIDFNEVFAPIARMETVRIITAIASQKEWHMHHMDVKSAFLNGPLEEE

SEQ ID NO: 226088 - protein, 44 aa, Glycine max
  Coding DNA Sequence Number=SeqID_109310
MITLFESLYVGGLDKAMHLMQDNFLELGLKREDCAKMTWMTWLL

SEQ ID NO: 226089 - protein, 87 aa, Glycine max
  Coding DNA Sequence Number=SeqID_109311
MSSYDSKSKYFSPEKVHGIKIKSTKEYHSVSNLGTLKLEFDIGKRCGIRLTTQLNNNKSQANLAKSNVANLMAKINKLELETKSLQA

SEQ ID NO: 226090 - protein, 100 aa, Glycine max
  Coding DNA Sequence Number=SeqID_109312
MVLFFYVKCGQRHANRQPHWRVCPGCDTWRLQWSRHCHWRFGHAKGSSQFDWRFGHARAQQACRARQEQQVVGLQRFSDWESPAPMATCAWMVSPTPLAI

SEQ ID NO: 226091 - protein, 101 aa, Glycine max
  Coding DNA Sequence Number=SeqID_109313
  Gene Ontology: Mol. function=transcription regulator activity; Cellular component=nucleus; Biological process=regulation of transcription
  Homolog annotation: Hit_ID=Q9FEA1; Match level="QueryCoverage=76%, HitCoverage=11%, E-value=3e-18, Identity=58%"; Hit description =Anthocyanin 1
MEQVAVKVKAVEVEAATSVQVSIIESNMLLEIKCPHREGLFINVMQMLREVRIEVSGVQSFNNGVLMAELRAKVKEYANGKKVSIVEVKRALNQTITHAVD

SEQ ID NO: 226092 - protein, 133 aa, Glycine max
  Coding DNA Sequence Number=SeqID_109314
  Homolog annotation: Hit_ID=Q94FN3; Match level="QueryCoverage=26%, HitCoverage=6%, E-value=4e-08, Identity=69%"; Hit description =Phosphatidylinositol transfer-like protein II
MWTDMLQWRKEFGVDTIMQDFEFKEIFDDVAQQVPHIPPFPYIEVLASEVPSSIKHNVDSVNLDGVTLLKCGIDKLLPHVSTDAKNDHGDGYDPILMAETIYSINNLQISMILSRSVNAQCLQHPNGVVYMAL

SEQ ID NO: 226093 - protein, 63 aa, Glycine max
  Coding DNA Sequence Number=SeqID_109315
MKSLTSAKYTRRRASIMYAITRQSSVLSDDGPLVRHENAVLPSILEPRKHEYINPRCTSRSSA

SEQ ID NO: 226094 - protein, 288 aa, Glycine max
  Coding DNA Sequence Number=SeqID_109316
  Homolog annotation: Hit_ID=Q337D4; Match level="QueryCoverage=24%, HitCoverage=17%, E-value=3e-20, Identity=68%"; Hit description =Methionine aminopeptidase 1, putative, expressed
MEKIRQRKLEILQKGICWLSFTNKGRLLHIVGHNGVAYGVNTETGELLKEFKITKKSITSLAFSHDEKYLAIVSSRPRVISWEIGEEILKFPNDLVNVEHISISNDAKNLVTSYFEDQHEVVEGVLLDDDLNEPTMGEKLASLSVLDGNKSRSDIEQESFVPARPPSADSVHVLLKQALNADDRTLLLDCLFTQNEKINSAELNICLVASLKSVYILNIHSLGALNETHFVGNVDEESRQLIKCTYECLEKAISIVKLGVRFREIGEAINRHASMFGFSMVMIYFFVL

SEQ ID NO: 226095 - protein, 1107 aa, Glycine max
  Coding DNA Sequence Number=SeqID_109317
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=90%, HitCoverage=91%, E-value=1e-135, Identity=37%"; Hit description =Chromo
  Pfam annotation: Domain name=Chromo; Domain location=998-1052; Score =23.1; E_value=0.001; Accession=PF00385.14; Description='chromo' (CHRromatin Organisation MOdifier
  Pfam module annotation: Pfam domain module=Chromo::RVT_1::Retrotrans _gag; Domain location=998-1052::536-784::99-188
MVDTRLKMLQDQITALTSWMNGQIEQDQRMQDHLDLMQQPIDLLIVNSVQHNDGSNLEGGPSHQTSPLNVVSPVKDISLGFPHFDGSTPMLEWIFKAENFFSITILQTLRMLILLLCILTRMLFHELTKALESQFGSSLFENPMAELFKLQQTGSVSKYYLQFMSLANRSVGLSEDAFFNCFISGLDPDIRRDVIDMTPSTLLRVVALEKLYEKKYNPIVKTIKSNFVQRYSQLSSNTKYPAQAKSVTKTQLPPLLPTPPGPPLKTSNVKRISPAEMQLGREKGLCYFCDDKFTFNLRCPNKQLLLLQMEEEGVDDLGDSLHHDNSVTDLVIHEDHRLSFNALKGGLGIGTIRFLAYMEKLPVTVLIDGGNSDSFLQPRIAKFLKLHVEPATKFKVMVGNGNYMTAEGLVKKLRVQAQGNVFHLPVFLLPIFGADLILGASWLKTIGPHIADYEHLQLKFLLDAEIYSMQVIEENSITFPLLDLPADIDPKLALLLHSYDEPVKVKPYRYPHSQKEEIEKLMAGMIDEGIIQPSKSLFSSPIILVKKKDGSWRVCTNYRALNAITIKDIFPIPTVDELYGASYFSKLDLRSGYHQILLKPEDRCKTAFRTHHGRYEWLIEYLGHTLSGDRVSMDLSKLKAIKNWPEPTNLKQLQGFLGLTGYYRRFIRSYANIAAPLTDLLKKDSFKWNTFAASSFLKLKEAMTSAPVLAIPNFQLPFTLETDASGIGIEFFAITEAMAKFRHYLLGHKFVIKTNQRSLKELLDQKLQTPEQQQWLPKFLGYDFTIQYKPGKENIPADALSRSFFMAISSLEFHASKLGGHARVNKTIARIASQFHWPLPIPQQIWEDLAIDFIVALPMSQGYSIIFVVIDRLSKFGYFIPLKSGLLNLFKAQGTTLAMTSSYHPQSDAAFGKHPPTVLRYEINPSDPVDLQESLKERDQLLGQLKVKLQPYRQHSVVLKRNQKLGLRYFGPFKVTKKIGTTPYVPLPLSSNEFGPLVQPMEILDARIVHRVGMEVPQVLIRWDLSEVNDDVWEDLRELQLSYPHLNLEDKVVSNGKGNVTCKGKNELMAEKFVTPLEHVAIDSGLIERRRGSRVKKLSIKLNLVFG

SEQ ID NO: 226096 - protein, 269 aa, Glycine max
  Coding DNA Sequence Number=SeqID_109318
  Gene Ontology: Mol. function=transposase activity; Biological process= transposition, DNA-mediated
  Homolog annotation: Hit_ID=Q1T4P3; Match level="QueryCoverage=77%, HitCoverage=33%, E-value=6e-11, Identity=28%"; Hit description=IMP dehydrogenase/GMP reductase
MTDKRKVLGKNNEETRSYFTWNLEMERVLADVLRDQRNLGNKGDGGWKRSALNAAAAVLSTSFNVNVTSDNVKNLIKLWRSWYGIVSDILGQSGFDWDGTKHMITVENENAWNEYCTSHKSAKPFRFKVLQNWDDIVDLCAKDRATGHGAETAMDADEAMSRETNEVEFMGLGATAIDLEEPSSNTKGKRQCSTSSGTHPHKRKMGEKEGITASLDKMANSFNRMVERMDGKVDDEDIQEVLREAALIPDLSRQQWAKAIKWLADDPKR

SEQ ID NO: 226097 - protein, 184 aa, Glycine max
  Coding DNA Sequence Number=SeqID_109319
MDCMALFTLTSLIIPKRKNFETKWWERERSKLKKGTYRLKGTQDETQKGVKEESQRFSRQIYGCKDTYMVGGISNAQYRLAGCVFNGYYHNSSFNSQREWEWEWETQKKTYNCSFLFGHTGILFLSFPILRPRQKAKKSGILAWRGLELNVPMDTSLDQAFNEEIQSFRDNMHLLKKTYKYKKL

SEQ ID NO: 226098 - protein, 56 aa, Glycine max
  Coding DNA Sequence Number=SeqID_109320
MSQNCTNYATIPSSASGMLQNFTDCAIMFPFDSRHVAELHGLLNDGCQVPRSSQAK

SEQ ID NO: 226099 - protein, 54 aa, Glycine max
  Coding DNA Sequence Number=SeqID_109321
MKFDKRGPKVAMTLKVNKTTRSMKKFKVSVEERCQEIPSWKRHSLNEESSAYVT

SEQ ID NO: 226100 - protein, 80 aa, Glycine max
  Coding DNA Sequence Number=SeqID_109322
MFVFKSVLKGLDNTQQSKSKPPTRWIVVKCNRQKGSTECGYYVMHWMSTIILGNFKNNWQMYFTDATPLEPERLKVFRIQ

SEQ ID NO: 226101 - protein, 68 aa, Glycine max
  Coding DNA Sequence Number=SeqID_109323
MAKWVTSIFVISEQGHLSLTKDTIALTGFRGCIHKQENENTQGPVKNDCSAHLLSFCIFVDKTSSIDR

SEQ ID NO: 226102 - protein, 328 aa, Glycine max
  Coding DNA Sequence Number=SeqID_109324
  Homolog annotation: Hit_ID=Q75GP1; Match level="QueryCoverage=95%, HitCoverage=97%, E-value=8e-45, Identity=35%"; Hit description =Expressed protein
MLVSESSGSKVDLPEELLNVLPSDPYEQLDVARKITSVALSTRVDALQSESSALRAELADRNRLIAELQSQVESIDAALSEAADKLARADQDKENLLKENASLSNTVRKLTRDVSKLETFRKTLMKSLREDEDTSEGTPDTAAKLHSQASFTSTSQFGDDDASSTLSSRTSSMRINTSDMGNYLAEDRESDGSKSRASHNLLLASQTSTPRITPPGSPPSMSALVSPTRTSSKPVSPRRHAISFSTSRGMFDDRSSVGSQTGVGILSETALQSVSTNVKFGAFLANVKELNSHKQTKEETLQKANELFGPENKDLYTIFEGLITRNVH

SEQ ID NO: 226103 - protein, 187 aa, Glycine max
  Coding DNA Sequence Number=SeqID_109325
  Gene Ontology: Mol. function=protein serine/threonine kinase activity; Cellular component=cytoplasm; Biological process=protein amino acid phosphorylation
  Homolog annotation: Hit_ID=Q8RXC8; Match level="QueryCoverage=99%, HitCoverage=41%, E-value=2e-30, Identity=41%"; Hit description =Putative serine/threonine protein kinase
  Subcellular localization annotation: CTP_CleavageSite=70; ConfidenceScore=5.44e-01
MASTRSETPSSRASTSDSESQGSFAGTPNNNNQWRGFFKLLKKGSQMPFQTFHPLKNVPKLTRRKSKRIREDLIPSLNAASLDTEFGCFKSSWKNFTLAEIQAATDDFSHGYAEVYLGKLEDGNFVAIKRLTRGCQEEMTADFLSELGIIVHVDHPNIARLIGYGVEGGMFLVLQLSPHGSLSSILY

SEQ ID NO: 226104 - protein, 311 aa, Glycine max
  Coding DNA Sequence Number=SeqID_109326
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=cytoplasm; Biological process=protein metabolic process
  Homolog annotation: Hit_ID=Q8LAN3; Match level="QueryCoverage=95%, HitCoverage=93%, E-value=1e-120, Identity=69%"; Hit description =Prolyl 4-hydroxylase alpha subunit-like protein
  Pfam annotation: Domain name=2OG-FeII_Oxy; Domain location=133-258; Score=64.8; E_value=2.9e-16; Accession=PF03171.10; Description=2OG -Fe(II) oxygenase superfamily
MASALALMLQWHEAFSSYAGSASAIIDPSKVKQVSWKPRAFVYEGFLTELECDHLISIAKSELKRSAVADNLSGESKLSEVRTSSGMFIPKNKAGAKSIGAGAAIIASMGVADPIVAGVEDKISSWTLLPKENGEDIQVLRYEHGQKYDPHYDYFADKVNIARGGHRVATVLMYLTDVTKGGETVFPNAEESPRHRGSETKEDLSECAQKGIAVKPRRGDALLFFSLYPNAIPDTMSLHAGCPVIEGEKWSATKWIHVDSFDKMVADGGDCNDKQENCDRWATLGECTSNPNYMVGSPGLPGYCMKSCKAC

SEQ ID NO: 226105 - protein, 204 aa, Glycine max
  Coding DNA Sequence Number=SeqID_109327
  Gene Ontology: Mol. function=protein binding; Biological process=two -component signal transduction system (phosphorelay)
  Homolog annotation: Hit_ID=Q94KS0; Match level="QueryCoverage=96%, HitCoverage=98%, E-value=2e-41, Identity=50%"; Hit description =Histidine-containing phosphotransfer protein
  Pfam annotation: Domain name=Hpt; Domain location=91-171; Score=31.6; E_value=2.8e-06; Accession=PF01627.13; Description=Hpt domain
MDVGQMQRQWIDYTKSLFLEFLQLQQLQDENNPDFVVEVVSLFFEDSERLLKDLTFALSVLLLSYHSRFPSFHSSCIHYSMVVIKVLNIHRLHCDFVAFVDITPHRRQMQPMRDQNGVDFKKVDAHVHQLKGSSSSIGAQRVKNACIAFRNFCEEQNTDACVRCLQQVKQEYCLVKNKLETMFRLEQQIVAAGGSIPTELSFSG

SEQ ID NO: 226106 - protein, 169 aa, Glycine max
  Coding DNA Sequence Number=SeqID_109328
  Gene Ontology: Mol. function=sugar porter activity; Cellular component=integral to membrane; Biological process=carbohydrate transport
  Homolog annotation: Hit_ID=Q8LBI9; Match level="QueryCoverage=92%, HitCoverage=31%, E-value=1e-50, Identity=62%"; Hit description=Sugar transporter ERD6-like 16
DFLQEKLIPFTLSGAILMDKSGRRPLVMVSAAGTFLGCLIAGIAFFLKASLKLDQNLLLEWVPILAVAGVLIYIAAFSIGLGSVPWVIMSEIFPLHLKGTAGSLVVLVAWLGAWVVSYTFNFLMSWSSPGTLFLYAGCSLLTILFVAKLVPETKGKTLEEIQACLSSQR

SEQ ID NO: 226107 - protein, 75 aa, Glycine max
  Coding DNA Sequence Number=SeqID_109329
MEFIQGLIIMCGSQLDVPLQKNVSKINVLCVSYLGNLRGKPGGIPCLIRLLSAALRCGSSVFSRGHLQNEGQQKK

SEQ ID NO: 226108 - protein, 62 aa, Glycine max
  Coding DNA Sequence Number=SeqID_109330
MQSLQQITIALYQPIMTSKDFLQRVAWPGDQPYSINGVGEGDVAKPRYDEDYIANISVAQTA

SEQ ID NO: 226109 - protein, 49 aa, Glycine max
  Coding DNA Sequence Number=SeqID_109331
MSMSIFIPIPEIRRAMSIFEFEVWVVGARLECILAWLSGFLALSSSLLS

SEQ ID NO: 226110 - protein, 385 aa, Glycine max
  Coding DNA Sequence Number=SeqID_109332
  Gene Ontology: Mol. function=calpain activity; Cellular component =intracellular; Biological process=proteolysis
  Homolog annotation: Hit_ID=Q1S3Q9; Match level="QueryCoverage=97%, HitCoverage=74%, E-value=6e-58, Identity=37%"; Hit description =Cyclin-like F-box; F-box protein interaction domain
  Pfam annotation: Domain name=F-box; Domain location=1-48; Score=46.5; E_value=9e-11; Accession=PF00646.23; Description=F-box domain
  Pfam annotation: Domain name=FBA_1; Domain location=217-378; Score= -37.8; E_value=0.004; Accession=PF07734.3; Description=F-box associated
  Pfam module annotation: Pfam domain module=F-box::FBA_1; Domain location=1-48::217-378
MAMAQLPQDLIEEILSWLPVKSLMRFRCVSRTWNSLIFQAHFVKLNLERSSRNTHVLLRCQINTVFEDMRDLPGIAPCSICSLLENPSSTVDNGCHQLDNRYLFIGSCNGLVCLINLVARGEFSEYRVWFCNLATRIMSEDSPHLCLRSCNYKLWWYQVKCGFGYDDRSDTYKVVLVLSNIKSQNREVRVHRLGDTHWRKVLTCPAFPILGEKCGQPVSGTVNWFAIRKLGFDYEWETVTVDQLVIFSYDLNKETFKYLLMPNGLSEVPRGPELGVLKGCLCLSHVHRRTHFVVWLMREFGVENSWTQLLNVTLELLQAPLPCVILKLLCISENGDVLLLANYISSKFILYNKKDNRIVYTQDFNNQVPMSSHDYIQSLVLPYGN

SEQ ID NO: 226111 - protein, 45 aa, Glycine max
  Coding DNA Sequence Number=SeqID_109333
MAVEVVNIATIIPAKVVTIMVMGPGLESTLARSKEREISHAVNQV

SEQ ID NO: 226112 - protein, 190 aa, Glycine max
  Coding DNA Sequence Number=SeqID_109334
  Gene Ontology: Mol. function=sugar porter activity; Cellular component=integral to membrane; Biological process=carbohydrate transport
  Homolog annotation: Hit_ID=Q8LBI9; Match level="QueryCoverage=96%, HitCoverage=33%, E-value=2e-55, Identity=62%"; Hit description=Sugar transporter ERD6-like 16
MLGAITSGRIQISLAGKGKFTQELFNILNHAMRISTGFCITGWLAVFFSKGSYSLDMGRFFTGYGIGVISYVVPVYIAEIAPKNLRGGLATTNQLLIVTGGSVSFLLGSVINWRELALAERYNNWLGLNFEGLVPCICLLVGLCFIPESPRWLAKVGREKEFQLALSRLRGKHADISDEAAEILVLSKLS

SEQ ID NO: 226113 - protein, 301 aa, Glycine max
  Coding DNA Sequence Number=SeqID_109335
  Gene Ontology: Mol. function=DNA binding; Cellular component=nucleus; Biological process=regulation of transcription, DNA-dependent
  Homolog annotation: Hit_ID=Q1RWX0; Match level="QueryCoverage=94%, HitCoverage=35%, E-value=4e-91, Identity=64%"; Hit description=SBP
MAAVVRRVIDFELWNPVENESGLSNFIPVLIGDKEICTEMKTLQQKLDVSLLSKQFQSASGGSICSSCETFALSHTSSSDFLVDIAWLLKDTTSENFDRVMTASQIQRYCHLLDFLICNDSTIILGKILPNLIILTESVESNNVVINRTSDVDITQLLNHIHNASNVICQKHQQSRSIIVHSEMEGFKLAQGCSQDNMLSVAINSQGILSRTDEKWGVLKSPTSNDKTERIPLLKRDIIMSVEELPERYGRRCLGRGFLTSRPAIFVIVSVAVCLGVCVAVLHPGRVSELAVSVRRCLFNY

SEQ ID NO: 226114 - protein, 1067 aa, Glycine max
  Coding DNA Sequence Number=SeqID_109336
  Gene Ontology: Mol. function=receptor activity; Cellular component =integral to membrane; Biological process=defense response to fungus
  Homolog annotation: Hit_ID=Q6JN47; Match level="QueryCoverage=99%, HitCoverage=91%, E-value=1e-156, Identity=33%"; Hit description=EIX receptor 1
  Pfam annotation: Domain name=LRR_1; Domain location=110-132; Score =16.2; E_value=0.12; Accession=PF00560.23; Description=Leucine Rich Repeat
  Pfam annotation: Domain name=LRR_1; Domain location=134-156; Score =21.3; E_value=0.0035; Accession=PF00560.23; Description=Leucine Rich Repeat
  Pfam annotation: Domain name=LRR_1; Domain location=158-181; Score =3.1; E_value=75; Accession=PF00560.23; Description=Leucine Rich Repeat
  Pfam annotation: Domain name=LRR_1; Domain location=210-237; Score =5.5; E_value=26; Accession=PF00560.23; Description=Leucine Rich Repeat
  Pfam annotation: Domain name=LRR_1; Domain location=239-262; Score =9.6; E_value=4.6; Accession=PF00560.23; Description=Leucine Rich Repeat
  Pfam annotation: Domain name=LRR_1; Domain location=265-287; Score =13.2; E_value=0.95; Accession=PF00560.23; Description=Leucine Rich Repeat
  Pfam annotation: Domain name=LRR_1; Domain location=290-304; Score =4.6; E_value=39; Accession=PF00560.23; Description=Leucine Rich Repeat
  Pfam annotation: Domain name=LRR_1; Domain location=306-328; Score =13.6; E_value=0.74; Accession=PF00560.23; Description=Leucine Rich Repeat
  Pfam annotation: Domain name=LRR_1; Domain location=31-59; Score=1.3; E_value=1.7e+02; Accession=PF00560.23; Description=Leucine Rich Repeat
  Pfam annotation: Domain name=LRR_1; Domain location=330-352; Score =15.3; E_value=0.23; Accession=PF00560.23; Description=Leucine Rich Repeat
  Pfam annotation: Domain name=LRR_1; Domain location=354-376; Score =6.7; E_value=16; Accession=PF00560.23; Description=Leucine Rich Repeat
  Pfam annotation: Domain name=LRR_1; Domain location=383-404; Score =8.6; E_value=7.1; Accession=PF00560.23; Description=Leucine Rich Repeat
  Pfam annotation: Domain name=LRR_1; Domain location=406-427; Score =10.4; E_value=3.3; Accession=PF00560.23; Description=Leucine Rich Repeat
  Pfam annotation: Domain name=LRR_1; Domain location=430-452; Score =10.2; E_value=3.5; Accession=PF00560.23; Description=Leucine Rich Repeat
  Pfam annotation: Domain name=LRR_1; Domain location=454-476; Score =10.2; E_value=3.5; Accession=PF00560.23; Description=Leucine Rich Repeat
  Pfam annotation: Domain name=LRR_1; Domain location=483-504; Score =7.6; E_value=11; Accession=PF00560.23; Description=Leucine Rich Repeat
  Pfam annotation: Domain name=LRR_1; Domain location=506-528; Score =15.0; E_value=0.28; Accession=PF00560.23; Description=Leucine Rich Repeat
  Pfam annotation: Domain name=LRR_1; Domain location=530-553; Score =9.4; E_value=5.1; Accession=PF00560.23; Description=Leucine Rich Repeat
  Pfam annotation: Domain name=LRR_1; Domain location=555-575; Score =3.7; E_value=59; Accession=PF00560.23; Description=Leucine Rich Repeat
  Pfam annotation: Domain name=LRR_1; Domain location=580-602; Score =3.6; E_value=61; Accession=PF00560.23; Description=Leucine Rich Repeat
  Pfam annotation: Domain name=LRR_1; Domain location=604-627; Score =3.9; E_value=54; Accession=PF00560.23; Description=Leucine Rich Repeat
  Pfam annotation: Domain name=LRR_1; Domain location=61-83; Score =13.6; E_value=0.74; Accession=PF00560.23; Description=Leucine Rich Repeat
  Pfam annotation: Domain name=LRR_1; Domain location=631-652; Score =1.6; E_value=1.4e+02; Accession=PF00560.23; Description=Leucine Rich Repeat
  Pfam annotation: Domain name=LRR_1; Domain location=675-696; Score =2.4; E_value=1e+02; Accession=PF00560.23; Description=Leucine Rich Repeat
  Pfam annotation: Domain name=LRR_1; Domain location=701-723; Score =14.6; E_value=0.36; Accession=PF00560.23; Description=Leucine Rich Repeat
  Pfam annotation: Domain name=LRR_1; Domain location=725-747; Score =14.8; E_value=0.3; Accession=PF00560.23; Description=Leucine Rich Repeat
  Pfam annotation: Domain name=LRR_1; Domain location=749-771; Score =15.4; E_value=0.21; Accession=PF00560.23; Description=Leucine Rich Repeat
  Pfam annotation: Domain name=LRR_1; Domain location=773-796; Score =12.4; E_value=1.4; Accession=PF00560.23; Description=Leucine Rich Repeat
  Pfam annotation: Domain name=LRR_1; Domain location=798-820; Score =9.4; E_value=5; Accession=PF00560.23; Description=Leucine Rich Repeat
  Pfam annotation: Domain name=LRR_1; Domain location=822-844; Score =6.2; E_value=20; Accession=PF00560.23; Description=Leucine Rich Repeat
  Pfam annotation: Domain name=LRR_1; Domain location=85-108; Score =15.7; E_value=0.17; Accession=PF00560.23; Description=Leucine Rich Repeat
  Pfam annotation: Domain name=LRR_1; Domain location=896-918; Score =13.9; E_value=0.58; Accession=PF00560.23; Description=Leucine Rich Repeat
  Pfam annotation: Domain name=LRR_1; Domain location=920-942; Score =16.7; E_value=0.081; Accession=PF00560.23; Description=Leucine Rich Repeat
  Pfam annotation: Domain name=LRR_1; Domain location=944-966; Score =14.2; E_value=0.49; Accession=PF00560.23; Description=Leucine Rich Repeat
  Pfam annotation: Domain name=LRR_1; Domain location=968-989; Score =9.6; E_value=4.6; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1::LRR_1::LRR_1::LRR _1::LRR_1::LRR_1::LRR_1::LRR_1::LRR_1::LRR_1; Domain location=110 -132::134-156::158-181::210-237::239-262::265-287::290-304::306 -328::31-59::330-352::...
  Pfam module annotation: Domain location=354-376::383-404::406 -427::430-452::454-476::483-504::506-528::530-553::555-575::580 -602::604-627::61-83::631-652::675-696::701-723::725-747::749 -771::773-796::798-820::822-844::...
  Pfam module annotation: Domain location=85-108::896-918::920-942::944- 966::968-989
  Subcellular localization annotation: CTP_CleavageSite=41; ConfidenceScore=5.25e-01
MACSLLGPLLIAANGKGFAAPTSPATSDMPSIVSLELPRTVISEERSTSRGIPEFLGSLTNLRYLDLSFSHFGGKIPTQFGSLSHLKYLNLAGNYYLEGSIPRQLGNLSQLQHLDLRANQFEGNIPSQIGNLSQLQHLDLSYNSFEGSIPSQLGNLSNLQKLYLGGRALKIDDGDHWLSNLISLTHLSFDSISNLNTSHSFLQMIAKLPKLRELSLIHCSLSDHFILSLRPSKFNFSSSLSVLDLSWNSFTSSMILQWLSNVTSNLVELDLSHNLLEGSTSNHFGRVMNSLEHLDLSYNIFKVFSSLRSLFLDGNKLSGKIPEGIRLPFHLKSLSIQYNSLEGGIPKSFGNSCALSSLDMSANNLNKELSVIIHQLSGCARFSLQELNIEANQINGTLSDLSIFSALKTLDLSINQLNGKIPESTKLPSLLESLSIGSNSLEGGIPKSFGDACALRSLDMSYNSLSEEFPMIIHHLSGCARYSLEQLSLSMNQINGTLPDLSIFSSLRELYLYGNKLNGEIPKDIKFPPQLEQLDMQSNSLKGVLTDYHFANMSKLDILELSENSLLALAFSQNWVPPFQLSYLGLRSCKLGPVFPKWLETQNQFRDIDISNAGIADMVPKWFWANLAFREFISMNISYNNLHGIIPNFPTKNIQYSLILGPNQFDGPVPPFLRGSVFLDLSKNQFSDSLSFLCANGTVETLYELDLSNNHFSGKIPDCWSHFKPLTYLDLSHNNFSGRIPTSMGSLLHLQALLLRNNNLTDEIPFSLRNCTNLVMLDISENRLSGLIPAWIGSELQELQFLSLGRNNFHGSLPLQICYLSDIQLLDVSLNSMSGQIPKCIKNFTSMTQKTSSRDYQGHSYLVNIIGMSGSYTYDLNALLMWKGSEQMFKNNVLLLLKSIDLSSNHFSGEIPLEIENLFGLVSLNLSRNHLTGKIPSNIGKLTSLDFLDLSRNHLVGSIPLSLTQIDRLGMLDLSHNNLSGEIPTGTQLQSFNASCYEDNLDLCGPPLEKLCIDGKPAQEPIVKLPEDENLLFTREFYMSMAIGFVISFWGVFGSILINRSWRHAYF

SEQ ID NO: 226115 - protein, 104 aa, Glycine max
  Coding DNA Sequence Number=SeqID_109337
  Homolog annotation: Hit_ID=Q1RYI3; Match level="QueryCoverage=56%, HitCoverage=8%, E-value=2e-10, Identity=59%"; Hit description=AAA ATPase, central region
MLAKAIANEASVQVSLMSQCQPSFTSKCFGEDEKNIGALFTLPGKEKKQREAEGQSSEDASNNKDKEEQEIKARPLNMEDMRQAKSQVDASFASEGSVMNELKQ

SEQ ID NO: 226116 - protein, 316 aa, Glycine max
  Coding DNA Sequence Number=SeqID_109338
  Gene Ontology: Mol. function=1-deoxy-D-xylulose-5-phosphate synthase activity; Biological process=terpenoid biosynthetic process
  Homolog annotation: Hit_ID=Q9XH50; Match level="QueryCoverage=86%, HitCoverage=37%, E-value=1e-134, Identity=86%"; Hit description=1-D -deoxyxylulose 5-phosphate synthase
  Pfam annotation: Domain name=Transket_pyr; Domain location=137-304; Score=214.8; E_value=2e-61; Accession=PF02779.14; Description =Transketolase, pyrimidine binding dom
  Subcellular localization annotation: CTP_CleavageSite=56; ConfidenceScore=5.04e-01
MAKSTLPSLFRQPQWPNADCFANPNGQMLTILPTPMAKCTPSCHVDEFADRTGAISGSTLFEELGLYYIGPVDGHNMNDLVAILNEVKNTETTGPCVIHVVTEKGHGYPYAERAAAKYHVVSKFDPATGEQFKAKATTKSYSTYFAEALIAEAEADKDIIGIHAAMGGGTGMNHFLRRFPTRCFDVGIAEQHAVTFAAGLACEGFKPFCAINSSFMQRAYDQVVHDVDLQKLPVRFGIDRAGLVGPDGCTHCGAFDVTFMACLPNMVVMAPSDEAELFHMVATAAAIDDRPSCFRYPRGNGVGVELPPGNKGIPLE

SEQ ID NO: 226117 - protein, 432 aa, Glycine max
  Coding DNA Sequence Number=SeqID_109339
  Gene Ontology: Mol. function=DNA binding; Cellular component=nucleus; Biological process=regulation of transcription, DNA-dependent
  Homolog annotation: Hit_ID=Q1RWX0; Match level="QueryCoverage=99%, HitCoverage=53%, E-value=1e-122, Identity=54%"; Hit description=SBP
  Pfam annotation: Domain name=SBP; Domain location=115-193; Score =156.2; E_value=8.7e-44; Accession=PF03110.5; Description=SBP domain
  Pfam annotation: Domain name=zf-NADH-PPase; Domain location=133-165; Score=14.5; E_value=0.0047; Accession=PF09297.1; Description=NADH pyrophosphatase zinc ribbon domai
  Pfam module annotation: Pfam domain module=SBP::zf-NADH-PPase; Domain location=115-193::133-165
MEPQSLPPPPTMDDAQDPSSIWDFSYLLDFNLDDQDGIFTSSNSLPLPLNDDDDAAAPEISQNDRVRKRDPRMTCSNFLAGRVPCACPELDAKLEDEGLPVKKRARTARASASARCQVPGCEADISELKGYHRRHRVCLRCANAATVMLNDEAKRYCQQCGKFHVLSDFDEGKRSCRRKLERHNTRRRRKPPADSGGAAHSELLQPVAQNEEHNYHVEAGKDKVGFLCCKNAHWLSMNRTDCSNLSTDINDVGVSLDLEDEPAPIPSSAPEAQNINSDSVVSLAVSGETRVNSGNTSNSPSYCDNKSAYSSMIFQWLASMPVELEGYIRPGCTILTIFIAMPNIMWINLLKDPLEYVHDIVAPGKMLSGRGTALVHLNDMIFRVMKDGTSVTNVKVNMHAPKLHYVHPTYFEAGKPMEFVACGSNLLQPKFR

SEQ ID NO: 226118 - protein, 1147 aa, Glycine max
  Coding DNA Sequence Number=SeqID_109340
  Gene Ontology: Cellular component=intracellular
  Homolog annotation: Hit_ID=Q1RWU7; Match level="QueryCoverage=45%, HitCoverage=96%, E-value=0.0, Identity=64%"; Hit description=BRCT
  Pfam annotation: Domain name=BRCT; Domain location=913-989; Score =15.8; E_value=0.075; Accession=PF00533.16; Description=BRCA1 C Terminus (BRCT) domain
MSPIDSTGNDDRKIHQDFDFVDTQPFDTDGEEDDVCGYFEDTVPFDEDDDVLETEAVDLAGETQALDDGDAFDDVLLETEAVNLAEEIQALDDGDTQLLEEESDSDRTQVLETVDDDEVSVDNVNGEAADSKKVESSQQNSYGSMPPRFNFLHAESLRQAALACDMDLKETLDVTNSVKGTSQFCQEPLVVKDKGESFLRCSEKDGGVDQENEHGKYSVEVGGFKSKSMCKVANSTVRKLFNDVLPVETNQPSLSSNDFNEGDDLDKLPIYHGELSGLSYVNSQEPGVLSQDNALCFVDRFLKDNIMEFDQETNCLKMEGKSKSIPSTKRQHSLAKTVNDKGKARRTGIYDWDDSREDEGGGDIFLRRKEDFFKGEMRRPRSLPGFQKSKVHRLNDDKEDKKQFSIPNKRKTAVHSDSKLGMHILKVRDNIIPEATMLKRNLANELDEQFNTDCSRGEMEPNANACAQEMLDVGLDTQMAAEAMEALCNVGDIVDHVANNATHVTRSGLTYKLNNSSTGKVGSGSSKERSVQYDRKRKVDVKSKLQTSGLSKKSTKEVKQCTEDNMMTRSKRSKLNAEGNQTSSANENGRVSLSPIIAQRKSDGALKRHQLDELDNPDGNNGEGGGSSVDKRHFQDGVWHFTPIACRTRRSLAVNQLINRDIPSKSLRGGDIGIRSLEKSSGIGLQASKALNSKSTTGSSDHFEVDDNSKSCQFENSVPKASAVNVSDDVKIDTLDCPKRRRSLRIRQLSNDDKQSETLVGSSKPSAHPEDIGKSTAGKRKMRTDSVVKFHVNCQARSSSYDGSVITSVDRKQGKISEINLDKANPGDNINNSEVSSSDESPRERYKSSDLASATQAKCKMPVNDASPICMGDEYYKQSCNRNLSRSCKELHRELQSLSDIRPELLTPSKDSRKRRDMTDVRILYSHHLDEDILKHQKKILARLGVSVASSIADATHFIANQFVRTRNMVEAIAFGKPVVTHLWIESCGQASCFIDERNYILRDAKKEKELGFSMPVSLARAIQHPLLKGRRVLVTTNTKPSKEIVSNLARAVQGQVVEKVGRSVFKGNTIADNLLILSCEEDYASCVPFLEKGAMVYSSELLLNGIVTQKLEYQRHRLFADNVKKTRSTLWLKRDDRTFIPVTKSN

SEQ ID NO: 226119 - protein, 735 aa, Glycine max
  Coding DNA Sequence Number=SeqID_109341
  Gene Ontology: Mol. function=zinc ion binding
  Homolog annotation: Hit_ID=Q1RWV9; Match level="QueryCoverage=62%, HitCoverage=97%, E-value=1e-147, Identity=61%"; Hit description=Zinc finger, RING-type
  Pfam annotation: Domain name=zf-C3HC4; Domain location=204-250; Score= 59.3; E_value=1.2e-14; Accession=PF00097.15; Description=Zinc finger, C3HC4 type (RING finger)
MQAPQAASATDEAPEISHQAVPQRNKEVSDSGPGGRRPDISLQVPPRPIGFGSTSSGRVLDHCQSFGKGISSSRGFLRALSLKRKGNVADGERSSLLNSDPKTAADGPNMASISEIAWKRCTSLPVTPASNLSPSVSTPISARTYNEQTKPHKDVDRSKVSRSLSVPGRNVVIELSILGQSDQITPVQVEVTADEEIPEEEAVCRICFDVCDERNTFKMECSCKGDLRLVHEECLIKWFSTKGDKECDVCRQEVQNLPVTLLRVTSSVRQNRQLQGQHNLHPESISAWQDFVVLVLISTICYFFFLEQLLLPELKTQAIIIAAPFAFTLGLLASIFAVILAIKEYIWTYAALEFALVALTVHLFYTMVNLIHCQVVMLDHPKMPYPANFMSKGIAERVKMSVRMQYYCSDYFMQSSSFVMQSSLLHLTAIYAILLSSVLGFGIAMGINYAYIQFVTWRLQVSHDDNPINWNPSLLHRQESLFKYAVKGQWREALEAYNKNLGALEAKITRVEDTVLHVAVYGVCRITSTERCLSTSCACKTQRETLPFTLRHSLGTWNCATTWPKGTPNLFHVTTLKVRPLSSRQLFTARERRSFVSMKTNQDVIMRMARCWLGKATGIPFFILPSLVNTLILAGKPNCFKSSMRMELLQRIIYNCSIVDEIEKTDDLRCNEADTAHHYPMNYETRATFLSLLKSIYHGKVICVDTSIGKDDNAASNDEENNVSRKSDNFSSCKS

SEQ ID NO: 226120 - protein, 43 aa, Glycine max
  Coding DNA Sequence Number=SeqID_109342
MLSRVLGWVACIKDRRPMRVMCYLAFKREVGVDGLASAPIRPK

SEQ ID NO: 226121 - protein, 163 aa, Glycine max
  Coding DNA Sequence Number=SeqID_109343
  Gene Ontology: Mol. function=1-deoxy-D-xylulose-5-phosphate synthase activity; Biological process=terpenoid biosynthetic process
  Homolog annotation: Hit_ID=Q6PRU5; Match level="QueryCoverage=87%, HitCoverage=20%, E-value=5e-63, Identity=81%"; Hit description =Chloroplast 1-deoxy-D-xylulose-5-phosphate synthase
  Pfam annotation: Domain name=Transketolase_C; Domain location=2-125; Score=144.6; E_value=2.6e-40; Accession=PF02780.10; Description =Transketolase, C-terminal domain
IGKGRILIEGERVALLGYGSTVQSCVAAATLLGDLGLHATVVNARFCKPLDHSLIRSLAKSHEVLITVEEGSIGGFGSHVAQFMALDGLLDGKLKWRPMVLPDCYIDHGSPADQLNEARLTPSHIAATVFNLLGQAREELEVMTKEKCKEGVQFSSPEMYKVA

SEQ ID NO: 226122 - protein, 988 aa, Glycine max
  Coding DNA Sequence Number=SeqID_109344
  Gene Ontology: Mol. function=heat shock protein binding; Cellular component=integral to membrane; Biological process=protein folding
  Homolog annotation: Hit_ID=Q5ZCV2; Match level="QueryCoverage=97%, HitCoverage=99%, E-value=1e-148, Identity=33%"; Hit description=DNAJ heat shock N-terminal domain-containing protein-like
  Pfam annotation: Domain name=DnaJ; Domain location=87-148; Score =92.3; E_value=1.4e-24; Accession=PF00226.21; Description=DnaJ domain
LVVCLLGHSTRFQVLKSGLLMECNKEEALRAKELAEKKMQNKDFIGARKFALKAQQLYPELENITQMLIVCDVHCSAEQKLIGNEMDWYKILQIELTANDTTIKKQYRKFALQLHPDKNKFSGAEAAFKLIGEAQRVLLDREKRSRLDMNLRRVPTNRTTMPSHHQQNVQMSFNPMMQTSARPNFTNLNPQPQQKSRQASQQGPNGGRLTFWTMCSFCSVRYEYYREVLNRSLRCQHCSRPFIAYDVNMQGTTPATNSSQQAFGAQNHSQNQGAFDVAAGSQGNLHTSRSNTESHNKKGPAADVSVKPNGKRRRKRVAESSESAESVGSTDSESEEDTLYDKDGFSTHRDENPRRSTRQKHQVSYNENVSDDDEGGGSPSGAAENTGEVSKMNNQNGLAADLKGDKQGAKRKQNFYSGESLQNIDEEIKEVRGKEAVGSSKIDKASEHSPSKSTNQLDNFVYPDAEFSDFDKDKKEGSFAVGQIWAIYDTIDGMPRFYAIIRKVFSPGFKLRITWFEPDPDEQDQVHWVEEQLPIACGKHKLGITETTEDRLSFSHLIVCEKIGRCTYKVYPRKGETWALFKNWDIKWHMDAESHRQYEYEFVEILSDYVEGVGVVVLYLAKLKGFVSLFSRMEGGNCTFQIPSTELFRFSHRVPSFKMTGQERVGVPVGSYELDPVSLPMNLEEIAVAEHLEVKEGHCPSSGVGTRYSDMSKFTMNSEGEASTEKVKWERSNSAEENKDPVDHIGNGSDPSASAADAFEIPDPEFCNFDAERSLEKFQVGQIWAFYGDEDGLPKYYGQIKRVKSSPDLELQVTYLTNCWLPEKCVKWEDKDMLISIGRFKIKAGARSCTYANTYSVSHQVQVITDGKKKEYEIFPREGEIWALYRNWTTKIKRSDLLNLEYDIVEVVGEHDLWMDVLPLELVSGYNSVFKRKSNAGSARATKIYWKDLLRFSHQIPAFKLTEEQDGTLRGFWELDPGAVPLHYFNNK

SEQ ID NO: 226123 - protein, 56 aa, Glycine max
  Coding DNA Sequence Number=SeqID_109345
MVSLLASIAFVLIEVRDDGSRVFMVRNFILLLLKLLECRNIDLYFANEDEAAGLLR

SEQ ID NO: 226124 - protein, 134 aa, Glycine max
  Coding DNA Sequence Number=SeqID_109346
MNGIMDVSSWLLIEDSADSEGDSGCFSLCPCNIGHKEDDAESCTCDPAGMCGIFEDGEGHEGEKGCGEFCADEDEHCGSEWNSSTMWLSDAALEIECSSPLVVEDEEETRIVKVNVNDVEDKIFWEICMAVGYP

SEQ ID NO: 226125 - protein, 131 aa, Glycine max
  Coding DNA Sequence Number=SeqID_109347
MHFSVDIGVHGFAPKYTSLEAQLELIILWNKKACSKGFGKGIKSQRTRKGTAGRKYQGGTRDNQSIVCVPAGVGESTRNPLTYGKLKKEELSTKGKRDVEKNEKLGTMDPSEMAKRFVVKSKKSLHEDGAN

SEQ ID NO: 226126 - protein, 119 aa, Glycine max
  Coding DNA Sequence Number=SeqID_109348
MIESENNNLIQSKAKIEAERKRLVDREKDLLAKIERDETIFKVMATLKEEKELAEQDAKSVRLKPEEAKKKKSNDLFFALEDARDDAVESFTKVFDAANDQVIQGDQVIEHMADVEEKL

SEQ ID NO: 226127 - protein, 247 aa, Glycine max
  Coding DNA Sequence Number=SeqID_109349
  Pfam annotation: Domain name=VQ; Domain location=86-116; Score=44.1; E_value=4.9e-10; Accession=PF05678.4; Description=VQ motif
  Subcellular localization annotation: CTP_CleavageSite=58; ConfidenceScore=5.89e-01
MSPSQFHAKKQTTSTTNNNNINGLLSPSLRINKESHLIKKSSSTSPSSSSTSSSSLVNSAMTQAMPMSLYKQTPPQQQQCHPVIIYTHSPKVIHTQPKDFMSLVQKLTGLSRSDEKEDEDGGNPTPQQPSNQKFGGDVAVAVGDKESGRKNEDNETSSVITTEENYCSSVGENQVNSCFMMGEPSMLEPRLNPYVTNLPVLAPSSAEFACSSQPFLNYTDSLFFSHNMRNSIPSSVTLEGMKEFREH

SEQ ID NO: 226128 - protein, 45 aa, Glycine max
  Coding DNA Sequence Number=SeqID_109350
MELLRKEHDEKLGIDENENGFKNNKNEILGIRFENQKFEFNKNER

SEQ ID NO: 226129 - protein, 52 aa, Glycine max
  Coding DNA Sequence Number=SeqID_109351
MEVQWDAMASDQEYKSWRMSINGVMAGRNDRAIVDGLEALAQAMGNQNRGET

SEQ ID NO: 226130 - protein, 416 aa, Glycine max
  Coding DNA Sequence Number=SeqID_109352
  Gene Ontology: Mol. function=cytochrome-c oxidase activity; Cellular component=membrane; Biological process=electron transport
  Homolog annotation: Hit_ID=Q33B99; Match level="QueryCoverage=98%, HitCoverage=54%, E-value=1e-114, Identity=54%"; Hit description =Expressed protein
  Pfam annotation: Domain name=DUF639; Domain location=1-411; Score =189.3; E_value=9.4e-54; Accession=PF04842.3; Description=Plant protein of unknown function (DUF639)
MGSEPVVLEFPELKGHARRDYWLAIIQEILYVHKFISKYKLKGVARDEALWKAVLGILRLQAIQDISSTIPIQNDALLMFNLCDQLPGGDLILETLANMPNLRESDHENDFKGGSGMYSISALDMVSNLGFVFGASSNNSNESRIAVGEISVGEMTELERAVKESKNNHKKVISAQATVDGVKVDGIDTNLAVMKELLFPLNELGKSLQSLAYWDDPRKSLVFCLFFSYIIYRREARGWLGYAVALVLLLLAVFMIITRCFSQGRSVPEVKVIAPPPLNTMEQLLAVQNAVSQAEQLIQDGNVILLKFRGLLLSIFPQGKNFYIDSVCLLNSSQLLSGQKHATEKLAFGLLSTALILAFLPTKYIILLLFLEIFTRYSPPRKASTERLTRRLKEWWFSIPAAPVTLERDTEEKTRT

SEQ ID NO: 226131 - protein, 197 aa, Glycine max
  Coding DNA Sequence Number=SeqID_109353
  Gene Ontology: Mol. function=cytochrome-c oxidase activity; Cellular component=membrane; Biological process=electron transport
  Homolog annotation: Hit_ID=Q33B99; Match level="QueryCoverage=96%, HitCoverage=29%, E-value=2e-48, Identity=51%"; Hit description =Expressed protein
MAVASKTRNMLEGLVKEGSLKWLLGKKSYFGEEFEEMENSPSAGKNFIRELSPVANLVVRRCSNDLLESFNQEASDSMKHPSRYARNFLEYCCFKALFLTTQMTGHLFDKTFRRLTYDMMLAWEAPAADSQPLTNVDEDISVGLEAFCRIAPSIPIIANVIISENLFEVLSSSTGGRLQFPIYDKYLTGLERYQPLP

SEQ ID NO: 226132 - protein, 119 aa, Glycine max
  Coding DNA Sequence Number=SeqID_109354
MGKVMGEGSLNKQEKFKISQGSVSDVGAAIDTGGKLEPPVPMAVRWVPLVPVAGHVLSRREGVGAADGICGTSERRWVEWVPPMLFAVQGGAASTACGTPSASNPAIRAGGTGFSCTWH

SEQ ID NO: 226133 - protein, 145 aa, Glycine max
  Coding DNA Sequence Number=SeqID_109355
  Gene Ontology: Mol. function=RNA-directed DNA polymerase activity; Biological process=RNA-dependent DNA replication
MSSFPPNNSAMNANDEVHARPIDKIKILLGFDSCLSVDTNGRSGGLVMFWKHPFDCQLLNFSSNPSWRLTGFYGYLECRRSKDSWNLLRYLANDTSLPLCVFGNFNDLLSSDEKIGFIDHPNWLLNGFREALADCNSHDLPMEGY

SEQ ID NO: 226134 - protein, 94 aa, Glycine max
  Coding DNA Sequence Number=SeqID_109356
MVCAERERELVRRESSSAVCDEIEGERVWVLFSLYLPKFPFSTFSVSGNSGGERRFRVVNAGYFSSSGYFLSCMEVRHWMMGRGGVQWSSVGKF

SEQ ID NO: 226135 - protein, 272 aa, Glycine max
  Coding DNA Sequence Number=SeqID_109357
  Gene Ontology: Mol. function=transcription regulator activity; Cellular component=nucleus; Biological process=regulation of transcription
  Homolog annotation: Hit_ID=Q5FAM4; Match level="QueryCoverage=85%, HitCoverage=88%, E-value=4e-54, Identity=54%"; Hit description =Putative bZIPtranscription factor protein
  Pfam annotation: Domain name=HLH; Domain location=162-212; Score =21.9; E_value=0.00067; Accession=PF00010.16; Description=Helix-loop -helix DNA-binding domain
MAEFTENMQLQSNIRPSQFPFLEIDPSMELLNQFLGMNQHVLENSNLIPMHNLVPFSCDTFLGPQEPECPGNLEENFPAHVNHNALPISLPIFQAENEIHEGKKRKSMDLPETSSANSTPAVSESGSKIKHSSGRGKRVKSNVTEEEKAKEVVHVRARRGQATDSHSLAERVRRGKINEKLRCLQNIVPGCYKTMGMAVMLDEIINYVQSLQHQVEFLSLKLTAASTFYDFNSETDALETMQRARASEAKELGKYKKEGYGGVSFFQPAWPL

SEQ ID NO: 226136 - protein, 147 aa, Glycine max
  Coding DNA Sequence Number=SeqID_109358
  Pfam annotation: Domain name=PAN_2; Domain location=26-81; Score= -16.4; E_value=0.067; Accession=PF08276.2; Description=PAN-like domain
GFEPLDGDGWGSGDYSKGCYRGDAGCDGSDGFRDLGDVRFGFGNVSLIKGKSRSFCEGECLRDCGCVGLSFDEGSGNLTGGGESGGFYVRVPKGGSGGRKKVFDRKVLSGVVIGVVVVLGVVVMALLVMVKKKRGGGRKGLEEEEED

SEQ ID NO: 226137 - protein, 460 aa, Glycine max
  Coding DNA Sequence Number=SeqID_109359
  Homolog annotation: Hit_ID=Q9FFU3; Match level="QueryCoverage=99%, HitCoverage=77%, E-value=1e-165, Identity=59%"; Hit description =Genomic DNA, chromosome 5, P1 clone:MBG8
MDLYVFATPYRITWDYYFSSREHTLKFDSWEEPAELEYVKQHGVSVFLMPSGMLGTLLSLIDVLPLFSNTGWGQKANLDFLKKHMGATFEKRSQPWRAYIDPADVHSGDFLAVSKIRGRWGGFETLEKWVTGSFAGHTAVCLKDEWGNLWVGESGHENEKGEEIIVVIPWEEWWELALKDDSNPQIALLPLHPEIRAKFNSTAAWEYARSMSGKPYGYHNMIFSWIDTVADNYPPPLDAHLVISVMSMWTRLQPAYSANMWNEALNKRLGTEKGFFKTGKFIKRWDMGGKVILQEKNVLKILTAFCQSNEPKCSLSFGFGSSMGLDLHDILVETEKRGIPFDELLTIPEQDEWVYSDGKSTTCVAFILSMYKEAEVFGPIANSIQVTEFTIRDAYMLRIFEDNQTRLPSWCNNENDRIPFCQILGEYKMELPGYNTLEPYANMNEYCPSLPPTYDRPSRC

SEQ ID NO: 226138 - protein, 105 aa, Glycine max
  Coding DNA Sequence Number=SeqID_109360
MASYGKAKDSIDEEDLRPKSSSWSYISDSPTNHLDANRGYTDIIIDTTMININMDNQTTVWIECERRQWCHGEEDGEGEELGKKRGVATENCLRQHANEEGYRGN

SEQ ID NO: 226139 - protein, 45 aa, Glycine max
  Coding DNA Sequence Number=SeqID_109361
MYSRALVFKHPSLSCLQFFKHLGQSELPSGHHGEGMSIAAAPSPA

SEQ ID NO: 226140 - protein, 202 aa, Glycine max
  Coding DNA Sequence Number=SeqID_109362
MDFWLSFMAVVSTFVYLATIDEVYKRAIHTAVAILTALLAATKATRSSNVVLVIVIGALGLLIAWLIEISKKYRSISFSFGLSLSFLQSLQTIKQWFCNLVKTLLRRFRWGFLLVGFITLAMAGLSWTLETSANYWFWHSFWHVTIYTSSFFFLCSKANIVDAEDSSSPSSGNYALTHQDSFPRGKKIWLLSRTRNQHKSEL

SEQ ID NO: 226141 - protein, 371 aa, Glycine max
  Coding DNA Sequence Number=SeqID_109363
  Gene Ontology: Mol. function=protein serine/threonine kinase activity; Cellular component=membrane; Biological process=protein amino acid phosphorylation
  Homolog annotation: Hit_ID=Q5YD56; Match level="QueryCoverage=90%, HitCoverage=73%, E-value=1e-109, Identity=58%"; Hit description =Calcium/calmodulin-regulated receptor-like kinase
  Pfam annotation: Domain name=Pkinase; Domain location=65-343; Score =132.7; E_value=1e-36; Accession=PF00069.15; Description=Protein kinase domain
  Pfam annotation: Domain name=Pkinase_Tyr; Domain location=65-340; Score=122.6; E_value=1.1e-33; Accession=PF07714.7; Description =Protein tyrosine kinase
  Pfam module annotation: Pfam domain module=Pkinase::Pkinase_Tyr; Domain location=65-343::65-340
MDWILKEEEQRGKIAAVSNASRAGSQRGHGSKRGTSISSYNILPAKEPGSVEFTMEEIFRVTRNFSPSFKIGQGGFGAVYRAKLLDGTVVAVKRAKKSVYEKHLGVEFQSEIQTLSRVEHLNLVKFFGYLEQEDERIIVVEYVPNGTLREHLDCIHGSVLDLAARLDIAIDVSHAITYLHMYIDHPIIHRDIKSSNILLTENFRAKVADFGFARQAPDSDSGMTHVSTQVKGTAGYLDPEYLKTYQLTEKSDVYSFGVLLVELVTGRRPIEPKFELKERITARWAMKRFIEGDAISVLDPRLDQIAANTLALEKILELALQCLAPRRQSRPTMKRCAEILWSIRKDIREQLSASNFRSFSTSSQRSTSLKE

SEQ ID NO: 226142 - protein, 578 aa, Glycine max
  Coding DNA Sequence Number=SeqID_109364
  Gene Ontology: Mol. function=nucleic acid binding; Cellular component= intracellular; Biological process=protein amino acid phosphorylation
  Homolog annotation: Hit_ID=Q9LHZ4; Match level="QueryCoverage=91%, HitCoverage=73%, E-value=6e-85, Identity=33%"; Hit description =Pentatricopeptide (PPR) repeat-containing protein-like
  Pfam annotation: Domain name=PPR; Domain location=159-193; Score=8.2; E_value=0.8; Accession=PF01535.11; Description=PPR repeat
  Pfam annotation: Domain name=PPR; Domain location=225-259; Score =32.2; E_value=1.8e-06; Accession=PF01535.11; Description=PPR repeat
  Pfam annotation: Domain name=PPR; Domain location=326-360; Score =41.2; E_value=3.6e-09; Accession=PF01535.11; Description=PPR repeat
  Pfam annotation: Domain name=PPR; Domain location=427-461; Score =52.3; E_value=1.6e-12; Accession=PF01535.11; Description=PPR repeat
  Pfam annotation: Domain name=PPR; Domain location=462-496; Score=0.8; E_value=6; Accession=PF01535.11; Description=PPR repeat
  Pfam annotation: Domain name=PPR; Domain location=498-531; Score=3.9; E_value=2.6; Accession=PF01535.11; Description=PPR repeat
  Pfam module annotation: Pfam domain module=PPR::PPR::PPR::PPR::PPR::PP R; Domain location=159-193::225-259::326-360::427-461::462-496::498 -531
MLCKFHFKKQLLFPLTPCSFVTQCTHSWSIIRASVPVPEETHFRDPHIVHLFCANALKVSARRALLPEGKQLHAHLIKFGFCHVLSLQNQILGVYLKCMEAEDVEKLFKELPLRNVVSWNILIHGIVGCGNAIENYSNRQLCFSYFKRMLLETVVPDGTTFNGLIGVCVKFHDIAMGFQLHCFAVKFGLDLDCFVESVLVDLYAKCGLVENAKRAFHVVPRRDLVMWNVMISCYALNWLPEEAFGMFNLMRLGGANGDEFTFSSLLSICDTLEYYDFGKQVHSIILRQSFDSDVLVASALINMYAKNENIIDACNLFDRMVIRNVVAWNTIIVGCGNCGEGNDVMKLLREMLREGFFPDELTITSIISSCGYASAITETMEAHVFVVKSSFQEFSSVANSLISAYSKCGSITSACKCFRLTREPDLVTWTSLINAYAFHGLAKEAIEVFEKMLSCGVIPDRISFLGVFSACSHCGLVTKGLHYFNLMTSVYKIVPDSGQYTCLVDLLGRRGLINEAFEFLRSMPMEAESNTLGAFIGSCNLHENIGMAKWAAEKLFIKEPEKNVNYAVMSNIYASHRH

SEQ ID NO: 226143 - protein, 275 aa, Glycine max
  Coding DNA Sequence Number=SeqID_109365
  Gene Ontology: Mol. function=protein serine/threonine kinase activity; Cellular component=cell surface; Biological process =protein amino acid phosphorylation
  Homolog annotation: Hit_ID=Q39203; Match level="QueryCoverage=89%, HitCoverage=31%, E-value=2e-57, Identity=44%"; Hit description =Receptor-like protein kinase precursor
  Pfam annotation: Domain name=B_lectin; Domain location=62-164; Score =88.9; E_value=1.5e-23; Accession=PF01453.15; Description=D-mannose binding lectin
  Pfam annotation: Domain name=S_locus_glycop; Domain location=178-274; Score=-31.6; E_value=0.0076; Accession=PF00954.11; Description=S -locus glycoprotein family
  Pfam module annotation: Pfam domain module=B_lectin::S_locus_glycop; Domain location=62-164::178-274
  Subcellular localization annotation: CTP_CleavageSite=14; ConfidenceScore=5.63e-01
MSLSLFFLLILIFSSSTSSSTTIILQGNTTLKSPNNTFQLGLFSFSFSFYLAIRHTSLPFPNTTWVANRLHPSPTQTGSILHLTQTGSLILTHSNTTLWSTAPTFNTSSNLSLKLLDSGNLILSAPNGLVLWQSFDSPTDTWLPGMNLTRFNSLTSWRTQTDPTPGLYSLRLKPPFFGEFELVFNDTVSYWSTGNWTDGKFLNIPEMSIPYLYSFHFLSPFSPAAEFGFSERASETGTQPPTMFRVEPFGQIRQYTWNNQAGSWKMFWSMPEPVA

SEQ ID NO: 226144 - protein, 71 aa, Glycine max
  Coding DNA Sequence Number=SeqID_109366
MKRRCEGNKTWGLDARDNHDYKWNIKKVDGGHKDLNEYNKCPKIRVTDEELVKCVISMQRQGRVMLRCNKI

SEQ ID NO: 226145 - protein, 137 aa, Glycine max
  Coding DNA Sequence Number=SeqID_109367
  Gene Ontology: Mol. function=nucleic acid binding
  Homolog annotation: Hit_ID=Q1SAT5; Match level="QueryCoverage=55%, HitCoverage=14%, E-value=5e-20, Identity=61%"; Hit description=Zinc finger, CCHC-type
MPPRIQFHALVASSSWIVVITTITALLLLSFGCERGHALKVPFRVNDVLPVLPREISWPVLNNLHSAVDLLPYFVGSLTPANASVKWKGACFFDNTAKIEFAPSLEGATLYLKFMTEVAGLLPEDAFWIVKNMTHFG

SEQ ID NO: 226146 - protein, 809 aa, Glycine max
  Coding DNA Sequence Number=SeqID_109368
  Gene Ontology: Mol. function=protein-tyrosine kinase activity; Cellular component=integral to membrane; Biological process=protein amino acid phosphorylation
  Homolog annotation: Hit_ID=O22178; Match level="QueryCoverage=90%, HitCoverage=93%, E-value=0.0, Identity=51%"; Hit description =Putative receptor-like protein kinase
  Pfam annotation: Domain name=LRRNT_2; Domain location=21-62; Score =54.7; E_value=3.1e-13; Accession=PF08263.3; Description=Leucine rich repeat N-terminal domain
  Pfam annotation: Domain name=LRR_1; Domain location=114-136; Score =16.3; E_value=0.11; Accession=PF00560.23; Description=Leucine Rich Repeat
  Pfam annotation: Domain name=LRR_1; Domain location=138-160; Score =19.0; E_value=0.018; Accession=PF00560.23; Description=Leucine Rich Repeat
  Pfam annotation: Domain name=LRR_1; Domain location=162-181; Score =0.7; E_value=2.1e+02; Accession=PF00560.23; Description=Leucine Rich Repeat
  Pfam annotation: Domain name=LRR_1; Domain location=183-205; Score =10.2; E_value=3.5; Accession=PF00560.23; Description=Leucine Rich Repeat
  Pfam annotation: Domain name=LRR_1; Domain location=206-228; Score =7.0; E_value=14; Accession=PF00560.23; Description=Leucine Rich Repeat
  Pfam annotation: Domain name=LRR_1; Domain location=66-88; Score=3.6; E_value=61; Accession=PF00560.23; Description=Leucine Rich Repeat
  Pfam annotation: Domain name=LRR_1; Domain location=90-112; Score =16.9; E_value=0.075; Accession=PF00560.23; Description=Leucine Rich Repeat
  Pfam annotation: Domain name=Pkinase; Domain location=461-730; Score =22.4; E_value=6.8e-10; Accession=PF00069.15; Description=Protein kinase domain
  Pfam annotation: Domain name=Pkinase_Tyr; Domain location=450-755; Score=-14.2; E_value=1.3e-11; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::Pkinase::Pkinase_Tyr; Domain location =21-62::114-136::138-160::162-181::183-205::206-228::66-88::90 -112::461-730::450-755
MSLLVQTLIISLVLVNQCCALSRDGVLLLSFKYAVLNDPLYALANWNYSDETPCSWNGVSCSTENRVTSLFLPNSQLLGSVPSDLGSIEHLQILDLSNNSLNGSLPSSLSQASELRFLNLSNNLITGEVPESITQLRNLEFLNLSDNDLAGKLPEGFSNMQNLTQASFKNNYLFGFLPSGLRTLQVLDLSANLLNGSLPTDFGGDVMRYLNISYNRFSGEIPTEFAARIPGNATVDLSFNNLTGEVPDSAVFTNQNSKSFSGNVNLCGEMTKNPCPIPSSPSSEPKASAPISPPAIAAIPKNLDDSPLAPTGQKQSGLKQGTIIGIVVGDVVGVGILAVLFVYVYRLKKKKEEEGSKTNNEAAITRSRSESSSSTTSESRGFTRWSCLRKRTEEEESSETTSSSDSDLEGAAAAGQNNQNLNNNHNNSKGPQQENNKTGTLVTVDGERQLELETLLKASAYILGATGSSIMYKAVLEDGTSLAVRRIGESGVERFKDFENQVRVIAKLVHPNLVRVRGFYWGHDEKLIIYDFIPNGCLANVRYRKLGLSPSHLPWEIRLKIAKGVARGLAYLHEKKHVHGNLKPSNILLGNDMEPKIGDFGLERIVTGDTSYKAGGSARIFGSKRSTASRDSFQDITFGPSPSPSPSSISGVSPYHAPESLRNLKPHPKWDVYSFGVMFLELLTGKIVVLDDMGQGPGLLVEDNNRALRMVDMAIRADMECREEALLAYFKLGYSCMSSVPQKRPPMKEYSGNNIVEAEAIDERGDIIGEVTLEKLPKDGEGENDLVDMAKAVDEDGESDVAGVASDSI

SEQ ID NO: 226147 - protein, 306 aa, Glycine max
  Coding DNA Sequence Number=SeqID_109369
MESRVLQCPLGKAGSNCTMDSYTLQIGDTITCSHILMVKKNIRCNNSKESIKMFIICRNRNVPSLILRRGATPFESYFLPVAIGEGASSANFPLEPLLNKSSNVGETGDIWTYFTLDIPHGAAGRNIHIRLSADVKISYEVYARFGGLPSLDSWDYYYASRTRKSDQSVFFMLYDSSDDKIDFYIIYAREGTWGIGLRHLYTGSDSLKAQTVMSISLEGCPKQCSSHGDSSALVIETMVALTVALKLYHIKGIYYNQFFSLDQMLQPYFLPIGPFGRRHLQNGFCSHPVALLVHYIMHVTLAPGVH

SEQ ID NO: 226148 - protein, 283 aa, Glycine max
  Coding DNA Sequence Number=SeqID_109370
  Gene Ontology: Mol. function=glutathione dehydrogenase (ascorbate) activity; Cellular component=cytoplasm; Biological process=tRNA aminoacylation for protein translation
  Homolog annotation: Hit_ID=Q4JR86; Match level="QueryCoverage=93%, HitCoverage=89%, E-value=1e-80, Identity=66%"; Hit description =Dehydroascorbate reductase
  Pfam annotation: Domain name=GST_N; Domain location=67-141; Score =20.7; E_value=0.0054; Accession=PF02798.10; Description=Glutathione S-transferase, N-terminal domain
  Subcellular localization annotation: CTP_CleavageSite=57; ConfidenceScore=5.78e-01
MSAVRVQVSACAVSATVNHLRLRQNAVVSFRKKKPLTLRVVSMSSVPPSQPFEIAVKASVTTPNRLGDLFIEKSVNAIVVEEIRVLLTLEEKHLPYDPKLVDLTNKPEWFLKVNPDGKVPVIKFDEKWVPDSDVITQTLEEKYPSPPLVTPPERATALLRSSKGPEWFAYDSRFGVDLVKFEVMGFGPAKKCRGYVQRTMSLVSRPSHKASINSFTLLGPFINGSEISAADLSLGPKLYHLEIALGHYKKWTVPDSLTSLKSYMKNTKLEYFTKDAEDAFASA

SEQ ID NO: 226149 - protein, 49 aa, Glycine max
  Coding DNA Sequence Number=SeqID_109371
MAHKNEFVTEMIVNMVMLTRLDKNVRTHLSGNYTFRDKNDYLPIHIPKE

SEQ ID NO: 226150 - protein, 182 aa, Glycine max
  Coding DNA Sequence Number=SeqID_109372
  Gene Ontology: Mol. function=DNA binding; Cellular component =nucleosome; Biological process=chromosome organization and biogenesis (sensu Eukaryota)
  Homolog annotation: Hit_ID=Q42461; Match level="QueryCoverage=75%, HitCoverage=78%, E-value=5e-26, Identity=47%"; Hit description=High mobility group protein
  Pfam annotation: Domain name=AT_hook; Domain location=109-121; Score =10.8; E_value=0.31; Accession=PF02178.9; Description=AT hook motif
  Pfam annotation: Domain name=AT_hook; Domain location=133-145; Score =10.1; E_value=0.42; Accession=PF02178.9; Description=AT hook motif
  Pfam annotation: Domain name=AT_hook; Domain location=164-176; Score =9.8; E_value=0.46; Accession=PF02178.9; Description=AT hook motif
  Pfam annotation: Domain name=AT_hook; Domain location=87-99; Score =4.0; E_value=4.7; Accession=PF02178.9; Description=AT hook motif
  Pfam annotation: Domain name=Linker_histone; Domain location=12-81; Score=54.7; E_value=3e-13; Accession=PF00538.9; Description=linker histone H1 and H5 family
  Pfam module annotation: Pfam domain module=AT_hook::AT_hook::AT _hook::AT_hook::Linker_histone; Domain location=109-121::133-145::164- 176::87-99::12-81
MATGVFINKPPSLPPYPEMILEAIEALNEDNGSNKSSISKYIESTYGGLPQGHKVLLNVHLAKMRDSGVLVFWKNNYTKRDPKAPPRRGRGRPPKPKEPLPPGTVLSPPRPKGRPPKDPNDPGKPPKALTESGRPRGRPRKMTRPTGGLSEASPASKVKASTSGRPRGRPPKVKPVFTEISA

SEQ ID NO: 226151 - protein, 188 aa, Glycine max
  Coding DNA Sequence Number=SeqID_109373
  Gene Ontology: Mol. function=nucleic acid binding; Cellular component= spliceosome; Biological process=protein folding
  Homolog annotation: Hit_ID=Q9FHP9; Match level="QueryCoverage=71%, HitCoverage=42%, E-value=2e-51, Identity=72%"; Hit description =Arabidopsis thaliana genomic DNA, chromosome 5, TAC clone:K12B20
  Pfam annotation: Domain name=RRM_1; Domain location=87-157; Score =61.3; E_value=3.1e-15; Accession=PF00076.12; Description=RNA recognition motif. (a.k.a. RRM, R
  Subcellular localization annotation: CTP_CleavageSite=74; ConfidenceScore=5.09e-01
MFGWFCVDRCFVGSSCQVGFYSARIQYTSLIHGILQRSFSLRTRTGALTSSIALSIRRARPFPWQHDLFEDSLRAAGIQGVEVGTKLYVSNLDHGVTNEDIRELFSELGELKRFAVHYDKNGHPSGSAEVVYTRRSDAFAALKRYNNVLLDGKPMKIEIVGSNSELPISARVNVTGVNGRRKRTVVMT

SEQ ID NO: 226152 - protein, 190 aa, Glycine max
  Coding DNA Sequence Number=SeqID_109374
  Gene Ontology: Mol. function=oxidoreductase activity, acting on the CH-OH group of donors, NAD or NADP as acceptor; Cellular component =nucleus; Biological process=regulation of transcription, DNA -dependent
  Homolog annotation: Hit_ID=Q53RP5; Match level="QueryCoverage=57%, HitCoverage=11%, E-value=2e-22, Identity=53%"; Hit description=FAR1 family, putative
  Subcellular localization annotation: CTP_CleavageSite=34; ConfidenceScore=5.36e-01
MKLHCLCAPKVSKNFIVSISSSTWSQVAQAPLKRAQALVLGFSAFESFTLNFHCTGCYWQSIDFFSHEAFLDNFYSMLVVMVLDHNHPLGLPEATHMLASHRKINEVQAYEIELDDDSELKQKSIFQLLSTHVGHSTNLGSTLMDVKNYLTARRQRSMVYGEVGCLSSMHTKWILTNELQMSFGPIQRWY

SEQ ID NO: 226153 - protein, 71 aa, Glycine max
  Coding DNA Sequence Number=SeqID_109375
MEKLIKILRQIDLPSCTEQMIRFRLEELNIDQKKVLRAIRKEKVGAMAVRGRSPKMLLQERLDYGGRSIDR

SEQ ID NO: 226154 - protein, 242 aa, Glycine max
  Coding DNA Sequence Number=SeqID_109376
MALLKTIGWVKELNADRTKSNNNIVMPSTPLMDLRAHALTLPRERARKNVDMHSRERKDIHLVLLISYIVKLNNLHSKLKMPRTSTLECSGCPPLRALTFDALGLIKVVEARDKQRGAPQVVERWGDLESSKCVMAVSMIDRESHPLLAVARKNNQIEVLSPVNGDIQATITDANDLDVQSEVNNIVGLHLFAKQNSELASRHLNSWEVPNGTSFLLFLTLDTNGFRVGGGHQKQISSFCLC

SEQ ID NO: 226155 - protein, 288 aa, Glycine max
  Coding DNA Sequence Number=SeqID_109377
MPLNSIPWCHLKLILLSALLLFCCSLDLCSAITDYEDDVFTVSSFSYPQTTLRPYDLRYIRVDIIPWFSAVFISLDSDVDLDVSRVERVPKSSLPLLCFRDGSPPLPDALNISLKDSAVTGINGLEVEQCFPMEKNITMKLTNEQTMNMRIIVQISPGALYIGLFNGIGDTRTQSKMIIRGSAYSFSANISVEACSNSMMRGELCNSTIYPLSCTAFDVYNSMKATVKKPMMENAMTCKSNLETFCAQEGVPEFYSLDITNMAEELTIMAPNVTFNTTASNNISSAND

SEQ ID NO: 226156 - protein, 55 aa, Glycine max
  Coding DNA Sequence Number=SeqID_109378
GVATPPTPPIFYCGAGFFVEWRLFVRSGSEKSHYESDGPVCTGTLTLTFLCTLAL

SEQ ID NO: 226157 - protein, 93 aa, Glycine max
  Coding DNA Sequence Number=SeqID_109379
MGSGRSRRRLHSERAIMTPFQENWLRQERGFRTIGRIELAYGRIEVKATRFLDLVQFLTKLHKISSTSSNVGNRSKEQLCACKVYVAGHLALG

SEQ ID NO: 226158 - protein, 193 aa, Glycine max
  Coding DNA Sequence Number=SeqID_109380
  Gene Ontology: Mol. function=nucleoside-triphosphatase activity; Cellular component=nucleus
  Homolog annotation: Hit_ID=Q6DDA2; Match level="QueryCoverage=77%, HitCoverage=40%, E-value=1e-22, Identity=39%"; Hit description =MGC89952 protein (WD repeat domain 74) (NOP seven associated protein 1 (NSA1))
  Pfam annotation: Domain name=WD40; Domain location=117-156; Score =21.2; E_value=0.0037; Accession=PF00400.22; Description=WD domain, G- beta repeat
MNKYFICRKGVEMNIWDLNNFTKIWNSKPPPKDNLGIFTPTWFTSATFLMKDDHRKFVAGTNSHQVRLYDMSAQRRPVLSFDFRETPIKALAEDIDGYSIYVGNGSGDMASVDIRTGKMLGCFSGKCSGSIRSIVRHPELPVIASCGLDSYLRLWDTKTRQLLSAVGSMLYFFVRGGMLYSSFYWDMYAWKLK

SEQ ID NO: 226159 - protein, 456 aa, Glycine max
  Coding DNA Sequence Number=SeqID_109381
  Gene Ontology: Mol. function=triacylglycerol lipase activity; Biological process=lipid metabolic process
  Homolog annotation: Hit_ID=Q41251; Match level="QueryCoverage=87%, HitCoverage=87%, E-value=1e-177, Identity=74%"; Hit description =Calmodulin-binding heat-shock protein
  Pfam annotation: Domain name=Lipase3_N; Domain location=7-75; Score =65.7; E_value=1.5e-16; Accession=PF03893.7; Description=Lipase 3 N -terminal region
  Pfam annotation: Domain name=Lipase_3; Domain location=110-249; Score= 113.7; E_value=5.2e-31; Accession=PF01764.16; Description=Lipase (class 3)
  Pfam module annotation: Pfam domain module=Lipase3_N::Lipase_3; Domain location=7-75::110-249
MSASCGVVECVFVLGCARWLWKRCTYVGSYDSATWPAATADEFDRVPRVCRLILANYEPDLRTPQYQKPTSATGHRLNPDCVIKRVTYEDTLGHAPPYIIYLDHENKEIVLAVRGLNLAKESDYKVLLDNRLGQQMFDGGYVHHGLLKSAVWLLNRESETLKRLWVENGSEYEMVFAGHSLGSGVVSLLTILVVNHRDRLGGIPKEKIRCYALAPARCMSLNLAVKYANVIHSIVLQDDFLPRTATPLEDIFKSIFCLPCLLFLVCLRDTFIPEGRKLRDPRRLYAPGRMYHIVERKFCRCGRFPPEVRTAIPVDGRFEHIVLSCNATSDHGIIWIEREAEKALQLMKAQSSETVTDPPTVQKFQRLKTIEKEHRDALERAVSLNVPHAVDTAEKETSENNEGDDDASASANNNVSSNQSKSSGGRSNWDEVVEKLLKKKSETGEQNLERDTNVTQ

SEQ ID NO: 226160 - protein, 153 aa, Glycine max
  Coding DNA Sequence Number=SeqID_109382
  Gene Ontology: Mol. function=protein serine/threonine kinase activity; Cellular component=mitochondrion; Biological process =protein amino acid phosphorylation
  Homolog annotation: Hit_ID=Q17U57; Match level="QueryCoverage=69%, HitCoverage=53%, E-value=1e-30, Identity=57%"; Hit description =Receptor protein kinase, putative
  Pfam annotation: Domain name=Pkinase_Tyr; Domain location=51-153; Score=-155.6; E_value=0.0064; Accession=PF07714.7; Description =Protein tyrosine kinase
MSFLRRLCPCLHKGGAAFHDGDDDDIDRNHPGDSFDLIFGLHTLQLATNFFSDINRLGHGGFGPVFRGLMPNGQEVAVKKLSLESRQGDREFTNEVRLLLRIQHKNLVTLLGCCAEGPEKMLVYEYLPNKSLDRFLFGIEKRRLFIYLFTVVL

SEQ ID NO: 226161 - protein, 110 aa, Glycine max
  Coding DNA Sequence Number=SeqID_109383
VIEVRYFHSFYTSNVILANISSGVDSLPCKEQTPTEILVSEEVEESPLKRKKSSRNKEHIPDGGERKKRSKQSKERKKSEGNDGGEKIASRDEGSRSASKKRNKRSIPVL

SEQ ID NO: 226162 - protein, 132 aa, Glycine max
  Coding DNA Sequence Number=SeqID_109384
MSPSDQEEAILHKFPRALHCKTLVDMPFSKNPTTIGIVSIFLNYGQVYQSIKKAQAEKVSKARLKRFRPTKPRESNRIASMIGFLLPFTSSGVLPRRPIWVLKMRGLQKGQEWSRCHLFLVLPLRVTSPFFL

SEQ ID NO: 226163 - protein, 116 aa, Glycine max
  Coding DNA Sequence Number=SeqID_109385
MALMCRWTPMLASQQELEVGAAKAEVKLKSDLDEVESDILRTHEASFKKTPHQVKFFFLKNVDLSLFDVDNPSSTKFMFQRDGSLTSTGIMTFDPYESQKRVSPVVTMESNNKPKG

SEQ ID NO: 226164 - protein, 100 aa, Glycine max
  Coding DNA Sequence Number=SeqID_109386
MAHTKKTDQMTSEVAKEIADRIDSLEEQASQESFFIYGCQDVLTAAIGRPKHPGRVHAVEAGVTIKNYFGPASRGSHTSSSMVVEDLEQLTQKIKDQLED

SEQ ID NO: 226165 - protein, 159 aa, Glycine max
  Coding DNA Sequence Number=SeqID_109387
  Subcellular localization annotation: CTP_CleavageSite=80; ConfidenceScore=5.52e-01
MQMTDGGRGGGRRTFNRGRRRGLSFRSSQFTTNPSTSSIHISTSESMIHAVSPTPNTLPTAQDQPNPTFIRESISTTPVRDASPSAPDDSLTLEYPSNPNCEHIVDQRPFVCAYKGEFQPTYRCSNIISNIIRAKFDEPAASWLKVSVDLRDRWFGEFK

SEQ ID NO: 226166 - protein, 358 aa, Glycine max
  Coding DNA Sequence Number=SeqID_109388
  Homolog annotation: Hit_ID=Q6CQF2; Match level="QueryCoverage=20%, HitCoverage=91%, E-value=2e-17, Identity=63%"; Hit description =Kluyveromyces lactis strain NRRL Y-1140 chromosome D of strain NRRL Y- 1140 of Kluyveromyces lactis
  Subcellular localization annotation: CTP_CleavageSite=38; ConfidenceScore=5.34e-01
VSAQLGTVTQLPVHPASPVLLTKNGPLGALDSMARLNRAAAPSYLFKSFAPIPKSDERFARQYRCGPPPEFPLASPRSGIVHHLSGPDRYALTRTLHRRSGSVGGATHRGIPPISFLAPYGRAEWGAHRPTPGARRCRGTPRARAAIHNRDDDVSTSISTARAWATIAIRVGQCPESIGGPALTVPHPTGDTSPAPIRFPPDNFKHSLTLFSKSFSSFPRGTCSLSVSRQYLALDGIYRPIGAAFPNNPTRRQRLVGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSRE

SEQ ID NO: 226167 - protein, 205 aa, Glycine max
  Coding DNA Sequence Number=SeqID_109389
  Gene Ontology: Mol. function=protein binding; Cellular component =integral to membrane; Biological process=xylan catabolic process
  Homolog annotation: Hit_ID=Q1T435; Match level="QueryCoverage=99%, HitCoverage=85%, E-value=1e-55, Identity=46%"; Hit description =Leucine-rich repeat; Leucine-rich repeat, cysteine-containing type
  Pfam annotation: Domain name=LRR_1; Domain location=33-55; Score =16.7; E_value=0.081; Accession=PF00560.23; Description=Leucine Rich Repeat
  Pfam annotation: Domain name=LRR_1; Domain location=57-79; Score =14.2; E_value=0.49; Accession=PF00560.23; Description=Leucine Rich Repeat
  Pfam annotation: Domain name=LRR_1; Domain location=81-102; Score =9.6; E_value=4.6; Accession=PF00560.23; Description=Leucine Rich Repeat
  Pfam annotation: Domain name=LRR_1; Domain location=9-31; Score=14.5; E_value=0.4; Accession=PF00560.23; Description=Leucine Rich Repeat
  Pfam module annotation: Pfam domain module=LRR_1::LRR_1::LRR_1::LRR _1; Domain location=33-55::57-79::81-102::9-31
MFKNSVLLLLESIDLSSNHFSGEIPLEIENLFGLVSLNLSRNHLTGKIPSNIGKLTSLDFLDLSRNHLVGSIPLSLTQIDRLGMLDLSHNNLSGEIPTGTQLQSFNASCYEDNLDLCGPPLEKLCIDGKPAQEPIVKLPEDENLLFTREFYMSMAIGFVISFWGVFGSILINRSWRHAYFKFISNFSDAIYVMAAVKVFKWHHRG

SEQ ID NO: 226168 - protein, 174 aa, Glycine max
  Coding DNA Sequence Number=SeqID_109390
  Gene Ontology: Mol. function=nucleoside-triphosphatase activity; Cellular component=membrane; Biological process=cell division
  Homolog annotation: Hit_ID=Q1SK92; Match level="QueryCoverage=93%, HitCoverage=19%, E-value=5e-75, Identity=87%"; Hit description=AAA ATPase, central region; DEAD/DEAH box helicase, N-terminal
  Pfam annotation: Domain name=AAA; Domain location=1-154; Score=136.1; E_value=9.3e-38; Accession=PF00004.19; Description=ATPase family associated with various cellular activities (AAA)
MSTITSKWFGEDEKNVRALFTLAAKVAPTIIFVDEVDSMLGQRTRVGEHEAMRKIKNEFMTHWDGLLTGPNEQILVLAATNRPFDLDEAIIRRFERRILVGLPSVENREMILKTLLAKEKHENLDFKELATMTEGYTGSDLKNLCITAAYRPVRELIQQERMKDIDTDFTRGYE

SEQ ID NO: 226169 - protein, 78 aa, Glycine max
  Coding DNA Sequence Number=SeqID_109391
MEGGAGPDASCTGAWRRGEGSTAARRWGDGRVKKMKMQRGRKFLTSDNEFEKRIRPELIHENEIGVRLADVGALDEIK

SEQ ID NO: 226170 - protein, 66 aa, Glycine max
  Coding DNA Sequence Number=SeqID_109392
MATLTEKGLWCGGKGRPTRSEAREKRFGVSIILSKTNNYVAIKEQPYHCLASAKSYHNHYERLNII

SEQ ID NO: 226171 - protein, 39 aa, Glycine max
  Coding DNA Sequence Number=SeqID_109393
MAHKERDVRKKTSLHDSRRTHAKSSTFPCRLTEGQTKWI

SEQ ID NO: 226172 - protein, 449 aa, Glycine max
  Coding DNA Sequence Number=SeqID_109394
  Gene Ontology: Mol. function=hydrolase activity, acting on ester bonds; Cellular component=cell surface; Biological process =nucleotide catabolic process
  Homolog annotation: Hit_ID=Q8UG32; Match level="QueryCoverage=75%, HitCoverage=51%, E-value=0.0, Identity=97%"; Hit description=2',3' -cyclic-nucleotide 2'-phosphodiesterase
  Pfam annotation: Domain name=5_nucleotid_C; Domain location=78-276; Score=210.6; E_value=3.7e-60; Accession=PF02872.8; Description=5' -nucleotidase, C-terminal domain
MGKPAVMAGFWGSHMGLIDLLLEKDGKSWKIVDFTSEARPIYHRDENRKVVADYTEKPEVLAAAKVDHEAALAYVRRPVGKTSAPLYSYFALVADDPSVQIVSNAQTWYIKDMLKEGQYKDLPVLSAAAPFKSGGRGGADYYTDVPAGDIAIKNVADLYLYPNTVQAVLINGAQVKNWLEMSAGMFNTVEAGAKDAPLLNPDFPSYNFDVIDGVTYQIDISKPAKFDKDGKAVNPDSNRIVNLQFNGKPIDPEQKFVVATNNYRASGGGKFPDIAGDKVIFVAPDTNRDVIVRYIIDQGTINPSADANWSFAPVENTTAVFETGPKGRHYAADIKGARIEDAGDGAEVAAVTVTADESQANHVAPQHGRIPEQVQAIQKAAEFSLGKTLPGGNFCPEIPEAQFLMRPAGRPLHQPAGGIKATNGLQHPALIDGWQQLRLSGCAFGGKDA

SEQ ID NO: 226173 - protein, 115 aa, Glycine max
  Coding DNA Sequence Number=SeqID_109395
MMAHQNSPYLAFCTPGQNETKNKIQGYQREANENIHIFLNEHQGMKGMVSFKTRKGKQGSKGLSKELSQGKSIWLEAYKNKIASVISKYACELGSINKNQAKAIVHAINGAKHTK

SEQ ID NO: 226174 - protein, 77 aa, Glycine max
  Coding DNA Sequence Number=SeqID_109396
MQVGSATFIIRVIKHSGKLQEHSAVHCGILQVASRFQDVKTSHVTSAFCSPCLHAPTAVKQFTAASSLQHLLSAISY

SEQ ID NO: 226175 - protein, 584 aa, Glycine max
  Coding DNA Sequence Number=SeqID_109397
  Gene Ontology: Mol. function=lithium ion binding; Cellular component =integral to membrane; Biological process=calcium ion transport
  Homolog annotation: Hit_ID=Q1SQ50; Match level="QueryCoverage=96%, HitCoverage=96%, E-value=1e-139, Identity=48%"; Hit description =Sodium/calcium exchanger membrane region
  Pfam annotation: Domain name=Na_Ca_ex; Domain location=125-259; Score= 99.3; E_value=1.1e-26; Accession=PF01699.14; Description =Sodiumcalcium exchanger protein
  Pfam annotation: Domain name=Na_Ca_ex; Domain location=431-574; Score= 124.2; E_value=3.8e-34; Accession=PF01699.14; Description =Sodiumcalcium exchanger protein
  Pfam module annotation: Pfam domain module=Na_Ca_ex::Na_Ca_ex; Domain location=125-259::431-574
MARFIYYDTKPRSKKLLLLLNISFIYLTFLFLKTYLHPSSSPNIVHASTKIFNHARMLSDISVDGCTDLHKYSDYDSKCLYVKSNVHCRSKGYINYLQIFYCSFGHSPILGHSLLVMWLVVLFYLLADTASNYFCNNLEGLSDILRLSPTIAGVTLLSLGNGAPDFFASVVSFTRSNDGAVGLNSILGGAFFVSSAVLGVISFLVRANEIAIDKASFIRDVIFFLFSLFILLVIISIGKITLLGSICYVSIYFLYVCAVSATYFIYGGDRTECELVSSSEDLTESGIPLLGCVDDEKSNVSNKEVIKDNNGDKQKCFGYDSFDFTYLSKFLQVLELPLSLPRRLTIPVVSEEGWSKPYAVISVTLAPVLFATLCNTQMENVSSKSSLVSYLTAALIGIVLGNMACVTTKSTSPPRKCLFPWLAGGFSMSVTWTYIIAEELVSLLVAIGSVIGVSPSILGLTVLAWGNSLGDLIANGAMAKNGGADGAQIAVSGCYAGPMFNILMGLGLPLVLSAWSEYPDSYVIPKDPSLYATLLFLMGGVLWALVILIKKKMKLDKSLGVGLLTIYLCFLFIRMAIAIGVIKF

SEQ ID NO: 226176 - protein, 214 aa, Glycine max
  Coding DNA Sequence Number=SeqID_109398
  Gene Ontology: Mol. function=transcription factor activity; Cellular component=intracellular; Biological process=regulation of transcription, DNA-dependent
  Homolog annotation: Hit_ID=Q07164; Match level="QueryCoverage=49%, HitCoverage=31%, E-value=3e-43, Identity=81%"; Hit description=ORF, complete CDS
  Pfam annotation: Domain name=LacI; Domain location=112-137; Score =31.9; E_value=2.2e-06; Accession=PF00356.11; Description=Bacterial regulatory proteins, lacI f
IALAVKSVPFEDIVFVQYPTGADYDDPNKVVPNYEAATALWDAIEANAQLQITHQNNSNDGVVVKEPTAPVEQATPNPSATPTDVVALPDSIKGNSAAQETCSNGNADPMSKRLAEVARKVGVSEATVSRVLNDKPGVSDATRQAVLTALDVLGYERPTKLRGERARLVGLVLPELQNPIFPAFAEIVGGALTQNGYTPLLCTQNAGGVTESDY

SEQ ID NO: 226177 - protein, 76 aa, Glycine max
  Coding DNA Sequence Number=SeqID_109399
  Homolog annotation: Hit_ID=Q7XIR5; Match level="QueryCoverage=50%, HitCoverage=11%, E-value=5e-07, Identity=61%"; Hit description =Serine/threonine-protein kinase bub1,checkpoint-associated-like protein
MATTPTKKVVDEVPNHDSQARMPITPTKRSSVEAYPLASQCSENQKLCNLPRIMCDMERDADQSLFPNQQDKDLTR

SEQ ID NO: 226178 - protein, 203 aa, Glycine max
  Coding DNA Sequence Number=SeqID_109400
MQGPYWITGVRGPCKQLTLGCGQKSVMSMVYSELCSWLAIVLGCIVGQCLVSETIPRHRDYRSSPPRQKESLKKKLLISLNELENLKPVVQQKINELNSKLAYQQNGQGKFSSNNSLDFSPVKKQTSASYGLIKAVRPTAGEFVYQGSRSQPFSYVRPVEEHARRLYNISFSWVIPAMGEELGSNRESEGLFSESRIELYREA

SEQ ID NO: 226179 - protein, 96 aa, Glycine max
  Coding DNA Sequence Number=SeqID_109401
MRKGQSINYVIQRKIMQSTKLTELCARLAFPKQATSSVVANLNKVAQQVGDTRVVDKAEVVRPPKLVTRSKVKRRDNLSKEVSSLSVEQQGMPKKQ

SEQ ID NO: 226180 - protein, 84 aa, Glycine max
  Coding DNA Sequence Number=SeqID_109402
  Gene Ontology: Mol. function=RNA-directed DNA polymerase activity; Biological process=DNA integration
MADPGREHWSVVKRLIRYIKGSLNVALCFRGPNFVVEGWTMSWLSKLQTVVALFTIEAEYMAATEACKGAIWIQRLLEELGHRQ

SEQ ID NO: 226181 - protein, 178 aa, Glycine max
  Coding DNA Sequence Number=SeqID_109403
MHDRSNNETDPVMPPGPSWTGPTGQAKPDFTTMLTTMVLNYLYTFVISYSRYLESIFNQYAAKYSGLELLLDILESTSVKQKGNASAALHKLAGKASSSVSLFDAAPPSTSHQDISVESVSLMYKMSEDFNDTKLKHACILFMLENFDKPRLEAWYCHVVPGIRMFLTYQVSSIQLDL

SEQ ID NO: 226182 - protein, 79 aa, Glycine max
  Coding DNA Sequence Number=SeqID_109404
QSKLNIRFLTVVYGSPSYQKQKSLCNTVEMTNEAWAIVGDFNTILNSHDPSGVSTNPSWRGAQDFQRMIQECDLVDAGF

SEQ ID NO: 226183 - protein, 163 aa, Glycine max
  Coding DNA Sequence Number=SeqID_109405
  Homolog annotation: Hit_ID=Q1S6B9; Match level="QueryCoverage=98%, HitCoverage=42%, E-value=3e-34, Identity=46%"; Hit description =Senescence-associated
LYPSINYNDLAENIFPEDATVVGSPSAPPEATEKAVLRILAAILNLIGKDYSVELACDDFSDATVVKVNYLHYFFSFCIPKGSDPDKEEEDMLSYGLTIMLNGQERLLKELDAAILEDCSCFSVRSISENVKKKEEAMDCFMGRENSSKDLELRKKMMDGRFH

SEQ ID NO: 226184 - protein, 209 aa, Glycine max
  Coding DNA Sequence Number=SeqID_109406
  Homolog annotation: Hit_ID=Q1PFE0; Match level="QueryCoverage=36%, HitCoverage=13%, E-value=1e-15, Identity=62%"; Hit description =Mandelonitrile lyase
  Subcellular localization annotation: CTP_CleavageSite=44; ConfidenceScore=5.83e-01
MPSQLMPSHMPPSCSTESSPSSRRRSASPSQFSFAPERSLTLPLATSPSPSSLTTSVTLARSLLPSPSSGSFSSATSPTVLSHLTPSSKASTSTTSFPSCSNFTMKWLQMALNSTKSLGVGDGKEITVGSVVEAGVDGVAATKNVATRVGDSLLGNESLGGRVSGFGVQEVGQEAFLVDQSWGRCDQHFDVPAKAPETTSRLERERENE

SEQ ID NO: 226185 - protein, 141 aa, Glycine max
  Coding DNA Sequence Number=SeqID_109407
  Subcellular localization annotation: CTP_CleavageSite=50; ConfidenceScore=5.30e-01
MGKKIFKRIPSFKKYTPNLKDSTPVTKPNPVNSNTSTLNSDNCEPYLICRDPMVMQQIERKPVIGQVDEKKHMFLGQFGPLPHHLQAPSTTPYPNFWDQNNVEDYTFANENWDDLRSVVQFAIDPSTVFDCTGTYIPPYFS

SEQ ID NO: 226186 - protein, 69 aa, Glycine max
  Coding DNA Sequence Number=SeqID_109408
MRQLCTELRATTLEGKLMKEFLVQIKAISDSLISVGSPIMLQEHIDSILEGRVGGFNRDGGGGGRCSGD

SEQ ID NO: 226187 - protein, 68 aa, Glycine max
  Coding DNA Sequence Number=SeqID_109409
MAKSQFRSDKACFTFSGGVLDGLGEEEEVFEDEDFVILVFNDEGIKVFNDVEGKYWKTEQEQHKILTD

SEQ ID NO: 226188 - protein, 261 aa, Glycine max
  Coding DNA Sequence Number=SeqID_109410
  Homolog annotation: Hit_ID=Q1SGH7; Match level="QueryCoverage=30%, HitCoverage=21%, E-value=2e-10, Identity=46%"; Hit description=Zinc finger, RING-type; Thioredoxin-related
MQWLDFGFGGWGFRNWGLGVGGGGCLVEHDGNDVVEVEAFDEGVKCDNTVGEVALEKLPEEGEGKSDLANVTEVVNEDGEGDVARGNVRLRSGAKENCDGEALRLREEGEDSVEHDGGMEDEESSFKLYYDGFNDEGLHPLPSTMSKFLLGLGFDRLLQQVSQIEINDFTFRSNQIVLLRAVIWRQAKAAHGGHRWSVVVEEDFGSVGGGFRGREGGRRWLFYAAGRADPAPIFMLRNPKTIFEDDPTVNESGVRILLKYV

SEQ ID NO: 226189 - protein, 79 aa, Glycine max
  Coding DNA Sequence Number=SeqID_109411
MDEECYLLSYASIDLAGNSSSNKFRGQLLKLGLGKDDSQIANSRLCLLIKGRIYAAIFCDSDEFRTLNQVLGFATAQQE

SEQ ID NO: 226190 - protein, 211 aa, Glycine max
  Coding DNA Sequence Number=SeqID_109412
  Gene Ontology: Mol. function=transcription initiation factor activity; Cellular component=nucleus; Biological process =transcription initiation from RNA polymerase II promoter
  Homolog annotation: Hit_ID=Q2HS28; Match level="QueryCoverage=97%, HitCoverage=64%, E-value=5e-56, Identity=55%"; Hit description =Transcription factor IIA, helical
  Pfam annotation: Domain name=TFIIA; Domain location=8-209; Score= -76.2; E_value=2.5e-05; Accession=PF03153.4; Description =Transcription factor IIA, alphabeta subunit
MAASTTSQVYIQVIDDVVNKVRDEFVNNGGPDDEVLKELQSMMQAGAIVGLIERSGAPKPTPGGPITPVHDLNMPYEGTEEYETPTAEMLFPLTPLQTPLQTPLPGTVDNSMYNIPTGPSDYPSAGNEPGANNEIKGGRPGPYMNQNQRAPLDVNIGRDEAERGASNQPLTQDFFMSSGKRKHDEIASQYNAGGYIPQQDGAGDAASQWHL

SEQ ID NO: 226191 - protein, 150 aa, Glycine max
  Coding DNA Sequence Number=SeqID_109413
MDSWSGCSQFVSDRTISDHYPFLRNSNLDCGPKPFKSSIVGSLVKASYKKWNCWNKESFKDIQNQGKELLAKINFLDAKDEVIKRKQKSLLHQKARIRWLREGDGNSKLFHYTINWRRRLNGVKGIEVHESWVEELLLVKRGVKGVLPKE

SEQ ID NO: 226192 - protein, 91 aa, Glycine max
  Coding DNA Sequence Number=SeqID_109414
  Gene Ontology: Mol. function=transferase activity, transferring nitrogenous groups; Cellular component=cytoplasm; Biological process= ethylene biosynthetic process
  Homolog annotation: Hit_ID=Q9AVH0; Match level="QueryCoverage=70%, HitCoverage=13%, E-value=2e-19, Identity=73%"; Hit description=ACC synthase
MDFRSFKQAMENFMSEVRGGRVRFDPYRILMSGGATRAHEVIMFCLADAGDAFLVPSPYYLAHVSSLSSRLFSFNESHYFTPIKMLKVDTN

SEQ ID NO: 226193 - protein, 359 aa, Glycine max
  Coding DNA Sequence Number=SeqID_109415
  Gene Ontology: Mol. function=metal ion binding; Cellular component =integral to membrane; Biological process=ubiquitin cycle
  Homolog annotation: Hit_ID=Q8H740; Match level="QueryCoverage=72%, HitCoverage=85%, E-value=5e-55, Identity=45%"; Hit description=RING -H2 protein
  Pfam annotation: Domain name=zf-C3HC4; Domain location=139-180; Score= 16.1; E_value=0.0034; Accession=PF00097.15; Description=Zinc finger, C3HC4 type (RING finger)
  Subcellular localization annotation: CTP_CleavageSite=82; ConfidenceScore=5.77e-01
MASPPPLSLNVVGSDIDPNTNTFPTVTSSLTPPSPRRSSPLQNLSPSILIIVTVLAVTVIVSLALCFLLRHLNRRCLRRFSSSSAAPSAAATPIFASSRRISPEILHSSASASASVIDTLPLFTFSSVTRRSAAVSGDCAVCLSKFHHHDLLRLLPLCCHAFHAECIDTWLQSNLSCPLCRSTIVADDSDLAKILRPPSSAGSSDSFRLELGNISRRGTDGAAEGGSVARGGSRSYSIGSFEYLIDDESEVPFSHARRRSVDDAKEFPAPAEAPVSHNEASLAGEVGGVRSWLKEYMDRVSVSISSRTASFRGSGRFFSGGGSSDRRSDIVPVAAPEYDAEGNRIGEEISEMFRWLSGV

SEQ ID NO: 226194 - protein, 77 aa, Glycine max
  Coding DNA Sequence Number=SeqID_109416
MVNYDFHVVAGGDKPSATLVVQKADVVTLDNPKSQFFFYPRSFLHSHCRHRERKRERRNVTKVVRLTSLLRRACTAS

SEQ ID NO: 226195 - protein, 781 aa, Glycine max
  Coding DNA Sequence Number=SeqID_109417
  Gene Ontology: Mol. function=RNA-directed DNA polymerase activity; Cellular component=chromatin; Biological process=chromatin assembly or disassembly
  Pfam annotation: Domain name=RVP_2; Domain location=317-445; Score= -23.0; E_value=6.2e-05; Accession=PF08284.2; Description=Retroviral aspartyl protease
  Pfam module annotation: Pfam domain module=RVP_2::RVT_1::Retrotrans _gag; Domain location=317-445::571-740::94-184
MADHGTRKTTTDRLEDAIARLTNSQANLNERYTDLSRKVDSILDHLKLRDHHQNQPPSNSSNHHRNSVKLDIPCFDGRDPLGWIFKMNQLFQYQNTSYPLDGAALSWYQWMFTNGLITSWQGFLQALESRFAPTFYDDPKGALFKLVQRGSVNDYLTEFERLANRVIGLPPPFLLSCFISGLNPELRREVLALQPISLLQATALAKLQEEKLRDKRTPPPQSSQPLPSNSSTNLNPKSKTPYVQRTPEDMAFRREKGLCYNCDDKWSPNHRCKGRILLLVADTSPSDDGDPSLDTTISILEANEGEPEKVPDTSFPHVSLHAMSGLSSSETFRVYGTVRNARITVLIDSRSTHNFLQTRIAQFLHLPVENTPPLRVLVGNGSMLDCNQRCVDTLLTIQGHSFPVTFHLLQISGADVVLGIDWLKQFGPITTDYSSFIMRFSHLGQDVSLQADVASGLEPASTTQVKRLVRTGSTFALFHLCVFPDTSPNHTVGHPSPLPEPVARLITQYERLFQTPTRLPPLHEVTHHITLLPSTAPVNVRPYRYPYFQKTEIEKQVSELLSAGLIRMSTSPYSSPVLLVKKKDGTWRMCVDYRSLNAVTVRDRFLIPTIDELLDELGNASWFSKLGLKQGFHQILMHEADIEKTTFRTHQGHYKYLVIPFGLCNAPSTFQAAMNLLLAPFLRRFAAVFFDNILVYNSSLSAPIQHLELIFQALLHGQYFLKKTKCLFAQNQLEYLGHIVFGKGVTPEPSKLQAITQWPIPTSAKELRAFLGLTSFYRKFI

SEQ ID NO: 226196 - protein, 311 aa, Glycine max
  Coding DNA Sequence Number=SeqID_109418
  Gene Ontology: Mol. function=hydrolase activity, acting on ester bonds; Cellular component=cellular_component; Biological process =lipid metabolic process
  Homolog annotation: Hit_ID=Q67ZI9; Match level="QueryCoverage=89%, HitCoverage=80%, E-value=3e-97, Identity=61%"; Hit description =Putative GDSL-motif lipase/hydrolase
  Pfam annotation: Domain name=Lipase_GDSL; Domain location=1-286; Score=100.0; E_value=6.9e-27; Accession=PF00657.12; Description=GDSL- like LipaseAcylhydrolase
GNNNFIPTIARSNFEPYGRDFFNGNPTGRFSNGRIAPDFISEAFGIKQSVPAYLDPAYNISDFASGVCFASAGTGFDNATARVADVIPLWKEIEYYKEYQKKLRAHLGDEKANEIIREALYLVSIGTNDFLENYYTLPERRCEFPIVQQYEDFLLGLAESFFKEIYGLGARKISLTGLPPMGCLPLERATNILEYHNCVEEYNNLALEFNGKLGWLVTKLNKDLPGLQLVDANAYDIILQIVKHPSRFGFEVADTGCCGTGRFEMGFLCDPKFTCEDANNNHATSIEDKPRTTIRPVRVTTKPRYLQDYVS

SEQ ID NO: 226197 - protein, 221 aa, Glycine max
  Coding DNA Sequence Number=SeqID_109419
MKQGVPCSDTLLHDSNSDFEFSTSTCLEFESSSADELFSNGVILPIQMQDKTTARKLTHHVKYPHTKLPPRPCASSVDKVKKETIRELLDVNPDHEKKPHSKSFWGFNRSKSLNCDTKKNLVCSIPLLSRSNSTGSVANPKRVSSNKHPSAAKSSSYSFSTLNMYPMQKSPSGKSYGGSYPKGLRINPVLNVPTPCVSKGSAHLFGLGSFLRVGKVKKSKK

SEQ ID NO: 226198 - protein, 147 aa, Glycine max
  Coding DNA Sequence Number=SeqID_109420
MVKGEVENVATWTTPHKREVRTKSTYTEAQSYNEDIKLSSNPTATMAARLAVRSVTLRLPQDWHVPQKPKKVLGLTTSSQNRPTYSIEQHRLDEMYLGNKKRVVTVFGAMENNKLRCKTDRGYTEMKRCDRAYMEMKRREQNSSRMI

SEQ ID NO: 226199 - protein, 128 aa, Glycine max
  Coding DNA Sequence Number=SeqID_109421
  Homolog annotation: Hit_ID=Q9XH46; Match level="QueryCoverage=31%, HitCoverage=34%, E-value=2e-08, Identity=68%"; Hit description=Tha4 protein
MVESFPFLVLGSKNWPFLKILSLPFARWCDLQHKEWRELVVMQYESKATYWKLFTVLSMLRSTSGNFLGTPTITTSLGTPKSNMALQLKPLFLHRPFTATLAELNNLGVPKHKDEEDLTLIAPLITEL

SEQ ID NO: 226200 - protein, 69 aa, Glycine max
  Coding DNA Sequence Number=SeqID_109422
  Homolog annotation: Hit_ID=Q2PCF1; Match level="QueryCoverage=62%, HitCoverage=3%, E-value=1e-07, Identity=63%"; Hit description =Pleiotropic drug resistance protein 2
MAVKESSEMASSLNQEPRKGMILPFQPLSLAFNHISYYVDMSAFAYAFLTLACYDYKNFLLADVLSVPR

SEQ ID NO: 226201 - protein, 82 aa, Glycine max
  Coding DNA Sequence Number=SeqID_109423
  Subcellular localization annotation: CTP_CleavageSite=33; ConfidenceScore=5.07e-01
MKAWHTCRVHGKSLDSYRKLRGPRDKTVRLHTRCVNRSRSVWGPRKSSDVAQNLEMSFVHPSQSKFDILFSRILNGVGDKIY

SEQ ID NO: 226202 - protein, 432 aa, Glycine max
  Coding DNA Sequence Number=SeqID_109424
  Homolog annotation: Hit_ID=Q9SCP2; Match level="QueryCoverage=44%, HitCoverage=40%, E-value=5e-92, Identity=82%"; Hit description =Probable pectate lyase 12 precursor
  Pfam annotation: Domain name=Pec_lyase_C; Domain location=143-326; Score=157.0; E_value=5e-44; Accession=PF00544.9; Description=Pectate lyase
  Pfam annotation: Domain name=Response_reg; Domain location=11-115; Score=23.6; E_value=5.2e-05; Accession=PF00072.14; Description =Response regulator receiver domain
  Pfam module annotation: Pfam domain module=Pec_lyase_C::Response_reg; Domain location=143-326::11-115
MDELNCAMTKMGEVSAADGAQSAAFIAVPDGLKAWEMLKKKAPELDLILTEVELPAISGFALFSLIMEHDICKRILVIMMSSHDSVNMALKCMLNGAINFLIKPIRKNELRNLWQHISTPTQNTTFSPKKLKTASEDNSASNKSNGSMASSKKNNECSERLSEAQKPQVCKLLCRALVHHQLWKLRVWILDTNGQSSPEHYGFQTESDRDGISIFGPKDIWIDHYTLSRCKDGLIDAVMGSIGITINNMLSHHNEVMLLGHSDDYLPDSGMQVTIAFNHFGEKLVQRMPRCRRGYIHVINNDFTEWEMYAIGGSGEPTINSQGNRYMAPENPFAKEVTKRVDTQQSKWKGWNWRSEGDILLNGAFFVASGEELEVKYEKTYIVQGLFCKIAKIAMVILECDVGYWIVHVTLKFPTMHFINGVTLKFNGKTIL

SEQ ID NO: 226203 - protein, 309 aa, Glycine max
  Coding DNA Sequence Number=SeqID_109425
  Homolog annotation: Hit_ID=P49208; Match level="QueryCoverage=19%, HitCoverage=28%, E-value=1e-21, Identity=91%"; Hit description=50S ribosomal protein L1, chloroplast precursor
  Pfam annotation: Domain name=Ribosomal_L1; Domain location=155-299; Score=-94.8; E_value=0.0029; Accession=PF00687.11; Description =Ribosomal protein L1pL10e family
  Subcellular localization annotation: CTP_CleavageSite=76; ConfidenceScore=5.03e-01
MLDLFSAATCSADFGLGMRLCFWVGHSGFYSLGSLLPFSLLLQFKVGLLCMSLFHSFSLPSIFFNNLSSFSSTGKRCVKPSKVTKDIHTDREKLMFKLATLPFLDSYWNQVASVLNILDDELIKNVGDYILRLIVLSLPQQRRSKRSLEIQQLRERKKEYDLKTAISLVKEIAKTNFVETVEAHFRLNIDPKYNDQQLRATDISVIQICHHEQVRTITGFEEDICVIQICHHEQVRATTGFEEDIPVIQISYHKQVRATTRFGELAANAILAVSLAVCRVGVAVLKVPLYKAVENLSTADIQLEKKGAE

SEQ ID NO: 226204 - protein, 184 aa, Glycine max
  Coding DNA Sequence Number=SeqID_109426
  Gene Ontology: Mol. function=zinc ion binding; Cellular component =cytoplasm; Biological process=ubiquitin cycle
  Homolog annotation: Hit_ID=Q1SUW3; Match level="QueryCoverage=59%, HitCoverage=10%, E-value=2e-59, Identity=96%"; Hit description=Zinc finger, RING-type; Zinc finger, CHY-type; RINGv
MAKYYCNICKFFDDERNVYHCPFCNICRVGQGLGIDYFHCMKCNCCLGIKSASHKCLEKGLEMNCPICCDDLFTSSATVRALPCGHYMHSSCFQPLHMSNLQQITGRYGGVLERGSSFGNHFVGSSLLLLGAHLAVSLPIQVYFGMLDALLAAEELPEEYRDRYQLFEREKEKLQEQPYCSKQR

SEQ ID NO: 226205 - protein, 179 aa, Glycine max
  Coding DNA Sequence Number=SeqID_109427
  Gene Ontology: Mol. function=small GTPase regulator activity
  Homolog annotation: Hit_ID=UPI00005A2256; Match level="QueryCoverage =80%, HitCoverage=16%, E-value=2e-11, Identity=30%"; Hit description =PREDICTED: similar to TGF beta receptor associated protein -1
MTFGTVVARPGELMLTPEVTGSPRRGGSFRLKKLEDSEAAEQYCAEIGRADAYMQLLEMYLDPQDDKDPMFTAAVRLLHKHGESLDPLQVLEKLSPDMPLQLASDTLLRMFRARVHHHRQGQIVHNLSRAVDIDARLSRLEERSRHVQINDESLCDSCDARLGTKLFAMYPDDSVVCYK

SEQ ID NO: 226206 - protein, 350 aa, Glycine max
  Coding DNA Sequence Number=SeqID_109428
  Homolog annotation: Hit_ID=UPI000065D1A4; Match level="QueryCoverage =74%, HitCoverage=26%, E-value=6e-09, Identity=22%"; Hit description =Homolog of Homo sapiens "TGF beta receptor associated protein-1
MWDFLIPSLQVPRNRYWGLHPPPAPLEDVIDDGLMTIQRASFLRKAGVETIVDSDLFLNPANRADLLESAIKNISRYLEACREKDLTESVREGVDTLLMYLYRALNSVEDMERLASSINWCVVEELEQMLEESGHLRTLAFLCASKGMSSKAVHIWRILARNYSSGLWKDPSLENITQNSGENLISGRAIAAAEASKILEESSDQELILQHLGWIADISQVLAVNVLTSDKREIQLSPDEVVTTIDPQKVEILQRYLQWLIEDQDCNDTQLHTLYALSLAKSAIKAFESENISENLDSGNIGTRSLAMLKNSIFKIPVRERLQIFLQSSDLYDPEEVHDLIEGSELWLEK

SEQ ID NO: 226207 - protein, 675 aa, Glycine max
  Coding DNA Sequence Number=SeqID_109429
  Homolog annotation: Hit_ID=Q1RVN3; Match level="QueryCoverage=44%, HitCoverage=50%, E-value=3e-19, Identity=25%"; Hit description =Nucleotide-binding, alpha-beta plait
  Pfam annotation: Domain name=RRM_1; Domain location=71-141; Score =34.5; E_value=3.7e-07; Accession=PF00076.12; Description=RNA recognition motif. (a.k.a. RRM, R
MRERERHRERERVRRERNIGRGRDTLRGKRVWRERVSFGEASRRSYAGNTGRVALTHTVTNWRDHKDITSLYFSRFADDITEKELWYHFKRWGDVREIFIPKRRNLAGRRYGFVRFKGVQDIPYLVRKLDSIVIGGLKLFVNLPKYGREIRRETAGTIQTKGVVRNRHSTPTSYADALRRNINCVGDQKTSFTPTKQNTSSSVVHIEVKPEDTLWLKEAWVARLKNPALFERMEEELLWEAGMDVNPTFLGDDQVLLLGLSENDAHQLINGGRTLLFSSTERWRPNIRVDYRLTWIQCWGIPVQAWNPKHINQIVAVMGEMVDLDDSVEEKRRLDKARVLIWTQWRPLIQHTMQVMIDDDKFTVHIIEESCQGHLDCLRRRGNVGGSSEEINSDDTMLDSSSHINWDPGDNVSNLPELESCSNLHGVVPQNSVGAEEQGGPTRPCPSASELRSARQGEVATSSQSTEVQDTGYLPAGYKEGRDPLDTYPQSIPETCVTPLPGQNFKSSFQAMETNTERRQQVSLCARNVEAKEHHQNGNGGNGRSRGVIYGQKESHAEDRHVALAEDRTDTCDKSKYSELEGHITDKTPRTAHNGEHIPIYTPKEKNYLLGLQTQEGLDGNLWQVYSKKRRCQKQPNTGFLPSNSRSTAIIGDTQQQHNDNSTQLEAIHKDILQQ

SEQ ID NO: 226208 - protein, 395 aa, Glycine max
  Coding DNA Sequence Number=SeqID_109430
MAKVESSSSISMSMSRVVLEPHAQFDLTAHSRASSIRSLAIAHSKRHHTTLFYVGTHSGTLFSLSAEDSNYTDDDAVLRKLSFLRSVSVSDTAVESISVIEEFGKLLLLSDGALFLVDSELSNGATKLSFPKGVSLVTRRRFRNNGGGESEGFGSGLGSGSGLGLFQKLRMNSMKEVDVQSETGGGFVFAVVVGKRLILAELVLGNRNGKTERDDGGGGTLVILKEIQCVDGVVSAMVWLNDSIVVGTVNGYSLISCVTGQNSVIFSLPDVSRPPRLKLLHKEWRVLLLVDNVGVIVDPHGQPVGGSLVFRHGLDLVGEIDSYVVVVSDGKIELYHKRHCGCVQVLPFGGEGVGRCVVASEEDRGGRLVAVATATKGSTQWINVLLGLWINGLLR

SEQ ID NO: 226209 - protein, 449 aa, Glycine max
  Coding DNA Sequence Number=SeqID_109431
  Gene Ontology: Mol. function=RNA-directed DNA polymerase activity; Cellular component=chromatin; Biological process=chromatin assembly or disassembly
MSPLHVLVGNGSVLDCNQVCPDTSLSLQGHHFTVTFHLLPISGANVVLGIEWLRQFRPITTDYTAFSMKFTYMGRPIELHVDITTGPKPISAPQVKWLLQTGSASALFHLKMVPNPQPDPQLHLPHLIPVVEALLTHFHHLLQQPSSLPPPRSIVHHINLLPNTTPINPSMSPYSSPILLVKKKDGTWRMCVYYRALNAATVRDRFLIPTIDELLDELGSTAWFSKLDLRQGFHQILMHGPDVEKMAFRTHQGHYEYRVMPFGFCNAPSTFQAAMNILLTPFLRKFAAVFFDDILVYSRTLSLDLQHLEFVFQTLLQGQYHLKRTKCLFAQKQVEYLGHIVSGKGVEPEPSKVQAMVQWPTPSSAKELRSFLGLTGFYRKFIKNYAMIAAPLTSLFAKDSFEWSLDAQSAFEQLKAAMKTAPVLALPDFEEPFVIEADAFGADMGAVLM

SEQ ID NO: 226210 - protein, 112 aa, Glycine max
  Coding DNA Sequence Number=SeqID_109432
MLRRQVAGSRCCLFGPCFCGFGPSSGIHEVIAIIRRPLPRCLRRIFLRSGGTRMKFEACKKATSGLSVACFGKTLAPPCLNSNRVISLRSLLPERIVSIDGHLGMFLWESCA

SEQ ID NO: 226211 - protein, 184 aa, Glycine max
  Coding DNA Sequence Number=SeqID_109433
  Gene Ontology: Mol. function=chromatin binding; Cellular component =chromatin; Biological process=chromatin assembly or disassembly
  Homolog annotation: Hit_ID=Q1SAV4; Match level="QueryCoverage=52%, HitCoverage=42%, E-value=1e-16, Identity=43%"; Hit description =Integrase, catalytic region
  Subcellular localization annotation: CTP_CleavageSite=66; ConfidenceScore=5.08e-01
MRPPSKPNPRRLLGHSLHDFSGTTYEEAKALRAFTRTATVFVAGIRINASLSVNPTYAVRSRGLVRGREGMGNLASREGDCYQYPHPRRPPCPQGGEGLELLTTVPRWCPQGVDPTIALARVALVETMMCQDHDARVGVNNGIRGGSLPPQLNIDPLADAEGHVAALVIRQSLHGVLCLLKTML

SEQ ID NO: 226212 - protein, 786 aa, Glycine max
  Coding DNA Sequence Number=SeqID_109434
  Gene Ontology: Mol. function=protein serine/threonine kinase activity; Cellular component=cell surface; Biological process =protein amino acid phosphorylation
  Homolog annotation: Hit_ID=Q1SDE2; Match level="QueryCoverage=87%, HitCoverage=99%, E-value=0.0, Identity=70%"; Hit description=Protein kinase; Curculin-like (Mannose-binding) lectin
  Pfam annotation: Domain name=B_lectin; Domain location=70-175; Score =37.4; E_value=5e-08; Accession=PF01453.15; Description=D-mannose binding lectin
  Pfam annotation: Domain name=Pkinase; Domain location=490-764; Score =182.3; E_value=1.2e-51; Accession=PF00069.15; Description=Protein kinase domain
  Pfam annotation: Domain name=Pkinase_Tyr; Domain location=490-764; Score=139.6; E_value=8.5e-39; Accession=PF07714.7; Description =Protein tyrosine kinase
  Pfam annotation: Domain name=S_locus_glycop; Domain location=182-315; Score=-26.4; E_value=0.0032; Accession=PF00954.11; Description=S -locus glycoprotein family
  Pfam module annotation: Pfam domain module=B_lectin::Pkinase::Pkinase_ Tyr::S_locus_glycop; Domain location=70-175::490-764::490-764::182-315
MSSAIFLPFILSLSLSLSLLNGLDVIQLNTNITAGSNSTWKSPSGDFEFGFYDLRTGLFLVGIWFGKIPDRTLAWYFQSPPVEANSQIQFTSAGNLVVAYPNQTIAQTIYSGGAATSSYMQDDGNFVMKDSNSESVWQSFNSPSNTMLPGQTLQSTKVLYSKERGDSNYSLGKFMLQMQDDGNLVLKAYQWSGPAYWYNSTNTPNVNLEFNATSALMHFVSGSRSIYTLTKSTSTPVEDYYHRATIDENGNFQQYAYPRRNENDTTGWRRVWRAVEDPCRVNLVCGVYGLCTSPDNESVKCECIPGYIPLDHQDVSKGCHPPDTINYCAEKKFKVEVFGDTDFQFDNNFVRVYDVDLEGCKKSLMDDCNVIAATYNTSTRTCAKKRLPLLNARNSSSSKGQKALLKVPNSVDDGRSNKATNKKSFNVRIFLKVMLAVTATLACFFGALVVYYHPFTQRLARRKRYLNASAIGINFREFTFQELHEATDGFTRILGRGSSGKVYHGTLIIDDAVIGIAVKKLEKKIEKSESEFMTELKIIGRTHHRNLVRLLGFCIESSHRVLVYELMTNGALSSFLFGEGERPQWGQRIEMALGVARGLLYLHEECHTQIIHCDIKPQNVLLDSNHTAKIADFGLSKLLLKDQTRTSTNLRGTIGYMAPEWLKSAPITAKVDIYSFGVMLLEIICCRRHFESPHDANDSEDDDLVLSNLVLRSVVSRKLEVVVRHDSEVLNDFKRFEEMALVGLWCVHPNPALRPSMKHVMQMLNGTVEVGIPPLVYDQMMEDQGL

SEQ ID NO: 226213 - protein, 199 aa, Glycine max
  Coding DNA Sequence Number=SeqID_109435
MTSALRPLASVVGLFAAALLVAGCTAGPGAQAPTNSPAPEADAGDDRDDMDGTLLDDGRMFAVITIGSSTCVPQVADVAADGQTVTVTLADPEGESPQPCTKDLAPRASIGALPDGVDPTKDITLNVTYGDLTDDVDIDGDPEATGTPGSTTEFLPSAGWVDDGLVLLTWGSSSCAPVVESLEGSGTAGTVTFATDEDQ

SEQ ID NO: 226214 - protein, 33 aa, Glycine max
  Coding DNA Sequence Number=SeqID_109436
  Homolog annotation: Hit_ID=Q6ACR2; Match level="QueryCoverage=84%, HitCoverage=5%, E-value=6e-07, Identity=92%"; Hit description =Cardiolipin synthase
MERGGETGEVVEHRRTQRLLHPLLQRQLTDDRA

SEQ ID NO: 226215 - protein, 66 aa, Glycine max
  Coding DNA Sequence Number=SeqID_109437
MEIEASASPRRVIDVEKRHGQEQSFSSLLHIGGYITKLLIKTQTLRAKHDAVPCVVAQPRHHRFSI

SEQ ID NO: 226216 - protein, 80 aa, Glycine max
  Coding DNA Sequence Number=SeqID_109438
MVLRRCEAPPISRFLPFLYLRFLRHQFIAKEKIKICKSLEQDQKSIKQKATSRIKTHESLCGADMLGILVFVPDRGLRNA

SEQ ID NO: 226217 - protein, 172 aa, Glycine max
  Coding DNA Sequence Number=SeqID_109439
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=67%, HitCoverage=13%, E-value=6e-22, Identity=49%"; Hit description =Receptor-protein kinase-like protein
MRLLSIMTTSLTLFFIFLFLSIHLQATILTEAATQDPSVNQVPYTTARLSRSQFNYFFPVSASPKFIRLFFYLAYYPSFPHTDASFSVQSNGFTFLKGFNASLNADTEATKTIFREYVVNVNDGEILILSFTPSQPNSYAFINGIEVQGGEKEKKMGLSLVSVEKKRRKWDL

SEQ ID NO: 226218 - protein, 229 aa, Glycine max
  Coding DNA Sequence Number=SeqID_109440
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=89%, HitCoverage=25%, E-value=4e-45, Identity=53%"; Hit description=Chromo
MEPELALLLHTYSVVFATPINLPPRRSHDHSIPLLERSQPIKVKPYRYPHSQKEEIEKLVSGIAMDANKLEVVQNWVEPMKLKQLRGFLGLTAPLIDLLKKDSFRWSQAIAQAFQQLKIAVTSALALAIPNFNEIFVLETDASRSGVGVVLSQNKHPIAYFSKKLSSRMQKQYVYTREFYAITKALAKFGHYLLGHKFIIKTNKKSLKELMEQKLQTLEQQLQHPIFRK

SEQ ID NO: 226219 - protein, 281 aa, Glycine max
  Coding DNA Sequence Number=SeqID_109441
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=20%, E-value=6e-53, Identity=37%"; Hit description=Chromo
MSLTNRSLRLSDEAFLNCFISGLNLDIRRDVVAMTPPTLLCGVALAKIFEEKYNPVPKSTCSSYIQKYSQISTTSVSVSSQPKIQNKNSLPGLLPTPQGPPLKSSNVKKISPTEMQLRREKGLCYFCDEKFYFSHKCPNRQFLFLQLEDEDVEDSSSLVVPLVVQEVETTKPNDHHLSLNASKGGVGVGTIKFMAYIDKLPMTVLIDGGKGLVKQLKVQAQGNVFHLPVFLLPISGAYLILGASWLKTIGPYIADYDALQLKFLMNGKFTTLQGHHNLILE

SEQ ID NO: 226220 - protein, 100 aa, Glycine max
  Coding DNA Sequence Number=SeqID_109442
MQMRFQTKPVDVEMEDRLEDMIHDLGQEYFQQAHAPMQGFEEMHKFSRCGVSQYKVKDDDECNNDESTMKYPPTNVLWYLPIISRFKHLSANGNDEKDLT

SEQ ID NO: 226221 - protein, 243 aa, Glycine max
  Coding DNA Sequence Number=SeqID_109443
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=68%, HitCoverage=20%, E-value=7e-15, Identity=35%"; Hit description=Chromo
ASQQQWLLKFLADDFTIQYKPGKENILTDSFMDKSTNYDAKVVVEAFINNIVKVHGFPKSIVSVRDRVFISSFWQQLFKSQDQLFSKLKVNLWKADKKRRNLQFKEVLEKNGNVTYKLKLPESAIIHPIFHVAQLKPFHGMVLDVRVVRRLEKEISQVLIQWEATEVKDAREDLQDIVNSYPQFNLKDKVVFDEKGNEKHTVEEIEHIAEGLRTLGGHESDLLSNASSSLKFSGILIIFPFSL

SEQ ID NO: 226222 - protein, 90 aa, Glycine max
  Coding DNA Sequence Number=SeqID_109444
  Homolog annotation: Hit_ID=Q1SUW3; Match level="QueryCoverage=63%, HitCoverage=5%, E-value=8e-21, Identity=81%"; Hit description=Zinc finger, RING-type; Zinc finger, CHY-type; RINGv
MRTHPIDEILLWHNAIKKELNEIAAQTRKIQLSGDFTNLSAFNERLQFIAEVCIFHSNIERESLSAMIRLLLPCDLEVLGSNSGNNLFTC

SEQ ID NO: 226223 - protein, 136 aa, Glycine max
  Coding DNA Sequence Number=SeqID_109445
MTRKVEEEEGKKKNHIHTGSGGRRRTTTTKKKKDNGDRNTERGASGSEEEEDEEVVVGREEGKLYGQISRSIYSIRVKGILDFLSSLLGVPTKMLDASREVWHNAIWLDLDSERVAQRNTIYMNLDFGMVARGDSA

SEQ ID NO: 226224 - protein, 212 aa, Glycine max
  Coding DNA Sequence Number=SeqID_109446
  Gene Ontology: Mol. function=protein serine/threonine kinase activity; Cellular component=cell surface; Biological process =protein amino acid phosphorylation
  Homolog annotation: Hit_ID=Q5MJV5; Match level="QueryCoverage=99%, HitCoverage=74%, E-value=4e-59, Identity=52%"; Hit description =Avr9/Cf-9 rapidly elicited protein 256
  Pfam annotation: Domain name=Pkinase; Domain location=1-206; Score= -5.5; E_value=3.1e-08; Accession=PF00069.15; Description=Protein kinase domain
  Pfam annotation: Domain name=Pkinase_Tyr; Domain location=1-206; Score=-68.8; E_value=3e-08; Accession=PF07714.7; Description=Protein tyrosine kinase
  Pfam module annotation: Pfam domain module=Pkinase::Pkinase_Tyr; Domain location=1-206::1-206
LLVYEKMENGTLSNFLFEKGNHRPSWESRVRIVIEIARGLLYLHEECDQQIIHCDIKPQNVLLDSSYTAKISDFGLAKLLMKDKTRTSTNARGTVGYMAPEWLKNAPVTTKVDIYSFGVVLLETIFCRRHIELHRINDETTGGDDMILIDWVLYLAKENSLRAAVVDDLEVESDFKRFERMVMVGLWCVYPNSTLRPSMKVVAQMLEGNIEV

SEQ ID NO: 226225 - protein, 113 aa, Glycine max
  Coding DNA Sequence Number=SeqID_109447
  Gene Ontology: Mol. function=zinc ion binding
  Homolog annotation: Hit_ID=Q6L4G5; Match level="QueryCoverage=93%, HitCoverage=10%, E-value=1e-42, Identity=76%"; Hit description =Putative zinc finger protein
  Pfam annotation: Domain name=Hemerythrin; Domain location=13-74; Score=28.5; E_value=2.4e-05; Accession=PF01814.13; Description =Hemerythrin
VIFPALDIRVKNVAQTYSLEHQGESDLFDHLFELLNSSIHNDESFPKELASCTGALQTSVSQHMAKEEEQVFPLLLEKFSLEEQASLVWQFLCSIPVNMMTEFLPWLFNIYIT

SEQ ID NO: 226226 - protein, 128 aa, Glycine max
  Coding DNA Sequence Number=SeqID_109448
  Homolog annotation: Hit_ID=Q9S7N8; Match level="QueryCoverage=72%, HitCoverage=97%, E-value=1e-46, Identity=100%"; Hit description=Seed maturation protein PM21
MEKQQQQAPSKETKAQSDESVKESSTEGLPMEDSPYVKYKDLEDYKRQGYGTQGHQEPKTGRGAGATEAPTLSGAAVSSDAQVAATDAINSKGFAYPAEWVNHSTANVKLGLFAGRAGPSEYDRFILT

SEQ ID NO: 226227 - protein, 907 aa, Glycine max
  Coding DNA Sequence Number=SeqID_109449
MDSNKQVNGLVLRELCNVWSHVDKLLLYALWSSSWAVVGDCHEPKCAEVTGHTTHKPSEFTRVVSLSYLRRTSRVSQVSADTCLNLCGWPRDGHWVSCHFERHDGAKGFTKGWETLIKKSLNEDRRSPLFSCSLAPCCPFTGIVCSFLRSCLHAVEVFILLPFALAFLMLPIRYAPWSCSLFPSVPCSSLFFVSCTMSSSATEDGSPVWGRSLLAKEVRGIGESGSEEEFFVLSPSSIFDSERTKDFLVSVGEGVESIEELKKKVDMMTLDEVELLIVEPRSTEEHASMGHQRNASKPEKKLVKSVDGQNEVSNAKVEIVNLDGPEVAKVSKVSEGLVAMLKEGVGGKEVEKEKEVEGNPSMGAPRKNKVVLRYDEGKLLRLDLSIKVEFGKAKELDLELAKSKEVAKKLQEELDKHIGCLSNKAKENKMLNGRVSNLEKQVKDVGRKMDELSSKKKTVDENALMVELDVAKRLIVLNHREGVKKAQRQVKVLVPSINSAQHNVNGDIVDGSNSTFWELLEKAEVQIRPPESYLKKSWLRPNLLRVLGMTFPVTSSSLYASFCMDSVMRNGPSQFGESFPSELSFPASPWSLQTKLLGLKLHFLSFELYFQVILCLHPSSSRRVKLITEFEMDRYSNNSALDVSRVKMGRVKSRQICQSIGQLMYFLQALWAAHGNEVFTFVWVALDPHTGDHETKELTPFDPKDAFFWAQPHVVLLEFGEYLHQVFRMIVETEGHDFVTEVGIFSDECRLAFICSSMLLAELLSLLCHRFGFRKNGEFVAYEIRIYAWHVNDASCEEINILCQHVLDSFLKVLIKSFPYLSALVWLLSELEIMQLLSWCWPFVFLISLSFEIDPAWYSVFHMIDICCIDMLRGGMCVGLDESNLVKSTSVNVFGGIDLLKPAAIGK

SEQ ID NO: 226228 - protein, 519 aa, Glycine max
  Coding DNA Sequence Number=SeqID_109450
  Gene Ontology: Mol. function=protein serine/threonine kinase activity; Cellular component=integral to membrane; Biological process=protein amino acid phosphorylation
  Homolog annotation: Hit_ID=Q1SDE2; Match level="QueryCoverage=94%, HitCoverage=70%, E-value=8e-92, Identity=38%"; Hit description =Protein kinase; Curculin-like (Mannose-binding) lectin
  Pfam annotation: Domain name=B_lectin; Domain location=70-177; Score =75.7; E_value=1.5e-19; Accession=PF01453.15; Description=D-mannose binding lectin
  Pfam annotation: Domain name=S_locus_glycop; Domain location=188-321; Score=-45.5; E_value=0.081; Accession=PF00954.11; Description=S-locus glycoprotein family
  Pfam module annotation: Pfam domain module=B_lectin::S_locus_glycop; Domain location=70-177::188-321
MVTKPLVLFVSFFLCSSVLRNANSIELGSSIVAGTNNSSWRSSNGDYAFGFYHLLSGHYLVGIWFDKVPNKTLVWSANRDNPVEIGSTINLTSSGEFLLQPVKGATFQIYKGTNTPAATAKMEDNGNLVLRNSLSEFIWQSFDSPTDTLLLGQTLKMGQKLYSNANGSVDYSKGQYSLEIQQSDGNIVLKAFRFTDAGYWSSGTNQNTDVRIVFNSTTAFLYAVNGTNQTIHNMTVDPLTGAIEDYYHRVLIDDRGNLQKLIHPKENGSDWTSVWNAIELPCRVTALCGVYGFCNSSDNQSYSCECLPGYTHLDPNVPSKGCYLSTEANGLCAANSSKVEVKAIQDADIPNNDYFYFDLQVINNMDLESCKRELMDDCLCMAAVFYGSDCHKKTWPVINAIKIFPDTSNRVMLIKVPLLDNDMENEKDSQSLVVLIVALVSCSLLAVLFAATFIYHHPIICQHLIHKGEPPKPKPMDINLKAFSFQQLREATNGFKDKLGRGAYGTVYSGVLNLEGQQG

SEQ ID NO: 226229 - protein, 149 aa, Glycine max
  Coding DNA Sequence Number=SeqID_109451
  Gene Ontology: Mol. function=metal ion binding; Cellular component =integral to membrane; Biological process=cytochrome complex assembly
  Homolog annotation: Hit_ID=Q96326; Match level="QueryCoverage=85%, HitCoverage=54%, E-value=1e-50, Identity=70%"; Hit description=G1p
  Pfam annotation: Domain name=CcmE; Domain location=1-117; Score=9.9; E_value=6.5e-08; Accession=PF03100.6; Description=CcmE
NFQDQLVFYVTPTEALEKYATNPTKARFRLGGLVLEGSVVYPASSPEVEFVVTDLISDMVVREGHSVVVEGLVKPFTEEIRKEVSVKNVSEKARKIECYFSATEVLAKHDEKYMPKEVAAAIEKNKKIIEDAATATVAAAATAEGPKTP

SEQ ID NO: 226230 - protein, 72 aa, Glycine max
  Coding DNA Sequence Number=SeqID_109452
  Subcellular localization annotation: CTP_CleavageSite=42; ConfidenceScore=5.02e-01
MACISKSRAMLFFMVFFVGLLFAAGVSAQTSELPQAPAPAPTMDAGAGFVVTYSGAFVCSSLLLSLIALLCH

SEQ ID NO: 226231 - protein, 120 aa, Glycine max
  Coding DNA Sequence Number=SeqID_109453
  Homolog annotation: Hit_ID=Q6L4G5; Match level="QueryCoverage=46%, HitCoverage=5%, E-value=2e-08, Identity=51%"; Hit description =Putative zinc finger protein
MVSVHRCEEMVALEEGLDVGAVSGGERHRQSVQRVELVPNRLVEEREYQNWRLRQRPAESAAAIGGGIHLAHRIRQHRYSAAAADAVQPRQRRRHALSIFFSSVGKFSRGSIFREFFFSL

SEQ ID NO: 226232 - protein, 52 aa, Glycine max
  Coding DNA Sequence Number=SeqID_109454
MEADDSSTQKEEQMKPMRNKVVGNLVKYLNPKSPNNHPNTRHQLPFKIMYDK

SEQ ID NO: 226233 - protein, 36 aa, Glycine max
  Coding DNA Sequence Number=SeqID_109455
MEVLKPPTDESATPSNTCESMTLRKITYVSMEGKPK

SEQ ID NO: 226234 - protein, 141 aa, Glycine max
  Coding DNA Sequence Number=SeqID_109456
MGLNQAPSFKKRFYHVKVKSLELAGLQELGQQMDQDLAMIEVSIEAIASLAQYFDQSLRCFTFRDFQLVPTIEDFEGILGCPLGGRKSYLFTGFYPSMARVEKVVKISTQELDRVKQNRNGVVGIPRQLSQPTLRREGEAR

SEQ ID NO: 226235 - protein, 141 aa, Glycine max
  Coding DNA Sequence Number=SeqID_109457
  Subcellular localization annotation: CTP_CleavageSite=19; ConfidenceScore=5.17e-01
MGNKNSALSKAHSSQRPKVASIEPQPNYVVSMQSKLSTKSEVVSLWAYPTEQQGEKEKPELCDDHTFFNYIQRTKYKIKSKSNINGCDAEQRYPAAPADVANGTSIDKENERDPFSDYIQSARKKLRMRTLSRNNSSFRRG

SEQ ID NO: 226236 - protein, 252 aa, Glycine max
  Coding DNA Sequence Number=SeqID_109458
MSAIQIWSVYLTWDIIFASIAPKDIQFFPYQPQIFARQFGHCQLPSVTIYRKKTHRYQIQGDESLIPKVIEKGTPKVKLQFQPSSFVPKIILRDFHLWWKKCYSQRLISILSSLEKLIKTCCSVQDTSKKIKAIPIKIPHQGEAENWEDDDETCTSKKTSRKRKVPLFVNTGNKSMHIFDKALRKTLVIRVIIRSNFLQNPPKTKDHTKDVNVEDHSSSQDYSNLEDDKDEGNHDTLVVSYTTKSLNKESNS

SEQ ID NO: 226237 - protein, 91 aa, Glycine max
  Coding DNA Sequence Number=SeqID_109459
MGNGLEENVEVGGASKDKSFHMASGVEEPLFCHHCRCKEESILHVLRDCLLAMEGVDRKAGCGGLIRNHHASWVCGFAKNINTTTAFLEEL

SEQ ID NO: 226238 - protein, 57 aa, Glycine max
  Coding DNA Sequence Number=SeqID_109460
MEIGMEKAMVHVGVTYGGSTHGGFWEDFQLWITYCLEELKFKCWDVLAPFVMSLMRL

SEQ ID NO: 226239 - protein, 329 aa, Glycine max
  Coding DNA Sequence Number=SeqID_109461
  Gene Ontology: Mol. function=nucleic acid binding; Cellular component= intracellular; Biological process=regulation of transcription
  Homolog annotation: Hit_ID=Q1SHX5; Match level="QueryCoverage=87%, HitCoverage=87%, E-value=1e-84, Identity=53%"; Hit description=Zinc finger, C2H2-type
  Pfam annotation: Domain name=zf-C2H2; Domain location=254-276; Score =14.1; E_value=0.31; Accession=PF00096.16; Description=Zinc finger, C2H2 type
  Pfam annotation: Domain name=zf-C2H2; Domain location=280-305; Score =7.0; E_value=1.8; Accession=PF00096.16; Description=Zinc finger, C2H2 type
  Pfam module annotation: Pfam domain module=zf-C2H2::zf-C2H2; Domain location=254-276::280-305
  Subcellular localization annotation: CTP_CleavageSite=50; ConfidenceScore=5.28e-01
MTNSYTSNDLNFWLDLNSPCLLSSPSPSPSINPPFYFPSNYHNNNYTSVISSTRHQFQPSPPPEGKALPLLHPRHEVEEEDLESSFSAMEVDKKKKELSSSSSCLDEEDAAVTVALHLGLPSTSDLASSSLYSSTEASSDKEEEEEEVVLTDSSGLLLSNRINRGQYWIPTSSQILIGPTQFPCPLCFKTFNRYNNMQGPESLRGTQPTAMLRLPCYCCAPGCKNNIDHPRAKPLKDFRTLQTHYKRKHGTKPFVCRKCCKAFAVRGDWRTHEKNCGKRWYCSCGSDFKHKRSLKDHIKAFGYGHTACGNDRCNLDQDHDDQLVGSEIE

SEQ ID NO: 226240 - protein, 160 aa, Glycine max
  Coding DNA Sequence Number=SeqID_109462
  Gene Ontology: Mol. function=zinc ion binding
  Homolog annotation: Hit_ID=Q10R22; Match level="QueryCoverage=90%, HitCoverage=59%, E-value=2e-24, Identity=41%"; Hit description=Zinc finger, C3HC4 type family protein, expressed
MEVHYNTISYPYNTAGSFIEYFEGLTYEHVNFIFSGASHAQESSYPSNSSFYKFGLSEPENNSYYRYSHGYEVNHHEPLVDEYRRPSENSLTINEQSPAVSTEWVEGGNTDTQDNSIECPRRHHSNSNDYQVIWQDNIDPDNMTYEVGLSLGFLLFLGII

SEQ ID NO: 226241 - protein, 295 aa, Glycine max
  Coding DNA Sequence Number=SeqID_109463
  Gene Ontology: Mol. function=metal ion transporter activity; Cellular component=membrane; Biological process=metal ion transport
  Homolog annotation: Hit_ID=Q6H7N1; Match level="QueryCoverage=73%, HitCoverage=79%, E-value=3e-80, Identity=69%"; Hit description =Putative Zinc transporter zupT
  Pfam annotation: Domain name=Zip; Domain location=2-222; Score=13.2; E_value=1.5e-06; Accession=PF02535.12; Description=ZIP Zinc transporter
  Subcellular localization annotation: CTP_CleavageSite=58; ConfidenceScore=5.14e-01
MKGFAAGLMLSISFFDLTHNALNSLGFLRGNLWFFAGVIFFAVVAKFIPEPTVAPPTSDEKKVGKQGNKDIMKRRRRQVLISGVVTAIGISLHNFPEGMAVYLGSMKGIRVGLNLALAIALHNIPEGVAVALPVYFATQSKWEAFKLASLSGFAEPLGVVIVACLFPTSLNPEILEGILGSVGGVMAFLTLHEMLPLAFEYAGQKQSVKAVFCGMAFMSARSTGRSPTSSSSSSTTVDYLDKPYSTPPSNGLPAVIATPPFAPSSPKSRRECHSQSPWENHLGIHLSLRVPQKFL

SEQ ID NO: 226242 - protein, 55 aa, Glycine max
  Coding DNA Sequence Number=SeqID_109464
MVKLESLRQTMSEMVGTDVSYLKPQESKFSYCLGGNRPGRPTGAYDLVYIKSSLD

SEQ ID NO: 226243 - protein, 218 aa, Glycine max
  Coding DNA Sequence Number=SeqID_109465
MALRGRDIVQIVVAQNNMLFVSMESPWYVPSVHYVPSNAAYGTTYNIPNAAMVERMFNHSGSSQIQYKGLGGEALGSMGDPHFVQDQNKYSFPPYGLPPNYTPPNVAQAPDENAHEAPRDHNLVDFEPYLGCTVEGQAFCDVPLPNTSGDPQYHPQPQPLHFVVGRVPPAIVEREKLDHIEERLRAIEGDGDYAFADMAELCLVPDVVVPLKFKVSDF

SEQ ID NO: 226244 - protein, 78 aa, Glycine max
  Coding DNA Sequence Number=SeqID_109466
  Gene Ontology: Mol. function=zinc ion binding
  Homolog annotation: Hit_ID=Q10R22; Match level="QueryCoverage=93%, HitCoverage=31%, E-value=6e-24, Identity=78%"; Hit description=Zinc finger, C3HC4 type family protein, expressed
ELLELGEAVGTQSRGLTQEQISSLPVSKYKCGFFLRKKSRDERWNIEEGTSVSPYHVNMFIMLVVGTSGLASIRQDIY

SEQ ID NO: 226245 - protein, 95 aa, Glycine max
  Coding DNA Sequence Number=SeqID_109467
  Subcellular localization annotation: CTP_CleavageSite=33; ConfidenceScore=5.10e-01
MSLKPKRPKKGAPTQQSHLPPHTAPTQQPYIPSPMAPTQQPCIPSHMAHTQQPYIPFPMTPTQKLYIPFPPHIPPLMAPMASNQQPYIPPFMAPI

SEQ ID NO: 226246 - protein, 269 aa, Glycine max
  Coding DNA Sequence Number=SeqID_109468
  Gene Ontology: Mol. function=actin binding; Cellular component =cytoplasm; Biological process=cytoskeleton organization and biogenesis
  Homolog annotation: Hit_ID=Q1S5P6; Match level="QueryCoverage=55%, HitCoverage=26%, E-value=8e-40, Identity=52%"; Hit description =Ankyrin
  Pfam annotation: Domain name=Transposase_21; Domain location=139-263; Score=-30.5; E_value=5.3e-12; Accession=PF02992.5; Description =Transposase family tnp2
MINDAFGNNKHHDVEPDMYEEAYEFVDIVPNEVNEEIVDFLKDGIKELYEGCRKYSKLSFLLRLYHIKCLCGMTEKAMMMILELLKDAFEYAKIPTSFYEAKKVIYKLFLNYTKIDVCPKNCMLYWGEDENLEICKHCKKSRWKAKGKKMLGNKIDVYLQPLINELNELWTKGVETYDSSLKEVFRIRVALMWTISDFPGLCNLSRWNTYIGYAYPSCNFDAFPCRLFSSSKWCFMGHRQFWREDLLARWSEGAIKEEYHILQSYLLEG

SEQ ID NO: 226247 - protein, 75 aa, Glycine max
  Coding DNA Sequence Number=SeqID_109469
  Gene Ontology: Mol. function=glutamyl-tRNA reductase activity; Biological process=tetrapyrrole biosynthetic process
  Homolog annotation: Hit_ID=Q6AVG1; Match level="QueryCoverage=82%, HitCoverage=15%, E-value=7e-17, Identity=57%"; Hit description =Expressed protein
MVHKLPFKQTPKIAFMFLTKGPVLLAPLWQRFFKGNEGLYSMYVHSYPSFNETVPESSVFHGRNIPSQGDYFKNE

SEQ ID NO: 226248 - protein, 54 aa, Glycine max
  Coding DNA Sequence Number=SeqID_109470
MGGVFGGNAACIRWLAHTVKGAGNNYFSSQKKKEKKPSVDSSTEIPHISQDLTV

SEQ ID NO: 226249 - protein, 93 aa, Glycine max
  Coding DNA Sequence Number=SeqID_109471
  Homolog annotation: Hit_ID=Q6QNU4; Match level="QueryCoverage=34%, HitCoverage=2%, E-value=3e-08, Identity=87%"; Hit description=DNA damage-binding protein 1
MEKPLPVLVSLAGRILVFVVEDGKLQLIVEKETKGVVYCLNAFNGDGICDGDCSGGCNAIWCAWKDRASKTSVDEDVQHVWEILQPNGRRDNK

SEQ ID NO: 226250 - protein, 51 aa, Glycine max
  Coding DNA Sequence Number=SeqID_109472
MLRCERYFSQFKYDIEIPNGESSRNWVANLVLKFYDDPMMNESDIIIFLRQ

SEQ ID NO: 226251 - protein, 698 aa, Glycine max
  Coding DNA Sequence Number=SeqID_109473
  Gene Ontology: Mol. function=binding; Cellular component=integral to membrane; Biological process=polysaccharide catabolic process
  Homolog annotation: Hit_ID=Q8FFF8; Match level="QueryCoverage=99%, HitCoverage=40%, E-value=1e-55, Identity=27%"; Hit description=YapH homolog
MDSGSGGQVGNRGTLNLNGYNSTGLKVIATAGNQAHAFSSGAINVAGDADRFGGTNNTAVWVTGEPGGHASADITGPIRLSGKAGIGIRAEGQATVNVSAGGIPTSSGSDSMLDSGQISFYRIGPDARINLPANGRYSASVWNGTIFRVEQGADFDGRGLTLSMNSPFATGVYGSGAGTDIDTHGATLNIASFASGLTITDGARATIDAATRIHLNGSDARVAIADGNRYTLQGNVVNPNTQFDPNTLLINQAAIDGRANNQQPFTVMNHARLVNRGAISLRGEGVTGIYAQYGATVDNRGDINILRNGRALFADGYPGAGDGKTLTEINNSGTLNLYSGQSTQQTTTFGAVSYHQLGRINQNGTINLYGDNVVGAKAFAGGRITLGVNSRVVFHDAQQIGYQAFDPGSRLIVNGSPVDVSSRNSTLYEIRNGAWLYNQGFGNVTLSGRDSTGIVVSGTDALVSSTDVYQVTGKGATVLRASDRAQGIITSLIALNGKNTLGAQATGDGTEVYAASLITGTGRNATAFDVSGDARLFNQQQGVVDLRGRNSTGARVHDGGNFINRGTVSVASGTGVDVSSGYGQYVPLDSTLRVNDGTAALRVGSGGAMKIYGDGQGASTLAAYGKADGLLLDSGAQRFEANDIIIGAYGSGTALNNRAGISDISLSNVRFEANGGTGIRSATSFDPAGSAQIHVGAG

SEQ ID NO: 226252 - protein, 123 aa, Glycine max
  Coding DNA Sequence Number=SeqID_109474
MKVDMEAMKEQMVTMMEAMMSMKKIMEANEVAVTATSVFAKVNLMPPSGLNRMNHPTSDMVGKDSSSMESFASGKILFARINRIFHSSLLQGCENKTTMDTSEPYTGAMKNTMHKPQANLGAD

SEQ ID NO: 226253 - protein, 81 aa, Glycine max
  Coding DNA Sequence Number=SeqID_109475
MTKGAEFVSAHLSLILLLLNDKGRRICLCAFISHLAAPEQQRAQNLSLRVYHSSSVRMTVIGLRISSGPPPLDDKRRRRRR

SEQ ID NO: 226254 - protein, 195 aa, Glycine max
  Coding DNA Sequence Number=SeqID_109476
MQLQMQSQELTMPLEPEGSCVNPSRQNPYTGDLEKCGFYVNDNHPHLVALGRVYEGLMIVHNVPLGNDQVNVSVEEVQDANACIPVPIQEDKQGVGGPAKPIYRSDPNVSPLYLMTLIISQLFLEPLQVLWDATLFGVALKGFNDSQGSKSKAATKCILVKYFTDPRPLELKRMKTIPIKWARFYLKVKNQTLGV

SEQ ID NO: 226255 - protein, 96 aa, Glycine max
  Coding DNA Sequence Number=SeqID_109477
MQVLSFMYVRPPGYRNESAKTIEMNDEKKTEDMSKGPSADDGPSFSMYLLHQLFSKEDKRCALEEIDDDEEKRKHDFKSRTENAREEILRKRRVEK

SEQ ID NO: 226256 - protein, 130 aa, Glycine max
  Coding DNA Sequence Number=SeqID_109478
  Gene Ontology: Mol. function=RNA-directed DNA polymerase activity; Biological process=RNA-dependent DNA replication
MNILSYNIRGLGRGLKWASIRNLVGKFNIDLLCLQETKKEFLDKASCQFLWGQSDLAWEWQPAVNAAGGLLCVWDNNKFQVDFRFSDKDYIMLGGVWLPQMQRVVVINIYAPCDIAGKRQLWQNLSTRKS

SEQ ID NO: 226257 - protein, 399 aa, Glycine max
  Coding DNA Sequence Number=SeqID_109479
MVLERMKDCISWELGYNISTKFLGDDMVILTGLPNNRVVWLQLWGFSIEVWDVDHMKQVVSIIGDVIETDEDTDDRHRLDRARLLVRTPLPPAIMKEVIVRTGDADYRVWLVEEVGDDGAVRRTRTPLSEEWTEEITSVEEDDDDDDTTFSYSAELSSTKNQLRSSHQSHAIPSGYCCQTPNHSSPLDNTPSADEYIDKSGDRGEHTQGSISAKVDPVVCFTEKAQGNALTDMITLDPAKAGSRQPVEDQIGNFLNCEDLAEKEQNIYGVNTRLVTDRGSQPGMPSLQFQKAIGPSSISGPIMKMEGCKKENHPTSAQTSKGSSDLFSKVYVRQRHGPSKAAPLEPVVEEDISLREDKGLGGLNDSSCKGPNNRTLEAFEGFKNTEENSLEDLEEAMQQ

SEQ ID NO: 226258 - protein, 55 aa, Glycine max
  Coding DNA Sequence Number=SeqID_109480
MPDLRFQVGDLAESGCFQGGYCGAWFRCKHGNLNKKRIFGLALASYETLLSNVHY

SEQ ID NO: 226259 - protein, 103 aa, Glycine max
  Coding DNA Sequence Number=SeqID_109481
MDKDGYSRWRGWRDLGKLASGDYPILGALIWSGKLISLTLLLPTRSKTMLFELGVVDQYTKKEVTLSKNNHRNKEKEGILKQAQPNSGAKRASGAKRATNCRR

SEQ ID NO: 226260 - protein, 366 aa, Glycine max
  Coding DNA Sequence Number=SeqID_109482
  Homolog annotation: Hit_ID=Q2QQM3; Match level="QueryCoverage=33%, HitCoverage=11%, E-value=2e-23, Identity=42%"; Hit description =Ubiquitin-specific protease 12, putative, expressed
  Pfam annotation: Domain name=MATH; Domain location=18-136; Score =37.1; E_value=6.3e-08; Accession=PF00917.16; Description=MATH domain
MVNELTTSVDFEKFSWKIEDFSKQNVMKLRSKPFKIRGCTWRILVYPLRRDVNHFSVYLMVADSLPPYGWSRNTFFKLALINQVDRSKSIAKETRQKFNGGYRCWGSFFLNLSDFNNPKQGYLVRNKCIIEAHICVSDLSPKIQVHPNSSPIFHDSLRCGQATESSSDDRDTISPRTSGSSTGAEGETHHQGLNINLILREVLVDFESLGAEEEAFIPLLEEVCIWHPNLIQCQRERTRRFRQWAFTSLGHVLHFLKTKRVKDINEEDIKYLHGLWKELVKSSGFDLTWLEPYVQSALGLRAYMERANQLKKLKDKVVALEINMKRLRGELAAAEGEFEVARSGLSEVRRGFNEMDVNAAIGYAMF

SEQ ID NO: 226261 - protein, 88 aa, Glycine max
  Coding DNA Sequence Number=SeqID_109483
MATKKSESNLDPWAQKIYPKINENPRTFFSSSNPILFESSIQYPWGVGLHHPLHLGKDLTSNPESRVRSENPFYGDLPMREHGSSPTQ

SEQ ID NO: 226262 - protein, 145 aa, Glycine max
  Coding DNA Sequence Number=SeqID_109484
MVVVVVSAAAMDQDHTSSWDDLINQDYRCWNKDCIDVARSKWLSRLHGRNINNLFCFLVWNRHLFNDQKHNIYHITLVDWLPSHSTVDQWLATSQGMSTLNSSVKLLVICCHDGNQLFAATRVLSIKAPPLAASIILLSINISSS

SEQ ID NO: 226263 - protein, 409 aa, Glycine max
  Coding DNA Sequence Number=SeqID_109485
  Gene Ontology: Mol. function=oxidoreductase activity, acting on paired donors, with incorporation or reduction of molecular oxygen; Biological process=carotenoid biosynthetic process
  Homolog annotation: Hit_ID=Q52QW3; Match level="QueryCoverage=48%, HitCoverage=32%, E-value=8e-88, Identity=79%"; Hit description =Carotenoid isomerase 1, chloroplast precursor
  Subcellular localization annotation: CTP_CleavageSite=80; ConfidenceScore=5.71e-01
MLNSSFLSLSEHTFSHTPHHFPTRSASQNPNLHPKFQSLAFGNRGGSEFPSGSCSNTPRRKGVLVVRSKSTLGVEEVVVKGGGVKGKGEEFDAIVIGSGIGGLVAGTQLAVKGARVLVLEKYVIPGGSSGFYQRDGYTFDVGSSVMFGFSDKGNLNLITQALEAVGCRMQVVPDPTTVHFHLPNNLSVRVHKEYDKFIEELTSYFPHEKEGILKFYGECWKIFNALNSLELKSLEEPLYLFGQFFRRPLECLTLAFLTIFLAAYYLPQNAGAIARKYIQDPQLLSFIDAESCGCAEKPRLQPTKFRSGDGCCSPVNKARPKAEGGSSSLMLVGDVSRIVYLNFSCRKRALHGVAVVVVDAERQEGSALVAKYAQQWACTDVFVQGTLVNIVAEANSEGGLVDAMKHIET

SEQ ID NO: 226264 - protein, 217 aa, Glycine max
  Coding DNA Sequence Number=SeqID_109486
  Gene Ontology: Mol. function=nucleoside-triphosphatase activity; Cellular component=integral to membrane; Biological process=transport
  Homolog annotation: Hit_ID=Q93YS4; Match level="QueryCoverage=93%, HitCoverage=27%, E-value=1e-83, Identity=75%"; Hit description=White- brown complex homolog protein 23
  Pfam annotation: Domain name=ABC2_membrane; Domain location=4-171; Score=79.8; E_value=8.7e-21; Accession=PF01061.14; Description=ABC-2 type transporter
MVPIPIDEALKTKAGLLFFIAVFWGFFPVFTAIFTFPQERAMLSKERAADMYRLSAYFLARTTSDLPLDLILPVLFLLVVYFMAGLRLSVAPFFLTILTVFLCIVAAQGLGLAIGATLMDLKRATTLASVTVMTFMLAGGFFVQRVPIFFSWIRYMSFNYHTYKLLLKVQYEHISPVINGMRIDSGATEVAALIAMVFGYRFLAYLSLRRMKLQSGA

SEQ ID NO: 226265 - protein, 61 aa, Glycine max
  Coding DNA Sequence Number=SeqID_109487
MACGRAPTAASRGRRTSSSSHERREKNSARGRRYSRKKEMKKEAEWLGAQGKNHESSKPKK

SEQ ID NO: 226266 - protein, 367 aa, Glycine max
  Coding DNA Sequence Number=SeqID_109488
  Gene Ontology: Mol. function=nucleoside-triphosphatase activity; Cellular component=integral to membrane; Biological process=transport
  Homolog annotation: Hit_ID=Q93YS4; Match level="QueryCoverage=95%, HitCoverage=43%, E-value=1e-142, Identity=73%"; Hit description =White-brown complex homolog protein 23
  Pfam annotation: Domain name=ABC_tran; Domain location=87-276; Score =163.9; E_value=4.2e-46; Accession=PF00005.17; Description=ABC transporter
MYVAAEDIESGPRTKFQTEPTLPIYLKAWMKLTLAIIATNRTRSSGSVLDKVSFHFTDVTYKIVIKGMTTTEEKDILNGITGSVNPGEVLALMGPSGSGKTTLLNLLGGRLSHPISGGSITYNDQPYSKFLKSRIGFVTQDDVLFPHLTVKETLTYAARLRLPKTYTKEQKEKRALDVIYELGLERCQDTMIGGSFVRGVSGGERKRVCIGNEIIINPSLLFLDEPTSGLDSTTALRIVQMLQDIAEAGKTVVTTIHQPSSRLFHKFDKLILLGKGSLLYFGKASEAMTYFQSIGCSPLISMNPAEFLLDLANGNINDVSLPSELEDKVQMGNAEAETLNGKPSPAVVHEKSVGKHQQYLPHSVDSK

SEQ ID NO: 226267 - protein, 145 aa, Glycine max
  Coding DNA Sequence Number=SeqID_109489
  Pfam annotation: Domain name=Extensin_2; Domain location=1-145; Score= -134.8; E_value=0.049; Accession=PF04554.4; Description=Extensin-like region
MAISVGADDKPYYGQPSNYYPHPTPTPYHQANGPPYYYNSPPYYYKSPPPPSPSPPPPYIYHSPPPYYYKSPPPPYYYKSSLHPSSSPPPSYIYKSPPPPSPSPPPPYVYNSPPPPSPSPPPPYVYKSPPLPLLSPPPPYVYKSP

SEQ ID NO: 226268 - protein, 488 aa, Glycine max
  Coding DNA Sequence Number=SeqID_109490
  Gene Ontology: Mol. function=calmodulin binding
  Homolog annotation: Hit_ID=Q9C9T2; Match level="QueryCoverage=95%, HitCoverage=98%, E-value=1e-104, Identity=45%"; Hit description =Putative calmodulin-binding protein; 77122-73705
  Pfam annotation: Domain name=Calmodulin_bind; Domain location=87-392; Score=554.6; E_value=1e-163; Accession=PF07887.2; Description =Calmodulin binding protein-like
MAAKRFFNDSDQDPDNPGDKRMRNTRPSFASVIGEVVMIKNMENLFSAMEPLLRRVIGEEVDRVMRQWPHSFARSPSLRLQALDQQQPSTLQLWFSKRLSLPIFTGSRILEVDGKPINIVLMDKSSGKVVPTSLPHAIKLEIVVLDGDFPPDDNDEDWTSEEFNRHVVKERIGKRPLLAGELNVIMRDGIAPIGDIEFTDNSCWIRCRKFRVAVRVAPGTNQGGVRIREAISEAFAVKDHRGELYKKHYPPMLHDEVWRLEKIGKDGAFHRKLSSEGIKTVQDFLKLAVIDTLKLRNILGIGMSDKMWEVTIKHAMTCDTGSKMHIYRGPDYTIFLDPVCKLIRADFNGHTFSNRDAMSPLNKAYIDKLVKEAYARWNNLEEIDGVLNDNIALLTQGDQTVEQFANNQPAAASVVTYDQNQYYSDKSGSYVANNNTQMGCCEWSLNQAYSPAPFANGFPFSFSVTQSDGEITASGSSSVDVDVITRQN

SEQ ID NO: 226269 - protein, 173 aa, Glycine max
  Coding DNA Sequence Number=SeqID_109491
  Gene Ontology: Mol. function=protein serine/threonine kinase activity; Biological process=protein amino acid phosphorylation
  Homolog annotation: Hit_ID=Q1RZG3; Match level="QueryCoverage=44%, HitCoverage=11%, E-value=2e-19, Identity=57%"; Hit description =Protein kinase
MAPASLMGCVALLRKCLAITKQYVFHILSFPHLLTAVASVVVIGGFMMCIVICCSKYRPTRQFCPKICGFGLAKLYPRNESIVSMLDARETIGYIAPEVWNKHVGGISHKSDAYSYEIMLLELVGVKKHINVEACHKKTPFYDDGNKLSTTVSNRLKGHVVESVDFPRRSPNN

SEQ ID NO: 226270 - protein, 133 aa, Glycine max
  Coding DNA Sequence Number=SeqID_109492
MVCTARGDHYAHHTTMLILEQLKAYSWDAKALIVQAAFALEYGKFLYLPLTTQYQMSEKSLADLNGLLMIQHNTQHLTFFNSVVKKVMQVIECITEWKRLTSAGYDIKDVPTLAETLHEIPVVVYWAIFTFVT

SEQ ID NO: 226271 - protein, 216 aa, Glycine max
  Coding DNA Sequence Number=SeqID_109493
  Gene Ontology: Mol. function=transferase activity; Biological process= DNA integration
  Homolog annotation: Hit_ID=Q1RVB5; Match level="QueryCoverage=84%, HitCoverage=37%, E-value=4e-29, Identity=54%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
MVEERTLEHQPLKVALLVPQIMWMSSAVNQQLVLEGLKKNLLSIGRLDDLECKIHTEGGILKVVKGNLVLMKAKKLTANLYMLLGDMLQEPNASIVAISQEEAMMIWHHRLENELESEQKNDNISKDTTTKKIGKKSGEKYSYEAEQDHEEQEPKDEPLTFQEAMNSSDASLWMTSMHEEMETLHRNKTWEIVKLLEGWKAIGCKWVYKIKCDNND

SEQ ID NO: 226272 - protein, 127 aa, Glycine max
  Coding DNA Sequence Number=SeqID_109494
MWDRHILKVALKSGAFTPKAYTLKNPLESFPPDSAGSHVYSGSDSGISSGFLKLLELFLWLLCFPSVREKEKGLKPSLHCLRAMSIYPSTDINFEIPKVEMCGNAFLTWCPNFKTIQRLTSSGSWFY

SEQ ID NO: 226273 - protein, 337 aa, Glycine max
  Coding DNA Sequence Number=SeqID_109495
  Gene Ontology: Mol. function=nucleic acid binding; Cellular component= cytosol; Biological process=regulation of mRNA stability
  Homolog annotation: Hit_ID=Q1SCP0; Match level="QueryCoverage=84%, HitCoverage=70%, E-value=1e-113, Identity=67%"; Hit description=RNA -binding region RNP-1
  Pfam annotation: Domain name=RRM_1; Domain location=12-83; Score =62.5; E_value=1.4e-15; Accession=PF00076.12; Description=RNA recognition motif. (a.k.a. RRM, R
  Pfam annotation: Domain name=RRM_1; Domain location=216-281; Score =69.5; E_value=1.1e-17; Accession=PF00076.12; Description=RNA recognition motif. (a.k.a. RRM, R
  Pfam annotation: Domain name=RRM_1; Domain location=99-171; Score =75.8; E_value=1.4e-19; Accession=PF00076.12; Description=RNA recognition motif. (a.k.a. RRM, R
  Pfam module annotation: Pfam domain module=RRM_1::RRM_1::RRM_1; Domain location=12-83::216-281::99-171
MVATAIEEVRTLWIGDLQYWVDESYLSQCFAHNGEVVSIKIIRNKLTGQPEGYGFVEFVSHASAEAFLRTYNGAQMPGTEQTFRLNWASFGDSGPDHSIFVGDLAPDVTDFLLQETFRAHYPSVKGAKVVTDPATGRSKGYGFVKFADEAQRNRAMTEMNGVYCSTRPMRISAATPKKNASFQHQYAPPKAMYQFPAYSAPVSAVAPENDVNNTTVCIGNLDLNVTEEELKQTFMQFGDIVLVKIYAGKGYGYVQFGTRVSAEDAIQRMQGKVIGQQVIQISWGSSMTARQPLCICKGKAAYNIPPPYLRIAKSLWAMGYEVFSGLAVWLLKDMFGR

SEQ ID NO: 226274 - protein, 65 aa, Glycine max
  Coding DNA Sequence Number=SeqID_109496
MCGKEIGRIEDYTRRKNIVIHTGKDIVKVLKALIISGENRESRQSVFNILTGEQVRHLDSVKSTF

SEQ ID NO: 226275 - protein, 206 aa, Glycine max
  Coding DNA Sequence Number=SeqID_109497
MATQLLHRVSLFVFFFSHSHLTLFYDLLAMSECPSLSDMILMPQPSSELKEIEDLPASTILSRLQLVRLMSSQLVPNSLPLPPLTVTVTLNMKVRRSQDRIPIEMEKVETDLFGSSLLASRIRPDLDEALESAVGDKVLGLEELHGADKRMGCLKMKWGSESQWWVTEVGKAVAKIIALALDLDANFFISQKCLERAHCNSAFATP

SEQ ID NO: 226276 - protein, 275 aa, Glycine max
  Coding DNA Sequence Number=SeqID_109498
  Gene Ontology: Mol. function=protein kinase activity; Cellular component=nucleus; Biological process=protein amino acid phosphorylation
  Homolog annotation: Hit_ID=Q1RZG3; Match level="QueryCoverage=83%, HitCoverage=35%, E-value=2e-32, Identity=34%"; Hit description =Protein kinase
MDEHNHIHMHIPMLLTSIVILLTTLPQSYCDFDYSVCKERPYNCGNLSDIFYSFWGQNRPLQCGGGGQTFELKCHDDDNTTILIGSQNFTVKEINTNAQTMRVVQTDLVLNFCSPQFEDTYVNSTQFRYSPSVYNITIFYDCLRMTDFPHGFGQNFTCGDVLSYFVVEYDEVLSNEFPRCKRRSHVPAEAPLDYTAPGAGYNNLIQVIDRGFEFRYDVSQDCTRCLGSEGECWSDCNDIDQNVLSCYYCPDGSHGLHCSPSKSMPSILLSSFTLC

SEQ ID NO: 226277 - protein, 339 aa, Glycine max
  Coding DNA Sequence Number=SeqID_109499
IKIEEFKKKHVLLFISGLDSIEEETLLLKSIYEKLKEKPREVEGYRKDDFKILWIPIVDEWNEERIKLIREVFNYKERSIIPLISPEGRVENIDTKQIISVWGIDGFPFRTSDHTRLTQQWNWFWSEMTKLNPRIGDLEDRYLFIYGGTDIMWIQEFTTAVEKLKRNVDSISLQIDITIESYQLGREDTKVVPRFWIAIDSLLASRKQQMMKGGDQGVQDFATREIKRLLFLKQDPKGWVILSKGYNVKLLGQGEAMCRSVRDFGIWYGKLHEEVSFDVAFKEYYESIKVKDCPKKCEHSEISNYPTDILAHIPCPNMECGRSMEVTSVNYRCCHGLEP

SEQ ID NO: 226278 - protein, 390 aa, Glycine max
  Coding DNA Sequence Number=SeqID_109500
  Gene Ontology: Mol. function=protein kinase activity; Cellular component=cell surface; Biological process=protein amino acid phosphorylation
  Homolog annotation: Hit_ID=Q1RZG3; Match level="QueryCoverage=75%, HitCoverage=46%, E-value=1e-114, Identity=69%"; Hit description =Protein kinase
  Pfam annotation: Domain name=Pkinase; Domain location=3-275; Score =120.9; E_value=3.7e-33; Accession=PF00069.15; Description=Protein kinase domain
  Pfam annotation: Domain name=Pkinase_Tyr; Domain location=4-275; Score=81.4; E_value=2.7e-21; Accession=PF07714.7; Description =Protein tyrosine kinase
  Pfam module annotation: Pfam domain module=Pkinase::Pkinase_Tyr; Domain location=3-275::4-275
MTNSFKVKLGEGGFGAVYKGELLSGCPVAVKILNSSKGNGEGFINEVSSISRTAHVNVVTLFGFCLEDSKKALIYEFMHNGSLDKFIYNKGLEATASLSWDNLWQISLGIARGLEYLHRGCNTRILHFDIKPHNILLDENFCPKISDFGLAKLCPRKESIISMSYARGTVGYVAPEVCNKHFGGISHKSDVYSYGMMLLEMVGVKKNINAEVSQTSEYFPDWIYSRLEQGGDLTTDGEIATEEKEMARRMTIVGLWCVQTIPQDRPTMSRVIDMLEGNMNSLEMPPKPVLSSPARSGTSTWVIILRTREDTSLVDQFKWRVHPLGSCKGFYKVKGNLKDRCGCLGTGCRHGLLSNKDRDCAEEKCHLVFGDEGHTDSTRPGLVVGSVKDR

SEQ ID NO: 226279 - protein, 147 aa, Glycine max
  Coding DNA Sequence Number=SeqID_109501
  Gene Ontology: Mol. function=DNA binding; Cellular component=nucleus; Biological process=regulation of transcription
  Homolog annotation: Hit_ID=Q2LME4; Match level="QueryCoverage=83%, HitCoverage=38%, E-value=2e-62, Identity=88%"; Hit description=MYB20
  Pfam annotation: Domain name=Myb_DNA-binding; Domain location=19-66; Score=31.6; E_value=2.8e-06; Accession=PF00249.21; Description=Myb -like DNA-binding domain
  Pfam annotation: Domain name=Myb_DNA-binding; Domain location=72-117; Score=48.8; E_value=1.8e-11; Accession=PF00249.21; Description=Myb -like DNA-binding domain
  Pfam module annotation: Pfam domain module=Myb_DNA-binding::Myb_DNA -binding; Domain location=19-66::72-117
MRKPEVSGKNNNINNKLRKGLWSPEEDDKLMNYMLNSGQGCWSDVARNAGLQRCGKSCRLRWINYLRPDLKRGAFSPQEEEIIIHLHSLLGNRWSQIAARLPGRTDNEIKNFWNSTIKKRLKNLSSNTSPNGSESSYEPNNKDLNMA

SEQ ID NO: 226280 - protein, 333 aa, Glycine max
  Coding DNA Sequence Number=SeqID_109502
  Gene Ontology: Mol. function=chitin binding; Cellular component =extracellular region; Biological process=chitin metabolic process
  Homolog annotation: Hit_ID=UPI00006A17C9; Match level="QueryCoverage =68%, HitCoverage=100%, E-value=8e-27, Identity=31%"; Hit description= UPI00006A17C9 related cluster
GLHALTFRGLHVLAFRGLHVLALRGLHALAFRGLHVLTFRGLHALAFRWLHALAFRGLHILTFRGLHALAFRELHALAFRGLHALAFRGLHVLPFKGLHVLAFRELHVLPFKGLHVFAFRGLHAVAFRGLHALTFKGGLHILAFRGLLALAFRGLHVLTFKGLHALAYVGLHALSFIGLYICAFKEFKASSLLLSVPRPPPDIGGRPTVRAQPEREAIVQLLCIPGQDFTQRSQCQSPPAEVSVGLCHHDIGIAPKTHPVDPEKSNRPWGFQLWLWASVSPTGIAPTRHPADSEKSNRVMGFPALSTSLCQFYGVPVGPIKVIKPPINRVYIK

SEQ ID NO: 226281 - protein, 500 aa, Glycine max
  Coding DNA Sequence Number=SeqID_109503
  Gene Ontology: Mol. function=transmembrane receptor activity; Cellular component=membrane; Biological process=defense response
  Homolog annotation: Hit_ID=Q1SI46; Match level="QueryCoverage=78%, HitCoverage=40%, E-value=1e-96, Identity=47%"; Hit description =Leucine Rich Repeat, putative
  Pfam annotation: Domain name=LRR_1; Domain location=116-137; Score =2.8; E_value=84; Accession=PF00560.23; Description=Leucine Rich Repeat
  Pfam annotation: Domain name=LRR_1; Domain location=139-160; Score =1.3; E_value=1.7e+02; Accession=PF00560.23; Description=Leucine Rich Repeat
  Pfam annotation: Domain name=LRR_1; Domain location=162-184; Score =11.7; E_value=1.8; Accession=PF00560.23; Description=Leucine Rich Repeat
  Pfam annotation: Domain name=LRR_1; Domain location=186-208; Score =3.8; E_value=55; Accession=PF00560.23; Description=Leucine Rich Repeat
  Pfam annotation: Domain name=LRR_1; Domain location=209-230; Score =4.2; E_value=46; Accession=PF00560.23; Description=Leucine Rich Repeat
  Pfam annotation: Domain name=LRR_1; Domain location=261-286; Score =3.9; E_value=52; Accession=PF00560.23; Description=Leucine Rich Repeat
  Pfam annotation: Domain name=LRR_3; Domain location=116-135; Score =36.2; E_value=1.2e-07; Accession=PF07725.3; Description=Leucine Rich Repeat
  Pfam module annotation: Pfam domain module=LRR_1::LRR_1::LRR_1::LRR _1::LRR_1::LRR_1::LRR_3; Domain location=116-137::139-160::162 -184::186-208::209-230::261-286::116-135
MAWELIWRESRIPGRFNRLWNFDDIDEALKNVKATEAIRSIQIDVQNIMKQKLSPHIFAKMSRSQFLEISGEYNDDLFDQLCILAEGLQFLAIELRFFYWDYYPLKSLPENFSAKKLVVLNLPDSKMEKLWDGVKNLVNLKQVDLSLSKELMELPDLSKATNLEVLKLNCCYRLTNVHPSIFSLPKLEKLEFCWCISLTILASESQLCSLSYLNLDYCFPLKKFSPISENMKEGRLVKTMVKALPSSINNPRQSLPELPVSLETLDARQCISLKTVLFPSTTAEQLKENRKQVLLLNCLNLDEHTLVAIGLKAQINVMKFANHILSTPSQNHVENCSDYHLKYCTYQCVYLYPGCSVPEWLEYKTTNDHINIDPSSAPPSPILGYIFCFVFGRNQYPGMSVMVRVKVKGTVSECYNGGTASTIWCQPNKAISTSAYNSFGKQMESGCASISSQVEAQFNGELTSDIDLLCQKLYAMNFYTCSDAITFGQAMTVLTALDSA

SEQ ID NO: 226282 - protein, 398 aa, Glycine max
  Coding DNA Sequence Number=SeqID_109504
  Gene Ontology: Mol. function=transmembrane receptor activity; Cellular component=membrane; Biological process=defense response
  Homolog annotation: Hit_ID=Q1T1A2; Match level="QueryCoverage=96%, HitCoverage=38%, E-value=2e-43, Identity=32%"; Hit description=TIR; Disease resistance protein; AAA ATPase
  Pfam annotation: Domain name=NACHT; Domain location=259-397; Score= -34.4; E_value=0.028; Accession=PF05729.3; Description=NACHT domain
  Pfam annotation: Domain name=TIR; Domain location=13-135; Score =121.9; E_value=1.8e-33; Accession=PF01582.10; Description=TIR domain
  Pfam module annotation: Pfam domain module=NACHT::TIR; Domain location=259-397::13-135
MSINTAPQIKFDVFVSLRGKDIRDGFLSHLTEAFKRNQVHAFVDDKLERGEEIWPSLVTAIERSFILLIIFSQDYASSRWCLEVLVTILECRDKYERIVIPVFYKMEPTNVQHQLGSYTKMHLLSMKEDTKARNDAEVVKEIVNLVLKRLAKPKIKSKGLHLTIKESPLRKEKNEGNFLPCLLTPPPQTKPFKIIELVLTALILTYTISLNDAAVVKEIVNLVLKTLVKPHVISKGLVGIEEKITTIESWIREKATDISLIGIWGMGGIGKTTLAEQVFNKLHSEYKGSYFLAREREESKRHEIISLKEKFFSGLLGYDVKICTPSSLPEDIVKRIGCMKVLIVIDDVNDLDHLEKLFGTLDNFGSGSKIIVTLRLTKSIRHTILDNSIMLKHLNFSI

SEQ ID NO: 226283 - protein, 560 aa, Glycine max
  Coding DNA Sequence Number=SeqID_109505
  Gene Ontology: Mol. function=transporter activity; Cellular component= membrane; Biological process=response to nematode
  Homolog annotation: Hit_ID=Q9LXV3; Match level="QueryCoverage=99%, HitCoverage=100%, E-value=0.0, Identity=71%"; Hit description=2 -oxoglutarate/malate translocator-like protein
  Pfam annotation: Domain name=Na_sulph_symp; Domain location=92-560; Score=854.1; E_value=6.8e-254; Accession=PF00939.9; Description =Sodium:sulfate symporter transmembrane region
  Subcellular localization annotation: CTP_CleavageSite=70; ConfidenceScore=5.57e-01
MASVALTTTALPYLRLRRNTAATLKPNRHSSISLSSLKPTLNASISSFPNFSLKKPSLVFNQKPSSLTVRASAASITPAPAPSSAPVQPWQGASIKPLIASIATGVILWFSPVPAGVNRNAWQLLAIFLGTIVGIITQPLPLGAVAILGLGVSVLTKTLPFAAAFSGFGDPIPWLIALAFFFAKGFIKTGLGNRVAYQFVKLFGSSSLGLGYSLVFSEALLAPAIPSVSARAGGIFLPLVKALCVACGSNAGDGTEHRLGAWLMLTCFQTSVITSAMFLTAMAANPLCATLTLNSINQTIGWLDWAKAAIVPGLASLVLVPLILYVIYPPTLKSSPDAPKLAKEKLEKMGPMTTNEKIMTATLFLTVGLWVFGGLLNVDAVSAAILGLSVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVATALGTPPFFGAIVLSFLSNLMGGLTHYGIGSAPVFFGANYVPLAKWWGYGFLISIVNIIIWLGLGGVWWKFIGLW

SEQ ID NO: 226284 - protein, 291 aa, Glycine max
  Coding DNA Sequence Number=SeqID_109506
  Homolog annotation: Hit_ID=Q9LXV3; Match level="QueryCoverage=47%, HitCoverage=31%, E-value=1e-61, Identity=71%"; Hit description=2 -oxoglutarate/malate translocator-like protein
  Subcellular localization annotation: CTP_CleavageSite=44; ConfidenceScore=5.38e-01
MSHAPNLCSVPSPALLPQATHSAFTSGRKIPPALADTEGIAGARSASLKTKLAMSQGMGSPKPENAAAKGSVLVRTETPNPNIATAPRGKGCVIMPTIVPKKIASSCHALRFTPAGTGENQRITPVAMEAISGFMEAPCHGCTGADEGAGAGVMEAAEALTGGGGVAAEAEVGECGGGECYGGHGGRELDLVMWRGRWRLGVEYAALFVGEELVAWGHVAGCEWVMAHVGFMLLDEHVGMEIGDYGMAPEENIKIFLACELTLWAFRSSKRAKSLEQKNPTTLKRHYKYYY

SEQ ID NO: 226285 - protein, 60 aa, Glycine max
  Coding DNA Sequence Number=SeqID_109507
MGRGGGGSEVGVGDGKNGERQAVREIHGEGRGGGEEGGPVAMSKFKSKTAISLGRKEIRH

SEQ ID NO: 226286 - protein, 216 aa, Glycine max
  Coding DNA Sequence Number=SeqID_109508
  Gene Ontology: Mol. function=protein kinase activity; Cellular component=cell surface; Biological process=protein amino acid phosphorylation
  Homolog annotation: Hit_ID=Q1RZG3; Match level="QueryCoverage=94%, HitCoverage=32%, E-value=7e-77, Identity=69%"; Hit description =Protein kinase
  Pfam annotation: Domain name=Pkinase; Domain location=43-216; Score =3.8; E_value=8.7e-09; Accession=PF00069.15; Description=Protein kinase domain
  Pfam annotation: Domain name=Pkinase_Tyr; Domain location=44-216; Score=-6.0; E_value=4.2e-12; Accession=PF07714.7; Description =Protein tyrosine kinase
  Pfam module annotation: Pfam domain module=Pkinase::Pkinase_Tyr; Domain location=43-216::44-216
MSSTNGKLSFTLKNDQGIESFLKHHGALAQKRYKFSEVKKMTNSFKVKLGEGGFGTVYKGELLSGCPVAVKILNASKGNGEEFINEVASISRTSHVNVVTLLGYSLEGRKKALIYEFMPNGSLDKFIHNKGLETTAALSWDNLWQIAIGIARGLEYLHSGCNTRILHFDIKPHNILLDENLCPKISDFGLAKLFPRKDSIVSLSYARGTIGYVAPE

SEQ ID NO: 226287 - protein, 140 aa, Glycine max
  Coding DNA Sequence Number=SeqID_109509
MTLLFPEEKKVQKTVPAPACYQAFCLTDSKRMGANNHKVSPRIMGISAYHGCRMTKLGLCLPTDTTVSEWQRGADNRKVSPRIIMTKLGLCLPTDTTVSEWQRGADNRKVSPRIIMTKLGLCLPTDTTVSEWQRGADNRK

SEQ ID NO: 226288 - protein, 134 aa, Glycine max
  Coding DNA Sequence Number=SeqID_109510
MSSAETRMLKIFPWLENCGWRVQVSVDVIPFENGRHFLRKLSVAGFSSTIWFSTEDPLLEQCERRLHVPTDVPEVDYGGGKNSAVEKALGKGFEYVFYPILAPLFSNQLTVVAKSSSYFAISLLLNLHLVPVRK

SEQ ID NO: 226289 - protein, 161 aa, Glycine max
  Coding DNA Sequence Number=SeqID_109511
MNYLVPALMKIKERSTSSDQHSGYCDDNIQNVVKYEVDMAMVHSAQGFAWSNALSVKLQRDRVNVDCDTTSFGEGSSSSRVCGQNCEMVPLDNFPSNPSLKSNNKCKEMPEMKRGLREDDDGDEDEVINGQLKSLRRLMPGGEEMCSEQMVNILRCLAETH

SEQ ID NO: 226290 - protein, 195 aa, Glycine max
  Coding DNA Sequence Number=SeqID_109512
  Gene Ontology: Mol. function=protein kinase activity; Cellular component=mitochondrion; Biological process=protein amino acid phosphorylation
  Homolog annotation: Hit_ID=Q1RZG3; Match level="QueryCoverage=72%, HitCoverage=22%, E-value=3e-36, Identity=55%"; Hit description =Protein kinase
MVSTTISSLNWHNANPSLLSLLTVAGEIHWTMKLILGITAGVMGGFMICIIICSTKCMSSTKVKLWLTLKNDQVIESFLKHHGALAQKRYKFSEVKKMTNSFKVKLGEGGFGAVYKGQLLSGCPVAVKILNASKGNGEYFINEVASISRTSHVNIVTLLGFSSEGRKKALIYEFFPMVLLTSLFTIRVWKQLHPC

SEQ ID NO: 226291 - protein, 101 aa, Glycine max
  Coding DNA Sequence Number=SeqID_109513
MKAILGYQEVAKIVEEGFSVHTTDATDKIAGVATSREVWQILEKCNKGVEQLKKVEELQFSLEAHEQRLIERGSKRSGDHQALEAYTSKRGGHNFKGHFRG

SEQ ID NO: 226292 - protein, 96 aa, Glycine max
  Coding DNA Sequence Number=SeqID_109514
  Gene Ontology: Mol. function=DNA binding; Biological process=DNA integration
  Homolog annotation: Hit_ID=Q1ST43; Match level="QueryCoverage=78%, HitCoverage=5%, E-value=1e-17, Identity=50%"; Hit description =Integrase, catalytic region; Peptidase aspartic, catalytic
  Subcellular localization annotation: CTP_CleavageSite=60; ConfidenceScore=5.03e-01
MSSIPPSNPKEDNPFGSDFNDPLLNPSSPYFIHPSDGPSSVSITPVLDGNNYQSWSRTIRMALISKNKMAFLLGTIPVPSVKEPLYSVWERCNTVI

SEQ ID NO: 226293 - protein, 307 aa, Glycine max
  Coding DNA Sequence Number=SeqID_109515
  Gene Ontology: Mol. function=2 iron, 2 sulfur cluster binding; Cellular component=chloroplast; Biological process=metabolic process
  Homolog annotation: Hit_ID=Q84RQ7; Match level="QueryCoverage=75%, HitCoverage=87%, E-value=8e-66, Identity=61%"; Hit description=NifU -like protein 3, chloroplast precursor
  Pfam annotation: Domain name=NifU; Domain location=135-202; Score =124.6; E_value=2.8e-34; Accession=PF01106.8; Description=NifU-like domain
  Pfam annotation: Domain name=NifU; Domain location=244-306; Score =4.3; E_value=0.00014; Accession=PF01106.8; Description=NifU-like domain
  Pfam module annotation: Pfam domain module=NifU::NifU; Domain location=135-202::244-306
MSANEETVAISISLAATNIRTELYHETKNETTFYINQNNFSFRLLMLGGALLTPTTQSLKATRTIAMLYPTHRLLSLKNPVSNTRGFSSKENIFIRGQQINIKQFFGLISGHSPRNKAGGVVSPRCGLPLTEENVEKVLDEVRPGLMADGGNVALHEIDGLVVVLKLQGACGSCPSSAMTLKMGIETRLRDKIPEILEVEQIMDTETGLELTEENVENVGGTSCIVSSISIISLAFWNFDFKYEVLSEIRPYLVGTGGGILELVQIKDYVVKVRLSGPAAGVTTVRVALTQKLRDKIPAIAAVQLID

SEQ ID NO: 226294 - protein, 190 aa, Glycine max
  Coding DNA Sequence Number=SeqID_109516
  Homolog annotation: Hit_ID=Q7XDI4; Match level="QueryCoverage=61%, HitCoverage=13%, E-value=1e-12, Identity=38%"; Hit description =Expressed protein
MWLSLPGCLALFFLSLATITHLFRDLSLGHSKRDSTPPLIMPPKLAAVTAADDLPSSFGQLAASLSDSDFALTAYEIFLAACRTSSGKPLSFAANHSSTIASKVKKAFGLKSPGLASRKSPGSASGQGKPKRPLIVGELMRNQMKVSEAMDSHVRRVLLRISAGQVVNTLRLNNSSRFFARAAMHVAREA

SEQ ID NO: 226295 - protein, 70 aa, Glycine max
  Coding DNA Sequence Number=SeqID_109517
MVRGRRRKSLRVNGLACLWLTKGADNHKRLMVCDRRRKSPCVNGLAGLWLTKGADNHKVPPHVIGLAVSG

SEQ ID NO: 226296 - protein, 101 aa, Glycine max
  Coding DNA Sequence Number=SeqID_109518
MSFSGEGSICSGDSRMLLLEVRLIRESFNDDPAHLHCGSNFASDQSSDIRVGGAIVGGVVVPLSAGVVAPTGGIATGIRPHPYFGVRSTLMEDEAESTRPN

SEQ ID NO: 226297 - protein, 399 aa, Glycine max
  Coding DNA Sequence Number=SeqID_109519
  Gene Ontology: Mol. function=nucleoside-triphosphatase activity; Biological process=defense response
  Homolog annotation: Hit_ID=Q1STU5; Match level="QueryCoverage=73%, HitCoverage=75%, E-value=7e-28, Identity=32%"; Hit description =Leucine-rich repeat
MLWQYARRPWESVLNLKDSPVQEIWLRLHSLHIPPHFRFKYLDTLIVDGCHFLSDAVLPFSLLPLLPKLKTLKVRNCDFVKIIFDVTTMGPLPFALKNLILDGLPNLENVWNSNVELTFPQVKSLSLCDLPKLKYDMLKPFTHLEPHPLNQVSIQKLTPNIEHLTLGEHELNMILSGEFQGNHLNELKVLALSIEFDAFLQRVPNIEKLEVCDGSFKEIFCFDSHNVDEDGLVSQLKVICSDSLPELVSIGSENSGIVPFLRNLETLQVISCLSSINLVPCTVSFSNLTYLKVKSCKSLLYLFTSSTARSLGQLKTMEISWCDSIEEIVSSTEEGDESDENEIIFQQLNCLELEGLGKLRRFYKGSLSFPSLEEFTLKDCERMESLCAGNDSNIRVRGD

SEQ ID NO: 226298 - protein, 158 aa, Glycine max
  Coding DNA Sequence Number=SeqID_109520
MHVCDLGSEYALEMQRWPRESFNPRGPGGTPPEKAPALPSPLTQILTGTDSRAPTISSASRPSRDSHSSERGGRWAPLVTPMAKFDLEIVMEFYANTWPTKEGAQDMCSWVRGQRIPFDADTLSQFLGHPRMGEDHAYEHDHPDPNMDDIAAQQHPTQ

SEQ ID NO: 226299 - protein, 72 aa, Glycine max
  Coding DNA Sequence Number=SeqID_109521
MANTCIPNCFIGYSLQNHAQMPLRHFTEHLVGACLGMNSKGMGAMWHFTEHLVGACLSACDTPIDRARWLGP

SEQ ID NO: 226300 - protein, 100 aa, Glycine max
  Coding DNA Sequence Number=SeqID_109522
  Gene Ontology: Mol. function=nucleic acid binding; Cellular component= chromatin; Biological process=RNA-dependent DNA replication
MACPEGQKVSFGTYTLAEEVVYWWENTRHCLEAEGQVVTWDVFQMLFMGKYFPEDVRNKKKMEFLELKQGNMTVAEYAAKFEELVRNGLLESASSCQVFN

SEQ ID NO: 226301 - protein, 42 aa, Glycine max
  Coding DNA Sequence Number=SeqID_109523
MTLKMDKSDLSILFSNYILREGNSCGDCKEFCFNLFPGTPIK

SEQ ID NO: 226302 - protein, 98 aa, Glycine max
  Coding DNA Sequence Number=SeqID_109524
MAHPTRALCLDVLQHKQAHETVMLRLPGALSLYAMWYHGDQSGSRCFARMLQPYEISIGLKEHSNPVTPKAYTPKSPSGPLPPDSGPTPKIILAHRHC

SEQ ID NO: 226303 - protein, 150 aa, Glycine max
  Coding DNA Sequence Number=SeqID_109525
MSKWSPRSSVTFIGCTQCTFYPIYLLALRGLEYDRCSVQSMLQYRAIPTLFASYIEPADTSIYSTSSILKRVITTYKYIIHRSLIFQLKKHSLKAIRSSNVRKISQHTNSRHDNKLKNFKATPCSRKFNNKHMVQELERPSLPLDELKKS

SEQ ID NO: 226304 - protein, 161 aa, Glycine max
  Coding DNA Sequence Number=SeqID_109526
  Homolog annotation: Hit_ID=Q9C7A2; Match level="QueryCoverage=32%, HitCoverage=9%, E-value=1e-12, Identity=70%"; Hit description =Ankyrin-like protein; 93648-91299
MGEYYLNFQINQQRVGRGGVWGAGVAVCYLADQPIAERGDLLVLCAEFVAGGKEVGDGGVLGGGENDDVVDFGWSSPLFRRELVCVTARPGGAQCRCAAPSPASPPSRTSSSSPGRFASPSSTAPAPAMEKETVISHKMGPSLLALQLRVLIHASKRVIEK

SEQ ID NO: 226305 - protein, 152 aa, Glycine max
  Coding DNA Sequence Number=SeqID_109527
MELKFSANSMKLYTFNNTKYHFCNQSDKEEVYANNVKLPVPVINGSEEDQAIWRPSLDGNLTFEEAFSFISPPGQVCSCLCGVAAETMDQLFFIYLFVKEISSASQASKTCCSQASGLESANFGLYIKCNTGGACRGFAGHAGVLLGVPSIL

SEQ ID NO: 226306 - protein, 70 aa, Glycine max
  Coding DNA Sequence Number=SeqID_109528
MLGAPSSTRHAASVGLFKDSFGAFRGCFSVYIGISTALHAKLYAVMVAVEHAHSVGWLRMWLECDSEYQN

SEQ ID NO: 226307 - protein, 109 aa, Glycine max
  Coding DNA Sequence Number=SeqID_109529
  Homolog annotation: Hit_ID=Q1T152; Match level="QueryCoverage=69%, HitCoverage=6%, E-value=2e-12, Identity=51%"; Hit description=IMP dehydrogenase/GMP reductase
MGFPSVREKEKRLQPLFHYQSARPIYLFKNIILKILTEKRKLSVRDISYTTDIIPKIPMIKLLALNVVLNDAEEKQIIDLAVKAWLDELKDVVYDAKDLLDEINIKSLR

SEQ ID NO: 226308 - protein, 152 aa, Glycine max
  Coding DNA Sequence Number=SeqID_109530
MVRTRGLGRALGQVTGRGVGRGNRDDFDDIPQRRQPTASARRQRVAVTVDYVDEPVIPTPDVQDDPMEAPVDVQDDPMEPGASSTSAEESRHAVEVFDDIAERLERHLSLGVVTPSSSTHEVIEECLRLVRSVTHDHLVYVRCRRRRRTDQA

SEQ ID NO: 226309 - protein, 80 aa, Glycine max
  Coding DNA Sequence Number=SeqID_109531
  Gene Ontology: Mol. function=protein kinase activity; Biological process=protein amino acid phosphorylation
  Homolog annotation: Hit_ID=Q1RZG3; Match level="QueryCoverage=98%, HitCoverage=12%, E-value=1e-18, Identity=61%"; Hit description =Protein kinase
MSDARGTIEYVAPEVWNRNFGGISQKSDVYSFGMMLLEMVGVKKNINGEVSQISEYFPYWIYNRLEQGIDLTTDGVIATQ

SEQ ID NO: 226310 - protein, 91 aa, Glycine max
  Coding DNA Sequence Number=SeqID_109532
MSDTLPPKTTVKDAAIHQSFDRSGFASAAIERGQLCGELVFRDDDWIAISPTTLRRGSRSREKESCTTPIACCHLRTTSKTKETPKTAAAS

SEQ ID NO: 226311 - protein, 158 aa, Glycine max
  Coding DNA Sequence Number=SeqID_109533
MNLPFQLPLLLIMTQPSRCSNSHIPLLNQCKTVIEPLQQPSITTHSNRKSSSFQYLLPESFSPEQKNAFDTLSSSAAINPLNVIAMSSQSSIDSSVVPPKLMGTTITYQFVTAFHNDRVLPPTALPYLDASAPNMTILKNHGHPLQWKLTLNDPDFGQ

SEQ ID NO: 226312 - protein, 452 aa, Glycine max
  Coding DNA Sequence Number=SeqID_109534
  Gene Ontology: Mol. function=transferase activity, transferring hexosyl groups; Cellular component=cytoplasm; Biological process =metabolic process
  Homolog annotation: Hit_ID=Q8LFF5; Match level="QueryCoverage=96%, HitCoverage=96%, E-value=6e-93, Identity=42%"; Hit description =Glucosyltransferase-like protein
  Pfam annotation: Domain name=UDPGT; Domain location=7-448; Score= -45.6; E_value=2.5e-08; Accession=PF00201.9; Description=UDP -glucoronosyl and UDP-glucosyl transferase
METQRHRLVLIPPPFQGHLTPMLQLATILHLKGFSITISHAHFNSPDPSNYPNFSFLPLFYDLSDTNITSKNVVDVTATLNTTKCVSPIKESLVDQIERANINHEKIVCVIYDGSMYSIDSVARELQLPSIVLRTTSATNLLTYHAFVQRQSKGFPPLQDSMLSLDLVPELEPLRFKDLPMLNSGVMQQLIAKTIAVRPSLGVICNTVDCLEEESLYRLHQVYKVSIFPIGPLHMIAEEDSSSSSFVEEDYSCIGWLNNKARKSVLYVSLGSIASWEEKELTEVACGLANSKQNFLWVIRSETISDVSEWLKSLPKDVKVAIAERGCIVKWAPQGEVLAHQAVGGFWSHCGWNSTLESLCEGVPIMCQPHFGDQRVNARLLSHVWKVGIEWSYVMERGEIEGAVRRLMVNQEGKEMSQRALELKNEIRLAVKGGSSYDALNRLVKSILSVNI

SEQ ID NO: 226313 - protein, 136 aa, Glycine max
  Coding DNA Sequence Number=SeqID_109535
  Gene Ontology: Mol. function=DNA binding; Biological process=DNA integration
  Homolog annotation: Hit_ID=Q1SKW6; Match level="QueryCoverage=91%, HitCoverage=23%, E-value=5e-13, Identity=34%"; Hit description =Integrase, catalytic region
MKAILGYQEVAKIVEEGFSVHTTDATDVQKALCKEYEKKDYKATILLQQCVDVAHFEKITGAATSREVWQILEKCNKGAEQLKKLEDLKVEEIQGSIEAHELRLIERGSKRSGDHQALEAYTSKRGGHNFKGHFRG

SEQ ID NO: 226314 - protein, 186 aa, Glycine max
  Coding DNA Sequence Number=SeqID_109536
  Gene Ontology: Mol. function=protein kinase activity; Biological process=protein amino acid phosphorylation
  Homolog annotation: Hit_ID=Q1RZG3; Match level="QueryCoverage=83%, HitCoverage=25%, E-value=3e-14, Identity=33%"; Hit description =Protein kinase
MRLVRTDLARDVCSPQFGDTYLNPTLFSYPPKVYNVTIFYDCPPITYPPPPHSITCGYAIPNIGEGFQDPLLEQCKRRLHVPTDVPEVDYGGGKNSAVEKALDKGFEVKYTVSQDCTTCLGSEGNCSRHDAHFYQNLCHYCPDGSHALHCSKTKSSSYFAISMLLNLHLVPVRKYESSNSTKSSRQ

SEQ ID NO: 226315 - protein, 346 aa, Glycine max
  Coding DNA Sequence Number=SeqID_109537
  Homolog annotation: Hit_ID=Q2HS22; Match level="QueryCoverage=62%, HitCoverage=68%, E-value=4e-29, Identity=40%"; Hit description=IMP dehydrogenase/GMP reductase
MAIDTSLPFPYQFLHDERGEQILPPIPSNDSNHTNCKNNNIHGHDLKPQELLIPREFRSLSQDNLVSDMPHFMLQDNTKFDSLSIGSDPLESLWDSVSYPQSTPSSTLSSIQGSSEGSSQEPSPNSYDFCWDNTYDVVEMLEKMKLDERDSSKYHHGYGNHRFETSNVGVCSLLQEQIQAIQLSRLRQEQILSRKQKLTKYRGKNHGQISQQFQKKGKGVDDGCDNECRTRPPWHNRWHQQAESKGTSCGTGVFLPRGRTSAPLESRERPGKGCSTVLIPARVVQALQLHFEQMAATTGPKPGGFPPLHDVLVSNRDGMYSLQKRQSRDKPAHIQNEMILPQEWTY

SEQ ID NO: 226316 - protein, 130 aa, Glycine max
  Coding DNA Sequence Number=SeqID_109538
  Gene Ontology: Mol. function=protein kinase activity; Biological process=protein amino acid phosphorylation
  Homolog annotation: Hit_ID=Q1RZG3; Match level="QueryCoverage=93%, HitCoverage=19%, E-value=2e-17, Identity=48%"; Hit description =Protein kinase
MADTAAAEKPVCICLEGRMRALIYEFMPNGSLDKLIYRKGPETITPLSWDIMYETAMGVSLKSDVYRFGMMLLEMVGRRKNTIDEASHRSEIYFLHWVYKRLQLGNDLRLDEVMTPEENEIAKRLTIVLW

SEQ ID NO: 226317 - protein, 52 aa, Glycine max
  Coding DNA Sequence Number=SeqID_109539
MTNPFKVKLGELHSGCPVAVKILNASKGNDKHFVNEVASMSITSDVNVAILL

SEQ ID NO: 226318 - protein, 633 aa, Glycine max
  Coding DNA Sequence Number=SeqID_109540
  Homolog annotation: Hit_ID=Q1SWM4; Match level="QueryCoverage=22%, HitCoverage=35%, E-value=6e-25, Identity=40%"; Hit description=Zinc finger, FYVE/PHD-type
  Pfam annotation: Domain name=PHD; Domain location=338-387; Score =20.1; E_value=0.00055; Accession=PF00628.19; Description=PHD-finger
MTGMIDRLEVSFQRQFNYHDQVPHKIGGGKTAVTYDIMAPSPVVGSSFKLVFQQILDSQAQLLEGKEYHKIQNPTVETNDHPHAPADSNIYTQPEDVSSDSAARALRPPKVGYCKICEVHLPYCKTLEMHNQENSHQIMLKLYEEIQRLKTSNVQIPNSQKNLVVLPKTVHISGKNGHPQKNMSSEASILKHKNYLKKGMGLTCEIPAKGPEVKPRDNSGAQGHGFKQNIRGLKIGKSSFKLQSQRILASQTPVSEHKEHAIHIGPESQLSKDTADCENQSCTDEKNNQLLPSIVAEFNSPSDSSTNTQTTDECSKAEQRIEILTHQSGTTQLSQVAVCLQCGNAGFPETLVFCNKCQVYARHRYCLDGPVIFTDDVTWFCEDCEAKVTSFHDSCTLLPSGKNISLNSGNDASQARIEPKSCIESVKNKQEPQNIIAKTMVLLSDNHSLSHHGLSQCINNAEKENKFEKEFQPDPKDEANTSESLNATVPYPIADPVWRGSLRISDPSFGTVIGLLAHVSTLASPKVLEETRFFPDVLCPDLRPRTAVWPKSFMKCGPNMDSIALYFFPDSERVERAFHKLVEDMMYFDLSLRTEVENAELLIFPSILLPIQCRRFLEKYYLWGVFRAKKPSL

SEQ ID NO: 226319 - protein, 119 aa, Glycine max
  Coding DNA Sequence Number=SeqID_109541
  Homolog annotation: Hit_ID=UPI000067F4D0; Match level="QueryCoverage =85%, HitCoverage=73%, E-value=2e-13, Identity=45%"; Hit description =conserved hypothetical protein
MSGECERDNKDVYRGVHVADSSKVPLDSLTQQGRVLFSVMLKLERPTEPLAWWEGETILGGKDALGGGTWLGSTRDGRIAFLTNFREVEMLSNPKTRGDLPLRFLQINASSKVHKFLKS

SEQ ID NO: 226320 - protein, 308 aa, Glycine max
  Coding DNA Sequence Number=SeqID_109542
  Gene Ontology: Mol. function=protein kinase activity; Cellular component=cell surface; Biological process=protein amino acid phosphorylation
  Homolog annotation: Hit_ID=Q1RZG3; Match level="QueryCoverage=98%, HitCoverage=48%, E-value=1e-118, Identity=69%"; Hit description =Protein kinase
  Pfam annotation: Domain name=Pkinase; Domain location=3-275; Score =136.0; E_value=1e-37; Accession=PF00069.15; Description=Protein kinase domain
  Pfam annotation: Domain name=Pkinase_Tyr; Domain location=4-275; Score=99.5; E_value=9.8e-27; Accession=PF07714.7; Description =Protein tyrosine kinase
  Pfam module annotation: Pfam domain module=Pkinase::Pkinase_Tyr; Domain location=3-275::4-275
MTNSFKVKLGEGGFGAVYKGEIHSGCPVAVKILNASKGNGEDFINEVASISRTSHVNVVTLLGFSLEGRKKALIYEFMPNGSLDKFIYNKGLETTASLSWDNLWQIAIGIARGLEYLHSGCNTRILHLDIKPQNILLDENLCPKISDFGLAKLFPRKDSIVSLSYARGTIGYVAPEVCNKHFGGISHKSDVYSYGMMLLEMVGVKKNINAETSQTSEYFPDWIYKRLEQGRDLTTDGVIATQETEIARKMTIVGLWCVQTIPQDRPTMSKVIDMLEGNMNSLEMPPKPILSSPARLVPEFTTSSLQSG

SEQ ID NO: 226321 - protein, 118 aa, Glycine max
  Coding DNA Sequence Number=SeqID_109543
  Gene Ontology: Mol. function=nucleic acid binding; Cellular component= intracellular; Biological process=response to DNA damage stimulus
  Homolog annotation: Hit_ID=P42698; Match level="QueryCoverage=67%, HitCoverage=20%, E-value=6e-37, Identity=91%"; Hit description=DNA -damage-repair/toleration protein DRT111, chloroplast precursor
CAYLHTLMPNWLIYAMKSSTVGPGEVDDELEDEVGSECAKYGTVTRVLIFEITEPNFPVHEAVRIFVQFERSEETTKALVDLDGRYFGGRVVRASFYDEEKFSKNELAPMPGEIPGFT

SEQ ID NO: 226322 - protein, 147 aa, Glycine max
  Coding DNA Sequence Number=SeqID_109544
MSREFGLIQIKLHSQMNLAELSLTKQRYDYSIIKTKLPHFMIRVYIKYSAEIPNNGFSLPSQGSTFYKQEKGFESNSQIHSGEDVSSTSKDQKITQKPRIYLKAKVFAPLLYSAPLFSIFHYSPPSFLFSLHFRIKKGFLTSKACLA

SEQ ID NO: 226323 - protein, 768 aa, Glycine max
  Coding DNA Sequence Number=SeqID_109545
  Gene Ontology: Mol. function=binding; Cellular component =mitochondrion; Biological process=translation
  Homolog annotation: Hit_ID=Q2HSE6; Match level="QueryCoverage=99%, HitCoverage=98%, E-value=0.0, Identity=66%"; Hit description=IMP dehydrogenase/GMP reductase
  Pfam annotation: Domain name=PPR; Domain location=108-142; Score=3.0; E_value=3.3; Accession=PF01535.11; Description=PPR repeat
  Pfam annotation: Domain name=PPR; Domain location=213-246; Score=6.5; E_value=1.3; Accession=PF01535.11; Description=PPR repeat
  Pfam annotation: Domain name=PPR; Domain location=251-285; Score =36.5; E_value=9.3e-08; Accession=PF01535.11; Description=PPR repeat
  Pfam annotation: Domain name=PPR; Domain location=286-320; Score =43.2; E_value=8.7e-10; Accession=PF01535.11; Description=PPR repeat
  Pfam annotation: Domain name=PPR; Domain location=321-355; Score =37.0; E_value=6.7e-08; Accession=PF01535.11; Description=PPR repeat
  Pfam annotation: Domain name=PPR; Domain location=356-390; Score =34.1; E_value=4.8e-07; Accession=PF01535.11; Description=PPR repeat
  Pfam annotation: Domain name=PPR; Domain location=391-425; Score =39.5; E_value=1.2e-08; Accession=PF01535.11; Description=PPR repeat
  Pfam annotation: Domain name=PPR; Domain location=563-597; Score=7.3; E_value=1; Accession=PF01535.11; Description=PPR repeat
  Pfam annotation: Domain name=PPR; Domain location=598-632; Score =27.5; E_value=4.7e-05; Accession=PF01535.11; Description=PPR repeat
  Pfam annotation: Domain name=PPR; Domain location=633-667; Score =25.8; E_value=0.00016; Accession=PF01535.11; Description=PPR repeat
  Pfam annotation: Domain name=PPR; Domain location=668-702; Score =49.4; E_value=1.2e-11; Accession=PF01535.11; Description=PPR repeat
  Pfam annotation: Domain name=PPR; Domain location=703-737; Score =45.4; E_value=1.9e-10; Accession=PF01535.11; Description=PPR repeat
  Pfam annotation: Domain name=PPR; Domain location=73-107; Score=16.6; E_value=0.08; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=108-142::213 -246::251-285::286-320::321-355::356-390::391-425::563-597::598 -632::633-667::668-702::703-737::73-107
MRHWKQLGEVLVAASITNTLSHSHSATINLPPNLALGLTQPLILKILSNPAHHASHKLRFFEWSRSHHCPSPAAYSVILRTLSREGFYSDIPSLLHSMTQAGVVLDPHSLNHLLRSFIISSNFNLALQLLDYVQHLHLDPSPIYNSLLVALLEKNQLTLALSIFFKLLGAVDSKSITACNQLLVALRKADMRVEFEQVFQRLREKRGFSFDTWGYNVCIHAFGCWGDLATCFALFKEMKGGNKGFVAPDLCTYNSLITALCRLGKVDDAITVYEELNGSAHQPDRFTYTNLIQACSKTYRMEDAIRIFNQMQSNGFRPDTLAYNSLLDGHFKATKVMEACQLFEKMVQEGVRPSCWTYNILIHGLFRNGRAEAAYTMFCDLKKKGQFVDGITYSIVVLQLCKEGQLEEALQLVEEMESRGFVVDLVTITSLLISIHRHGRWDWTDRLMKHIREGDLALSVLKWKAGMEASMKNPPGKKKDYSPLFPSKGDFIDIINFMTCAQDTTNINDGEENSCNEIDEWSSSPHMDKLANQVSSTGYSSQMFTPSRGQRVQEKGPDSFDVDMVNTFLSIFLAKGKLSLACKLFEIFSDAGVDPVSYTYNSIMSSFVKKGYFAEAWAILTEMGEKFCPTDIATYNMIIQGLGKMGRADLASAVLDRLLRQGGYLDIVMYNTLINALGKASRIDEVNKLFEQMRSSGINPDVVTYNTLIEVHSKAGRLKDAYKFLKMMLDAGCSPNHVTDTTLDYLGREIDKLRYQRASILSEKDDPS

SEQ ID NO: 226324 - protein, 269 aa, Glycine max
  Coding DNA Sequence Number=SeqID_109546
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=73%, E-value=9e-78, Identity=49%"; Hit description =Integrase, catalytic region
  Pfam annotation: Domain name=rve; Domain location=10-163; Score=61.4; E_value=3e-15; Accession=PF00665.16; Description=Integrase core domain
MVGLLCPLPVPHRPWEDLSLDFITGLPPYHGNSVTLVVVDCFSKGIYLGMLPSSHTAHTMASLFMDIVGKIHGLPRSLVSDRDPLFVSKFWQELFQLSGTQLRMSSAYHPQSDGQTEVLNKIIEQYLRAFVHRRINPYEITFERKPFNFPEYIAGSSKLDVVDDMSKDREETFQGIRKKLLKAQTAMKHFVDAKQREVTYQTGDWVILILRPHRQLSVKGPNAVHGKLAKRFYGPFRIVERIGLVTYRLQLLDKVRIYPVFHCSVLKSF

SEQ ID NO: 226325 - protein, 343 aa, Glycine max
  Coding DNA Sequence Number=SeqID_109547
  Gene Ontology: Mol. function=nucleic acid binding; Cellular component= chromatin; Biological process=DNA integration
MADYERGDDLSDNAMMVTKDDPVTYEEAVKSKTWRDAMKKEMVAIEKNKTWELTNLPTGMKPIGVKWIYKTKLKENGEIDKFKARLVAKGYAQQYGVDYTEVFAPVAKMDTIRILVSISAQHGWSIYQLDVKSAFLHGELKEEGGKILIMSLYVDDLIYTGNDESMCNDFRSSMMLEFHMMDLGRMRYFLGIEILKNNHGIFMCQRKYAHDVLTQFGMQDCNAIKNPIVPGTKLSRNDAGTKVDATQFIQVVGSLMYLTATRPNLMYGVSLISRFMANPTKTHWFAAKRILRYLKGTTELGIYYKKEESTNVVAYTDNDFAGDIDDRKSTSGFVFFLGNEAVP

SEQ ID NO: 226326 - protein, 434 aa, Glycine max
  Coding DNA Sequence Number=SeqID_109548
  Gene Ontology: Mol. function=cation transporter activity; Cellular component=integral to membrane; Biological process=zinc ion transport
  Homolog annotation: Hit_ID=Q6DBM8; Match level="QueryCoverage=87%, HitCoverage=95%, E-value=1e-83, Identity=43%"; Hit description=Metal tolerance protein B
  Pfam annotation: Domain name=Cation_efflux; Domain location=64-400; Score=197.4; E_value=3.4e-56; Accession=PF01545.11; Description =Cation efflux family
MEHEKAPILVEERTMQEIEIPIASERLDVIPMKADSSCSSVCPFSGHENSAVASKESSKKLSGLIVFYAIVMVVELIGGIKAHSLSVISDAAHLLSDIAGFSISLFAVWASGWEATPHQSFGYNRLEVLGALVSVQLIWLISGFLIYEAVGRILVRNGSVNGKLMLAIAALGFVLNFIMVAWIGHDHSHHHHYHHHHHHHHHHHHDGCESSGHDHSHHQYQTDHDHGKEEQSKITDEENVTLVSSSQTNTNVLNINLQGAYLHVMADMIQSIGVMIAGAIIWAKPEWFMVDLVCTLIFSVLSVSTTLPLLRNIYGILMERTPSEIDISKLESGLRNIKGVQDVHDLHVWAITVGKCVLSCHVVAEPGISSIDLLGTIKNYLCQVLGETRAMRGMVNSVKGTEYRHWLGSGYRENNFGDGLLIGVRYARHCQTNV

SEQ ID NO: 226327 - protein, 667 aa, Glycine max
  Coding DNA Sequence Number=SeqID_109549
  Gene Ontology: Mol. function=transferase activity; Cellular component= nucleus; Biological process=protein amino acid phosphorylation
  Homolog annotation: Hit_ID=Q1RZ85; Match level="QueryCoverage=76%, HitCoverage=67%, E-value=2e-83, Identity=32%"; Hit description =Asp/Glu racemase; Polynucleotidyl transferase, Ribonuclease H fold
  Pfam annotation: Domain name=PPR; Domain location=184-218; Score=8.7; E_value=0.69; Accession=PF01535.11; Description=PPR repeat
  Pfam annotation: Domain name=PPR; Domain location=287-321; Score =32.6; E_value=1.4e-06; Accession=PF01535.11; Description=PPR repeat
  Pfam annotation: Domain name=PPR; Domain location=322-356; Score =38.4; E_value=2.5e-08; Accession=PF01535.11; Description=PPR repeat
  Pfam annotation: Domain name=PPR; Domain location=357-391; Score =38.6; E_value=2.1e-08; Accession=PF01535.11; Description=PPR repeat
  Pfam annotation: Domain name=PPR; Domain location=458-492; Score =38.2; E_value=2.9e-08; Accession=PF01535.11; Description=PPR repeat
  Pfam annotation: Domain name=PPR; Domain location=494-528; Score=9.9; E_value=0.5; Accession=PF01535.11; Description=PPR repeat
  Pfam annotation: Domain name=PPR; Domain location=530-564; Score=0.8; E_value=6; Accession=PF01535.11; Description=PPR repeat
  Pfam module annotation: Pfam domain module=PPR::PPR::PPR::PPR::PPR::PP R::PPR; Domain location=184-218::287-321::322-356::357-391::458 -492::494-528::530-564
MKRAHAIDHSGTKRREIKTAASDPNATPTLTLASSPGIRNWFDSLSATPLQQPSSYKDKSDDVDLLSMKVRSGWGDVGAKAVFEGITFRLMGHKCERNATLLATNGIISRHFFRSEPESYAELIDMYARDRALHAGKKLHAHLVTNGFARFNVVASNLVSFYTCCGQLSHARKLFDKIPTTNVRRWIALIGSCARCGFYDHALAVFSEMQAVQGLTPNYVFVIPSVLKACGHVGDRITGEKIHGFILKCSFELDSFVSSSLIVMYSKCAKVEDARKVFDGMTVKDTVALNAVVAGYVQQGAANEALGLVESMKLMGLKPNVVTWNSLISGFSQKGDQGRVSEIFRLMIADGVEPDVVSWTSVISGFVQNFRNKEAFDTFKQMLSHGFHPTSATISALLPACATAARVSVGREIHGYALVTGVEGDIYVRSALVDMYAKCGFISEARNLFSRMPEKNTVTWNSIIFGFANHGYCEEAIELFNQMEKEGVAKLDHLTFTAALTACSHVGDFELGQRLFKIMQEKYSIEPRLEHYACMVDLLGRAGKLHEAYCMIKTMPIEPDLFVWGALLAACRNHRHVELAEVAAMHLMELEPESAANPLLLSSVYADAGKWGKFERVKKRIKKGKLRKLQEKGTPTGIILDVSFCAPLDGDGMRWKEKERNSTHFIV

SEQ ID NO: 226328 - protein, 435 aa, Glycine max
  Coding DNA Sequence Number=SeqID_109550
  Gene Ontology: Mol. function=kinase activity
  Homolog annotation: Hit_ID=Q2HS33; Match level="QueryCoverage=82%, HitCoverage=85%, E-value=5e-15, Identity=27%"; Hit description=IMP dehydrogenase/GMP reductase
MAQLERPQRQVETPKTPPTIHTMEQLLREGESKSKQSPTYSSSSSMNSSPSSPFFQRLRHHDSEEDHGQNQKKSVLTKVKEKAKKLRHSLSKRKHEDGNPTSPSSATGVEGDGAEEDAEYLGAPMYGSEKSPAGYEAYVRQQNSSPRGNLVFPEKHMLSSSDKHVVEPDHQEKTLSRSMSKKTTTTSSPNATTSNINTNTLSGLNKTIVAKKPTPVHVEKPDASHITSKIQGLTVSKPTEHHDHTSPSSTTVQTIRNTSLSYAAPFTPPAKLPSQAPSITPRTTPAPVTPEPSSAPAFSGKSTSPTAQIQDKGVSMKEYLLNKLEPGEDEKALSQMISEAMSPRRTPGDVGVMEKVREAVTSLLRTEEPTKYADTTTTTPTRMSCQSPKASCASSQMPASISASRSSSQIPLSFNAQQDYEVAEEENHGRILQAN

SEQ ID NO: 226329 - protein, 50 aa, Glycine max
  Coding DNA Sequence Number=SeqID_109551
MEDEKDKENTNSISCVGKIFREIRRREKVQYLIPDGCWGGANVDDLARYF

SEQ ID NO: 226330 - protein, 498 aa, Glycine max
  Coding DNA Sequence Number=SeqID_109552
  Gene Ontology: Mol. function=sugar porter activity; Cellular component=integral to membrane; Biological process=carbohydrate transport
  Homolog annotation: Hit_ID=Q0WWW9; Match level="QueryCoverage=85%, HitCoverage=86%, E-value=1e-134, Identity=55%"; Hit description=D -xylose-proton symporter-like 3
  Pfam annotation: Domain name=MFS_1; Domain location=99-455; Score =21.2; E_value=3.4e-05; Accession=PF07690.6; Description=Major Facilitator Superfamily
  Pfam annotation: Domain name=Sugar_tr; Domain location=95-496; Score =186.7; E_value=5.5e-53; Accession=PF00083.14; Description=Sugar (and other) transporter
  Pfam module annotation: Pfam domain module=MFS_1::Sugar_tr; Domain location=99-455::95-496
  Subcellular localization annotation: CTP_CleavageSite=79; ConfidenceScore=5.81e-01
MASTTLFSFRLSLNPLHHQQTTRPKSLLSSPRTNPRLVSSINNHLALTRVTYPLLQSHSAPKRRFHVYSDGESSESLVSDATYQEEFSWSSVILPFLFPALGGLLFGYDIGATSGATISLQSPELSGISWFKLSAIQLGLVVSGSLYGALLGSLVAFAIADFLGRKKQLITAALLYLFGGVITAYAPELGVLLAGRLLYGLGIGLLGYFVGSFLIETVGGWRFMYGFSAPVAVLMGLGMLTLPNSPRWLLLRAVQGKGSFQDLKEKAIFSLSKLRGRPPGDKESERQVEETLVSLKSAYADKESEGNFLEVFQGPNLKAFIIGGGLVLFQQITGQPSVLYYAGPILQSAGFSAASDATKVSVVIGLFKLLMTWIAVLKVDDLGRRPLLIGGFPLVAVGALLLYVGCYQISFGPISWLMVSEVFPLRTRGKGISLAVLTNFASNAVVTFAFSPLKEFLGAENLFLLFGAIAILSLLFIIFSVPETKGLSLEDIESKILK

SEQ ID NO: 226331 - protein, 159 aa, Glycine max
  Coding DNA Sequence Number=SeqID_109553
  Gene Ontology: Mol. function=histone-lysine N-methyltransferase activity; Cellular component=nucleus; Biological process =multicellular organismal development
  Homolog annotation: Hit_ID=Q9SHE9; Match level="QueryCoverage=99%, HitCoverage=98%, E-value=3e-58, Identity=68%"; Hit description=LOB domain-containing protein 4
  Pfam annotation: Domain name=DUF260; Domain location=13-113; Score =245.5; E_value=1.1e-70; Accession=PF03195.5; Description=Protein of unknown function DUF260
MKDGGRKQGAPSPCAACKLLRRRCAQDCVFAPYFPADEPQKFANVHKVFGASNVNKMLQDLAEHQRGDAVSSMVYEANARVRDPVYGCVGAISSLQQQIDVLQTQLAVAQAEAVHLRVRQTASLYSPTSPTNSGSPSQAKPIFDMDMVVDQNSYGDSMW

SEQ ID NO: 226332 - protein, 914 aa, Glycine max
  Coding DNA Sequence Number=SeqID_109554
  Gene Ontology: Biological process=mRNA processing
  Pfam annotation: Domain name=PWI; Domain location=45-117; Score =129.3; E_value=1.1e-35; Accession=PF01480.8; Description=PWI domain
MSGGFFRGTSADQDTRFSNKQAKLMKSQKFAPELEHLVDMTKVNMEVIKPWITRRVTELLGFEDEVLINFIHGLLDAKEVNGKEVQIQITGFMEKNTGKFMKELWMLLLSAQKNASGVPQQFLDAKEEELLKKKAESDLIASEIQRKTDNEDREIMEERLKKLDGGFDSKDNDTASDPTLKLRDSGYREWDGKETDKRNGVRARSRLSRSPHSPAVSISPHRGSPSRSMSKSFSNSRSYSGHRSRSISRSPEAQGPSLSAERIRRSPRRRSISPQRHSPRRSPHRRIPYSRRSRSPSPERRRMHSPVHRRSPSFRRRRSPSPVRRHRSPSPVRRRRSPSPVRRRRSPSPVRRRRSPSPVRRRRSPSPVRRRRSPSPVRRRRSPSPVRRRRSPSPGRRHRSPSPGRCHRSPSPLGQRRSLSPRRRRSLVTRHRSPSPVRRIPPTNVQNRSDSPMQSPSHIRQRYGSRTPSLSPSPLQRRSPIPSKQRSPNISPQRSPQDEQSSQSPIRCVSPSPIRKNSPRHQKSPLHSSMGRVRTESVTRQPSSPLGSAIRDKCGKASHYKSQDSMSTPEKSPIQSVSQEARSETSSEGRSPHESPMKQRRDKLSNEINTNPLKKQRTQRPSRDSPDTRDEAEETHYSRESRDPKMNSSQKISKHFPVSKRKGSPAKYRHEEFSPERVSGHPASEHHYDNNDWSKKGQEIMRDKSSGKGNEFPAQKSSMNKETFSREKPQESYAVDIKKSDVKDQSHSNYAKSSYRHHKSETTQDLVGKGDRVNHNASHDSVSEDSGKHRREGKDRKRHKRSEKKYTSSDEDYSDDSELEDRKEAKRRRKEEKKLQKEEKRRRCEEKRRRREERRAEKLKMKSKTDDISGDEEAKRMDYHQSDSVVTPSEQKKLEIELRNKALESLKAKKGMNN

SEQ ID NO: 226333 - protein, 174 aa, Glycine max
  Coding DNA Sequence Number=SeqID_109555
  Homolog annotation: Hit_ID=Q9ZU94; Match level="QueryCoverage=54%, HitCoverage=34%, E-value=1e-11, Identity=41%"; Hit description =Expressed protein
MERADTVIYIRDRRWMGSELLILDTELEKRSQLQRSTAELCWSSEPTGSDQHNDTLKHTKLDRVEEIKVSGDIVVFDKIVVKLQCVVVGDEVEVVELSDRRRHAARALVVDEVVATLEVVVDDIEGGGDSEVVVVGEGDGVDKGGEDRVDDVFIDETQHGLELGTDLHESDRSS

SEQ ID NO: 226334 - protein, 104 aa, Glycine max
  Coding DNA Sequence Number=SeqID_109556
MSKPFCTLFALSIILVTCHAQTLNTSTTCEPSKCGNLNISYPFWKKSNTNVQEFCGYPEFGLECLDDQAILILPTNRYQMCWDNHVQGLDTMFPYTISLYLSAH

SEQ ID NO: 226335 - protein, 117 aa, Glycine max
  Coding DNA Sequence Number=SeqID_109557
MDYQALTMKFAQGPHYIELKGETSTDPTQLSYNHLCKLLTRDQVAKLRITNPDLGDYTPLHHAHVLNLTFRPLFHDHAFLLEESSHHLLLVRPTNHSIPLLQNVVPITVCLYRNTRL

SEQ ID NO: 226336 - protein, 73 aa, Glycine max
  Coding DNA Sequence Number=SeqID_109558
MQKGFVLDWMRAQDCAVCEESNGYCRFDQATKQSRCLCSEGRTEAKSCKKDFYIIEIFAHIHNSTQFIAFIKI

SEQ ID NO: 226337 - protein, 48 aa, Glycine max
  Coding DNA Sequence Number=SeqID_109559
MDIGIGIPWWWVQAACLSDGTTVQVSKERLSYGRDSHLKGKLLEYKCE

SEQ ID NO: 226338 - protein, 379 aa, Glycine max
  Coding DNA Sequence Number=SeqID_109560
  Gene Ontology: Mol. function=protein kinase activity; Cellular component=cell surface; Biological process=protein amino acid phosphorylation
  Homolog annotation: Hit_ID=Q1RZG3; Match level="QueryCoverage=80%, HitCoverage=48%, E-value=1e-120, Identity=70%"; Hit description =Protein kinase
  Pfam annotation: Domain name=Pkinase; Domain location=3-275; Score =135.9; E_value=1.1e-37; Accession=PF00069.15; Description=Protein kinase domain
  Pfam annotation: Domain name=Pkinase_Tyr; Domain location=4-275; Score=99.0; E_value=1.4e-26; Accession=PF07714.7; Description =Protein tyrosine kinase
  Pfam module annotation: Pfam domain module=Pkinase::Pkinase_Tyr; Domain location=3-275::4-275
MTNSFKVKLGEGGFGAVYKGELLSGCPVAVKILNASKGNGEDFINEVASISRTSHVNIVTLLGFSLEGRKKALIYEFMPNGSLDKFIYNKGLETTASLSWDNLWQIAIGIARGLEYLHSGCNTRILHFDIKPHNILLDENLCPKISDFGLAKLFPRKDSIVSLSYARGTIGYVAPEVCNKHFGGISHKSDVYSYGMMLLEMVGVKKNINAETSQTSEYFPDWIYKRLEQGRDLTTDGVIATQETEIARKMTIVGLWCVQTIPQERPTMSKVIEMLEGNMNSLEMPPKSVLSSPARSVPEFTTSSLQSGSLNMIMLYFSFILKQSGCQASANKLNSNARPNCVLCLVLCEIKVVDSDEICYKGWTSGSKCVFLFLDSLSS

SEQ ID NO: 226339 - protein, 212 aa, Glycine max
  Coding DNA Sequence Number=SeqID_109561
MNAWVTTNHIGLRLLPSVWALYFMQTLSFMQYYPYHSRPHRKHLVLKVLGDQRIGSKRDTGIPSPTRRNNAEELGEGNGGGSGGRGGGGGVVTSRGGGGGVVAGEGGLVVNAVSVDDGVGLSSRGDDGVCSGVGMMVADGGGQGVNGSGEVVLAEGFRMTSRVGGGRQPWKLRMVSGSHGRRPWEVNESTNVTCDGLVAELRGSTPPEEEES

SEQ ID NO: 226340 - protein, 228 aa, Glycine max
  Coding DNA Sequence Number=SeqID_109562
  Gene Ontology: Mol. function=protein serine/threonine kinase activity; Cellular component=nucleus; Biological process=protein amino acid phosphorylation
  Homolog annotation: Hit_ID=UPI0000162DEA; Match level="QueryCoverage =87%, HitCoverage=38%, E-value=2e-34, Identity=36%"; Hit description =ATP binding / kinase/ protein kinase/ protein serine/threonine kinase/ protein-tyrosine kinase
MTLQIFFHYNTPQQCCLCIITTIFFLATRVLSSNPKFEPCTPRNCGNGPPIKYPFWIPYEQESFCGYSNFSFTVANIDVYEDKCPVPLDNYTFYQTPFTYRSENWNLSFFYNCSIEPKNYPTFEVDCAKNATHYSLAVFHKEALEHKTYSLNECQFMVNVPLNMNAAINFTSLLRMNYPEILKMGSLLNWIAPDCQDREKSGGRCGSDGNQFLCNCKDKSYLKSCGSG

SEQ ID NO: 226341 - protein, 52 aa, Glycine max
  Coding DNA Sequence Number=SeqID_109563
TAVTEIMLKVCIEEVKENAGNKPHNHFTKLAYWKDTGLGLDGEKKTIAGSDE

SEQ ID NO: 226342 - protein, 227 aa, Glycine max
  Coding DNA Sequence Number=SeqID_109564
MDVGSLHFCSAPDNNPIHASTPYFGVIEEIWELDYSKFRVLIFKCKWINGNISVRQNEIGFTLVDLDKVVYKDEPFIMSLRLGGLNSPHDSSLTARQLDKAKATLDIPESSNAKKKDSLQDQMTQGSFVPHGYQDIETIGIRGVEGGPDEQLELEVEEPDLDIMPTMGLYVNDDHYTRLVALGKVYEGASTIHHMHLTNDVVKVDVEEVQDVDVQVPFTTLEIQCVG

SEQ ID NO: 226343 - protein, 78 aa, Glycine max
  Coding DNA Sequence Number=SeqID_109565
  Subcellular localization annotation: CTP_CleavageSite=68; ConfidenceScore=5.13e-01
MRLSLEVQKEQSCSADHWAQRASTAKRSFSALSVTREFGRAQESRLCAKREISLLSETFVFSQAQRTTGSKPKSTYSH

SEQ ID NO: 226344 - protein, 514 aa, Glycine max
  Coding DNA Sequence Number=SeqID_109566
  Gene Ontology: Mol. function=lipoxygenase activity; Cellular component=chloroplast; Biological process=electron transport
  Homolog annotation: Hit_ID=Q1S9M9; Match level="QueryCoverage=95%, HitCoverage=57%, E-value=0.0, Identity=68%"; Hit description=Plant lipoxygenase; Lipase/lipooxygenase, PLAT/LH2
  Pfam annotation: Domain name=Lipoxygenase; Domain location=168-514; Score=109.3; E_value=1.1e-29; Accession=PF00305.9; Description =Lipoxygenase
  Pfam annotation: Domain name=PLAT; Domain location=59-156; Score =70.5; E_value=5.5e-18; Accession=PF01477.13; Description=PLATLH2 domain
  Pfam module annotation: Pfam domain module=Lipoxygenase::PLAT; Domain location=168-514::59-156
  Subcellular localization annotation: CTP_CleavageSite=60; ConfidenceScore=5.20e-01
RVSRGMKVVMATTTKNANTITTSQSVKALVTVKQSGGGIIRNLVNGGLDGIRELVGKTLVLELVSDEIDSKSNSERKTKKSNVHKTETKEDEVLYEATFDLPEAFGNVGAVLVQNEDHNEVFLKSIVLDGFPNGPLHFTCDSWIQPKSDSPVKRVFFSDKSYLPSQTPSGLRKLREEELKQKRGNGEGERKSTDRIYDYDVYNDLGDPDSNIDLKRPVLGGTRQYPYPRRCRTGRKHSEADPSSEKKASNFYVPRDEIFSEIKQTQFTTTTISSAVSLVLESLDAILTDQSLGFVSFEDIDTLYKEGFHVPALQANGNALQRVIPKLLSVVNDKQNLLRFDTPDAFKRDRFFWLSDEQFARETLAGVNPYSIQLVKEWPLRSKLDPQIYGPPESAITKEVIEPQIIGYCTVEEAIKEKKLFMLDYHDLFLPYVRKVREIKGTTLYGSRTLFFLTEQSTLKPLAIELTRPDMEGKPQWKQVFTPATHSSSHATKLWLWRLAKAHVLAHDSGYHEL

SEQ ID NO: 226345 - protein, 55 aa, Glycine max
  Coding DNA Sequence Number=SeqID_109567
VHMAQEEETSTDQIPEPSPAPIPNDAIPSAPVTEQEQPIQDSSAAPALDLNEHQP

SEQ ID NO: 226346 - protein, 477 aa, Glycine max
  Coding DNA Sequence Number=SeqID_109568
  Gene Ontology: Mol. function=transferase activity, transferring glycosyl groups; Biological process=sucrose metabolic process
  Homolog annotation: Hit_ID=O24301; Match level="QueryCoverage=84%, HitCoverage=54%, E-value=1e-169, Identity=71%"; Hit description =Sucrose synthase 2
  Pfam annotation: Domain name=Sucrose_synth; Domain location=8-477; Score=701.5; E_value=6.2e-208; Accession=PF00862.10; Description =Sucrose synthase
  Subcellular localization annotation: CTP_CleavageSite=48; ConfidenceScore=5.14e-01
MEPQNIDTDLPSLRFDFTAILFHIDNTSLQPMNTMKSPPTDDSRRSPKASAMPTTPMARQRISTMPTLPPMDVIFLPSFVAIPVRPRPGVWEYLQEELVDGKINDNFVLELDFEPFNATFPCPFHSASIGNGVQFLNRHLSPIMFRTKDSLQPLLDSLQAHKYKGHTLMINDRVQTFSNLQSALAMTKDYLSKLASDTLYSEFEYVLQGMDFERGWGDTIEQAPDHYALETFLGREPMVFNVAILSPHGYFGQANVLGLPDIGGQVVYILDQVCALENEMLLQIKKQGLDFTPRILIFTRLIANAKGTTCNQRLERVSGTDHTHILRVQFRSELGTLSKWNSRFLVWTYLETYVEAVASEIVAELQGHPTSIIGNYSDGNLVASLLAYKMGVTRCTITHALEKTKYLKSYLYWKKFEDISHFSCQFTFDLIAGYNVDFTITSTYQEITGTKNTVRQYESHTSFIFPGSIGLSMALMF

SEQ ID NO: 226347 - protein, 363 aa, Glycine max
  Coding DNA Sequence Number=SeqID_109569
  Homolog annotation: Hit_ID=Q9SLV8; Match level="QueryCoverage=29%, HitCoverage=14%, E-value=2e-31, Identity=75%"; Hit description =Sucrose synthase
MQTEDWKRFVLYHLSLEYDPCICELGGNQAKVAIKKLDTIANGCGVEWARKCGIKWLKVKLQYKIVINLSIDKFFLKLRYSEMLNCSRLRSETLTQTYSQTPGLGRTVKEEDESLDSVENHPGSLCGRDERLVWKMQNHEMIQDDVGSQLALNKCEHGNDYGDHQRGRWEKTMGGRVGMVDMRCRAIGVVGIAEALGDLRESSVGGDFMVFIGCKDVLSMWNKMAVKSNLRLGRSVSMFCGSIVMVSTSGTQPLQRVHGGLVAVMNGHGQRQGAVVMGGRKTVRKGGDKGFGASESAKIVGRLGVDSVFKKVGSACAVEEQAKVLKSVKLDAKGNAHEASKNNKGFVVNKKWGVKLVYGEGNK

SEQ ID NO: 226348 - protein, 227 aa, Glycine max
  Coding DNA Sequence Number=SeqID_109570
  Gene Ontology: Mol. function=lipoxygenase activity; Cellular component=chloroplast; Biological process=electron transport
  Homolog annotation: Hit_ID=Q1S9M9; Match level="QueryCoverage=99%, HitCoverage=28%, E-value=1e-102, Identity=70%"; Hit description =Plant lipoxygenase; Lipase/lipooxygenase, PLAT/LH2
  Pfam annotation: Domain name=Lipoxygenase; Domain location=1-211; Score=-177.9; E_value=2e-08; Accession=PF00305.9; Description =Lipoxygenase
MAVADPNAPHGLKLTIEDYPFANDGLLIWDAIKEWVSEYVNHYYPSSSTIEFDQELQAWWTEIRTVGHGDKSEEPWWPNLKTPKDLIEIITTIAWVSSAHHAAVNFAQYTYGGYFPNRPTIVRNNIPTEDPSKEELEKLINNPEKTFLESLPSQIQATLVMVVLNLLSNHSPDEEYIGQYVEQSWVENQTIKAAFERNGAGVVPYELMKPFSGPGVTGKGVPYSISI

SEQ ID NO: 226349 - protein, 105 aa, Glycine max
  Coding DNA Sequence Number=SeqID_109571
MVTSEENESWKIPLRSKGSSQCGVATENNGGLWLLTVAVGDGESTWDVRNGFGRKKGKEMIFFLSYTKAKAENAQVRNGLRHGNVAHTSYIFSKIPTVRSWKSIL

SEQ ID NO: 226350 - protein, 479 aa, Glycine max
  Coding DNA Sequence Number=SeqID_109572
  Homolog annotation: Hit_ID=Q1SFS3; Match level="QueryCoverage=35%, HitCoverage=30%, E-value=3e-12, Identity=27%"; Hit description =Lambda repressor-like, DNA-binding
MAWMGAEEGVSTLDIQFSLKIIEEKIQAEALPNPGMPTGRKEAKLFFGFYPSMTRVAKVVKISTQELDWAKQNRNEVVGVPRKCLEEKAKALVNQGEWASFIDILVLLIFRVSLFPNVEGLVDLAAIDAFLAFHYSKESSIVSILADMYDTFDRRCEKSSARIVCCTPALYVWLLSHLFRQEGRPACPLQGHRSSAEKRKANWDQLLASMEGASVNWFPCWLNLEVLKVVVALNSPFGLSAHPSLSAASALSAQLALSSNPLTLAKREAQGLDWLPKLSAARDKEAEALEESEEVQALKVELERARAVKEKFKEYDELRDVNMATTEAFERETKRARKEEHGRNKFRGALWGSNSELKLQRDERDQSRVEGMILKDKLKAYLRSKRNLSQQLSEIEGNMWAIIDDGKGSKGKDNQLIAQRGNDVDRKIAFTLNGSQELPRLLAKAKAMADVYSAPEEIHGLLNYCQHMIDLMAHIIRIR

SEQ ID NO: 226351 - protein, 75 aa, Glycine max
  Coding DNA Sequence Number=SeqID_109573
MLLMFHALESVFVKACVSLWGHIGILFDGACHTLISSGDHPLLGCDPRLTTLRYFAPIVRQFVKFRDMPEVKRKH

SEQ ID NO: 226352 - protein, 86 aa, Glycine max
  Coding DNA Sequence Number=SeqID_109574
MFKTIMLKNRMFKITNHKLLKLTNNRMLKMLKRIKGLSAKVVAKSVAKHYSQQNTKTETGEALNRKTKAKHHTKQNNKTLNTLTQH

SEQ ID NO: 226353 - protein, 1067 aa, Glycine max
  Coding DNA Sequence Number=SeqID_109575
  Gene Ontology: Mol. function=RNA binding
  Homolog annotation: Hit_ID=Q2HS37; Match level="QueryCoverage=99%, HitCoverage=99%, E-value=0.0, Identity=70%"; Hit description=Nucleic acid binding NABP
  Pfam annotation: Domain name=NABP; Domain location=322-730; Score =194.5; E_value=2.6e-55; Accession=PF07990.3; Description=Nucleic acid binding protein NABP
  Pfam annotation: Domain name=PUF; Domain location=731-765; Score =36.4; E_value=1e-07; Accession=PF00806.9; Description=Pumilio-family RNA binding repeat
  Pfam annotation: Domain name=PUF; Domain location=767-801; Score =31.8; E_value=2.4e-06; Accession=PF00806.9; Description=Pumilio -family RNA binding repeat
  Pfam annotation: Domain name=PUF; Domain location=803-837; Score =38.1; E_value=3e-08; Accession=PF00806.9; Description=Pumilio-family RNA binding repeat
  Pfam annotation: Domain name=PUF; Domain location=839-873; Score =35.6; E_value=1.8e-07; Accession=PF00806.9; Description=Pumilio -family RNA binding repeat
  Pfam annotation: Domain name=PUF; Domain location=875-910; Score =44.0; E_value=4.9e-10; Accession=PF00806.9; Description=Pumilio -family RNA binding repeat
  Pfam annotation: Domain name=PUF; Domain location=912-946; Score =37.4; E_value=5.1e-08; Accession=PF00806.9; Description=Pumilio -family RNA binding repeat
  Pfam annotation: Domain name=PUF; Domain location=948-982; Score =34.9; E_value=2.8e-07; Accession=PF00806.9; Description=Pumilio -family RNA binding repeat
  Pfam annotation: Domain name=PUF; Domain location=990-1024; Score =33.0; E_value=1.1e-06; Accession=PF00806.9; Description=Pumilio -family RNA binding repeat
  Pfam module annotation: Pfam domain module=NABP::PUF::PUF::PUF::PUF::P UF::PUF::PUF::PUF; Domain location=322-730::731-765::767-801::803 -837::839-873::875-910::912-946::948-982::990-1024
MLSELERRPMLGSNEGSFGDELEKELGMLLREQRRQEADDREQELNIYRSGSAPPTVEGSLSAVGGLFGGAAGAPVAFSGFQGTKDVNLIASEEELRSDPAYLSYYYSNVNLNPRLPPPLLSKEDWRFQQRLRGGASVLGGIGDRRKVSRTDDNSGRSPFSTPPGFNMRKQEGEVDNEETRGSSEWGGDGLIGLPGLGLSKQKSFAEIFQVSLIPYPFSSAHHLQPVIVQEDLGHITSIACLPSHPASRDAFDDNDITSSAEAELAHACRESMATDALRSGSNVQGSSAAQNVVPPASYSYAAAVGSSLSRSTTPDPQLVARAPSPCITPMGGGRAIASDKRAIVSPDAFNGVSSGVNESADLVAALSVMNLSADDVLDGENHFPSQVESDVDNHQRYLFGRQGSQDHGKQHAYLKKSESAHLQNSSKNNRSGSDLNNLSLDRQVELQKSTVPSNNSYFKGLSTSHFSRGGSMPPQYQPLDSTNSSFGNYGLSGYAGNPALASLMTNQLGTGNLPPLFENVAAASAMASPGMRSRILGGGLASGAAAPSDVHNIGRMGNQIPGSALQAPFVDPMYLQYLRTSEFAAAQLAALNDPSVDRNYLGNSYMNLLELQKAYLGSILSPQKSQYNVPLGGKSGSSTPHGYYGNPAYGVGMSYPGTPIANSVVSTSPVGSGSPVRHNELNMRFASGLRNLAGVMGPWHVDTGNIDESFASSLLEEFKSNKTKCFELSEIVGHVVEFSADQYGSRFIQQKLETATTEEKKMVYQEIMPHALALMTDVFGNYVVQKFFEHGLASQRRELANKLLGHVLTLSLQMYGCRVIQKAIEVVDLDQKIEMVQELDGNVMRCVRDQNGNHVIQKCIECVPEDAIDFIVSTFFDQVVTLSTHPYGCRVIQRVLEHCEDPTTQQKVMDEILGAVSMLAQDQYGNYVVQHVLEHGKSHERSSIIKELAGKIVQMSQQKFASNVVEKCLTFGGPSERQLLVNEMLGTTDENEPLQAMMKDQFANYVVQKVLETCDDQQRELILSRIKVHLNALKKYTYGKHIVTRVEKLVAAGERRIAAQAPPQPA

SEQ ID NO: 226354 - protein, 90 aa, Glycine max
  Coding DNA Sequence Number=SeqID_109576
  Subcellular localization annotation: CTP_CleavageSite=45; ConfidenceScore=5.37e-01
MDYGRLGPSDLGGSSRLNSLRSSGRKKIVLLSLFAVLIIVASTVTAVVVRSHTKNTRADGTSLEKFTKAISSEIDRFLALSLSSGHLEKE

SEQ ID NO: 226355 - protein, 106 aa, Glycine max
  Coding DNA Sequence Number=SeqID_109577
MADSKTWWKAEIPPYKHTPLCLIAPPWWASLHILSTVVGKKSAKPFHCDSAMAAFFSTLTYICLPKTPPFLSGVFACKPPQFTLPPSQPQRRNSSPQGILPKEQTQ

SEQ ID NO: 226356 - protein, 536 aa, Glycine max
  Coding DNA Sequence Number=SeqID_109578
  Gene Ontology: Mol. function=nucleic acid binding
  Homolog annotation: Hit_ID=Q1T493; Match level="QueryCoverage=94%, HitCoverage=97%, E-value=7e-54, Identity=28%"; Hit description =Nucleic acid-binding, OB-fold, subgroup
  Pfam annotation: Domain name=DUF223; Domain location=58-153; Score= -11.7; E_value=0.036; Accession=PF02721.5; Description=Domain of unknown function DUF223
  Pfam annotation: Domain name=Rep_fac-A_C; Domain location=311-439; Score=-34.2; E_value=0.00021; Accession=PF08646.1; Description =Replication factor-A C terminal domain
  Pfam module annotation: Pfam domain module=DUF223::Rep_fac-A_C; Domain location=58-153::311-439
MVVNFGFQWLRWLCDYKLMARVPDKIKLIDGSREALKFSIRITDLWFIGIPEKSEQAKMVVVDSNGDEIHVVCKHDQLKSRKADLKENLTYVMHNFKVMKNDGKFKVCDHEYNLCFTGITIVRQSDMEHLPFRKFRFVDFSNVIAGHFQTGLLVDVIAMVDEVVFRYVSSKNMRVVFKLKDLIRQVLSYTLWENYCLQFLSYLNEVEDERSIVILLTHGRIKEAQGSYPPSVSNSFKASKLMINELVLEIQEFRESLLDLGIEVRSVLTPIGQGSSQVLGSSQLSSKDAFLSKAEVKNISQINAICEEIIYVTVAKITTIVVDNYSWCYPACGQCYKKTDIETVRFTCPCGKENDQPVLRYRVEVMVNHKGEQTKFLLWDHECAELIGQSADEDDDVDLNASPQALDRLLGCFLAFKVKVQPRFRNSVVLKYSDESDLINVVLDMLSPCCKIENSILESTDPTELESQSVFVNADHDRSMLDSTEPTELEFQSVSVTGDHDPLLRIPLTPTKRVSHDELDDEPKKLSDFACPSFLK

SEQ ID NO: 226357 - protein, 381 aa, Glycine max
  Coding DNA Sequence Number=SeqID_109579
  Gene Ontology: Mol. function=protein kinase activity; Cellular component=cell surface; Biological process=protein amino acid phosphorylation
  Homolog annotation: Hit_ID=Q1RZG3; Match level="QueryCoverage=92%, HitCoverage=56%, E-value=1e-110, Identity=58%"; Hit description =Protein kinase
  Pfam annotation: Domain name=Pkinase; Domain location=80-353; Score =152.8; E_value=9.2e-43; Accession=PF00069.15; Description=Protein kinase domain
  Pfam annotation: Domain name=Pkinase_Tyr; Domain location=81-353; Score=90.7; E_value=4.4e-24; Accession=PF07714.7; Description =Protein tyrosine kinase
  Pfam module annotation: Pfam domain module=Pkinase::Pkinase_Tyr; Domain location=80-353::81-353
MTQGNKWKKSRRRLVIGVTGGAIAGFLICITILCLYKLPTWKGHFGLNTNSNKNIEALLKVHGAITLKRYKLSNVKKMTNNFKVKLGQGGFGSVYKGKLPNGAPVAVKILNASKKDGEEFMNEVASISRTSHINVVTLLGFSLEGRKRVLIYEFMPNGSLDKLIYRKGPETIAPLSWDIIYEIAIGIARGLEYLHIGCNTRILHFDIKPHNILLDEKFCPKISDFGLAKLCPRNESIISLSDARGTMGYVAPEVLNRHFAGVSLKSDVYSYGMMLLEMVGGRKNTNAEASNMSEIYFPHWIFKRLKLGSDLRLEEEIAPEENEIAKRLAIVGLWCIQTFPNDRPTMSRVIDMLEVNINSLEIPPKPLLSSPTTSLPESSIS

SEQ ID NO: 226358 - protein, 242 aa, Glycine max
  Coding DNA Sequence Number=SeqID_109580
MSPNSIISWHRILIRRGHNTNINIMLILYSHHGQQQSSNVVVEVLVFFAAAVKDMLCWASLSRGSGHDQRGLFKCGNDNIGKVLEVLGNDELEGDGITNVKGFDEVIDELWEEFVKELVKPRDGKNVPAKWSSVVEERRLENWSLMYLLKSSRPPIVLGHDFHPWTSLGFILGLFGPRMNSGKAGKMNLLASKFQKSKVKPRSCHAQHHTLMWMSQPDAYMLPFIKIIGNEEDKTQFWTEYN

SEQ ID NO: 226359 - protein, 81 aa, Glycine max
  Coding DNA Sequence Number=SeqID_109581
  Homolog annotation: Hit_ID=Q1RZG3; Match level="QueryCoverage=60%, HitCoverage=8%, E-value=9e-07, Identity=60%"; Hit description =Protein kinase
MVGGRKNINIEASKASEIYFAHWIYGRLEHGRDLRPDEVIAVEENEIYSKENDGSGSIDTNVQAYKQVQKQEAQQQNRRCG

SEQ ID NO: 226360 - protein, 326 aa, Glycine max
  Coding DNA Sequence Number=SeqID_109582
  Gene Ontology: Mol. function=protein kinase activity; Biological process=protein amino acid phosphorylation
  Homolog annotation: Hit_ID=Q1RZG3; Match level="QueryCoverage=68%, HitCoverage=34%, E-value=2e-29, Identity=34%"; Hit description =Protein kinase
MDYHNHIHMHISMLLMSLLTVCCLLLTTLPHSQCQPTAFDYSICKKQSYNCGNLSNISYPFWGQNRSPQCGSGDPFELSCNGDDNTTSIRIGSLNYTVKEINITAQTMRLVPTNIVVNVCFPQYEETYESRILFRYSPSVYNVTIFYNCSRIQYFPYGYFRCGNAISYFARAYDRLFTDYPQLQKCKRSLNVSAVAQLDFKGGGDFALKKSLNEGFEVNYNVSQHCQRCLGSEGHCWRYGIEKHVLSCYYCPNGTHALHCSPRPPKTMASTNSTSSILSPLSSISLVSSPRSKLVSVCLCLRWLQCNGSCFGNFAVESLVCPFNTI

SEQ ID NO: 226361 - protein, 105 aa, Glycine max
  Coding DNA Sequence Number=SeqID_109583
MVLLFYLLVWIIDCVDGDENVGTRAGDRVGDKEVDGGGDKNVDGVGCIDIDGGDVDCRGLDCDDGETTVTFAVAVAVAVPGPVVVTVALALAVAGGCIKKLVIHG

SEQ ID NO: 226362 - protein, 282 aa, Glycine max
  Coding DNA Sequence Number=SeqID_109584
  Gene Ontology: Mol. function=RNA binding; Biological process =regulation of transcription, DNA-dependent
  Subcellular localization annotation: CTP_CleavageSite=60; ConfidenceScore=5.78e-01
MEGVLLPVCPSPSSCSATPKPRIPIPLRSSFPSPLLHNRFFSQNAAFSLRNSLRTSTFALAQHEAPVLGKPDNNNNSSPYLPKIDKTGRFCSPRAARELALSIIYAACLEGMDPVRLFEKRMNARREAGYKFNEEKLLEYNHMSFGGPPVTVGSDEEANELLRHIEEESAIVVGDESQSCLYFVFLLLPRMEKAEVLTAPPKLVYNKLILRFTKKLLVAVRDTWDSHVLVINKIAPQNWKSNLPVKGQIDKVNVETYLSPDIFVILRNNPIVEYKDRKCLYE

SEQ ID NO: 226363 - protein, 591 aa, Glycine max
  Coding DNA Sequence Number=SeqID_109585
  Gene Ontology: Mol. function=NADH dehydrogenase (ubiquinone) activity; Cellular component=integral to membrane; Biological process=ATP synthesis coupled electron transport
  Homolog annotation: Hit_ID=Q7W5B9; Match level="QueryCoverage=82%, HitCoverage=97%, E-value=0.0, Identity=84%"; Hit description=NADH -ubiquinone oxidoreductase, chain M
  Pfam annotation: Domain name=DUF1777; Domain location=443-585; Score=- 95.9; E_value=0.097; Accession=PF08648.2; Description=Protein of unknown function (DUF1777)
FRDGNVLQQGLDRHVHHVGEGLGIDPHVQHGDRHHAKNHEFAAVDIGQLADVVVGDVAQDHALDHPQRIRSAQDQRGGRQQADPEVVLDRAHDHHELADETAGGRQAAVGHREQDEEGGEARHHVDHAAVVGDAARVHAVIEHADTHEHGARDEAVGDHLHDGAFDACRVEDEETQGDEAHVGDRRIGHQLLHVVLHDRHQADVDHGDQRQRDHQARPGCARRRARSAARSAGTVGAQLQHDRRQHDGAAGGRLDVGVRQPGVHRPHRHLDREGRQQRHEDQDLRGVAQLGLLPGQDVERTARGIPQVDERHKRQQRAHQGVEEELEGRVHPVRSAPDADDDVHRDQRGFEEHVEQHAVQRAEHAHHQTRQDQEGGHVLRHAAGDDFPAGQHHDDGDERGQEHEPQRNAVHAQVVVDVEGFDPGGLLDELHGSRLGVEPGVQRDRDEEAGDRADQRQAARQAGTVVTAHRQHQQAEYDRDKDRKREPGESHKESHQRHDADDHRERVVIDEAGLQVAADRRHPAHHAGAAVDQQAVDDAAVAGLPQATTQAAQAAGDDLLVDPVDVVLVLKHLVDARQARLDRGRDLRVDQ

SEQ ID NO: 226364 - protein, 857 aa, Glycine max
  Coding DNA Sequence Number=SeqID_109586
  Gene Ontology: Mol. function=RNA binding
  Homolog annotation: Hit_ID=Q2HS37; Match level="QueryCoverage=96%, HitCoverage=79%, E-value=0.0, Identity=76%"; Hit description=Nucleic acid binding NABP
  Pfam annotation: Domain name=NABP; Domain location=115-520; Score =173.9; E_value=4.1e-49; Accession=PF07990.3; Description=Nucleic acid binding protein NABP
  Pfam annotation: Domain name=PUF; Domain location=521-555; Score =35.6; E_value=1.8e-07; Accession=PF00806.9; Description=Pumilio -family RNA binding repeat
  Pfam annotation: Domain name=PUF; Domain location=557-591; Score =31.8; E_value=2.4e-06; Accession=PF00806.9; Description=Pumilio -family RNA binding repeat
  Pfam annotation: Domain name=PUF; Domain location=593-627; Score =37.7; E_value=4.1e-08; Accession=PF00806.9; Description=Pumilio -family RNA binding repeat
  Pfam annotation: Domain name=PUF; Domain location=629-663; Score =34.5; E_value=3.6e-07; Accession=PF00806.9; Description=Pumilio -family RNA binding repeat
  Pfam annotation: Domain name=PUF; Domain location=665-700; Score =45.6; E_value=1.7e-10; Accession=PF00806.9; Description=Pumilio -family RNA binding repeat
  Pfam annotation: Domain name=PUF; Domain location=702-736; Score =38.9; E_value=1.8e-08; Accession=PF00806.9; Description=Pumilio -family RNA binding repeat
  Pfam annotation: Domain name=PUF; Domain location=738-772; Score =34.3; E_value=4.2e-07; Accession=PF00806.9; Description=Pumilio -family RNA binding repeat
  Pfam annotation: Domain name=PUF; Domain location=780-814; Score =33.0; E_value=1.1e-06; Accession=PF00806.9; Description=Pumilio -family RNA binding repeat
  Pfam module annotation: Pfam domain module=NABP::PUF::PUF::PUF::PUF::P UF::PUF::PUF::PUF; Domain location=115-520::521-555::557-591::593 -627::629-663::665-700::702-736::738-772::780-814
MVRFFAVSAAGKFSTAKDSCHQFDDLGHNTSIRRLPSRPASRNAFDDNDIISSAEADLAHVHRESAPTDVLRSGSNVKGSSAAQNVGLPASYSYAAAVGSSLSRSATPDPQLVARAPSPCITPIGGGRAIASDKRAIASTDAFNGVSSGINESADLVAALSVMNLSTDDVLDGENHLPSQIESGVDNHQRYLFGKQDHGKQHAFSKKSESAHLQNSSKKSRSGSDLNNPSLDRQVELQKSTVPSNNSYFKGSPTSHFSRGGSMPPQYQPLDSTNSSFGNYGLSGYAGNPALASLMTNQLGTGNLPPLFENVAAASAMAAPGMDSRILGGGLASGAAAPSDVHNLGRMGNQIPGSALQAPFVDPMYLQYLRTSEFAAAQLAALNDPAVDRNYLGNSYMNLLELQKAYLGSILSPQKSQYNVPLGGKSGSSTPHGYYGNPAYGVGLSYPGTAMANSVVSTSPVGSGSPIRHNELNMQFASGMRNLAGAMGPWHVDTGNIDESFASSLLEEFKSNKTKCFELSEIAGHVVEFSADQYGSRFIQQKLETATTEEKNLVYQEIMPHALALMTDVFGNYVVQKFFEHGLASQRRELANKLHGHVLTLSLQMYGCRVIQKAIEVVDLDQKIEMVQELDGNVMRCVRDQNGNHVIQKCIECVPEDAIHFIVSTFFDQVVTLSTHPYGCRVIQRVLEHCKDPTTQQKVMDEILGAVSMLAQDQYGNYVVQHVLEHGKPHERSSIIKELADKIVQMSQQKFASNVVEKCLTFGGPSERQLLVSEMLGSTDENEPLQAMMKDQFANYVVQKVLETCDDQQRELILYRIKVHLNALKKYTYGKHIVARVEKLVAAGERRIAAQAPPQPA

SEQ ID NO: 226365 - protein, 853 aa, Glycine max
  Coding DNA Sequence Number=SeqID_109587
  Gene Ontology: Mol. function=RNA binding; Biological process =regulation of translation
  Homolog annotation: Hit_ID=Q2HS37; Match level="QueryCoverage=96%, HitCoverage=79%, E-value=0.0, Identity=79%"; Hit description=Nucleic acid binding NABP
  Pfam annotation: Domain name=NABP; Domain location=108-516; Score =203.2; E_value=6e-58; Accession=PF07990.3; Description=Nucleic acid binding protein NABP
  Pfam annotation: Domain name=PUF; Domain location=517-551; Score =34.4; E_value=4e-07; Accession=PF00806.9; Description=Pumilio-family RNA binding repeat
  Pfam annotation: Domain name=PUF; Domain location=553-587; Score =31.4; E_value=3.3e-06; Accession=PF00806.9; Description=Pumilio -family RNA binding repeat
  Pfam annotation: Domain name=PUF; Domain location=589-623; Score =38.1; E_value=3e-08; Accession=PF00806.9; Description=Pumilio-family RNA binding repeat
  Pfam annotation: Domain name=PUF; Domain location=625-659; Score =34.5; E_value=3.6e-07; Accession=PF00806.9; Description=Pumilio -family RNA binding repeat
  Pfam annotation: Domain name=PUF; Domain location=661-696; Score =45.6; E_value=1.7e-10; Accession=PF00806.9; Description=Pumilio -family RNA binding repeat
  Pfam annotation: Domain name=PUF; Domain location=698-732; Score =34.0; E_value=5e-07; Accession=PF00806.9; Description=Pumilio-family RNA binding repeat
  Pfam annotation: Domain name=PUF; Domain location=734-768; Score =34.9; E_value=2.8e-07; Accession=PF00806.9; Description=Pumilio -family RNA binding repeat
  Pfam annotation: Domain name=PUF; Domain location=776-810; Score =33.0; E_value=1.1e-06; Accession=PF00806.9; Description=Pumilio -family RNA binding repeat
  Pfam module annotation: Pfam domain module=NABP::PUF::PUF::PUF::PUF::P UF::PUF::PUF::PUF; Domain location=108-516::517-551::553-587::589 -623::625-659::661-696::698-732::734-768::776-810
MVYLFSYHFPSAHHLQRAIVQDDLGHNTSIARLPSRPSSRNAFDENDISSSADAELAHVHRESTPADVLRSGSSAAQNVGPPASYSYAAAVGSSLSRSTTPDPQLVARAPSPCITPIGGGRAIASDKRAIASQDAFNGVSSGINESADLVAALSVMNLSADDVLDGENHLPSQVESDVDNHQRYLFGRQGGQEHGKQHAYLKKSESAHLQNSRASSRSGSDLNNPSLDRQVELQKSTVPSNNSYFKGSPTSHFSRGGSMPPQYQPLDSTNSSFGNYGLSGYAGNPALASLMTNQLGTGNLPPLFENVAAASAMASPGMDLRILGGGLASGAAAPSDVHNLGRMGNQIPGSALQAPFVDPMYLQYLRTSEFAAAQLAALNDPSVDRNYLGNSYMNLLELQKAYLGSILSPQKSQYNVPLGGKSGSSTPHGYYGNPAYGVGMSYPGSPMANSVVSTSPVGSASPVRHNELNMRFASGMRNLAGVMGPWHADTGNIDESFASSLLEEFKTNKTKCFELSEIAGHVVEFSADQYGSRFIQQKLETATTEEKNMVYQEIMPHSLALMTDVFGNYVVQKFFEHGLASQRRELANKLLGHVLTLSLQMYGCRVIQKAIEVVDLDQKIEMVQELDGNVMRCVRDQNGNHVIQKCIECVPEDAIHFIVSTFFDQVVTLSTHPYGCRVIQRVLEHCKDPTTQQKVMDEILGAVSMLAQDQYGNYVVQHVLEHGKPHERSCIIKELAGKIVQMSQQKFASNVVEKCLTFGGPSERQLLVSEMLGTTDENEPLQAMMKDQFANYVVQKVLETCDDQQRELILSRIKVHLNALKKYTYGKHIVTRVEKLVAAGERRIAAQAPPQPA

SEQ ID NO: 226366 - protein, 236 aa, Glycine max
  Coding DNA Sequence Number=SeqID_109588
  Gene Ontology: Mol. function=protein dimerization activity
  Homolog annotation: Hit_ID=Q9ZWT4; Match level="QueryCoverage=57%, HitCoverage=16%, E-value=8e-40, Identity=56%"; Hit description =Transposase
MTNQDIIVAKVFKVKYFPTVDFLEAQLGHNPSFIWRSIHASWVVVEEGLQWRIGDDNSIIAWTQPWLKYGENSWVSSNYHDGQGAEGVGWPKGLMATPTGHDESVGSGNRGNFLEMIKLLASYNKEIDEIISENVPQNVRYISLTIQKDILYVFARKVQDEIQEEIGNAKFCFIVDEAHDESKREQTTLVLRFVDKNGYVKEHFLDMIHMQDTTSSILKHGICSILSHHNLNIQNI

SEQ ID NO: 226367 - protein, 75 aa, Glycine max
  Coding DNA Sequence Number=SeqID_109589
  Subcellular localization annotation: CTP_CleavageSite=51; ConfidenceScore=5.36e-01
MKSNYCLHRKGDPSSSSWHLTITQTLSNGSLLLLPPLSSKIASSRLAPLSRLAQVSGFGLGANASLSLARDGRLA

SEQ ID NO: 226368 - protein, 77 aa, Glycine max
  Coding DNA Sequence Number=SeqID_109590
MAGEEMVKRLYETSAVNNNDSETCSTNATIATISFRGVIPSEVECDSEDEDTQWQGNGVEGVGEEEVGEVGCDNEGT

SEQ ID NO: 226369 - protein, 439 aa, Glycine max
  Coding DNA Sequence Number=SeqID_109591
  Gene Ontology: Mol. function=transferase activity; Cellular component= nucleus; Biological process=regulation of transcription, DNA-dependent
  Homolog annotation: Hit_ID=Q1SJX2; Match level="QueryCoverage=98%, HitCoverage=99%, E-value=1e-123, Identity=55%"; Hit description =Transferase
  Pfam annotation: Domain name=Condensation; Domain location=33-299; Score=-123.6; E_value=0.076; Accession=PF00668.10; Description =Condensation domain
  Pfam annotation: Domain name=Transferase; Domain location=2-433; Score=197.2; E_value=3.8e-56; Accession=PF02458.6; Description =Transferase family
  Pfam module annotation: Pfam domain module=Condensation::Transferase; Domain location=33-299::2-433
MEAVQLMSTTTIKASSNNYNDNSVQKIDLTPWDLQFFHIGSIQRGLLFRKEKNTEYCQIEHLQHSLSSTLAFFPLLAGRLAILEHHDNTVSSHIVCDNKGVPFVHAAAHNTTVADILQPKYVPPILRSFFALNGVKNYEATSQPVLAVQVTELFDGIFIALSINHVVADGKSFWLFVNSWAEISRGSLKISKFPSLKRCFLDGVDRPIRFLFTKELEKEPSKNLQPQTRPVRVFHFTKEKIADLKSKANAEANTDKISSLQALLANLWRSVIRCQHVEPHEEIQFTMPVGVRPRVVPPLPEDYFGNAALIGRVTMKAGELLQGELGKIALEINKMISSQSDEKVKNHYESWARTPRQRGVAYSNTLNVGSSPRFNIYGNDFGWGKPMAVRSGGDFMSYSIVFLFAGFEEGSIDIEVFLPYEILEAMGNDPEFMHICHSE

SEQ ID NO: 226370 - protein, 1021 aa, Glycine max
  Coding DNA Sequence Number=SeqID_109592
  Gene Ontology: Mol. function=hydrolase activity
  Homolog annotation: Hit_ID=Q0KB35; Match level="QueryCoverage=34%, HitCoverage=53%, E-value=1e-38, Identity=31%"; Hit description =Hypothetical membrane spanning protein
  Pfam annotation: Domain name=Metallophos; Domain location=384-615; Score=38.1; E_value=3e-08; Accession=PF00149.18; Description =Calcineurin-like phosphoesterase
MGSSKQSAGILDTLKMERVRTILTHTYPYPHEHSRHAVIAVVVGCLFFISSDNIHTLVEKLDKNVKWWSMYACLFGFFYFFSSPFIGKTFKPSYSNFSRWYIAWILVAAVYHLPSFQSMGVDMRMNLSLFLTIYLSSILFLLVFHIIFLGLWYIGFVSRVAGKRPEILTILQNCAVLSVACCVFYSHCGNRAMLRERPLDRRNSNWFSFWKKEERNTWLAKFLRMNELKDQVCSSWFAPVGSASDYPLLSKWVIYGEIACNGSCPGSSDEISPIYSLWATFIGLYIANYVVERSTGWALTHPLSVKEYEKLKKKQMKPDFLDMVPWYSGTSADLFKTVFDLLVSVTVFVGRFDMRMMQAAMSRVSDGNHQDDLLYDHFSEKDDFWFDFMADTGDGGNSSYAVARLLAKPFIRTLKDDSELTLPRGNLLIIGGDLAYPNPSAFTYERRLFVPFEYALQPPPWYKAEQIAVNKPEVPFGAQLKQYNGPQCFVIPGNHDWFDGLQTFMRYICHRSWLGGWLMPQKKSYFALQLPKRWWVFGLDLALHGDIDVYQFKFFSELITEKVQDDDSVIIITHEPNWLTDWYWNDVTGKNISHLISDYLRGRCKLRMAGDLHHYMRHSHVKSDGPVHIHHLLVNGCGGAFLHPTHVFSKFNKLDEVSYECKAAYPSFEDSSRIALGNILKFRKKNWQFDFIGGIIYFVLVFSMFPQCELNHILQDDTFSGHIKSFLGTVWNGFIYILQHSCVSLAGAILLLIAAYSFVPPKLSRKKRAIIGVLHVSAHLAAALILMLLLEIGVEICIQHKLLATSGYHTLYQWYRSVESEHFPDPTGLRARIEQWTFGLYPACIKYLMSAFDVPEVMAVSRNNICQNGLESISRGGAVIYYASVFLYFWVFSTPVVSLVFGSYLYICINWLHLHFDEAFSSLRIANYKSFTRFHINSDGDLEVYTLAVDKVPKEWKLDPDWDGETKHPHELSHLRRFPSKWRAAIAHLDPVHTVKIVDHFVIGRTDKNDCATTAPNGPVQ

SEQ ID NO: 226371 - protein, 362 aa, Glycine max
  Coding DNA Sequence Number=SeqID_109593
  Gene Ontology: Mol. function=protein serine/threonine kinase activity; Cellular component=nucleus; Biological process=protein amino acid phosphorylation
  Homolog annotation: Hit_ID=UPI0000162DEA; Match level="QueryCoverage =76%, HitCoverage=45%, E-value=1e-104, Identity=67%"; Hit description= ATP binding / kinase/ protein kinase/ protein serine/threonine kinase/ protein-tyrosine kinase
  Pfam annotation: Domain name=Pkinase; Domain location=42-310; Score =115.6; E_value=1.4e-31; Accession=PF00069.15; Description=Protein kinase domain
  Pfam annotation: Domain name=Pkinase_Tyr; Domain location=53-310; Score=79.6; E_value=1e-20; Accession=PF07714.7; Description=Protein tyrosine kinase
  Pfam module annotation: Pfam domain module=Pkinase::Pkinase_Tyr; Domain location=42-310::53-310
  Subcellular localization annotation: CTP_CleavageSite=75; ConfidenceScore=5.26e-01
RKRKSAQYANRLSPRVGRFINAAGTTADNNFTQETAMTMITNSSSVPSCDVSCLGKLRDGRSVAVKRLYENNFKRVAQFMNEIKILANLDHPNLVTLFGCTSRHTRELLLVYEYIPNGTIADHLHGQRSKPGKLSWHIRMNIAVETASALKFLHQKDIIHRDVKTNNILLDNNFCVKVADFGLSRLFPDHVTHVSTAPQGTPGYVDPEYHQCYQLTKQSDVYSFGVVLVELISSLPAVDITRHRQEIKLSDMAINKIHSEALHELVDPSLGFESNFKVRKMINAVAELAFQCLQSSKEMRPSMEEVADTLKDIQSDGKHKSQPEVMDITSTADDVVLLKDDPPPPSPDSNAVSKLTTPNASG

SEQ ID NO: 226372 - protein, 413 aa, Glycine max
  Coding DNA Sequence Number=SeqID_109594
  Gene Ontology: Mol. function=protein kinase activity; Cellular component=cell surface; Biological process=protein amino acid phosphorylation
  Homolog annotation: Hit_ID=Q1RZG3; Match level="QueryCoverage=77%, HitCoverage=50%, E-value=1e-126, Identity=68%"; Hit description =Protein kinase
  Pfam annotation: Domain name=Pkinase; Domain location=113-386; Score =117.5; E_value=3.8e-32; Accession=PF00069.15; Description=Protein kinase domain
  Pfam annotation: Domain name=Pkinase_Tyr; Domain location=114-386; Score=97.3; E_value=4.5e-26; Accession=PF07714.7; Description =Protein tyrosine kinase
  Pfam module annotation: Pfam domain module=Pkinase::Pkinase_Tyr; Domain location=113-386::114-386
  Subcellular localization annotation: CTP_CleavageSite=60; ConfidenceScore=5.01e-01
MKYIVVVIGQSEHDTCNNTDTTSKNTTKIGTINNTATIIATTNFFIANWVTSTSNNIFVTINTNTSVRYKLLIQPIKLCSTTKSDQDIEAFLKNKGAVAQKRYKFSEVKKMTNSFKVKLGQGGFGAVYKGQLPTGCPVAVKLLNSSKGNGEEFTNEVASISRTSHVNIVTLLGFCLKGRKKALIYEFMANGSLDKFIYNRGPETIASLRWQNLYQISIGIARGLEYLHRGCNTRILHFDIKPHNILLDENFCPKISDFGLAKLCPRKESIISMSNTRGTLGYVAPEMWNRHFGGVSHKSDVYSYGMMLLEMVGGRKNIDAEASRTSEIYFPHLAYKRLELDNDLRPDEVMTTEENEIAKRMTIVGLWCIQTFPNDRPIMSRVIEMLEGSMNSLEMPPKPMLSSPTRSATESSS

SEQ ID NO: 226373 - protein, 370 aa, Glycine max
  Coding DNA Sequence Number=SeqID_109595
  Gene Ontology: Mol. function=protein kinase activity; Cellular component=cell surface; Biological process=protein amino acid phosphorylation
  Homolog annotation: Hit_ID=Q1RZG3; Match level="QueryCoverage=87%, HitCoverage=51%, E-value=1e-123, Identity=66%"; Hit description =Protein kinase
  Pfam annotation: Domain name=Pkinase; Domain location=70-343; Score =131.0; E_value=3.2e-36; Accession=PF00069.15; Description=Protein kinase domain
  Pfam annotation: Domain name=Pkinase_Tyr; Domain location=71-343; Score=111.3; E_value=2.7e-30; Accession=PF07714.7; Description =Protein tyrosine kinase
  Pfam module annotation: Pfam domain module=Pkinase::Pkinase_Tyr; Domain location=70-343::71-343
MTFLEDFSHDSLMIDSLFALATSLCRYRSLTGLFKFCLTTKSKLDIEAFLKIHVVSLQRYKFSEVKKMTNSFKVKLGQGGFGAVYQGKLHTGCPVAVKLLNASKGNGEDFINEVSSISKTSHINIVTLLGFCLKGRKKALIYEFMANGSLDKFIYNRGPETIASLRWQNLYQISIGIARGLEYLHRGCNTRILHFDIKPHNILLDENFCPKISDFGLAKLCPRKDSIISMSDTRGTLGYVAPEMCNRHFGGVSHKSDVYSYGMLLLEMVGGRKNINAEASHTSEIYFPHLVYGRLELDNDVRPDELMTAEENEIAKRMTIVGLWCIQTFPNDRPTMSRVVDMLEGNMDSLEMPPKPLLSSPTRSETESSS

SEQ ID NO: 226374 - protein, 242 aa, Glycine max
  Coding DNA Sequence Number=SeqID_109596
  Gene Ontology: Mol. function=iron ion transporter activity; Biological process=high affinity iron ion transport
  Homolog annotation: Hit_ID=UPI000066943B; Match level="QueryCoverage =99%, HitCoverage=92%, E-value=2e-59, Identity=48%"; Hit description =predicted ABC-type Fe3+-hydroxamate transport system, periplasmic component
  Pfam annotation: Domain name=Peripla_BP_2; Domain location=1-218; Score=25.0; E_value=3.5e-06; Accession=PF01497.9; Description =Periplasmic binding protein
MKVISLVPSITEALFDLGLTEDEIIGRTKFCIHPKDKIKNVPVIGGTKNLNIEKIKGLQPDLILANKEENIKEQVEALMEDFKVVVTNVETIEDNYYLLKTLGNIFQKEERAKAYNLKIYEVLNQTKISSKIKAAYLIWKNPYMTVGADTFIHWILTEIGFENSFKDKTRYPEVTIQDLADTDLIMLSSEPFPFKEKHIAELKEYYPDKKIIIVDGEAFSWYGTHIAKCGNYFKELVAEIDL

SEQ ID NO: 226375 - protein, 152 aa, Glycine max
  Coding DNA Sequence Number=SeqID_109597
  Homolog annotation: Hit_ID=UPI0000162DEA; Match level="QueryCoverage =28%, HitCoverage=7%, E-value=1e-10, Identity=67%"; Hit description =ATP binding / kinase/ protein kinase/ protein serine/threonine kinase/ protein-tyrosine kinase
IQLLVIPIVPLFRYHAIAIRVYLLHEAFGERKINWKVKLIIGVVSGVVGALAVGIIGYLCYRKKKNRYTMSYTQSRSLSSDPSSKDTEKGIQRFTQSFVPGVHLFTYDELEEATNYFDSSKELGEGGFGTVYFGKSKNPLLYLCRFCAFDDH

SEQ ID NO: 226376 - protein, 279 aa, Glycine max
  Coding DNA Sequence Number=SeqID_109598
QETVRHFFRAGGASGTIAKAMSAYDKDFSDAIYGKEAKNRYVTQNRLRKMLRYEVALIEERISRENSPNRKFFSYANTVTTINFDKTLKGHGWVGIRFQVKENEGYNEIVIHVKFKENDATLQQETLGNLGVNLIFGAFTYYDNPRTLIESLYDDIATDNLEIDMIDFSGPAFDYVDNRLMSLQLVKNNMTDAVIFNSQGNNMLPADILYKKNIFAVRGSFRPVTKVNIDMLQNGIDLFMKDAACTEEQTEILIEITISNLRADGDIDERDFMDRVDIL

SEQ ID NO: 226377 - protein, 1184 aa, Glycine max
  Coding DNA Sequence Number=SeqID_109599
  Homolog annotation: Hit_ID=Q10QS2; Match level="QueryCoverage=90%, HitCoverage=88%, E-value=0.0, Identity=53%"; Hit description =Expressed protein
  Subcellular localization annotation: CTP_CleavageSite=61; ConfidenceScore=5.23e-01
MYRFCFRTRPLLRNFSSSRKPIANSTLENSQIAPPPILDNRRTLSPVHSKSLSRTSVVALSAAAISAVVASAALLSDSDRGGGGTNPLHEGAERAARKAADSFDRIFHHAKRTGVAAAVLWQSLRSVLSSANHEVRSGFEIRVAALLADIAAANSARRAAIVGAGGGAVVDWLLESVAAAKDGGGTQAEYARALAYLIADPNVSAAVLGRPHAVPSLLRFIFSCQPRRSKNTKQHSRRGAFDISDSLKGRSMLVAAIMDIVTSSCENAEEVSFKPSLPENAETRDIAAALEVIEEGGLHLDEPPEGEDDGGGSGRKGIGIKILDGKPVLGLSRTSNDACHEELKHQSPKTLIYQNKYDNSLEQKNVSAAVVPGLWDDLHCEHVAVPFATWALANWATASQLNRSHIQELDRDGNAIMSALIAPERSVKWHASLVVRLLLEDRNTPLNESVSDWASSLLSTISQACKHEDISLAQVALSAFLLSVERSPGVQKVVMEKGLNPMRDIAKQMTKHKQVQEPMAKALELLCTGELHLSLEESQKWSGILLPWVFGTFSSDTIRSSAIKILSRILEDYGPTCVPLSQGWLAMMLSEVQSSIKKSNDKGTSQPKSDNVKTLINNANIASAAQVANQLSSAVVNLAAKQLRNASNSGDASPLADFLSMEPLAGPFKSLKRDNLPKLDAADSALATLKGIKALTEVCAEDSVCQDMIVDFGILCLLRRFLLSDDYEKLAAIEAYDASSRAHEGKERISNVDGEPATPNVNDPASVRVPPTAHIRKHAARLLTILSLLPRVKKVITADETWCKWLDDCANGRIPGCSDLKMQSYARAALLNMFCNDQPNRKSESGSGGPSDGGVPNYRNSCPRYDDMIFLINSHLPHWKCPKETDQQEAFSEEISLFTSTEMGDGTESVNDSNGSISNDSTKSSPDADCPPLDIVFVHGLRGGPYKTWRIAEEKSSTLSPLVEKIDEEAGKLGTFWPGEWLSGDFPEARMFTLKYKTNLTQWSGASLPLQEVSSMLLEKLLAAGIGNRPVVFVTHSMGGLVVKQILHKAKEERFDNLVKNTIGIIFYSCPHFGSKLADMPWRMGFVLRPAPTIGELRSGSSRLIELNDYIRHLHKKGLLDVLSFCETKVTPIVEGYGGWAFRTEIVPIESAYPGFGELVGGPLPYCPIGQSMWGSYPWAPDLL

SEQ ID NO: 226378 - protein, 99 aa, Glycine max
  Coding DNA Sequence Number=SeqID_109600
  Gene Ontology: Mol. function=ribonuclease H activity; Cellular component=mitochondrion; Biological process=DNA integration
MSGYIEDVNSECNQRFMAKSIERTLPFFRILKKDNRFTWTEECETTFQQFKETLFAPPTLTKWNLGETLYLYLAITEEAINVALFKNNNKTQKLVYFVS

SEQ ID NO: 226379 - protein, 102 aa, Glycine max
  Coding DNA Sequence Number=SeqID_109601
  Subcellular localization annotation: CTP_CleavageSite=71; ConfidenceScore=5.52e-01
MKKGDPFVTPSFASINITPDYRLFTATTSLLNDKMYSLNSSSSPCQISFKSTPIFGLSLLVVKENLNVPLKSSHKSMDLNRKDLNYFNEVDFNDSGNARHKV

SEQ ID NO: 226380 - protein, 114 aa, Glycine max
  Coding DNA Sequence Number=SeqID_109602
MTCKRVTHSARNHKSVKRRPSPLIFDDKYTNMSIVPNHDDPLLVKVFTNNKEESQNHLSELLPYNEDLIGFFGQHITPIGYVKLHITFELDCKEDIKKGVWAPRPEPRGSCQDL

SEQ ID NO: 226381 - protein, 173 aa, Glycine max
  Coding DNA Sequence Number=SeqID_109603
  Gene Ontology: Mol. function=zinc ion binding
  Homolog annotation: Hit_ID=Q1S5F3; Match level="QueryCoverage=66%, HitCoverage=59%, E-value=3e-24, Identity=48%"; Hit description=Zinc finger, C3HC4 type (RING finger), putative
  Pfam annotation: Domain name=zf-C3HC4; Domain location=99-146; Score =26.0; E_value=0.00014; Accession=PF00097.15; Description=Zinc finger, C3HC4 type (RING finger)
MSSLQLCHVVDLEQGSLSHHRSVSGSDMSMCFSDAENGSCYSHFYSTNGDPYDDYTIGCVSDAEDSRKASSVTDCSVEVEIESGVPEIKVHLAKVERDCRICHLGLESDSQEESGVPIELGCSCKDDLGAAHKNCAEAWFKIKGNRKTENRDPNFIDLLHWEFELINYSYHAM

SEQ ID NO: 226382 - protein, 158 aa, Glycine max
  Coding DNA Sequence Number=SeqID_109604
MSVISHKGSSSTVGHECGLWCCDTIIAMPLGKCIPNTKATPSRGNPNVDTKEVQKQLPYLLSRHCLSETISTQGHLLGRKYYLLHLLSWHCLSKTISARGQLFKGKYRLPHLLNRDCLFETILTRGKLFRGKYKLYTSWACGTKHRHIKTDLRITSRL

SEQ ID NO: 226383 - protein, 243 aa, Glycine max
  Coding DNA Sequence Number=SeqID_109605
MTERILAGSLALESRILHYLIVRILLPRSSNLAQVSEEDLIVMWAFHIGRQIDWAHLVRYRMHKALRLNAPLPYPHLVTLFLQHFNIPIDSEPYVPIKRSFLIGVAVVASFGYRKEHDGSWVKKGVQPNDDEGQLLVEGDSSLLQSILDRFDGLQTYVGERFVALEQQVDMRFDAMDSRITKVEEDVTIIRDCLDLPLPPPDCHHQKGGDCGNKAFQGYFDDAKESRVKQIPKIQDSRIKIQE

SEQ ID NO: 226384 - protein, 164 aa, Glycine max
  Coding DNA Sequence Number=SeqID_109606
  Gene Ontology: Mol. function=RNA-directed DNA polymerase activity; Biological process=RNA-dependent DNA replication
MVEEISQKYCCYHRTTGHDTNDCFQLKNAIEIIIHRGKLDIYVRDRGEGFADEGPSNKAWKRHARELLTVAYSGRNHKLVKRQPPPLIFDNKDMDMLIVPNHDDPLLVKYFINNKEVHKLLVDIGSSVAIMFYDFFRNLKISQSNLLPYNDDLIAFSGHYINPM

SEQ ID NO: 226385 - protein, 66 aa, Glycine max
  Coding DNA Sequence Number=SeqID_109607
MGLFCSEDPRYLVPANTINIREVSVSQCNCRYPSYWEGVVSLSFENSSGVVKKSLDGENKRSFQCS

SEQ ID NO: 226386 - protein, 197 aa, Glycine max
  Coding DNA Sequence Number=SeqID_109608
MAGNQLTFAKGASISKPPLFCGMNYPFWKVQMKIFMESINRGILSVLEMNIIHSSLNPNEVFRVSVGTIAKEIWDLIQVIDEGTQERASAKYNTPRLSARKTLEEDELYRKLRGYEMGLTRMAEEEAIDKKNRGLASKTSIPSSDKSEYDNAKGLKAKNLNLLMGKFNKFLKKGKNYGNKTFLPKKNLKKGEPFFSN

SEQ ID NO: 226387 - protein, 489 aa, Glycine max
  Coding DNA Sequence Number=SeqID_109609
  Gene Ontology: Mol. function=protein-tyrosine kinase activity; Cellular component=chloroplast; Biological process=protein amino acid phosphorylation
  Homolog annotation: Hit_ID=Q8LEG7; Match level="QueryCoverage=99%, HitCoverage=99%, E-value=1e-151, Identity=56%"; Hit description =Protein kinase-like protein
  Pfam annotation: Domain name=Pkinase; Domain location=59-303; Score= -111.1; E_value=0.061; Accession=PF00069.15; Description=Protein kinase domain
MGARCSKFSFCWFHSHLKPSVLESSDQENGEKGERKLWPSFGEFSLEQLKAATNGFSSENIVSEHGEKAPNVVYKGKLDNGQWIAINVSTSLLGLILANSSSPNAAHVATIVVGMLLWRSPCFSHNCGRDAVTEISKTSILRLQIPRQVGSLRSERLANLVGEAQPMKWAMRLRVAFYLAQALEYCTSKGRGLYHDLNAYRILFDQDANPRLSCFGLMKKSRDGKSYSTNLAFTPPEYLRTGKIFRMFALDLIRGKNFLMLMDSALEGHFSKDDGTELVRLASRCLQYEARERPNAKSLVASLMSLQNETEQHADEVHPYFLYSFLVGPLICSNGSPARNCILNKAITLTPFGEACLRLDLTAIHEILEKTGYKDDEGIANEETLNLKKHGDTAFRAKDFITAIDCYTQFIDGGTMVSPTVYAIRCLSLLMNDMAQEALGDAMQAQVVSPEWPTALYLHAACLFSLGMENDAQETLKDGTNMEGRKNKN

SEQ ID NO: 226388 - protein, 105 aa, Glycine max
  Coding DNA Sequence Number=SeqID_109610
MPVLAGDQPRHAPAPDHEDYMQPDIPQVPVAFDPPRHAVDDYEGYEAIAERLERVLNLRMVTAGTELHDIMQDCLRIARGVPAQMEVLGLDKGGAQSIDDVFYVL

SEQ ID NO: 226389 - protein, 80 aa, Glycine max
  Coding DNA Sequence Number=SeqID_109611
  Gene Ontology: Mol. function=heat shock protein binding; Cellular component=integral to membrane; Biological process=protein folding
  Homolog annotation: Hit_ID=Q2QNZ9; Match level="QueryCoverage=72%, HitCoverage=6%, E-value=1e-24, Identity=86%"; Hit description =Expressed protein
MVVQMEYFELLTESSYIKVLWPECGWQPVSLTDMITSSAVKKVYRKANLCIHPDKVQQKGATLEQKYTAEKVFDILKVPY

SEQ ID NO: 226390 - protein, 306 aa, Glycine max
  Coding DNA Sequence Number=SeqID_109612
  Gene Ontology: Mol. function=translation initiation factor activity; Cellular component=membrane
  Homolog annotation: Hit_ID=Q6ZGV8; Match level="QueryCoverage=61%, HitCoverage=13%, E-value=1e-51, Identity=58%"; Hit description =Eukaryotic translation initiation factor 3 subunit (EIF-3)-like
MAMSQSACKETGMKSCSLVENFLVHLLRRILRDRALYKVTSDFVDAAINGAIGVISGCIPPINLTDPECFHMYVHNNIFFSFAIDADLEKLSKKLVDANSKSWSSSSLQSSSDKDSIPVHGESQVPNGGKDDGSSSEDLNSTEITQDVSPEAQLAENEQATYASANNDLKGTKAYQEADVPGLYNLTKKLMFLAQRFLLRSLEQVKDCLYAPATIPITFHIKLNWIMCWLPSLHTCPNILNVNLRILLKVIGKKLLVQQFSHIEVENNFKKVHLLLQMHLYLLGKILETQEGRILRVPEFGILSLN

SEQ ID NO: 226391 - protein, 93 aa, Glycine max
  Coding DNA Sequence Number=SeqID_109613
  Subcellular localization annotation: CTP_CleavageSite=37; ConfidenceScore=5.11e-01
MGSVLVVVAKIFFYNRKFQLKISPRQVPKLQGKRICCQTMPRNIYAVIFNGTKTNMRHQLGKQTGRCRNRASANRSIDFAKALAVGSKKALPH

SEQ ID NO: 226392 - protein, 104 aa, Glycine max
  Coding DNA Sequence Number=SeqID_109614
MVDILMKLGGCIGMKVHVLLLMMSRLLERLHLWLFELLTSKFFDGSKHFQIKSCEVKLSKVPRSFLCKVKDDLVPPNPTVKVFAVAAPEATDSIRGEDGVQLGD

SEQ ID NO: 226393 - protein, 527 aa, Glycine max
  Coding DNA Sequence Number=SeqID_109615
  Gene Ontology: Mol. function=oxidoreductase activity; Cellular component=intracellular; Biological process=translation
  Homolog annotation: Hit_ID=Q1SGI4; Match level="QueryCoverage=99%, HitCoverage=89%, E-value=0.0, Identity=81%"; Hit description=Copper -resistance protein CopA
  Pfam annotation: Domain name=Cu-oxidase; Domain location=112-269; Score=200.2; E_value=5e-57; Accession=PF00394.12; Description =Multicopper oxidase
  Pfam annotation: Domain name=Cu-oxidase_2; Domain location=377-511; Score=173.4; E_value=5.7e-49; Accession=PF07731.4; Description =Multicopper oxidase
  Pfam annotation: Domain name=Cu-oxidase_3; Domain location=1-102; Score=186.3; E_value=7.3e-53; Accession=PF07732.5; Description =Multicopper oxidase
  Pfam module annotation: Pfam domain module=Cu-oxidase::Cu-oxidase _2::Cu-oxidase_3; Domain location=112-269::377-511::1-102
MVTVNGKFPGPRVVAREGDRIVVKVVNHVPNNVSIHWHGVRQLQSGWADGPSYITQCPIQTGQNYVYNFTIVGQRGTLFWHAHFSWLRATLYGPLILLPRRNESYPFEKPYKEVPIIFGEWWNADPEAVIAQALQTGAGPNVSDAYTFNGLPGPFYNCSNNETDTDTFRLKVKPGKTYLLRLINAALNDELFFSIANHTLVTVEADATYVKPFESDIIVLGPGQTSNVLLKTKAEYPNANFLMLARPYFTGMGTFDNSTVAGFLEYKNKPLAAPKNINIPTLKPFLPAINDTSFVANFSNKFFSLNPAKVPQIVDKSFFFTIGLGTSPCPKNQTCQGPNNSSKFAASMNNISFTLPSIALLEQHFFGQANNGIYTTDFPAMPLMPFNYTGTPPNNTLVGNGTKTVVIPFNTSVQVVLQDTSILGAESHPLHLHGFNFYVVGQGFGNFNPNTDPQIFNLFDPVERNTVGVPSGGWVAIRFLADNPGVWLMHCHFDVHLSWGLRMAWIVEDGKLPNQKLPPPPADLPKC

SEQ ID NO: 226394 - protein, 102 aa, Glycine max
  Coding DNA Sequence Number=SeqID_109616
MTFGIPVISTIDVDYVTIPSHFYHRWRHELEQQVYVKGDDKTTVLFKFPYIRNNYFKIVIKKELDDSDEDDNNLQDQLLWQTIVFKAMTNSRDLLVRIILLL

SEQ ID NO: 226395 - protein, 147 aa, Glycine max
  Coding DNA Sequence Number=SeqID_109617
MEKCKEIGGRVYTTTTTTTTTTPYPTRWGRLHGSTSAIMFYQKNLEELASSDYPTFGALIWHKELIGLILLLLTGSKTTHCTHLAWWHCWALLCVKCGNQLYLGCMLCVLFVVFEEQRTYPYNQQLSRTDIRGDHDDLTPMEMEEYK

SEQ ID NO: 226396 - protein, 201 aa, Glycine max
  Coding DNA Sequence Number=SeqID_109618
  Gene Ontology: Mol. function=nucleoside-triphosphatase activity; Cellular component=integral to membrane; Biological process=protein catabolic process
  Homolog annotation: Hit_ID=Q94ES0; Match level="QueryCoverage=92%, HitCoverage=20%, E-value=5e-42, Identity=52%"; Hit description=AAA -metalloprotease FtsH
MIFSRIARSVSRSPRARNFLHGDGRLGTHVGVPRTNAYSEGAERVLGFARGYVSSARALSNGFVSNLPDFKSVAANPRIRRLFCSEAPKKKNYKNFYPKEKKEVPKGNDKKHESKVSSYCFIAFNLMPELPLCWEVGESDNSHANTENSGNFKEAFMKQVQNLITPLLLGMGLFLTSFSFGHREQEEGKNGNIREITRNKI

SEQ ID NO: 226397 - protein, 123 aa, Glycine max
  Coding DNA Sequence Number=SeqID_109619
MELIETIAASDHAILHGRAYTPTKKSLIELISQDAMLAQNKLLAIRDPHINSESYPGNNFNQGVPSNRSLNQGLDLYKRTTKLEDTLTQFMQVSLSNHKSTEFIIRNLEGQTQDSMVAGAKIK

SEQ ID NO: 226398 - protein, 112 aa, Glycine max
  Coding DNA Sequence Number=SeqID_109620
MEGFFCEKLLGILVVLELVEELFWDKLLIKRGEFEEELEEEPLVEQLLENNDDLLEPASFFHTFPFSSMKNKGTVISRISYGTKMCTWMDEHSTLTLMSNTHIIVEDIRRVS

SEQ ID NO: 226399 - protein, 96 aa, Glycine max
  Coding DNA Sequence Number=SeqID_109621
  Homolog annotation: Hit_ID=Q5ZAY6; Match level="QueryCoverage=46%, HitCoverage=10%, E-value=2e-09, Identity=64%"; Hit description =Putative WDR13 protein
MCSAVLNFGHMSSDLLAYGASDGTLTVCSVSKNPSVIKQLNEHSKDVTDEWSLRELRRAWAKKRDMSSSDLLVEMKQWFEETNLNVILKKVAGKRY

SEQ ID NO: 226400 - protein, 269 aa, Glycine max
  Coding DNA Sequence Number=SeqID_109622
  Gene Ontology: Mol. function=protein-tyrosine kinase activity; Cellular component=nucleus; Biological process=protein amino acid phosphorylation
  Homolog annotation: Hit_ID=Q6L4G6; Match level="QueryCoverage=87%, HitCoverage=29%, E-value=4e-20, Identity=29%"; Hit description =Putative receptor-like protein kinase
MSKPFCALFALSIILVTCHAQTLNTSTTCEPSKCGNLNISYPFWKKSNTNVQEFCGYPEFGLECLDDQAIMIFPTDRYQVTDINYDIHSITLLDIDVLGQPCPRARHNVSLHNLPLSFSSLDFNLSFYFNCSSYPSSIQHIGCMEHDKYQSYVFKTGDEAESNGFDWLRHCEEHVVVTVKQDEIEISSLITGFGDAMQKGFVLDWMRAQDCAVCEESNGYCRFDQATKQSRCLCSDGRTEAKSCKKDFSIIEIFAHIHNSAQFIAFIKI

SEQ ID NO: 226401 - protein, 601 aa, Glycine max
  Coding DNA Sequence Number=SeqID_109623
  Gene Ontology: Mol. function=nucleoside-triphosphatase activity; Cellular component=integral to membrane; Biological process=protein catabolic process
  Homolog annotation: Hit_ID=Q94ES0; Match level="QueryCoverage=99%, HitCoverage=74%, E-value=0.0, Identity=79%"; Hit description=AAA -metalloprotease FtsH
  Pfam annotation: Domain name=AAA; Domain location=149-339; Score =303.1; E_value=5.2e-88; Accession=PF00004.19; Description=ATPase family associated with various cellular activities (AAA)
  Pfam annotation: Domain name=AAA_2; Domain location=146-278; Score= -30.8; E_value=0.002; Accession=PF07724.4; Description=ATPase family associated with various
  Pfam annotation: Domain name=AAA_5; Domain location=149-285; Score= -4.3; E_value=0.0038; Accession=PF07728.4; Description=ATPase family associated with various
  Pfam annotation: Domain name=FtsH_ext; Domain location=4-123; Score =35.8; E_value=1.5e-07; Accession=PF06480.5; Description=FtsH Extracellular
  Pfam annotation: Domain name=Peptidase_M41; Domain location=346-549; Score=400.4; E_value=2.7e-117; Accession=PF01434.8; Description =Peptidase family M41
  Pfam module annotation: Pfam domain module=AAA::AAA_2::AAA_5::FtsH _ext::Peptidase_M41; Domain location=149-339::146-278::149-285::4 -123::346-549
TLPAKGSGGQYKYYFNIGSVESFEGKLEEAQEALGIDSHDFVPVTDSERSTFEEMTKAALTLLFLLSIGLIDTVDPGQLGFGGSGGSKGARGIFNIGKAHTKVDKNAKNKVYFKDVAGCDEAKQEIMEFVHFLKNPKKYEELGAKIPKGALLAGPPGTGKTLLAKATAGESGVPFLCLSGSDFMEMFVGVGPSRVRNLFQEARQCSPSIIFIDEIDAIGRSRGRGGFSGANDERESTLNQLLVEMDGFGTTSGVVVLAGTNRPDILDKALLRPGRFDRQITIDKPDIKGRDQIFQIYLKKIKLDHEPSYYSQRLAALTPGFAGADIANVCNEAALIAARGEGTQVTKEHFEAAIDRIIGGLEKRNRVISKLERRTVAYHEAGHAVAGWFLEHAEPLLKVTIVPRGTASLGFAQYVPSENLLMTKEQLFDMTCMALGGRASEQVLIGRISTGAQNDLEKVTKMTYAQVAVYGFSDKVGLLSFPPTEGSYEISKPYSSKTAAIIDNEVRDWVNKAYEHTVQLIKEHKEQVAQIAELLLEKEVLHQDDLLRVLGERPFKVTEPTNYDRFKQGFIEEEEKVAESTIDTPEKGGGSSPLEPQVVPA

SEQ ID NO: 226402 - protein, 144 aa, Glycine max
  Coding DNA Sequence Number=SeqID_109624
MAGKMEGTTMEMDDFAKVVVDLEARLKELESRMEEFEEELLMYKKEVVEQHEKGFHKVVRQAGFFTKDLDLGLFDPFKDEKDDVLLEEEDISTEEEQDIEEQGDEANVWEERPWCCRNDVILTRSGSLDTGYEDLDDATSSEGR

SEQ ID NO: 226403 - protein, 244 aa, Glycine max
  Coding DNA Sequence Number=SeqID_109625
  Gene Ontology: Mol. function=protein serine/threonine kinase activity; Cellular component=nucleus; Biological process=protein amino acid phosphorylation
  Homolog annotation: Hit_ID=Q9C6K9; Match level="QueryCoverage=88%, HitCoverage=34%, E-value=1e-48, Identity=50%"; Hit description=Wall -associated kinase, putative
  Pfam annotation: Domain name=Pkinase; Domain location=39-244; Score= -21.6; E_value=2.8e-07; Accession=PF00069.15; Description=Protein kinase domain
  Pfam annotation: Domain name=Pkinase_Tyr; Domain location=39-241; Score=-28.2; E_value=9.7e-11; Accession=PF07714.7; Description =Protein tyrosine kinase
  Pfam module annotation: Pfam domain module=Pkinase::Pkinase_Tyr; Domain location=39-244::39-241
MGLGLFECCFTSSSSDTFSKQSKWRILPYKKLAKVTNNFNQSHCLGKRGFATEYYGKLEDGREITIQCFNEDKHHMLQQFINETAILNYLPHKNIVSIYGCASHHKESLLVHEYLSNGNLASHLQSEITKNSTLPWLTRLDIAIDIANSLDYLHYYGIIHRNVKSSNILLDVNFCAKLANLHLSRKLPDGVPVYATHVTGDIIGTCSYIDPEYLTKGRLSVKNDVYSFGVVLCELFSSKLAKNW

SEQ ID NO: 226404 - protein, 87 aa, Glycine max
  Coding DNA Sequence Number=SeqID_109626
MANKTIFDNIISDTLREKRTKIDLSVMMEANFPEEESIMYVSDSLGFAAMEPSLRDPSLEDNDFSETSKFISQILMEENVQERPFYD

SEQ ID NO: 226405 - protein, 303 aa, Glycine max
  Coding DNA Sequence Number=SeqID_109627
  Gene Ontology: Mol. function=protein binding; Cellular component =proteasome complex (sensu Eukaryota); Biological process=ubiquitin -dependent protein catabolic process
  Homolog annotation: Hit_ID=Q307X2; Match level="QueryCoverage=92%, HitCoverage=88%, E-value=3e-82, Identity=57%"; Hit description =Ubiquitin fusion-degradation protein-like
  Pfam annotation: Domain name=UFD1; Domain location=3-169; Score =307.7; E_value=2.1e-89; Accession=PF03152.5; Description=Ubiquitin fusion degradation protein UFD1
MVVKLFMPIKLLMQTLFLPSVIMPPSALRRLAYLDIEYPMVFELRNSSAEIVTHCGVLEFTADEGIIHMPEWMMKNMKLQEGNTVILKNTQVPRATYVKLQPHTKDFLDISNPKSILEISLRSYSCLTTGDTIMIPYNNKKYYIDIVETKPSNAISVIETDCEVDFAQPLDYIEPEKLLPSASSDKGCTEVHDDSATQTAQIVPFTGFGRRVDGKPCTQSVEETCSMLNLLKTEKETKNCNSKISNTASRRASGKLVFGSNANTPKIQTPPKASLKIKTQESSKKEEESKFQAFTGKKYSLID

SEQ ID NO: 226406 - protein, 614 aa, Glycine max
  Coding DNA Sequence Number=SeqID_109628
  Gene Ontology: Mol. function=protein-methionine-S-oxide reductase activity; Cellular component=nucleus; Biological process=regulation of transcription
  Homolog annotation: Hit_ID=O81074; Match level="QueryCoverage=96%, HitCoverage=96%, E-value=1e-132, Identity=43%"; Hit description =Putative SCARECROW gene regulator
  Pfam annotation: Domain name=GRAS; Domain location=209-522; Score =446.1; E_value=4.5e-131; Accession=PF03514.5; Description=GRAS family transcription factor
MEPNIPRGAEEQSTAYLMEDSDFSETAKFISQILMEENIDQRPLYDTLTLQVTEKSFYDALTGNIPLSPNPNQHPLLLSPQAQTTITEHGLSDLDSSLQQNLFNDADSVSHFKRGLEEATKFLPPVSNLVTGQYPNGEQPINTFEGNSYGFQSRKNHEREEIDTREEEHEGRGHKQSALSLVDETDLSDAIDRVFLSVENVCIEHSSLQNGALKPKAPEVGKGRSKKQGRKKETVDLRNLLLMCSQSVYANDIRTANELLKQIRQHSSPVGDASQRLAHYFANGLEARLIGAGSGAIGTFSFVSSKRITAAEFLKAYQVFLSATPFKKFTYFFANQMIVKAAAKAEIIHIIDYGILYGFQWPILIKFLSNREGGPPKLRITGIEFPQSGFRPTERIEETGHRLANYCKRYNVPFEYHAIASRNWETIKLEALKIERNELVAVNCHMRFEHLLDESTIEVNSPRNAFLHLIRKINPDIFTQIIINGSYDAPFFATRFREALFHYSAIYDMFDTVITSENEWRMTIESELLGREVMNVIACEGSERVQRPETYKQWQVRNTRAGFKQLPLNEELMAKFRSKLKEYHRDFVLDENNNWMLQGWKGRIFNASTCWFPA

SEQ ID NO: 226407 - protein, 534 aa, Glycine max
  Coding DNA Sequence Number=SeqID_109629
MSYRFVRLVKPSSLNKCVRDASIKLSRMDMLLVLQARFDMLGECSAHAILLQRVTHGVACTGDMIITIFRLLLSFSQNCFALLLVISLSSSFVFFDFQGTSLSTMSSLLFDFAIGMGGSDFGGLIKQTLVDREHISIDGSSLEETCHSACDNESSSSERHFLPSAASPVVEPIPVTMILPHSIFGGAMRSGVGDVRASPRVQHSHGDGSSSSIPVVAGFDWVLGLVLPLTTFQCALLEHINMAPSQIYLNSCAMVRAFKVMCPFFNILPNVLVFFVFFRMKLMGKIDWVSLNNVSKKLFEFELNVFHYFKDHLFKVLATDAMDLLTFMERVDKAILEELSALLDAWDILSLPSVDDPFIALDGIMGVQPIVKVCPIASIAEERRDYATISSLRQVAGLTPPLIVEAFAPAPPPPSTVLVQEVAFGAKCSQDVASSFFNSPGSSPVVLVSPSPSTSSHPHTPVSFVSAFDKNLIRSVGVQKATNSTKVFLQRSLALLEKNGQRHQEALSKVASLEAKVAKWRVIARIIWRVERLK

SEQ ID NO: 226408 - protein, 214 aa, Glycine max
  Coding DNA Sequence Number=SeqID_109630
  Homolog annotation: Hit_ID=Q9XE58; Match level="QueryCoverage=45%, HitCoverage=12%, E-value=4e-21, Identity=57%"; Hit description =Scarecrow-like 14
  Pfam annotation: Domain name=GRAS; Domain location=66-213; Score= -128.8; E_value=0.023; Accession=PF03514.5; Description=GRAS family transcription factor
MEVNFPITDLFGEEEESIFLAATPSLNHLHLLLIMDSQIWILPLLNSWQTIFSMMLILFPSLGEAWRKLPSFFHRGLSCNWSAFQWVEGLQSETMKAVEASGGKSLPKKQGTKDETIRQHSSPSGDALQRLAHYFVNGLEARLVGEGMFSFLSSKRSPAAEFLKAHQVFLSASPFKKLTYFFANKMIMKAGAKAETVHIIDLRHPIWFSMANAY

SEQ ID NO: 226409 - protein, 128 aa, Glycine max
  Coding DNA Sequence Number=SeqID_109631
MEREVKNKCSKTRKNGRQGMSYPTDEVMVHGGIVYDGVLDNTEKKNKNSYKKCLMETTDFPCQDDDHSGKKKMLSTKGEKPFDPYPRIKVSKEEYESWRNAWKCTLVSLLCKIKLQKFGSKKVILKYT

SEQ ID NO: 226410 - protein, 185 aa, Glycine max
  Coding DNA Sequence Number=SeqID_109632
MSSLVGKLYITSQKECILTNKKKVTGLVVGPWSALKKWRYFYGDCCEIAYRLVTKGVDCPITSSKWPNDPESRCHGLGETNKYGKTLRSQFLYPCKQRKIQSLTSGSRLANVHYAHPHMLKCKVDASILSNSSQYGMDVIGSTTLRENSWLPQHLFTLGSYLQLKQKHQLSLLLFLGYLIQATTT

SEQ ID NO: 226411 - protein, 680 aa, Glycine max
  Coding DNA Sequence Number=SeqID_109633
  Gene Ontology: Mol. function=protein-methionine-S-oxide reductase activity; Cellular component=nucleus; Biological process=regulation of transcription
  Homolog annotation: Hit_ID=Q00LP5; Match level="QueryCoverage=92%, HitCoverage=90%, E-value=1e-157, Identity=47%"; Hit description=GRAS4
  Pfam annotation: Domain name=GRAS; Domain location=283-587; Score =454.4; E_value=1.4e-133; Accession=PF03514.5; Description=GRAS family transcription factor
MLSTDSLLENFPFVNGPISVFSNQNPESGFKVDDSCSPSESVTDSGPSSGTSSNGEHAESTKHSNPILRYISDILMDEEVDLERKPCMLQDCLRLQAAEKSFYDALVRSYPSSTGQFNDNPDPDDNFGGTTSSESFSSYTTDNSCESDWFNGASDLDSSFLQRSLIDSLEHTYVAPDLFRETQAGVHFSNGAWNLIHLQNKPRAIEDGVMRGSVTATGLREKRSYQMNDISHEEEEKSNKLSAVYLDDSEPSSMFDDVLLCKDGKSPSIFYAGREPSPSQIADSGGSNGKKTRSKKGSNKRTSASATVDLWTLLTQCAQAVASFDQRTANETLKQIRQHSSPYGDGLQRLAHYFADGLEKRLAAGTPKFISFQSASAADMLKAYRVYISASPFLRMSNFLANSTILKLAQNESSIHIIDFGISYGFQWPCLIQRLSERPGGPPKLRMMGIDLPQPGFRPAERVEETGRWLEKYCKRFGVPFEYNCLAQKWETIRLEDLKIDRSEVTVVNCLYRLKNLSDETVTANCPRDALLRLIRRINPNIFMHGIVNGTYNAPFFVTRFREALFHFSSLFDMFEANVPREDPSRLMIEKGLFGRDAINVIACEGAERVERPETYKQWQVRNQRAGFKQLPLAQEHVNRVKEMVKKEYHKDFVVGEDGKWVLQGWKGRILFAVSSWTPA

SEQ ID NO: 226412 - protein, 124 aa, Glycine max
  Coding DNA Sequence Number=SeqID_109634
MCLCYARKGMEEAEILEESEMKLEVIISAMSECFEEGDGLEDQNMLEEDFMSNARKPIWLIKRMAEESKGPVEEREIVPIWFSGHCRPPYIPAKVSHTQEIDIVPKVFPCRPRPRAVPEMGDTF

SEQ ID NO: 226413 - protein, 256 aa, Glycine max
  Coding DNA Sequence Number=SeqID_109635
  Gene Ontology: Mol. function=phospholipase A2 activity; Biological process=lipid metabolic process
  Homolog annotation: Hit_ID=Q9AQT8; Match level="QueryCoverage=91%, HitCoverage=58%, E-value=7e-96, Identity=75%"; Hit description =Patatin-like protein
MWLCLFHEIDILLCDVISQLKKRPDLNASLSDICISTSAAPTYLPAHSFETKTHHGVSKFDLIDGGVAANNPALVAMAEVTNRISHEGQCNSLNVKPMQYDRFLVISLGTGSQQKEMKYSADEAAQWGIFSWVTTTNGGTPLIDAFSHASSDMVDFHITSLFQALNSEHNYLRIQDDSLNGDMSSVDLATEKNLNDLVKVGESLLKKPVSKINLQTGVHEPVNSHETNGEALKRFAERLSKQRRFRKSQMSANGNL

SEQ ID NO: 226414 - protein, 368 aa, Glycine max
  Coding DNA Sequence Number=SeqID_109636
  Gene Ontology: Mol. function=phospholipase A2 activity; Biological process=lipid metabolic process
  Homolog annotation: Hit_ID=Q9AQT8; Match level="QueryCoverage=95%, HitCoverage=93%, E-value=1e-125, Identity=64%"; Hit description =Patatin-like protein
  Pfam annotation: Domain name=Patatin; Domain location=22-212; Score =210.9; E_value=3e-60; Accession=PF01734.12; Description=Patatin-like phospholipase
MEATKALVSSTPCDDGHLVTVLSIDGGGIRGIIPGIILGFLESELQKLDGNHVRLADYFDVIAGTSTGGLVTAILTAPNENNRPLYAAKDIKNFYLDHTPKIFPQNKCWNLLSSMVKLTRTLFGPQYNGKYLHNLIREKLGETKLHQTLTNVVIPGFDIKRLQPTIFSSFQLDPTYLPAHSFETKTHHGHVIGKFDLIDGGIAANNPALVVMAEVTNQIFHEGPCDCLNVEPMQYDRFLVLSLGTGSQKQEMKYRLMKQLNGPLSWVSTTNGGTPLIDAFSQASADMVDFHISSVVRALNSEHNYLRIQDDTLTGVDKATMKNLDDLVKVGESLLKKPVSKINLKTGVYEPVKSYQTNEEALKRGEMI

SEQ ID NO: 226415 - protein, 524 aa, Glycine max
  Coding DNA Sequence Number=SeqID_109637
  Gene Ontology: Mol. function=protein-methionine-S-oxide reductase activity; Cellular component=nucleus; Biological process=regulation of transcription
  Homolog annotation: Hit_ID=O81074; Match level="QueryCoverage=98%, HitCoverage=87%, E-value=1e-105, Identity=44%"; Hit description =Putative SCARECROW gene regulator
  Pfam annotation: Domain name=GRAS; Domain location=229-519; Score =372.9; E_value=4.9e-109; Accession=PF03514.5; Description=GRAS family transcription factor
MEDNDFSETAKFISQILMEENVELEQSPFYDSLTLQVTEKSFYDALAGNLLLSPQASNTNFSVENSRELNLPSPDSLSVSALQFNPHALSQPPPLVNVSEGVSDLDSSIARLLAHNIFNDVDSVSHFRRGFEEASRFLPPGPNLVTALHSNAQEPINSFRENSYGLLKGRKNLERQEINTREEERGGRSNKQSAFSFVDESDLSDAIDRVFLSVENVCSEHSSLQSGPLRAEEQDRGKGLSKKQERRKQETVDLRNLLLMCSQSVYANDNRTANELLKQIRQHSSPVGDASQRLAHYFANGLEARLVGDGTSSQGMYTFLSSKNITAAEFLKTHQDFMSASPFKKFTYFFANKMIMKAAAKVETVHIIDFGILYGFQWPILIKFLSNREGGPPKLRITGIEFPQPGFRPTEKIDETGRRLANYCKRYSVPFEYNAIASKNWETIRIEALKIESNELVAVNCHQRFENLLDDSIEVNSPRNAVLHLIRKINPNIFTQSITNGSYNAPFFAPRFREALFHILLFMI

SEQ ID NO: 226416 - protein, 108 aa, Glycine max
  Coding DNA Sequence Number=SeqID_109638
  Gene Ontology: Mol. function=metal ion binding; Biological process =ubiquitin cycle
  Homolog annotation: Hit_ID=Q8LBL5; Match level="QueryCoverage=79%, HitCoverage=21%, E-value=3e-32, Identity=65%"; Hit description=E3 ubiquitin-protein ligase PRT1
  Pfam annotation: Domain name=zf-C3HC4; Domain location=25-64; Score =6.8; E_value=0.031; Accession=PF00097.15; Description=Zinc finger, C3HC4 type (RING finger)
MENNAFRDRILEDNEHEEIPDSFVCCVCLDLLYKPIVLSCGHICCFWCVYNSMNCLRESQCPVCRNQYYHFPTVCQLLHFLLLKIYTAAYKRRENQTLGISLFLMTYA

SEQ ID NO: 226417 - protein, 298 aa, Glycine max
  Coding DNA Sequence Number=SeqID_109639
  Gene Ontology: Mol. function=protein serine/threonine kinase activity; Cellular component=nucleus; Biological process=protein amino acid phosphorylation
  Homolog annotation: Hit_ID=Q9C9P0; Match level="QueryCoverage=93%, HitCoverage=15%, E-value=6e-20, Identity=35%"; Hit description =Protein kinase, putative
MDKNITLPWLKRLDMAIDIANPLDHLNNYGIIHRNKLPDGVPVDATHVTSDRAGSSGYMDPEYLTKGQLSVKNDVYSFGVVLCELLSSKLAKDWVLNEVDNLVSILSRKIENQALVELLDPRLGFESNLKIKQVMTVTAKLALKRMKLMSTRIKASFCLCVFVNIPRGRTSRNCNKHMLVYEYISNGTLTNIFTNLLVILDSHGLFPGHATHVSTIPVGTRAYIDPDYYESGRVSDKSDVYSFGMVLFKLISSIRPSLMEGTNDDTLTQYAKRKILNKQFNEVVDPSFWLGSNKIISV

SEQ ID NO: 226418 - protein, 163 aa, Glycine max
  Coding DNA Sequence Number=SeqID_109640
  Homolog annotation: Hit_ID=O81071; Match level="QueryCoverage=99%, HitCoverage=100%, E-value=7e-46, Identity=56%"; Hit description =Expressed protein
  Pfam annotation: Domain name=Rab5ip; Domain location=15-163; Score =168.9; E_value=1.3e-47; Accession=PF07019.2; Description=Rab5 -interacting protein (Rab5ip)
MKEGKSVKLNHQQPHQNGHLSPSKFAKLFDPEASWDKDQLGDVLHWIRQVLGLACGFLWGSIPLVGGIWFILKCCSSYKTKEIACMRKFCCAKATLTLEIEKMASPMCFLALSTGIIYSYYAVILKVDEEEFGGHGALLQEGLFASITLFLLSWILVYSLAHF

SEQ ID NO: 226419 - protein, 737 aa, Glycine max
  Coding DNA Sequence Number=SeqID_109641
  Gene Ontology: Mol. function=protein-methionine-S-oxide reductase activity; Cellular component=nucleus; Biological process=regulation of transcription
  Homolog annotation: Hit_ID=O81074; Match level="QueryCoverage=96%, HitCoverage=99%, E-value=0.0, Identity=47%"; Hit description =Putative SCARECROW gene regulator
  Pfam annotation: Domain name=GRAS; Domain location=338-644; Score =447.9; E_value=1.3e-131; Accession=PF03514.5; Description=GRAS family transcription factor
MSNFINGVKPSQVPNTVDVEDHSFDPVNGMMKPFDFGFMDNRFLISPDPNAAQNPFSSSTDEDYPLDEIDFSATVLRYINQMLMEEDLEAKPCMFHDTLALQAAEKSFYEVIGETYHSSSIQNYHNMDSPDESSFSGATTSTSNSFESQWNNVDLADYKPSILQTTFPADFVFQASSIQSSMNTTSNFAVTNSQFLASSVAGFLDPGSTNLFSKSESVLQFERGVEEANKFLPKWNPLVFDLENPSFRMVPPQQVKIKAETERDEISAESRGRKNHEREDEEADLQDGRSNKQSAVYIDDSEISELLDKVLLGTGCRNEQAPSCIGHADLPNGPSLGKLEETNKSGGGKSHVKKQGSKKEIVDLRTLLILCAQAVSSDDRMSANELLKQIKQHASPLGDGTQRLAQCFASALEARLVGTGTQIYTALSHKRTSAADMVKAYQMYISACPFKKLSMIFANHTILHLAKEVETLHIIDFGIRYGFQWPALIYRLSKQPGGPPKLRITGIELPQPGFRPAERVQETGLRLTRYCDRFNVPFEFNAIAQKWETIKIEDLKIKENELLVANAMFRFQNLLDETVVVNSPRDAVLKLIRKANPAIFLHANVNGSYNAPFFVTRFREALFHYSTLFDVLDTNVACEDPMRLMFEREFFGRQVMNIVACEGCERVERPETYKQWQVRNMRAGFKQLPLDKHLINKLRCKLKDAYHSDFMLLEDDNYMLQGWKGRVVYASSCWVPA

SEQ ID NO: 226420 - protein, 906 aa, Glycine max
  Coding DNA Sequence Number=SeqID_109642
  Gene Ontology: Mol. function=protein-methionine-S-oxide reductase activity; Cellular component=nucleus; Biological process=regulation of transcription
  Homolog annotation: Hit_ID=Q6AVK7; Match level="QueryCoverage=94%, HitCoverage=89%, E-value=1e-128, Identity=43%"; Hit description =Putative transcription factor
  Pfam annotation: Domain name=GRAS; Domain location=270-580; Score =463.6; E_value=2.4e-136; Accession=PF03514.5; Description=GRAS family transcription factor
MDSNFPGASEDQGTPYLSDSLGFATMEDNDFSETAKFISQILMEENVDQKPFYDSLTLQVTEKSFYDALAGNLPLSPDQHPVLLSPEAETTTTTTTSSSSSSSNNNFSDEYSRELKLRSPDSISVSAFQFKSQPPPSVTVSDAVSDLDSSIAKLLAHNIFNHVDSVSQFRRGFEEASKFLPPGPNLVTALHSKREEPINSFGDNSYGLLKGRKNHQRQEIETREEGEGERSNKQSALSLVDESDLSDAFDRLLLHEGNLCDEHIRLTSGSVNVEERDGGKGRSKKQGRRKKETVDLRNLLLMCSQSVYANDNRTANELLKQIRQHSSPVGDASQRLAHYFTNGLEARLVGDGTSAQGMYTFLSSKNITVAEFLKAYQVFTSSSPFKKFIHFFANKMIMKAAAKAETVHIIDFGILYGFQWPILIKFFSNREGGPPKLRITGIEFPQPGFRPAERIEETGHRLANYCKRYNVPFEYNAIASKNWENIQVEALKIQSNELVAVNCHLRFENLLDESIEVNSPRNGVLHLIRKINPDIFTQSITNGSYNAPFFATRFREALFHYSAIYDLIDTVIPRENEWRLMLERELLGREIMNVIACEGSERIERPETYKQWYVRNTRAGFKQLPLNEELMAKFRTKLKEWYHRDFVFDEDNKWMLQVLIFPVRASSYTPTGALADYLSLEIFQLVAMVKLILLVTLFQVLVSCVWLPTCLTFGLIEYNAIASKNWETIQVEALKIESNELVAVNCHQRKINPDIFTQSITSGSYNAPFLSTRYREALFHYSGISDKIDTVIPRKNDRRLMVERELLGREIMNFIACEGSERIERPETYKQWQVRNMKAGFKQLPLDEELMAKFRSKLKEYHRDFVLDENNNWMLQACCNGEAYFAGYNVSSSDILGLWLPTFLTF

SEQ ID NO: 226421 - protein, 735 aa, Glycine max
  Coding DNA Sequence Number=SeqID_109643
  Gene Ontology: Mol. function=protein-methionine-S-oxide reductase activity; Biological process=regulation of transcription
  Homolog annotation: Hit_ID=O81074; Match level="QueryCoverage=97%, HitCoverage=97%, E-value=1e-117, Identity=42%"; Hit description =Putative SCARECROW gene regulator
  Pfam annotation: Domain name=GRAS; Domain location=233-543; Score =392.3; E_value=7.4e-115; Accession=PF03514.5; Description=GRAS family transcription factor
MESNFTGADDLFAEDKGMPYLSDSLGFATMDPSPEDNNDFLETANFISHILTEENVEQRPFYDSLTLNRNPSTMLSPATYLFHPFNTLSFSVLKMKPPPAVATTATTIFQMKILFNPNTLSQPPPSVTVSDGVSDLDSSIANLLAHNIFNHVDSVSQFRRGLEEASKFLPPGPNLGRKNHEHEEIDTREEGRRSNKQSALSLVDETDLSDAFDRVLIHEGKQCDKHNCLQGGSVNVEERDRGKVRSKNQEGRKKETVDLRNLLLMCAQSVYANDSRTANELLKQIRQHSSAIGDASQRLVHYFANGLKTCLIGDGTGAQGMYFFLTSKKITAAEFLTTYLVFLSASPFKKFIHFFANKMIMKAAAKAETVHVIDFGILYGFQCPSLIKFLSNRESGPPKLRITGIEFPQPGFRPTERIEETGHCLANYCKHYNVPFEYNAIASKNRESIQVEALKIQSNELVAVNCHLRFENLLNESIEVNSPRNAVLHLIRKINQDIFTQSITNGSYNAPFFATRFREALFHYSATYELIDTVIPRENEWRLMIERELLGREIMNVIACEGSQRIERPETYKQWQVRNTRAGFKKLPLNEELMAKLRTALKEWATFCMLPLVGCQHNEMLLDWVQNSYYTEGFGILGLATSTCLTFRCCDEDCNKLCTKLLACERRPETYKQWQVRNMRAGFKQLPLDEHLINKLRCKLKDVYHSDLVLLEDGNYMLQVWKGRVVYASSCWVPA

SEQ ID NO: 226422 - protein, 76 aa, Glycine max
  Coding DNA Sequence Number=SeqID_109644
AFEKSLRARLVKGTIIEFKRTVDGRLITKISGNQIGSVHCKDLCRAFFDMYIGDVPVCEQTKKEIGMNAANIIRKC

SEQ ID NO: 226423 - protein, 271 aa, Glycine max
  Coding DNA Sequence Number=SeqID_109645
  Gene Ontology: Mol. function=protein serine/threonine kinase activity; Cellular component=nucleus; Biological process=protein amino acid phosphorylation
  Homolog annotation: Hit_ID=Q9C9P0; Match level="QueryCoverage=95%, HitCoverage=19%, E-value=1e-52, Identity=46%"; Hit description =Protein kinase, putative
  Pfam annotation: Domain name=Pkinase; Domain location=2-257; Score =15.6; E_value=1.7e-09; Accession=PF00069.15; Description=Protein kinase domain
  Pfam annotation: Domain name=Pkinase_Tyr; Domain location=8-257; Score=-12.6; E_value=1.1e-11; Accession=PF07714.7; Description =Protein tyrosine kinase
  Pfam module annotation: Pfam domain module=Pkinase::Pkinase_Tyr; Domain location=2-257::8-257
KFEDGCEITVQRFKEDKRYILQQFINETVILNYLPHKNIVSIYGYASHHEESLLVHEYLSNGNLAAHLQSEIAKSSKIPWLTRLDIAIDTANALDYLHYHGIIHRNVKSSNILLDANFSAKVANLHLSRKLPDGVPVHATHVTTDIIGSGGYVDPEYMTKGWLSVKNDVYSFGVVLCELLSSKLAKYWVLNEEENLATLLNRKIENQALVELLDPRLGFQSNLKIKSMMTATAELAALCMQCPQDLRPNMEHVLEILNGIKQGRYETNSIK

SEQ ID NO: 226424 - protein, 349 aa, Glycine max
  Coding DNA Sequence Number=SeqID_109646
  Gene Ontology: Mol. function=nucleic acid binding; Cellular component= nucleus; Biological process=DNA integration
MDNVSDMHEESNILDPSPCVDEVYVSGEGTMLVGFDNGLFGSEYKLVDGDDNEDYESEDISDFEETIDAIENEHSDDDIEEIYVEKGIKGQPLENGPNGKIKLAKNQLFFNLDHFREILKDYAIQKGFQLYRVKNGRRRVTCECNTHGCTWRIHGSPTPEKIAKKLESLIVVDPNISYPAVKQTLLEKYNVESSSKMQFYRAKRKVQQTTKGVHDVYYNDLRPWIVLVENENKGSIVKLNVELVPKPNMNPQFKRLFLCLDAQKKRFVRGCRPWLGIDGCHLKGPYGGILLSIVALDTNRGIFLIAVGVVEIECKESWMFFLTYLPESLQSVPGWKDNCLTIMSYIQKV

SEQ ID NO: 226425 - protein, 185 aa, Glycine max
  Coding DNA Sequence Number=SeqID_109647
  Gene Ontology: Mol. function=DNA binding; Biological process=DNA integration
  Homolog annotation: Hit_ID=Q2HRM8; Match level="QueryCoverage=55%, HitCoverage=8%, E-value=1e-28, Identity=56%"; Hit description =Polynucleotidyl transferase, Ribonuclease H fold
MEHFEAAIDRIIGGLEKRNKIHENSVEGRILHGNSPCELIERSTESIGRLPELPEWIISSAIVGMQGRKDVVRHIWDVLKLGMNVHHSQLETETLENSQRQSFCEDISKLHGRRDEKELDEAIVNLLSHDMTVDFYVFGAFVEDRIRSDLNGGMIIAIKSSWLNEGHAEILKKKHEPLQFTGSGS

SEQ ID NO: 226426 - protein, 220 aa, Glycine max
  Coding DNA Sequence Number=SeqID_109648
  Gene Ontology: Mol. function=nucleic acid binding; Biological process= DNA integration
  Homolog annotation: Hit_ID=Q1ST43; Match level="QueryCoverage=85%, HitCoverage=19%, E-value=4e-26, Identity=40%"; Hit description =Integrase, catalytic region; Peptidase aspartic, catalytic
  Pfam annotation: Domain name=zf-CCHC; Domain location=194-211; Score =12.7; E_value=0.0078; Accession=PF00098.13; Description=Zinc knuckle
MALSKKYEIMRALQETNYITLPNDKIQFIEENNENPTIALVSPVLDSTNYHSWNKSMIIALSAKNKVEFVDGSAPEPLKTDRTGRNLAQFEVQILARRSLANFRSPVGSIIDEGCTLTFSIIAQKKLEDQAMQFLHGLNEHYANVRSHVLLMDPMPAILKIFSYVAQQERQLLGNTSLNLNLKSKDISINVVKVVCDFCGRVGHMGNVCYKKHGMPSNYD

SEQ ID NO: 226427 - protein, 163 aa, Glycine max
  Coding DNA Sequence Number=SeqID_109649
MRTSKPFTDNGHPLIVDDMFDRVELRLRWFGSKSVVKSPRCSIRRQSTFADAEEDLSMIFALASTWAMFHAFGSLACVGPISYTIGMAYQNAFDSGLSLGSQTSGLGFLALVNSLIFVGLCFVIGYPVASAFSPSSSYALIFKCVLQTISQMPPYFSSIGKSL

SEQ ID NO: 226428 - protein, 128 aa, Glycine max
  Coding DNA Sequence Number=SeqID_109650
  Homolog annotation: Hit_ID=Q1SSC0; Match level="QueryCoverage=27%, HitCoverage=14%, E-value=6e-13, Identity=83%"; Hit description =Thaumatin, pathogenesis-related
MGCSVNHIDTRTQRERKKKRNNRAIPKKVLDEGNRKVVLNRRKEKEGERLRFGSKKEEVSSAFEVESKSDSEGTRAYPIRRTYPCWWTSACAVAEEGPTAVTGGTAPVLADVEGAAVAAPETPGSEGG

SEQ ID NO: 226429 - protein, 208 aa, Glycine max
  Coding DNA Sequence Number=SeqID_109651
  Gene Ontology: Mol. function=protein transporter activity; Cellular component=nuclear pore; Biological process=protein import into nucleus, docking
MPLPPHKTAIGCRWVYKIKHRADGSIERYKARLVVKGYTQTEGLDYLDTFSPVAKLTTLDVNNAFLHGELNEEVYMHVPSGLPVTSPNQLQPPWIIPLGYSLPRAPHYPMYLHSSIVTWSDVLFTSPMRALTFPSLSSNLVSTCPLRQPLIIRQVFACYVILKDHQAWVSSSLLMALLNFVLSVTQTGLGVVILDVPSPASPFTSVLH

SEQ ID NO: 226430 - protein, 71 aa, Glycine max
  Coding DNA Sequence Number=SeqID_109652
MNQLQQSNVRTMPRTRTVKSYRFRIRKERKLRRLKFKHWDSGFMTKKNWESLVIPVFLDGENHEMALAPRL

SEQ ID NO: 226431 - protein, 229 aa, Glycine max
  Coding DNA Sequence Number=SeqID_109653
  Subcellular localization annotation: CTP_CleavageSite=6; ConfidenceScore=5.41e-01
MANNSRSFALEEAFGHVSRFAGALLFWLSRASSSNLARSLRGSSPPLRFGSVQVKAVSTNVRVFGFPFGLKRKSSFASVRLGKISSLAMRMIWREAKRLRSFPVLSLAAALVPPFQNLSSNVLSSPLQNPDVQMFGAMDQVPKEVECQGCAFLPCLELNQAKPAVEPKTGIEFPLVLDNIFTGEKNYDFNSEIYCQSYHWSVVTNHLALGLHRPPNDTKQSQMQVMNQK

SEQ ID NO: 226432 - protein, 243 aa, Glycine max
  Coding DNA Sequence Number=SeqID_109654
  Gene Ontology: Mol. function=signal transducer activity; Cellular component=heterotrimeric G-protein complex; Biological process=G -protein coupled receptor protein signaling pathway
  Homolog annotation: Hit_ID=P93163; Match level="QueryCoverage=99%, HitCoverage=52%, E-value=1e-100, Identity=81%"; Hit description =Guanine nucleotide-binding protein alpha-2 subunit
  Pfam annotation: Domain name=G-alpha; Domain location=12-243; Score= -20.8; E_value=2.5e-16; Accession=PF00503.10; Description=G-protein alpha subunit
MGLLCSRNRRYNDADAEENAQTAEIERRIELETKAEKHIQKLLLLGAGESGKSTIFKQIKLLFQTGFDEAELKSYLPVIHANVYQTIKLLHDGSKEFAQNDVDSSKYVISNENKLVHDMISKSIWSSGLEFDPCYPHSSDKKLNFWHKEIGEKLLEIGGRLDYPYLSKELAQEIENLWKDPAIQVARWHTLETYARGSELQIPDCTDYFMENLQRLSDANYVPTKEDVLYARVRTTGVVEIQF

SEQ ID NO: 226433 - protein, 176 aa, Glycine max
  Coding DNA Sequence Number=SeqID_109655
MYETDDGITFEGPKKAIQIKCGKRKVPGCPPLVDAPDRLPLVVAPGRPTLLVTPSRPPLVVMPGRPPLPPPPSVPSSPVNLSRHATCRLLMERAPHRLGYNLVRVKEAQGHAGGIWALCMKGAAFSFTMIESMPQCITLQLMKERQVWCCFGVYASPRVATRRLLWKYLEEVTGRV

SEQ ID NO: 226434 - protein, 107 aa, Glycine max
  Coding DNA Sequence Number=SeqID_109656
MLGTALQFGGVRGDDRLYIPVKARKNQNQRKPVQREKSGGETESTDSVSKRELAASENGNPNESSYSLNKPSSCPSVEPASNIDRFLESTTLSVTAQYLAKGTTCSI

SEQ ID NO: 226435 - protein, 582 aa, Glycine max
  Coding DNA Sequence Number=SeqID_109657
  Homolog annotation: Hit_ID=Q1RV80; Match level="QueryCoverage=95%, HitCoverage=79%, E-value=1e-101, Identity=72%"; Hit description=SAM (And some other nucleotide) binding motif
  Pfam annotation: Domain name=MTS; Domain location=372-530; Score= -80.4; E_value=0.009; Accession=PF05175.4; Description=Methyltransfera se small domain
MEISPMFYSLAFPHKSVSVNISGKSHEDFKESHVSAFVSDLTADDLCNEILPSSVDIVTMIFMLSTVSPEKMPLVLQNIRKVIKERFSGKDQKISDNFYVRGDGTRAYYFSNEFLKNLFKENGFDVDKLHVYCKQVENRSRELIMNRRWVQAVFRVSDSSNSSSCIEAEANHLDNDNANMEIKQNSLNGGLNDSAVDLSEGVAVDMFGVLPSNEYEVSLSMSSATTSDLKLGPTRPVRHSEADGNNNADKPDGDSAQSDSEGPSNGWMMRVSNNVDNQVVLAEDTMYYPTAEEVHSKDEPLEHPSLSWSLPHSICVLSVPPWPHVKPLQVEAQGLLESTRQGRKIIEINLRSWNFKISLLSKEYQHTCKSTGLMLWESARLMASVLAENPNIVAGKRVLELGCGSGGICSMIAVRDADLVVATDGDGFALDLLTKNVASNIEPSLLTKLTTKKLEWGNKEHIECIKEVVSNRGFDVIIGTDVTYIPDAILPLFATAKELIAPRGSKEDDNVPRLILCHIFRRVDEPTLLSAAVHFGFRLVDKWPAGTSSNLSQSIIDNWFVDNDLKDDLPSTALNILLFCKE

SEQ ID NO: 226436 - protein, 103 aa, Glycine max
  Coding DNA Sequence Number=SeqID_109658
  Gene Ontology: Mol. function=hydrolase activity, hydrolyzing O -glycosyl compounds; Biological process=carbohydrate metabolic process
  Homolog annotation: Hit_ID=Q1M320; Match level="QueryCoverage=98%, HitCoverage=22%, E-value=2e-40, Identity=61%"; Hit description =Putative beta-glycosidase
MGLKLVENVEYSESGRGVYPDGLYRRLLQYHERYKHLNIPFIITKNGWADGYDSKFGVVDVDWANKLARIPRPSYHVFSKIVNTGKVTHEDGERAWDELQRAA

SEQ ID NO: 226437 - protein, 88 aa, Glycine max
  Coding DNA Sequence Number=SeqID_109659
MARHGSGIRPRGNRIEPVPTLTDKNRVDRVRGRIRVFPDNPKWGRGQLLSPHSTYLSLSLTSSLVAVAPQSSLYHSCTSISSPISIPP

SEQ ID NO: 226438 - protein, 89 aa, Glycine max
  Coding DNA Sequence Number=SeqID_109660
MNQAKTGRHITPRMNHIRMRGIQRLYSYEMDDILRRFPKKHVSEDKTHRKVSCWFVGIVDDLENIRAVTELVVEVSKPTKRILTNKDVE

SEQ ID NO: 226439 - protein, 181 aa, Glycine max
  Coding DNA Sequence Number=SeqID_109661
  Gene Ontology: Mol. function=metal ion binding; Cellular component =intracellular; Biological process=protein amino acid phosphorylation
  Homolog annotation: Hit_ID=Q2QXH1; Match level="QueryCoverage=92%, HitCoverage=53%, E-value=2e-22, Identity=30%"; Hit description=SEC14 cytosolic factor, putative
  Pfam annotation: Domain name=PPR; Domain location=21-55; Score=0.4; E_ value=6.6; Accession=PF01535.11; Description=PPR repeat
  Pfam annotation: Domain name=PPR; Domain location=87-121; Score=25.9; E_value=0.00014; Accession=PF01535.11; Description=PPR repeat
  Pfam module annotation: Pfam domain module=PPR::PPR; Domain location =21-55::87-121
MERHINLKNIFGFGHKLSDTKIVAYLIQTFARTKELNKGKQLHARLIRGGFLPCTFLSNNFLNLYSKCGELDYTIKLFDRVSKRNMISWTAMINGFVHNLRFQKALSSFFQMRVEGEIATQFALASVLQARASLGAIQFGTQKCVEVSDACKVFEEMPCKDAVLWTSVIDGFVKNGGFKKL

SEQ ID NO: 226440 - protein, 103 aa, Glycine max
  Coding DNA Sequence Number=SeqID_109662
  Homolog annotation: Hit_ID=Q6Z3X5; Match level="QueryCoverage=77%, HitCoverage=7%, E-value=7e-24, Identity=71%"; Hit description =Putative 2-oxoglutarate dehydrogenase, E1 subunit
MVAISLKVMFLVFSYSVAFVLAGWNNFVLSLMTLTNESLNDRYPNAEVVWCQEEPMNMGGSYVLPRLISSMKAVNRKGYDDVKYIGGAPFAATTTGFLKIHQK

SEQ ID NO: 226441 - protein, 40 aa, Glycine max
  Coding DNA Sequence Number=SeqID_109663
MWCYEWKKSEALRVGRTYEKAWAVLERKTNDQSEQRVISK

SEQ ID NO: 226442 - protein, 122 aa, Glycine max
  Coding DNA Sequence Number=SeqID_109664
  Homolog annotation: Hit_ID=Q1T2T2; Match level="QueryCoverage=63%, HitCoverage=19%, E-value=3e-08, Identity=32%"; Hit description =Ribonuclease H
AQWIKQVSWHLPRVGIVKCNMDESAKGSLGHAAAGVVIIALEVAKCRGWNNLWIECESSLIIQAFGNPLLVPWRLHDKLAKLDTSTHDSTLGGTLSLAFLGQKFLRNIIYLPSYRRIWVFGV

SEQ ID NO: 226443 - protein, 123 aa, Glycine max
  Coding DNA Sequence Number=SeqID_109665
  Gene Ontology: Mol. function=mitochondrial processing peptidase activity; Cellular component=mitochondrial respiratory chain; Biological process=electron transport
  Homolog annotation: Hit_ID=O04308; Match level="QueryCoverage=80%, HitCoverage=19%, E-value=7e-43, Identity=83%"; Hit description =Probable mitochondrial-processing peptidase alpha subunit 2, mitochondrial precursor
  Pfam annotation: Domain name=Peptidase_M16; Domain location=21-123; Score=79.4; E_value=1.1e-20; Accession=PF00675.10; Description =Insulinase (Peptidase family M16)
MAMLLCMCMLVIFWCLDMFNDNVTNPAASIGLYLDCGSIYETPFSSGASHLLERMAFKSTTNRSHFRIVREVEAIGGNVGASASREQMGYTFDALKTYVPQMVELLVDCVRHPAFLDWEVNEE

SEQ ID NO: 226444 - protein, 118 aa, Glycine max
  Coding DNA Sequence Number=SeqID_109666
MTKARPKGFDFGNLPVEDRRTTKNDEEQMKNDEERLKIFAKSPTETSRKRLGKEKLATQLAQASSACPGELGCFLQKAPPSGELPGWPKNFLTMGAKYLEVVKQGSHPNNGWSPDEIR

SEQ ID NO: 226445 - protein, 297 aa, Glycine max
  Coding DNA Sequence Number=SeqID_109667
  Homolog annotation: Hit_ID=Q47522; Match level="QueryCoverage=15%, HitCoverage=58%, E-value=7e-21, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFTVLMIAQMYLLSIPAIRVKLGLSKVVPAAVMAPPGMLVVSPIGLTHAAKAIQEARRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 226446 - protein, 741 aa, Glycine max
  Coding DNA Sequence Number=SeqID_109668
  Homolog annotation: Hit_ID=Q9X4C7; Match level="QueryCoverage=48%, HitCoverage=94%, E-value=4e-52, Identity=35%"; Hit description =Repeat unit exporter Wzx
ATGTDVESGLQEVDRLTLFIRSEEVFQHALQHLLVGAQGLQLAQGGLGNAQLLTNLPDFHSQDRLGIRRHICDLLRGKILWPNGVWSNGVFDLAVLHGANRGDFWYRNHPVQAHQQKCAERPAADDRGADHAPGATVADINPGVDLGLDTFSVYNNARLASRLNTIANSAGLLLGFAMSFTIAWLHLNPLWLTASIVAVTLVPYAIKRVNFYREHQDLAPPQDKRTTYLRYLMYAGLPLAISSIFISVQVKAAQMFLAGIASARDLGLFAAANTISASWIFIPVAIITSCFSEIFRERGAAAIKLTARLNGYVMGVSLLLLAVIALYGEKIIIALYGHEYTQSGSLITLLSLATCFSAMGTVAYRYMPAAVVVADPGLRHHGCRLERLHHGVTVPDRNELLLQKRRHPKNSGFLTQLQNLQMRSDMIRLKDELRRSVQYFIKKMPWAYQDRIYYFHKFRKLPNLRQPKVFNEKVLYRKFVYGDYQCYGRLSDKFSVREYIAEKVGSEYLIPLVYETSDPHSLHTLPSWKNTVIKPNHGSNMVEILLEEPDALKKQQIISDCQRWLKTDFANEAREIHYRYIKPRILVEKYIGDGKTAPIDYKFHMFNKRDGNFEYVLQVIYNRCNPLLSMNFYVNNLNEAYHKIRDTGLDVSPLLPQLQHALALSKTLASDFDYVRVDWYIDGEQIYFGELTFTPGAGLVTGLDRGLNQMMGDMWIQDRRDTQRSDVTVPEVPLPAVLKKI

SEQ ID NO: 226447 - protein, 517 aa, Glycine max
  Coding DNA Sequence Number=SeqID_109669
  Homolog annotation: Hit_ID=P0ACS2; Match level="QueryCoverage=27%, HitCoverage=90%, E-value=1e-52, Identity=72%"; Hit description=Redox- sensitive transcriptional activator soxR
  Pfam annotation: Domain name=HTH_AraC; Domain location=291-335; Score= 38.0; E_value=3.2e-08; Accession=PF00165.13; Description=Bacterial regulatory helix-turn-helix proteins, araC family
  Pfam annotation: Domain name=HTH_AraC; Domain location=341-385; Score= 56.1; E_value=1.2e-13; Accession=PF00165.13; Description=Bacterial regulatory helix-turn-helix proteins, araC family
  Pfam module annotation: Pfam domain module=HTH_AraC::HTH_AraC; Domain location=291-335::341-385
  Subcellular localization annotation: CTP_CleavageSite=61; ConfidenceScore=5.37e-01
VNRQKSAAGSDAAQSRARGAPAACSATLSECLYSAPRRPGAAAMAPAFCPVAQTPASSPVAASANLQHSAASNAPEFAPLPHAAPADARCPFDLIRHRQLFQQPQHPMRTGVFQMVNGNHARFLAAKGWHLDRSGALLPQAVTRIAQWTVAHRQAAATNAAVKIVAQTRQGFDAFIQLFAPVLRQRVPLLRRHALIRRHVHQAVADRRQRNPDALGNFDDCHTAQHITAVAALITAIARAADQAFAFIKVQCRYRHAAAFRHFARRQHRFRAITLQKEQAMMQQEIIHSLTNWIDQNLDKTLSIDEVAAKSGYSKWHLQRMFRTVTKQTLGGYIRERRLTLAAEALRQTQRPVFDIAMQYGYDSQQTFSRVFRRQFSQTPTAYRHSMRRQAMVQRPRLVNFDCSEGMNSFAQRTTGECCPIQAVLRRQKGFPDLPFLPPVIALMMFFASTMKIKLRQNSHHVMALMCGGVGVAMSCWFVTGLLGITLSMENVHNFMSITKEAFIQVMSQTPADWPMP

SEQ ID NO: 226448 - protein, 445 aa, Glycine max
  Coding DNA Sequence Number=SeqID_109670
  Homolog annotation: Hit_ID=UPI00005FA609; Match level="QueryCoverage =34%, HitCoverage=93%, E-value=2e-47, Identity=60%"; Hit description =COG1335: Amidases related to nicotinamidase
  Pfam annotation: Domain name=Isochorismatase; Domain location=1-145; Score=-17.0; E_value=5.3e-05; Accession=PF00857.11; Description =Isochorismatase family
  Pfam annotation: Domain name=RES; Domain location=306-431; Score =92.7; E_value=1.1e-24; Accession=PF08808.1; Description=RES domain
  Pfam module annotation: Pfam domain module=Isochorismatase::RES; Domain location=1-145::306-431
MVVDMQNGVLATPRYDRAGRCARINQLMAAADQVIFIQHSGPDLAADSADWQIVAELERPADALYITKTACDSFWQTGLAAQLEQHQIESFVICGCATDYCVDTTIKVGASLGYHITVAADAHTTADRTYVSAQQLINQHNEVWADLIMPGNPVRMRAYIPQHGANDNALWRVAGLPPRGIELTRMLEAGLPVAVIDDIRHWSAMTRAEIMKVTGINERNIARRKSTGKSLSPDESERVARFVRVMDAAVQLFAGNKEEATQWLSRPVKGLGNVAPITLLTTESGALDVLDLIGRLEHGSQYAAEAWSGYGAKQYGGRWNHKGYPTIYVATSVSLAALEVLVHIGRESVLDEYTLFSIDIPDAEVAYLAEAFLPPDWRHDPAPLSTMDLGTGWLQSAEGAALMLPSTIIPMENKAILNPLHHSFKSALTRVKELPFVFDQRLIKG

SEQ ID NO: 226449 - protein, 296 aa, Glycine max
  Coding DNA Sequence Number=SeqID_109671
  Gene Ontology: Mol. function=nucleic acid binding; Cellular component= intracellular
  Homolog annotation: Hit_ID=Q1SE31; Match level="QueryCoverage=91%, HitCoverage=17%, E-value=7e-67, Identity=54%"; Hit description =Transcription factor jumonji, jmjC; Transcription factor jumonji, JmjN; Zinc finger, C2H2-type
MESMCTNYQKIKAHARAVAEEIHSAFDYNEVPLDTASPENLTLIDLAIDGEEHDECEDWTSKLGINLRNCVHARNNSPSKQVPWILGTLLYDKCLASKSLALNWQSRRSRSKRSSCLAQTKPCDSIERKKEDRFYGRIDDSPAEKKLLQYSRRKFKSKQRCFPVASMVSEFQEKSKNLSATLNGDHNNCFSKTDLEAKNFRSDYALSCVSASTKMSPIHPEIQIAEMPASTRLNDAKPQPSNSIPDHTLMTEEVGAEIEKQTIQESDVDRNNDLTLGHSKMHCNTSVSEICGKESQ

SEQ ID NO: 226450 - protein, 473 aa, Glycine max
  Coding DNA Sequence Number=SeqID_109672
  Gene Ontology: Mol. function=nucleic acid binding; Cellular component= intracellular
  Homolog annotation: Hit_ID=Q1SE31; Match level="QueryCoverage=97%, HitCoverage=29%, E-value=1e-147, Identity=58%"; Hit description =Transcription factor jumonji, jmjC; Transcription factor jumonji, JmjN; Zinc finger, C2H2-type
  Pfam annotation: Domain name=zf-C2H2; Domain location=358-383; Score =20.4; E_value=0.0064; Accession=PF00096.16; Description=Zinc finger, C2H2 type
  Pfam annotation: Domain name=zf-C2H2; Domain location=384-405; Score =6.4; E_value=2.1; Accession=PF00096.16; Description=Zinc finger, C2H2 type
  Pfam annotation: Domain name=zf-C2H2; Domain location=411-435; Score =19.9; E_value=0.0092; Accession=PF00096.16; Description=Zinc finger, C2H2 type
  Pfam annotation: Domain name=zf-C2H2; Domain location=441-467; Score =21.6; E_value=0.0027; Accession=PF00096.16; Description=Zinc finger, C2H2 type
  Pfam module annotation: Pfam domain module=zf-C2H2::zf-C2H2::zf -C2H2::zf-C2H2; Domain location=358-383::384-405::411-435::441-467
ASRISVYLQSNNEEAALSPASLVNQSTLASVVGSFGSPNNNYTAEKISSPIFLEKTTEEEIDSLSERDKEPLIDDRPISEHTLKEVCEVQRELYASADLHNTIVLDYEMQHETQGGKDSRKEINQSTLVSTITRGEYAEGLNDEVIPKSVEQCQIENMNKINVEPVSSYVAKGENKCVTSSELGCSEVLVETYPKDSCIQLISDKEKETEIQSVSIIDEEFCSGTDTSIDDSSSIQECSKIEKESCVTENINGIKANLSKDNRELESCELTTAVPRSNARKNKKRKVKNTTKNQSNIDNFIRSPCEGLRPRAGKIATDKSGVEINQVDKENQVAKRARRSSEGLVPHKNKKDDVKKPHKCDLDGCQMSFKTKAELLLHKRNLCPHEGCGKKFSSHKYALLHQRVHDDERPLKCPWKGCSMSFKWAWARTEHIRVHTGEKPYHCKVEGCGLSFRFVSDFSRHRRKTGHHVKPPA

SEQ ID NO: 226451 - protein, 143 aa, Glycine max
  Coding DNA Sequence Number=SeqID_109673
  Gene Ontology: Mol. function=chitin binding; Cellular component =extracellular region; Biological process=chitin metabolic process
  Homolog annotation: Hit_ID=Q86AI8; Match level="QueryCoverage=90%, HitCoverage=28%, E-value=1e-10, Identity=37%"; Hit description =Similar to Homo sapiens (Human). Mucin 2
MSKSCGFGMTGPLDESISCFLIRVDPWVLVPITLRGLHVLALRGLHVLTIRGLHALTSKGLHVLALRGLPALALGTSYPHLQRATRPRHQRTACPHLQRATRPRHQRTACPHLQRTARPHLERTTRPRHQRAAHPHLQRTTHP

SEQ ID NO: 226452 - protein, 511 aa, Glycine max
  Coding DNA Sequence Number=SeqID_109674
  Gene Ontology: Mol. function=exonuclease activity; Biological process= response to DNA damage stimulus
  Homolog annotation: Hit_ID=Q8D081; Match level="QueryCoverage=91%, HitCoverage=93%, E-value=0.0, Identity=82%"; Hit description =Exonuclease I
  Pfam annotation: Domain name=Exonuc_X-T; Domain location=45-228; Score=105.1; E_value=2.1e-28; Accession=PF00929.14; Description =Exonuclease
  Pfam annotation: Domain name=Exonuc_X-T_C; Domain location=246-509; Score=593.1; E_value=2.6e-175; Accession=PF08411.1; Description =Exonuclease C-terminal
  Pfam module annotation: Pfam domain module=Exonuc_X-T::Exonuc_X-T_C; Domain location=45-228::246-509
MSATASPRPRRKRNDRSPTTAPLLSSTAGLLSPDAILSSKATATFYIHDYETFGKSPSLDRPAQFAGVRTDMDFNIIEEPLVIYCAPADDYLPEPEAVMITGITPQVARAKGVNEAEFTRQIHQAFSVAGTCILGYNNIRFDDEVSRNIFYRNFYDPYAYSWQNGNSRWDLLDVMRACYALRPDGIVWPENEDGFPSFRLEHLTRANGVEHTQAHDAMSDVYATIAMAKLVKQAQPRLFDFLLQHRNKHKLNALIDVAEMTPLVHVSGMFGAARGNTSWVSPLAWHPDNKNAVIMCDLAGDMTPLLTLSAEQLRERLYTRRDDLAPDQAPVPIKLVHINKCPVLAPAKTLLPENAERLGIDRQACLQNLQLLKQHPEVREKVVALFAEAELFKGSDDVDARLYDGFFSDADKAAMRIIQQTKPQNLPALDLAFSDGRMKELLFRFRARNYPNTLDDAEQRRWLQHRQEALSAERVQSYLLQLESLYNLHESDKEKTALLKALFDYGKELVG

SEQ ID NO: 226453 - protein, 184 aa, Glycine max
  Coding DNA Sequence Number=SeqID_109675
  Gene Ontology: Mol. function=transporter activity; Cellular component= outer membrane-bounded periplasmic space; Biological process=transport
  Homolog annotation: Hit_ID=Q392A8; Match level="QueryCoverage=79%, HitCoverage=56%, E-value=8e-42, Identity=58%"; Hit description=ABC amino acid transporter, periplasmic ligand binding protein
  Pfam annotation: Domain name=SBP_bac_3; Domain location=1-143; Score =11.4; E_value=8.1e-09; Accession=PF00497.10; Description=Bacterial extracellular solute-binding proteins, family 3
  Subcellular localization annotation: CTP_CleavageSite=36; ConfidenceScore=5.20e-01
APARLVAHKGSSLQPTAASLKGKSVGVQQGSSQEAYANALWRPAGVNVVAYQSQQEVNEDLANGRLDASLLASVSASEFFKTPGGKDFAFIGAELNDSKYFGVGDGIGVRKEDTALLNAFNTALQAIRANGTYKKINDKYFDFDMYGWGGAFGRRGTPQRKRQRRQERKIRRDKDAGQAGRPAR

SEQ ID NO: 226454 - protein, 239 aa, Glycine max
  Coding DNA Sequence Number=SeqID_109676
  Homolog annotation: Hit_ID=P0A8M6; Match level="QueryCoverage=41%, HitCoverage=91%, E-value=8e-43, Identity=87%"; Hit description =UPF0265 protein yeeX
  Pfam annotation: Domain name=DUF496; Domain location=143-237; Score =229.6; E_value=6.9e-66; Accession=PF04363.3; Description=Protein of unknown function (DUF496)
ALHGFLKCMDHLSAKVLIDPVNHSRNLHPAADAEFAGIAGGADARRAAGTAAGGGGAAGGDRRRAENADAGGQPRPARRSADLRLCLAQYGAGAATGRAGGSAPGLHRRRARIRGQIMKAALWVLAAGAKWGIKMDNANKPSFQDVLEFVRMFRRKNKLQREIVDNEKKIRDNQKRVLLLDNLSEYIKPGMSIEDIQGIIANMRSDYEDRVDDYIIKNADLSKERRELSKKLKAMGEVK

SEQ ID NO: 226455 - protein, 105 aa, Glycine max
  Coding DNA Sequence Number=SeqID_109677
  Gene Ontology: Mol. function=RNA-directed DNA polymerase activity; Biological process=RNA-dependent DNA replication
MKLKQLFACHHISEERKVPLATISFQGIHGDHTIEYWNDLKSALRKRHIPSYYERELMYKLQRLRQGSMSVEEYRQQMELLLLRARIREEERTSIARFLSGLNME

SEQ ID NO: 226456 - protein, 78 aa, Glycine max
  Coding DNA Sequence Number=SeqID_109678
MGFRIGSKIPLAIYTLGVVAKYLDIAKIRLPITRAFIEKYCTQRQAQGDAPQAAGAPPPPHQAGPTGSFDMEQYLHHL

SEQ ID NO: 226457 - protein, 56 aa, Glycine max
  Coding DNA Sequence Number=SeqID_109679
MGKFDIFVPHPLVITSLLPLEYGCKPLVCLLKRPALLSLDFQDRSIRNYPCYTFGE

SEQ ID NO: 226458 - protein, 67 aa, Glycine max
  Coding DNA Sequence Number=SeqID_109680
MVRIEYRTLGELVLFCKLFQQISVWISQSLTNSSQALKSAPASSSGLCRSSHSKISQNSLELGPFSL

SEQ ID NO: 226459 - protein, 140 aa, Glycine max
  Coding DNA Sequence Number=SeqID_109681
MKDKRDEGKKLEKQKKKKNSKTLSSKAKGKEKEKNDFSKKIVKKENHVATKGYIKIALLFKQSFYLLLSRETFLSTVIPLELEVIPQVYELLDEGLVCIMRHQIPMIGRMMNVLSGATLFCKIIHASNIFMIHIYRDSLG

SEQ ID NO: 226460 - protein, 807 aa, Glycine max
  Coding DNA Sequence Number=SeqID_109682
  Gene Ontology: Mol. function=microtubule motor activity; Cellular component=microtubule associated complex; Biological process =microtubule-based movement
  Homolog annotation: Hit_ID=Q9SS42; Match level="QueryCoverage=90%, HitCoverage=67%, E-value=1e-177, Identity=51%"; Hit description =Kinesin-like protein
  Pfam annotation: Domain name=Kinesin; Domain location=147-485; Score =493.8; E_value=2e-145; Accession=PF00225.13; Description=Kinesin motor domain
MVSDFSDGKLGGFLSLTWCICFNGQKLMDDAIFFCWTWLKNMEKGLFLFIHGLASNIIRDLKALKLKIKKEFEEMQSQFQGFFNDIAFASENSVDIDSLELCCFMNSGSQIQEMSTKALGYHKVVEENRKLYNMVQDLKGNIRVYCRIRPSFRAESKNVVDFIGEDGYLFILDPTKTLKDGRKVFQFNRVFGPTADQDEVYKDTQPLIRSVMDGYNVCIFAYGQTGSGKTYTMSGPSGGVTSKDMGINYLALHDLFQMSNERKDIISYDIYVQMVEIYNEQVRDLLAEDKTDNKYPFHRVKHFHTTHKRLGREKIRSCNDDGLSLPDARLHLVKSPTDVLTLMKLGEVNRAVSSTSMNNRSSRSHSVLTVHVNGKDTSGSSIRSCLHLVDLAGSERVDKSEVTGERLKEAQFINKSLSCLGDVITALAQKNSHIPYRNSKLTLLLQDSLGGHAKTLMFAHVSPEADSFGETVSTLKFAQRVSTVELGAARMNKESSEVMHLKEQVENLKIALATKEAQRVMLQRIKEPHTPLEKPTLVSEKTPLRPRRLSIENCSAVKTDKSVNHEDRSGAKSPLLLPRSRRLSLEGGSKTIKKDSLLPKVSDDTVSKALQYESVSRQKYHPMQDPESVSKLNGHFSSGNSRSELHTRTPRSPTSISYQTRLIKVKGGMQVHPLKLPQTPEPPVLDGNDAHGTKVMGSTNGKGSQIRKSLRTIGKLINGPDKRSQQNNMVEVKSPIKGTGHTNHVKSPISAAEKTKKRQSLTGTQPPLSNNSRRSSLGGKPVVAYDKDGNARTPPSHSDTKTAKRWL

SEQ ID NO: 226461 - protein, 335 aa, Glycine max
  Coding DNA Sequence Number=SeqID_109683
  Gene Ontology: Mol. function=microtubule motor activity; Cellular component=microtubule associated complex; Biological process =microtubule-based movement
  Homolog annotation: Hit_ID=Q9SS42; Match level="QueryCoverage=66%, HitCoverage=23%, E-value=2e-54, Identity=52%"; Hit description =Kinesin-like protein
  Pfam annotation: Domain name=CH; Domain location=23-148; Score=44.4; E_value=4e-10; Accession=PF00307.21; Description=Calponin homology (CH) domain
MEDGSRNRTHFNMTSRKAEEAAWRRYEATQWLESQVGPLGISNQPTERELISCLRNGLILCNAINKIHPGAVPKVVVVDNQVPSQSLTWDSQPLPAYQYFENVRNFLFAMEELKLPAFEAADLEKDNLEMGSAAKVVDCILALKSFQELKQMNNQNGYIKHIKSPLPMRMHTRAAAFSSDACRHLDLSSKLEKMPPAECNFPKREEIVELLAKQLVDRMFDAKENIDGNIIASLRKEHLVADPIKVFNQIMACCNGEQPPTKFNELPLLPKDSAKEKDNLPPHSTSTPMQSDALSAPDSSKHCQACPRKCKCNQVHLLDRQEKELLLRTGGGAVL

SEQ ID NO: 226462 - protein, 271 aa, Glycine max
  Coding DNA Sequence Number=SeqID_109684
  Homolog annotation: Hit_ID=Q1T5Q8; Match level="QueryCoverage=45%, HitCoverage=20%, E-value=2e-07, Identity=36%"; Hit description=RNA -directed DNA polymerase
MMRKEQVDMFCLQETKKEVIDKALCQALWGDAEETFKMDKVTGNDLEGTWAGDGEKLTIVNIYSPCDTAAKRILWDQVRKLKATSRGGRGSMKKFNDWIVELEVEDVPFGVGLKDKLCQKQIWGDWEVLSTDVRENYPNGNKDTSLLGIPKKVVERFMRLRVGSCGGKLRPAKDCLGELGDSLSPKRKRWIGHPGFGEIQLCSTWKMAVEPLPSPRRIGGWFKSGTKWKIGCGSKMKFWEDGMGMAVLVEETIYGGGDRNNYKIYGGHRKR

SEQ ID NO: 226463 - protein, 98 aa, Glycine max
  Coding DNA Sequence Number=SeqID_109685
MRVKTNDHTKQGITQVRIFVQETKTHTQVEEPEKNNSEWGLALGSEPQLRNRNATSFGSAKRLRSVGFAYRVNLSNGEDSLIGNTRNQVRFCAVYIWK

SEQ ID NO: 226464 - protein, 208 aa, Glycine max
  Coding DNA Sequence Number=SeqID_109686
  Gene Ontology: Mol. function=GTP binding; Cellular component =intracellular; Biological process=small GTPase mediated signal transduction
  Homolog annotation: Hit_ID=Q53KJ1; Match level="QueryCoverage=83%, HitCoverage=47%, E-value=5e-69, Identity=73%"; Hit description=Short integuments 2
  Pfam annotation: Domain name=MMR_HSR1; Domain location=137-204; Score= 1.3; E_value=0.00076; Accession=PF01926.13; Description=GTPase of unknown function
MSGLKELLKKGLGLGDMAFNAGGGAITWFPGHMAAATRAIRHRLKLADLVIEVRDARIPFSSANADLQPHLSAKRRVVALNKKDLANPNIMHKWTHYFESCNQNCVAINAHSMSSVKKLLEVVEFKLKEVICREPTLLVMVVGVPNVGKSALINSIHQIAKSRFPVQEKMKRAAVGPLPGVTQDIAGFKVWLTDVNVKYRIKLRYYVI

SEQ ID NO: 226465 - protein, 156 aa, Glycine max
  Coding DNA Sequence Number=SeqID_109687
LMTSFQPDAVPVSVLDAISETSTAFGASGNNPETGDSDRCGLYIEANPARLVAQGRVYERSTIVHKTPLLPGQVKVGNSHLPCLTDTSGQVFITTAKPPQKPDPEVDDPLYLMTLTIPVLFLRPYQVTWDATVFGVFNLDFPLYIKHEDLSEIAHS

SEQ ID NO: 226466 - protein, 111 aa, Glycine max
  Coding DNA Sequence Number=SeqID_109688
  Gene Ontology: Mol. function=GTP binding; Cellular component =intracellular
  Homolog annotation: Hit_ID=Q53KJ1; Match level="QueryCoverage=77%, HitCoverage=22%, E-value=9e-12, Identity=45%"; Hit description=Short integuments 2
MWGICICWVSNHDILCSTCPESVKDSVVGEERIAQYLLAVLDTRGTPLHWNHLNNRRIDGIEYEAEENPEYSLKNLKPKRRNLPNRSDLVYVENMVLLSFNYQCWKFLHLG

SEQ ID NO: 226467 - protein, 588 aa, Glycine max
  Coding DNA Sequence Number=SeqID_109689
  Gene Ontology: Mol. function=nucleoside-triphosphatase activity; Cellular component=integral to membrane; Biological process=transport
  Homolog annotation: Hit_ID=Q8RWI9; Match level="QueryCoverage=91%, HitCoverage=84%, E-value=1e-168, Identity=51%"; Hit description =White-brown complex homolog protein 15
  Pfam annotation: Domain name=ABC2_membrane; Domain location=292-504; Score=109.5; E_value=9.4e-30; Accession=PF01061.14; Description=ABC -2 type transporter
  Pfam annotation: Domain name=ABC_tran; Domain location=32-220; Score =113.5; E_value=6.1e-31; Accession=PF00005.17; Description=ABC transporter
  Pfam annotation: Domain name=MobB; Domain location=33-137; Score= -34.9; E_value=0.028; Accession=PF03205.4; Description=Molybdopterin guanine dinucleotide synthesis protein B
  Pfam module annotation: Pfam domain module=ABC2_membrane::ABC _tran::MobB; Domain location=292-504::32-220::33-137
MVILWEDITVQHRFLEDKKKLLSGITGFAEAGRIMAVMGPSGSGKTTLLDSLAGRLPVNVVVTGNILINGKRSLYSKEVSYVAQEELFLGTLTVKETLTYSANTRLPSKMSKEEINKVVEETIMEMGLEDCADTRIGNWHCRGISNGEKKRLSIGLEILTQPHVLLLDEPTTGLDSASAFYVIQSLCHIALNGKIVICSIHQPSSETFDLFDDLLLLSIGETVYFGEANMALKPSSSNSALGTKKAEIRETLIRSYKGSGIMINARRRIQQLKPNEEQKIKPNIGSSATWWKQLCTLTKRSFVNMTRDIGYYWLRMVFYILVGITVGTLYFHIGTANNSILDRGKCVSFIYGFNICLSCGGLPFFIEELKVFYGERSKGHYGEAAFVVSNIISSFPFLVLTSLSSGIIIYFMVQLHPGLTNFAFFCIDLFCCISVVECCMMIVASVVPNVLMGLGTGTGVIVFMMMPSLLFRPLQDIPKFFWRYPMSYLSFTTWAVQGQYKNDMLGLEFDPLLPGNPKLTGEQVLTLLFGVPLNHGKWWDLTALIILLIVHRLLLFLALRYSKRSSTSPMLWFHRCRGKSTICRKMSI

SEQ ID NO: 226468 - protein, 95 aa, Glycine max
  Coding DNA Sequence Number=SeqID_109690
  Gene Ontology: Mol. function=GTP binding; Cellular component =intracellular
  Homolog annotation: Hit_ID=Q53KJ1; Match level="QueryCoverage=78%, HitCoverage=20%, E-value=2e-16, Identity=60%"; Hit description=Short integuments 2
MGVQRALYSTLTEFDGNVEDESDLESLIDLQFSALQKALKIPHKASEARLMVSKKFLTLFRTGKLGPFILDDVPNVKPKEIELPEDAGDLQAFQF

SEQ ID NO: 226469 - protein, 279 aa, Glycine max
  Coding DNA Sequence Number=SeqID_109691
  Gene Ontology: Mol. function=nucleoside-triphosphatase activity; Cellular component=integral to membrane; Biological process=transport
  Homolog annotation: Hit_ID=Q75HT8; Match level="QueryCoverage=97%, HitCoverage=66%, E-value=7e-44, Identity=37%"; Hit description =Putative ATP-dependent transmembrane transporter
MTKNEIDKVVTKILAEMGLQDSTDSRLGNWHLRGISSGEKRRPRGEVFNLFDDLVLLSGGEAVYFGEATMTVKFFADAGFPCPTRISPPEHFLGCVSSEFNGVAALMQSKNEEPLVGKIYDTSRLKQLCTLTNRSILNMTRDIGYYCLRIVFYIFISVRAGFLLFNIGTSTEAILTRGKCDGFIVGLMIYICLGGVPFYHEELKVFMMVPSNIFRSLADLPKFFWRYPMSYISYITWSIQGQFKNDLIGLEFEPEVPGDTKIKGEEILNNMFGIRNGGT

SEQ ID NO: 226470 - protein, 196 aa, Glycine max
  Coding DNA Sequence Number=SeqID_109692
MIACATLRAEICEKCDGCRREEERDGGCSPLECKCNGGGPSSTFETFLDLRILPTNVGMTGNVLLKGTTRSTGCIDISLRSSQDQRNKNEYSKVQSQDLQQDFMWFSNVPTSMGKLQGLSPIFNWRASMKHGTPTRWCFPSLVLHGDEDGMGMPEDSQEMSWTYWVRLTKTGMTTSFCGDILGTIVAYMHITASQN

SEQ ID NO: 226471 - protein, 106 aa, Glycine max
  Coding DNA Sequence Number=SeqID_109693
MIGAHFFSTLAGTVDGCIVLRNKQGELSQQGKMKMTLPNSPYFQPLGVGKKQNKLKIILIWIILNKAEVSRAVRLIKESRRRSSLILAGEVKECHHFDTLHGLAAK

SEQ ID NO: 226472 - protein, 512 aa, Glycine max
  Coding DNA Sequence Number=SeqID_109694
  Gene Ontology: Mol. function=transcription factor activity; Cellular component=nucleus; Biological process=regulation of transcription, DNA-dependent
  Homolog annotation: Hit_ID=Q8GWK2; Match level="QueryCoverage=84%, HitCoverage=92%, E-value=1e-107, Identity=50%"; Hit description =Putative AP2 domain transcription factor
  Pfam annotation: Domain name=AP2; Domain location=59-164; Score=79.1; E_value=1.4e-20; Accession=PF00847.10; Description=AP2 domain
MASSSSDPGKSAETSEAAVVVANDQLLLYRGLKKAKKERGCTAKERISKMPPCAAGKRSSIYRGVTRWTGRYEAHLWDKSTWNQNQNKKGKQEVYPNRVLFFLIIVIIELAGAASFLKIMIFVVDGFWTGAYDDEEAAARAYDLAALKYWGPGTLINFPVTDYTRDLEEMQNVSREEYLASLRRKSSGFSRGLAKYRGLSSRWDPSYGRMSGSDYFNSMHYGAGDDSAAESEYVSGFCIERKIDLTSHIKWWGSNKSRHSDAGTRLSEEKKLGSAGDICIEIKQLEQKVQPTAPYQMPQLGRPQNEKKHRSSSVSALSILSQSAAYKSLQEKASKTLENIIDNDENENKNTINKLDHGKAVEKPSNHDGGNDRLDIATGMSGTMSLQRNVYPLTPFLSAPLLTAYNTVDPLVDPVLWTSLVPMLPAGLSHTAEVGYKDRDQFNVHDVSARGMNGWAFGFPIEEERLKGKHLKAELVSNKEQNIGSKALVHEEEAGINGVSGVLLWARKQSQI

SEQ ID NO: 226473 - protein, 41 aa, Glycine max
  Coding DNA Sequence Number=SeqID_109695
MSRLCSVFSIKEQGLGHVEKIIRYPTGLKQAERVKVTCNKR

SEQ ID NO: 226474 - protein, 222 aa, Glycine max
  Coding DNA Sequence Number=SeqID_109696
  Pfam annotation: Domain name=PPR; Domain location=174-208; Score =39.6; E_value=1.1e-08; Accession=PF01535.11; Description=PPR repeat
  Subcellular localization annotation: CTP_CleavageSite=49; ConfidenceScore=5.00e-01
MSESAVILNSLFQPRYSIPVLFNGASTASHYLQLAGTTESTRRWRISISCTKKSNKLAFQETKEGFVDYDRGQHEVSTKISGLRKDDIAARYRLRVSGNRFQMDCTVSEVVDLVLSLDVSDDDVDGLLKRWIGRFARKNFPFLIKELTQRGSIEHCNRVFRWMKNQKKYCARNDMYNMMIRLHARHNRTDQARGLFFEMQEWRCKPDVETYNALISAHGRAG

SEQ ID NO: 226475 - protein, 62 aa, Glycine max
  Coding DNA Sequence Number=SeqID_109697
MSKYGEALSFMEEMMHLKLPLSKEVYSSVICAYSKHAKAESAFNLMKSSCVDRLTSAPMCFK

SEQ ID NO: 226476 - protein, 205 aa, Glycine max
  Coding DNA Sequence Number=SeqID_109698
MSQLPKENLAKAYALFEEIEASGIKLDTIARAALMRSFNKGGQPGRVLSLAEITREKKFLSVIPYFLKWYLPVAFNVSNCYIPVKLNVSFAIRLQDWRTAVDMIKYSSKCWLASGADVNLNTYSILLKNLLSSGNWRKYLELNGFSNTCKKEQKTSNKKKVENSLAIFETLKSSREIFQDLLQASFDLKSITVYFFCYNHRGSFI

SEQ ID NO: 226477 - protein, 229 aa, Glycine max
  Coding DNA Sequence Number=SeqID_109699
  Subcellular localization annotation: CTP_CleavageSite=68; ConfidenceScore=5.31e-01
VWSVLSYSNLAPTSHTSNLIVDRARLIFGLVSRMDMNVGALISCQITSIAQSNFSRLGFPALITALCRARGVVSDSLTFEHLSPVINLAYIRRNYWNPNDLTGQIILLQSLQVVAPPGSIPFVEQFLERVAWPGAQPSLHMEDEGPTAQDRQVVAATPERSLEGTPEPPALVVDLSSPQYAADPSTPILEIPEDPTTPVLTLSTSLPATLVLHLTDEEDVQTQDTQDQS

SEQ ID NO: 226478 - protein, 118 aa, Glycine max
  Coding DNA Sequence Number=SeqID_109700
  Homolog annotation: Hit_ID=Q1RUD8; Match level="QueryCoverage=67%, HitCoverage=20%, E-value=2e-08, Identity=52%"; Hit description=IMP dehydrogenase/GMP reductase
MTPSTEDVKKAMQGLFAVLQLSMWGWFHTSFSKKVGPSIRYKKEGRIKILSSCEGCPNVPLMGTRGCINYNPVLAIRQLGYPMRGAPLDESITPFIARGFSDHNARVLQGVRKAWDAA

SEQ ID NO: 226479 - protein, 76 aa, Glycine max
  Coding DNA Sequence Number=SeqID_109701
MKKIQDLQAPHGATLDTATKSKALVEARREPTPSTEKEVDFHPWPLTIVTLCLQSNHAQDSENYYKEQRTSQQGIE

SEQ ID NO: 226480 - protein, 176 aa, Glycine max
  Coding DNA Sequence Number=SeqID_109702
MERHNFHKRFTNLADSSIDLTLVKEFYANLYSPEGPLPKQVIIWVHLIRIDADNLNAFLETLMVLAEGESLPAYSRYCRMPTDIREIEAALCIPDRGFILNAEGHPGKILRKDLTTLAQVWSVLSYSNLALTSHTSDLTVDQARLIFGLVTQLDMNVGVLISGQITSMAQSNSSRL

SEQ ID NO: 226481 - protein, 72 aa, Glycine max
  Coding DNA Sequence Number=SeqID_109703
MEKDNLGKFDAKSNEDSLEDTHIHGNDSKEKDEGSNEDSQDNGVRANNELPREWKASRDHPLDNIIGDISKG

SEQ ID NO: 226482 - protein, 79 aa, Glycine max
  Coding DNA Sequence Number=SeqID_109704
MCISGKERSTGFNRRKSLKVYQSHTGQGLTFSPWVKVYDKLGFWLKACRTAGHDIRQGLASGSGIKGMSYIISMIHMQQ

SEQ ID NO: 226483 - protein, 70 aa, Glycine max
  Coding DNA Sequence Number=SeqID_109705
MVRVFKTWHGMRVRVRVRGIEPLSYGEKGVVTSCWMPHFSQKSSNSLEPIPLKIIEATRSKKWYQSGILV

SEQ ID NO: 226484 - protein, 62 aa, Glycine max
  Coding DNA Sequence Number=SeqID_109706
  Subcellular localization annotation: CTP_CleavageSite=40; ConfidenceScore=5.35e-01
MTVSWAKRASTAKRSISAIEESSRASISRPPTKRVISVLSATTIFSQAQRTTGAKLKSTYSR

SEQ ID NO: 226485 - protein, 171 aa, Glycine max
  Coding DNA Sequence Number=SeqID_109707
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=86%, HitCoverage=13%, E-value=8e-72, Identity=78%"; Hit description=DNA -directed RNA polymerase beta'' chain
MDSVGIRSANPYLATPGATVHGHYGEILSEGDILVTFIYEKSRSGDITQGLPKVEQVLEVRSIDSISMNLEKRVDTWNGRITKILGIPWGFLIGAELTIAQSHGMSNVFLPGELIGLLRAERAGRSLEEAICYRVLLLGITKTSLNTQISYLKQVFKKLLEFYQKPLSGGA

SEQ ID NO: 226486 - protein, 251 aa, Glycine max
  Coding DNA Sequence Number=SeqID_109708
  Gene Ontology: Mol. function=carboxy-cis,cis-muconate cyclase activity
  Homolog annotation: Hit_ID=UPI00005F9628; Match level="QueryCoverage =96%, HitCoverage=61%, E-value=2e-80, Identity=61%"; Hit description =COG2706: 3-carboxymuconate cyclase
MHTRTLLVASLSMLATAAVAQKQYAWVGTYNPNGEGLYRFTVNPQTGALNDKTLVSKLPNAAQLTLSQDGKTLYLASEVEQGVVQALRVGDNGELRELNQVASGGAGPVYLSLTPNGQHLLVANYVSGSIAVLPINADGSLGEATDKHQDQGEPGVAKPEAAAEGSFAISDHNGPHAHMIAADPSGKYVFSTDLGLDRIYQYRFDDRTGKLTPNDPPFISASSKGAGPRHFVFTPKGDALWLSNEEASTLT

SEQ ID NO: 226487 - protein, 213 aa, Glycine max
  Coding DNA Sequence Number=SeqID_109709
  Gene Ontology: Mol. function=chromatin binding; Cellular component =chromatin; Biological process=chromatin assembly or disassembly
  Homolog annotation: Hit_ID=Q1SAV4; Match level="QueryCoverage=77%, HitCoverage=42%, E-value=2e-39, Identity=50%"; Hit description =Integrase, catalytic region
  Pfam annotation: Domain name=Chromo; Domain location=117-167; Score =29.8; E_value=9.9e-06; Accession=PF00385.14; Description='chromo' (CHRromatin Organisation MOdifier
MHETLQHRLRKVQELMKLMVEKHRWDLSFTVGDWVYVHLRPYRQTSLAPSYSKLGKRFYGPFEVIEHIGPVAYKLLLPESSRIHLVFHISLLKLHRGPLPVTPATLPAASTDNHPLPTPLHVLDWKLDHSVSPPVTQVLVQWEGLAPEESTWEHWDELRRIHNLEDKVAFGDGCVHSNARLDDDQKMGNRALASSSNRPRRVIRKPTYLQEYV

SEQ ID NO: 226488 - protein, 69 aa, Glycine max
  Coding DNA Sequence Number=SeqID_109710
  Gene Ontology: Mol. function=chromatin binding; Cellular component =chromatin; Biological process=chromatin assembly or disassembly
  Homolog annotation: Hit_ID=Q1SAV4; Match level="QueryCoverage=95%, HitCoverage=17%, E-value=9e-22, Identity=71%"; Hit description =Integrase, catalytic region
MKPMGGVLMNIRTKVLLQGSIKYLRLTVGLWMVSGAHSELGVGQFEQLALKIANKNRVTIRNKATRKAM

SEQ ID NO: 226489 - protein, 135 aa, Glycine max
  Coding DNA Sequence Number=SeqID_109711
WVASGGSNPARLGELRSPGRAGRQPPPPFSYKKAEGGCSKDPSAPWLCISAVLGEKNCFREENPSRGASVTLPRCFRKQIREGFRPFFIVLHPFFVLQREQKPRFCRPPQEIVNGPNALTFLSFQKQEIVNGPTH

SEQ ID NO: 226490 - protein, 63 aa, Glycine max
  Coding DNA Sequence Number=SeqID_109712
WCLVSDVQQAGSVADLGVAFVDDWVFLANRMMGSEKGWLPIHQSRIIKFASSQTHFDPFAGEN

SEQ ID NO: 226491 - protein, 208 aa, Glycine max
  Coding DNA Sequence Number=SeqID_109713
  Gene Ontology: Mol. function=nucleic acid binding; Biological process= DNA integration
  Homolog annotation: Hit_ID=Q1SFD6; Match level="QueryCoverage=63%, HitCoverage=8%, E-value=3e-30, Identity=47%"; Hit description =Integrase, catalytic region
MASSNPSALEDLLNPHSPYYVHSSENPSISLVSPLLDPTNYNSWCRSMSTTLSAKNKLEFIDGSLSQLAPNHALHTTWKRSNNMVVSWLIHSVSPSIKQGILWLDNAVDIWRDLKSRYSQGDLLRISELQQEVASVKQAIEGRMDMLLKIVGKRMAIQVIFHRIEEEEIELFMVMVEAQMLIEAAKCAITVVSLATLRHNASRNMDIH

SEQ ID NO: 226492 - protein, 229 aa, Glycine max
  Coding DNA Sequence Number=SeqID_109714
  Gene Ontology: Mol. function=DNA binding; Cellular component=beta -galactosidase complex; Biological process=DNA integration
  Homolog annotation: Hit_ID=Q1SDN3; Match level="QueryCoverage=92%, HitCoverage=16%, E-value=2e-73, Identity=60%"; Hit description =Polynucleotidyl transferase, Ribonuclease H fold
MALLNGIRLAWLLRLIYLTNTRPNITFVVHHLSQFIASPTTAHYTALYHILRYIKVAPGLGIFFPSTNELQLKAFSDSNWARCIDTRKSITGFSVYLGSSLISWKSKKQATVSRSSSEAKYRALAIVTCEIQWLTYLLHDFGIIHKPALVFCDNKSTLHIAANPVFHERTKHIEIDCHLVRDKLLSGLIKLLPIASAQQLVGDYTKALAPGAFHFICSKLGMNDIHSPT

SEQ ID NO: 226493 - protein, 227 aa, Glycine max
  Coding DNA Sequence Number=SeqID_109715
  Gene Ontology: Mol. function=oxysterol binding; Cellular component =cytosol; Biological process=steroid metabolic process
  Homolog annotation: Hit_ID=Q2HUM5; Match level="QueryCoverage=98%, HitCoverage=58%, E-value=1e-94, Identity=71%"; Hit description =Oxysterol-binding protein
MTWCHSPISKFNGTLVETKVHGKRQLKLQNHGETYEMSSPNLVIRILPIPGTDWVGNVSIRCQETGLVAELNYIGQSFFGFRAGRRLIKGKIFDSLSMKILYKIEGHWDSTVTVRNTTNTEARVIYDAKEVLSGLQAPIVQDPESVWPTETALVWGELSQAILSKDWEKAREAKKTVEERQRELFKERESKGGNWVPKHFLVSYSKEGGWECSPIQKSVPKAPIATL

SEQ ID NO: 226494 - protein, 280 aa, Glycine max
  Coding DNA Sequence Number=SeqID_109716
  Gene Ontology: Mol. function=nucleoside-triphosphatase activity; Cellular component=nucleus; Biological process=protein transport
  Homolog annotation: Hit_ID=Q9SS94; Match level="QueryCoverage=83%, HitCoverage=45%, E-value=8e-24, Identity=29%"; Hit description=Cell division control protein 48 homolog C
  Pfam annotation: Domain name=AAA; Domain location=57-176; Score= -12.4; E_value=0.0018; Accession=PF00004.19; Description=ATPase family associated with various cellular activities (AAA)
  Subcellular localization annotation: CTP_CleavageSite=45; ConfidenceScore=5.12e-01
MASSMNAQAQLGLIAGFSRNGRRPVLRRRRVEEALLVQLRKGSVCGGVEVKGKDVTIFRDLGGMKNVKEELNMLLLPIYHPHLGESQENIRDLFSKAYRTAPSIIFIDEVDAIALKRENLSQMELLIGPMPLTPPLEDLEYLIGPTDLPKIAKSTKAFTGSDLKSLIEHAGKLAMRRITYPEDCFREPFLPEEVDKAAIKMSDLEDRFIQKVEEEFLNNTNVELGVIPSRMWLGDECAELEGLGMDLTTRFLLYGPPGCGKTLIAKAVANAAVASFCHIK

SEQ ID NO: 226495 - protein, 87 aa, Glycine max
  Coding DNA Sequence Number=SeqID_109717
MMASRKRKAPSTPTQVRFDRSRFTSQEAWERYTDIIVPRKLLPERNMVVYYTEFDEFNEELERCHWDEELTDFGDGNIDVAIVKEDC

SEQ ID NO: 226496 - protein, 46 aa, Glycine max
  Coding DNA Sequence Number=SeqID_109718
  Gene Ontology: Mol. function=transcriptional repressor activity; Biological process=regulation of nitrogen utilization
  Homolog annotation: Hit_ID=Q9SDZ0; Match level="QueryCoverage=68%, HitCoverage=10%, E-value=1e-08, Identity=96%"; Hit description =Isoflavone reductase homolog 2
MLCSYNLKSLIPTIVGVGRSIRSPKFGECDKAGRCGNFYCRTPTAS

SEQ ID NO: 226497 - protein, 88 aa, Glycine max
  Coding DNA Sequence Number=SeqID_109719
MEKKTLGHKFTKQGSLVINRTFVLRYYPSKENRSQNHSIKLMRRYGEGSFTHPYPCIYKEVVSIFKPMTNQSSRPNSETFPCSKMYIQ

SEQ ID NO: 226498 - protein, 63 aa, Glycine max
  Coding DNA Sequence Number=SeqID_109720
MSRYCLKHQRKRRCQIRCVGGARGWVVVAIGGDRDKVSVTDVNKGKGYVLSDAVVIGGGEHWI

SEQ ID NO: 226499 - protein, 47 aa, Glycine max
  Coding DNA Sequence Number=SeqID_109721
MALSFNLELINTKTLSITDSKGIYLNLHEKVQTTWGLSMQGRISLKP

SEQ ID NO: 226500 - protein, 113 aa, Glycine max
  Coding DNA Sequence Number=SeqID_109722
  Homolog annotation: Hit_ID=Q7EY71; Match level="QueryCoverage=33%, HitCoverage=4%, E-value=5e-08, Identity=65%"; Hit description =Putative xeroderma pigmentosum group C protein
MVVGHMQRKKKGKEMKHGPLIGSTSSLASGNQTGVPCINNDESSVTVCDINDKSQNQRDQQVDKCDTNLDSSLSTPLKDHEHAFLKEFESFDEGTFLLTKRCQCGFSVQVEEL

SEQ ID NO: 226501 - protein, 86 aa, Glycine max
  Coding DNA Sequence Number=SeqID_109723
MVASFGYDKERDDSWVKKGAQPNDDEAHLPVEGDSSLLKSILISSRVFGYVLKHLLVCHHQKGGDCRNKLHDDESINFDDAKCPSD

SEQ ID NO: 226502 - protein, 325 aa, Glycine max
  Coding DNA Sequence Number=SeqID_109724
  Gene Ontology: Mol. function=transporter activity; Cellular component= integral to membrane; Biological process=transport
  Homolog annotation: Hit_ID=Q392E2; Match level="QueryCoverage=88%, HitCoverage=92%, E-value=6e-59, Identity=57%"; Hit description=Major facilitator superfamily (MFS_1) transporter
MGRGVRHGVWRLRPDHRRISAGELADTDCRLAARQRRAGGPDGHSYRAGGAADQPGMAIGGFWTLSTAITMRLVPADQVPRALSIVFSVLHPAVDAAGEQNAQRRRAGPAASERDALGHAGGYHDVYRPFRLLYLSASVPGNQRAAECESAVAGAAGVRRGELLRHLAGRVAGDAQRVADADRHGAGDERDGGAAGELWPRLLAGGERRRAVGAGVWFNADWLVNLAVARGARRRRIGRRSAGGNYSASDHRRCGSRWLDVRSAGRGRRIPCQRRADAAGRHHHLYPRAASRLNPFTAIRRAATRFRVCRGAAFAAYAWSHQSQQ

SEQ ID NO: 226503 - protein, 194 aa, Glycine max
  Coding DNA Sequence Number=SeqID_109725
  Gene Ontology: Mol. function=sequence-specific DNA binding; Cellular component=intracellular; Biological process=regulation of transcription, DNA-dependent
  Homolog annotation: Hit_ID=Q4BEH2; Match level="QueryCoverage=99%, HitCoverage=56%, E-value=5e-58, Identity=57%"; Hit description=Helix- turn-helix, AraC type
  Pfam annotation: Domain name=Cupin_2; Domain location=9-80; Score =7.3; E_value=0.049; Accession=PF07883.2; Description=Cupin domain
MGMRLYGVKYQRIALHAPFGLQYDDAPGKAQLHFVGRGSLLIRSASGTVYPLQAGDALLIPHGKPHALISGEDAVCVPIATFNSKPICDSVCAINDAPDADACPDDSDVILFSACMAFELGGMQPLVHTMPDVMLVSTLLAQYPEIQPILDAMERETRQRKAGFAGILSRLADVVAAQIVRGWVENGCGQGSGL

SEQ ID NO: 226504 - protein, 139 aa, Glycine max
  Coding DNA Sequence Number=SeqID_109726
  Homolog annotation: Hit_ID=P76116; Match level="QueryCoverage=46%, HitCoverage=18%, E-value=1e-07, Identity=47%"; Hit description =Hypothetical protein yncE precursor
  Pfam annotation: Domain name=DUF1471; Domain location=3-71; Score= -7.2; E_value=0.0058; Accession=PF07338.3; Description=Protein of unknown function (DUF1471)
MTMKTIKTFAAVIALSVLPFASFAQSVTATASTLDGAEAQIAAKAQELGASYKGAFGRPGGVANAIKSLGAASATGGHGAAVLQRAAGGGNAAAQSADRQRRLRTGLQQQRQRAVPRHGAKRRQPAGRYRLPSRSAESG

SEQ ID NO: 226505 - protein, 167 aa, Glycine max
  Coding DNA Sequence Number=SeqID_109727
  Homolog annotation: Hit_ID=Q1MHZ0; Match level="QueryCoverage=72%, HitCoverage=9%, E-value=1e-07, Identity=31%"; Hit description =Putative adhesin autotransporter precursor
MNDFTDEDNNQVRYGDYHQTIGRLGARLDRSWTDDSNRQYTPYLRANYYKGWGGTAQASVSAADNPALGASFSSGNFGQMWEVGAGGTVTLQQDVSLYAEADYRKEIDGNGARGWRYNLGVRWQDAVAMNGDPTKWGMLRDAQGCVRRERRPYENGHVAGCAGMRSP

SEQ ID NO: 226506 - protein, 94 aa, Glycine max
  Coding DNA Sequence Number=SeqID_109728
MKAHWQQPPAKIWTPSPRKWNGKVPEVGYPEGVKLYKVGEKGDLRLNGRTFLSAALRGEYVRFLEVDDGIDVILFDRLILAYYDRAEKRIIRID

SEQ ID NO: 226507 - protein, 104 aa, Glycine max
  Coding DNA Sequence Number=SeqID_109729
  Subcellular localization annotation: CTP_CleavageSite=70; ConfidenceScore=5.43e-01
MRRDFLVQFSILNLFRSPMNCVFVHVSSTFEFGAMRSDCLVQFSIFNLFRSPRNGVFVHESSTFEFGAMRSDCLVQFSIFNLFSEPHEFRFRSCVLHHRVGSHA

SEQ ID NO: 226508 - protein, 168 aa, Glycine max
  Coding DNA Sequence Number=SeqID_109730
  Homolog annotation: Hit_ID=Q5CEG7; Match level="QueryCoverage=62%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGTRVKLNRVFFPPLIPAKPVPFGCGFAG

SEQ ID NO: 226509 - protein, 526 aa, Glycine max
  Coding DNA Sequence Number=SeqID_109731
KFPEILTIAKKQNEPQVVQAIPNFKKNPSSASSENISLVRITRHAPMTILVVEVTMKDKEPKVHVEHFFDIESLENDGYLIKAHFMLCGIHHFFKDPTVVAPKLIPHFWKTTKDKSIGKDIYHSVVLTKVFEAHVQDNIYLDRVFLPKHKTFGQENISCHGSLSKWPTPKKQKPLSTIKCLRALSETNSDDDQALVFKKHKSAPPSDEISLPQVKKSEQSSIVADATNNPPPSEIPPIHEFTSTIHQFEQSLQRTKTINIRKKKRTESTTNKDDKVQNEAPLSPIHLDRFHHQGPLATTLLFPLDIEEEEVTCLPATHLDYQAASTSIELDPPTWKRLRLKIDDQQINPSSDDFLALFLHPKHIQLFTPLSKFVPLIYGHQALPLTKDDIYNPSYPFDIHIKPTTTIKFMSDPVAPRLQPSDLSKKRGKVPPHTKPMPHPSPKDIVAFRPVPCDWNKYFTRDITMKIVALKPDAEFDKSDAFLFYFKDMFENSHLVSTSKYDKEDNSNHMRMVQILHPTKIYIFND

SEQ ID NO: 226510 - protein, 67 aa, Glycine max
  Coding DNA Sequence Number=SeqID_109732
  Gene Ontology: Mol. function=transcription regulator activity; Cellular component=nucleus; Biological process=regulation of transcription
  Homolog annotation: Hit_ID=Q1T454; Match level="QueryCoverage=76%, HitCoverage=21%, E-value=3e-17, Identity=84%"; Hit description=Helix- loop-helix DNA-binding
MGEKTFVVSLTCSKRTDTMVKLCAVFESLKLKVITANITSFSGTLLKTVFIQLMRQLTRKDHVNLVL

SEQ ID NO: 226511 - protein, 132 aa, Glycine max
  Coding DNA Sequence Number=SeqID_109733
MESQRPEGHPLGYTNDGRRDQGESHIPHCRCFCNLFSPRGKEPQRSLISYVNSFQTMLETQPLISALMLDPSCPHVAAVAAHEAELGRRRREGLVPRVGVAEINIQIDVDKDLVFEWNLERYVAVYLFKLKK

SEQ ID NO: 226512 - protein, 159 aa, Glycine max
  Coding DNA Sequence Number=SeqID_109734
  Gene Ontology: Mol. function=mannosyl-oligosaccharide 1,2-alpha -mannosidase activity; Cellular component=membrane; Biological process=metabolic process
  Homolog annotation: Hit_ID=Q9SEH8; Match level="QueryCoverage=87%, HitCoverage=27%, E-value=2e-46, Identity=57%"; Hit description =Mannosyl-oligosaccharide 1,2-alpha-mannosidase
VENIKGHMKDSTESIENDEANKFTKDISVEEDPINIRRRDKVKDAMLHAWTSYEKYAWGKDELKPQSMNGVDSFGGMGATLVDSLDTLFIMGLDAQFKRATEVLGGLLSAYDLSGDKVFLEKAKDLADKLLPAWNTPSGIPYNRINLAYGNTNNPTWAR

SEQ ID NO: 226513 - protein, 225 aa, Glycine max
  Coding DNA Sequence Number=SeqID_109735
  Gene Ontology: Mol. function=mannosyl-oligosaccharide 1,2-alpha -mannosidase activity; Cellular component=membrane; Biological process=metabolic process
  Homolog annotation: Hit_ID=Q9C512; Match level="QueryCoverage=90%, HitCoverage=36%, E-value=1e-96, Identity=80%"; Hit description =Mannosyl-oligosaccharide 1,2-alpha-mannosidase, putative; 8615-12432
  Pfam annotation: Domain name=Glyco_hydro_47; Domain location=1-200; Score=-92.2; E_value=1.9e-10; Accession=PF01532.11; Description =Glycosyl hydrolase family 47
MWEKSMKGLQSMIRRSTPSSFTYLIERLGNADFDKMDELACFVPGMLALGSSNYGPGEAEKFLALGEELAWTCYNFYQLTPTKLAGENYYFRNGQDMSVGTSWNIQRPETIESLFYLWRFTGNKTYQEWGWNIFQAFENNSRIETGYVGLKDVNTGAKDNMMQSYFLSETLKYLYLLFSPPSVISLNEWVFNTEAHPLRIMTRSAHEESGDQEEGTAGFALSTEL

SEQ ID NO: 226514 - protein, 233 aa, Glycine max
  Coding DNA Sequence Number=SeqID_109736
  Homolog annotation: Hit_ID=Q2TV62; Match level="QueryCoverage=90%, HitCoverage=48%, E-value=3e-75, Identity=69%"; Hit description=NTA15 protein
MDHVAMWEELILTDLRLADFRAKQRAMEDALMALELIKNIHDRMVSKMYNFPLRRDKGSLSENNVRGRIMLEKNGKTTNSFPGDVTTERIAALQEAYWSMASALSEADGIDYTDPEELELLVRTLIDLDAMDGKQSVSLLAECSSSPDVSTRRALANALAAAPSMWTLGNAGMGALQRLAEDSNPAIATAASKAIYELKKQWEIEEGDSWRFMMDENTMEEKGSIESDNEDTK

SEQ ID NO: 226515 - protein, 1067 aa, Glycine max
  Coding DNA Sequence Number=SeqID_109737
  Homolog annotation: Hit_ID=Q10NT0; Match level="QueryCoverage=99%, HitCoverage=98%, E-value=4e-65, Identity=42%"; Hit description =Expressed protein
  Pfam annotation: Domain name=DUF593; Domain location=688-781; Score =177.3; E_value=3.8e-50; Accession=PF04576.6; Description=Protein of unknown function, DUF593
MATNKFATMLHRNTNRMVVILVYAVLEWLLIALLLLNSLFSYLITIFAKCVGLQPPCLWCSRVDHVLQKDIATHLHKDLVCEAHAAEISKLGYCSNHQRLAETHSMCEDCLASRPNHPENSFGMRQRIAFISWVSSHGKHENGDDDIMGLRRCSCCNESLSCSSSSSQLYSPYLLLKPSWGHENYNSKGSSFIVEEAIDDEKEDDKDLEFDFEFERNNGEEEVADEHQILSDIESFILIEAAEDRLSSVSNLHSDEKDAEKDEKEDDDDLIIITELDPSGDHNFVCQFTSTMQGSLYGDQSLEVINVHFENHMACDSHRLVPVKLIDSITSLNLETYKLDESPIEAQSSILERGGLLTVDESAEKTSVRELESLENCINLELEGLKQNSVDEVHPQGTTAGEAQTLLNDDNSVEAATEELDDTQVDLPQSQKPESSNECTEEDESSSSDDDVGVQNAFDKFIAQNNLSKSQSLSNGDNSMEAEMQEPENPQANLPPSEEPACSCQCISEDESSSSDDDAEVQNAFDEFIAQNRLSQSQSLSNDDKSIKSDTEEPENKQDNHSPSEEPACLSNIQEDQSSTSEDDTEAPNAFDEFITQNNLCPDKTGANDTEYAKNIEKTIAVEKNHEETSHESSKCPEPYEVEEEKLPETPRSVDGLHYLHKRESVANDSVDGSVASEAECGDPVLTIDRLKTALQTERRALSVVYQELEEERSASAVAANQTMAMITRLQEEKAAMQMEALQYQRMMEEQSEYDQEALQLLNELMMKREKEKQELEKELEEYRQKVMEYEAKEKLRVLQRMKDGSVRSRGSSSSCSNMNYTDELSIDLNREVHDEDNVLFNHEEISHNNATDDTVSNMEEMALDCVKHVSALDDTLAEFEEERASILEQLKALEEKIISLADNEEFLDDIKLIEHSSMYGDKDLNENCNFSSVEEENGYSNGFSDDKHSPIGSLAKKLLPYLDAAENETEETYTLEGQLESESSDMQNSVPILEMDSMKTCIEEEVDRVYERLQALETDKEFLQHCMGSIQNGGEKGVDLLQEILQHLRDLKDVEIRLKTLGNDPL

SEQ ID NO: 226516 - protein, 133 aa, Glycine max
  Coding DNA Sequence Number=SeqID_109738
  Pfam annotation: Domain name=AT_hook; Domain location=11-23; Score =16.7; E_value=0.029; Accession=PF02178.9; Description=AT hook motif
  Pfam annotation: Domain name=AT_hook; Domain location=37-49; Score =10.3; E_value=0.38; Accession=PF02178.9; Description=AT hook motif
  Pfam annotation: Domain name=AT_hook; Domain location=61-73; Score =13.4; E_value=0.11; Accession=PF02178.9; Description=AT hook motif
  Pfam module annotation: Pfam domain module=AT_hook::AT_hook::AT_hook; Domain location=11-23::37-49::61-73
  Subcellular localization annotation: CTP_CleavageSite=48; ConfidenceScore=5.75e-01
PLPPGTVVSPPRPRGRPPKDPNAPPKSPKAKATPGSGRPRGRPKKVPRSPAVAAPTAVSSGRPRGRPPKVKPQLTEIGKGEAEVDDVLNLTLCLIFGHQPYDAISIPVFPLIRPFQYAKKSLFPWWGKFSALV

SEQ ID NO: 226517 - protein, 73 aa, Glycine max
  Coding DNA Sequence Number=SeqID_109739
  Subcellular localization annotation: CTP_CleavageSite=59; ConfidenceScore=5.24e-01
PQGPTEKWKLFSNSNGHNFSLGGPIQAHNISRRSKLNNGSSREVQMVITFHSEAHDISRRSKLSNGNSREIQM

SEQ ID NO: 226518 - protein, 264 aa, Glycine max
  Coding DNA Sequence Number=SeqID_109740
  Gene Ontology: Mol. function=hydrolase activity; Biological process =aromatic compound metabolic process
  Homolog annotation: Hit_ID=Q9C942; Match level="QueryCoverage=93%, HitCoverage=93%, E-value=4e-82, Identity=52%"; Hit description =Putative lipase; 20450-21648
MAQESEVHPNFWGHTPEEEYYTSQGVRNTKSHFETPNGKIFTQSFFPLNLEPHEVKATVFMTHGYGSDTGWLFQKICINFSTWGYAVFAADLLGHGRSDGLRCYLGDMDKIAATSLSFFLHVRNSEPYKNLPAFLLGESMGGLATLLMYFKSEPNTWTGLMFSAPLFVIPDDMKPSRDNFSKVTAPFFTAHGTSDGVTCPSSSRLLYEKGSSEDKSLKLYDGMYHSLIQGEPDESANLVLGDMREWIDERVRRYGPNKNPQSNN

SEQ ID NO: 226519 - protein, 1010 aa, Glycine max
  Coding DNA Sequence Number=SeqID_109741
  Gene Ontology: Mol. function=protein binding; Biological process =protein metabolic process
  Homolog annotation: Hit_ID=Q9LU73; Match level="QueryCoverage=99%, HitCoverage=99%, E-value=1e-176, Identity=40%"; Hit description =Arabidopsis thaliana genomic DNA, chromosome 5, P1 clone:MUL3
  Subcellular localization annotation: CTP_CleavageSite=58; ConfidenceScore=5.23e-01
MRSGVCTLQQTLTAEAASVLKHSLGLARRRGHAQVTPLHVAATLLSLRGSSLRRACLKSSQASHHPLQCRALELCFNVALNRLPTTPSPLIHTQPSLSNALIAALKRAQAHQRRGCIEQQQQQPLLTIKVELEHLIISILDDPSVSRVMREAGFSSTAVKNHIEDSNSPQYSVFQCYNSSGGVFSSPCSPSASENNNHRETATNNNPTNFRHTTRHFLTSYASEFHPSLVFSPPKNAPVCSITGAASSSSKDDDVRLVLDILLRKKKKNTVIVGDSLSLTEGLVGEIMGRLERSEVPDELKSIHFIKFQISHVSLSCMKRDEVEMKLLELERKVNSIASGGGGGIFYIGDLKWTVEEASLSEKEEGSPNGEVSGYNPVDHLVSEIGKLFCDCGTSNNAKVWLMATASYQTYMRCQMRQPPLEKQWALQAVPVPSGGLGLSLHAPSVLDSKMTISHNQSQVLETKPFGNMEQEDKLNCCEECASNYEKEAQFIRPDQKKRLPFWLQSHITEDHKKDELVQLKRKWNRLCHCLHQSKQPQNQWNWNHNSYNSPSSISFASNATHGSTSKLVPRFRRQQSCIIEFNFGKKREATEPVLDSLESMEGKEVKTTLALGNGGSGESAVGDITDTTLQRAHICKLLQENVPWQSETFPSIAEALIDSKSAKESNNITWLLMQGNDTIGKRRLALAIAESVFGSTNLLLQFDMLKRETSIAPFSEMLEGALKTHHQLVMLIENVDFADAQFKKFLCDGFETGNFGNFTEENSSQVIFILTNGGSGSTNIEQQNEDSVMRLLWQVSETKPNLETPSVTTTIAEPCFGHKRRAELDMFSNTNSFQGSKKKEFSRQTSFNTLDLNMKADEGDKAGESSPISSDQTGETIADPLNQNGFLDSIVNRFEFNTNPVKDREMAELFLCKFKESFEEVYGKKCLENLSVDERVIEDVGVGCGYFTNSLFEKWLKDVFQSSLETVNFGGKEGILFRLSWGGKGDRKSDSGFMSSSLPKSIQVNYFIE

SEQ ID NO: 226520 - protein, 236 aa, Glycine max
  Coding DNA Sequence Number=SeqID_109742
MPLRGRIALETLCAYSRFRLLRPDPQELAAKLSIPGRGFELNDDGYLLKILWKNMTTLAQIWSVISFSNLIPTSHTSDVTLDRAKLIYGIIMKMDMNVGYLVSHQISLTTQHDTSRLGFPALITALCKARGVQSDSRSLESLSPAINLGYIKKNCWNLDDPTVTFRGPRKARGKRSKAPSTLASEAPALASSTLPPSSSTEIPMIPPAPTQIPLPAPLSAGPADFIFTPQMLHSML

SEQ ID NO: 226521 - protein, 361 aa, Glycine max
  Coding DNA Sequence Number=SeqID_109743
  Gene Ontology: Mol. function=endonuclease activity; Cellular component=membrane; Biological process=RNA-dependent DNA replication
  Homolog annotation: Hit_ID=Q1RY72; Match level="QueryCoverage=84%, HitCoverage=81%, E-value=4e-46, Identity=35%"; Hit description =Endonuclease/exonuclease/phosphatase
MKYLDNYDKHENGRIWFIWDDSKVMIKHICSTSQLIHCGVYNPNGDFLHWCTAIYALNHLDDRRKLWKDIEDLRVQQADPWCLLGDFNNVLKAEDRIGGRDVTESEYVDLREMMSRVGLYEMDTCGDFFTWTNKQADNTIYSRIDRFLGNLNWLQMHIDSTLKILAPSVSDHALMFLSCKDQSSRLRGRFKYRNSLARLNGFHDEVKKNWNLGVHGNPMYKLWTKLSRLQSVLKNLSSPLNGLREKIDEARRNLQQAHEDLCRDRFNVDNINRVKDRTSELLQLNELEDSDLRQKAKINWIRQGDGNNSYFHATIKGRYKHNAIRSLIKEDGSCITSHEDIEEEVLKFYSALLGSRESNLA

SEQ ID NO: 226522 - protein, 464 aa, Glycine max
  Coding DNA Sequence Number=SeqID_109744
MVGEKVNLPKVIFYYWMPAFKDKFNPKVNKNLVPYGMLFTQIMRDVSVDMFGMALSGGATQLKGIEVIRMSQEEWLNCLDTKIQALREFNFLSEGVLACNKALSSKERKRKLAEDAMIAALVGKLFEEISDEVILESLKTLSVAEVYRQNAEKATMMNIDGELVFEFVVDLIQARSEQGMKKVEMNELERVQSIAEYATKILSLDVAQRQAEMEYVIVLEDIDPVEKEALKEAMLQTIIEASLTNIIEIDSITEPDTKFLNEKSGVGSYILYPKIQEVELAKLSLLNLWKQDFLEIDPFHYPYSYTREVNPNEEVDALRCYGAKELAFQEFPIRQTTASNSKKFILEHRLTIRKTLNHSSFTQETLFNMVCPWTREFSIVSNCTFSFMLLLPYSRFTFTHHVQLIIEEVDSDVEVEAALDVMVAEAQLLKSKELLAQALEDCAHGEKEAKKGFVIGDYFTKIIG

SEQ ID NO: 226523 - protein, 114 aa, Glycine max
  Coding DNA Sequence Number=SeqID_109745
MNLRGRQVEISDPMCPLCNNSEEVAAHLFFNCSKVLPLWWKSLSWVNSVGAFPKEQKDHFMQHSRRNATRTKDIRWSYWWIALTRTIWQHRNKVVFDNQTFNASKLMDEALLLV

SEQ ID NO: 226524 - protein, 112 aa, Glycine max
  Coding DNA Sequence Number=SeqID_109746
MEGLVDLAVIDAFLAFHHGKESPVVAILAMGCINYNPVLAIRQLGYPMRGAPLEDGLAPKDKELRGSGPIGGYREWLKAHVQALGQNSSKLKQSKKGSDGSLLVGLLWRLDH

SEQ ID NO: 226525 - protein, 81 aa, Glycine max
  Coding DNA Sequence Number=SeqID_109747
MSELREIPFELDSISHIFTIGISEIIFMEVDNGISRRQYKWRLQSLLVLSNVWKPYQSNHRKNLRNLKKLLEMPLSLPEHT

SEQ ID NO: 226526 - protein, 194 aa, Glycine max
  Coding DNA Sequence Number=SeqID_109748
MAEGKRLKHKRMDSNSERKWDESTVLKEEVDTFCTSKRERTKEYSFNHRWVDTQLSKSKELEDLDSVFSSHSRAGEEYGGRKLKLRSNIQRQEDFFPHRRQCSVGEDHSFLSSPATLAYMAATESTKAKARSTSSPKIRTGGNVDMNSDNYSPCKKSYPLHLLLTVKCLVMVGWASSVLTNSKDHQALRDFQCL

SEQ ID NO: 226527 - protein, 70 aa, Glycine max
  Coding DNA Sequence Number=SeqID_109749
  Subcellular localization annotation: CTP_CleavageSite=29; ConfidenceScore=5.10e-01
MAGSLRRAHVASKSLVGLATSPKVDLATTAGESASGRRLGFSVIGLLFQRKESCNCHWRVKGKLQLPLAS

SEQ ID NO: 226528 - protein, 265 aa, Glycine max
  Coding DNA Sequence Number=SeqID_109750
  Gene Ontology: Mol. function=transition metal ion binding; Cellular component=nucleus; Biological process=proteolysis
  Pfam annotation: Domain name=Transposase_21; Domain location=42-130; Score=-56.2; E_value=8.2e-10; Accession=PF02992.5; Description =Transposase family tnp2
MGMEYQKIHACPNNCILYRNEFEEMHNCPRFKRMFANANDAKDLTWHADERNCDGMLRHPADSSQWKKINSLYLEFGKETRNLRIGLSKDGMHPYGNLSTQHTFSGSQEHDSARILLTSEQVLERVDDIDTVFGKTQKKEKKSKTSIWKKSKVIDHVKLDELENEDIIILCQLEMYFPPSFFDIMVHLIVHLVRKIKCCGPIYLWWMYPIERYMKILKGYTKNLHHPEASIVERYISEEAIEFCSEYMEKEKPVGVLESQHDERV

SEQ ID NO: 226529 - protein, 205 aa, Glycine max
  Coding DNA Sequence Number=SeqID_109751
  Gene Ontology: Mol. function=glycine dehydrogenase (decarboxylating) activity; Cellular component=glycine dehydrogenase complex (decarboxylating); Biological process=glycine metabolic process
  Homolog annotation: Hit_ID=O80988; Match level="QueryCoverage=93%, HitCoverage=32%, E-value=4e-73, Identity=84%"; Hit description =Glycine dehydrogenase [decarboxylating], mitochondrial precursor
MQKVNTSPQYDVPVSAHGSEGTNPADAAMCGIKIVSVGTEAKGKIDIEELRKHILQVTVFMRKNYYPVLFRGVNGTVAHEFIIDLRGFKNTAGIEPEDVAKRLMDYGFHAPTMSWPVPGTLMIEPTESESKAELDRFCDALISIRHEIAEIEKGNADINNNVLKSAPHPPSLLMADAWTKPYSREYAAFPAPWLRASKFWPTTVG

SEQ ID NO: 226530 - protein, 69 aa, Glycine max
  Coding DNA Sequence Number=SeqID_109752
MSMCPYSVATKCAQEGLHSLKNSLWILGHASENLRKCEDDLDVPDTVSTPTSAESRKLEVGFSMTKCHS

SEQ ID NO: 226531 - protein, 87 aa, Glycine max
  Coding DNA Sequence Number=SeqID_109753
  Gene Ontology: Mol. function=chlorophyllase activity; Cellular component=chloroplast; Biological process=chlorophyll catabolic process
  Homolog annotation: Hit_ID=Q9MV14; Match level="QueryCoverage=87%, HitCoverage=28%, E-value=7e-15, Identity=48%"; Hit description =Chlorophyllase-1, chloroplast precursor
  Pfam annotation: Domain name=Chlorophyllase; Domain location=1-86; Score=-189.8; E_value=0.052; Accession=PF07224.2; Description =Chlorophyllase
KANFVSPPCAPDGENHKEFFNECKPSCAHFVATEYGHMDMLNDDGIGPRDSMRRAVGGLVVAFLRAQLNNLWKDFNAILADPYLALP

SEQ ID NO: 226532 - protein, 345 aa, Glycine max
  Coding DNA Sequence Number=SeqID_109754
  Gene Ontology: Mol. function=RNA-directed DNA polymerase activity; Biological process=RNA-dependent DNA replication
MKGKMKAMMKVMMSMRKMMEVNFATAVAARTTTERDSIHSPCLEQAFFPPYGLPSNYTSPTVVYAPSENIVNSAPIFIESRKPQPDHTHAHVSQPMGETHKAPQDHTLTGFKAYSGYTTEGHAFSGVPVPNAPGGPLYRPLSQPLHFVMGGGSFAIVEKEKFDHIEETLRAIEGGGNYGFADMLELCLVPDVVIPPKFKVPNFDKYKGTTCPKNHLKMYCRKMGDPMNAFIRQYSYNSDMDPNRMQLQNMCKRDIESFKEYAQRWRDPTAQVVPSMTKREMITMIMNTLLVFYYEKMVGYMSSSFADLVFASERIEPGDSGGVARGRRRENLMLWLYFPRGQTFH

SEQ ID NO: 226533 - protein, 86 aa, Glycine max
  Coding DNA Sequence Number=SeqID_109755
  Gene Ontology: Mol. function=chlorophyllase activity; Cellular component=chloroplast; Biological process=chlorophyll catabolic process
  Homolog annotation: Hit_ID=O22527; Match level="QueryCoverage=91%, HitCoverage=25%, E-value=2e-13, Identity=46%"; Hit description =Chlorophyllase-1
  Subcellular localization annotation: CTP_CleavageSite=28; ConfidenceScore=5.04e-01
MAQRAQSVLATKDVFQKGDFHWKQFNVETSSASSSTPKPLLIFTPIVPGSYPVILFCHGFFIHNSFYSEFLGHIALHGFILVAPQL

SEQ ID NO: 226534 - protein, 51 aa, Glycine max
  Coding DNA Sequence Number=SeqID_109756
MGCMYERWGGWVGTGSGRPSLTYDYATGLENRSCLAQKTPRPTRKPPRRVA

SEQ ID NO: 226535 - protein, 114 aa, Glycine max
  Coding DNA Sequence Number=SeqID_109757
MFISQENGLGPKLKQGNPAQTAIAQQGWKTLVVSRRKQRSQCGNHHREWHIAHGTTSARSSGARPPHGRWRHDIDDNRCIMVVQTKKREKEPKENKCDRALNAIGEGPTSVKLP

SEQ ID NO: 226536 - protein, 222 aa, Glycine max
  Coding DNA Sequence Number=SeqID_109758
  Gene Ontology: Cellular component=endoplasmic reticulum; Biological process=response to oxidative stress
  Homolog annotation: Hit_ID=P19244; Match level="QueryCoverage=78%, HitCoverage=89%, E-value=2e-49, Identity=58%"; Hit description=22.7 kDa class IV heat shock protein precursor
  Pfam annotation: Domain name=HSP20; Domain location=75-176; Score =96.1; E_value=1.1e-25; Accession=PF00011.11; Description=Hsp20alpha crystallin family
MRHFLVLVPLILLVFAGFPSKAKGSLLPFTNHPNTLLADLWSNHFPDPFRVLEQIPFGVDKDETFTALSSHARVDWKETPEGHVIMLDVPGLKRDEIKIEVEGNRVLRVSGERKREEEKEGDHWHRVERSYGKFWRHFKVPDNVDSQDVIPYGSSNNNDFFLHKTKRGTSNNLKVVHSGTKEFKIASNKRDLFLGFSDHQERIRKKLALDEGRIFAANEQLS

SEQ ID NO: 226537 - protein, 144 aa, Glycine max
  Coding DNA Sequence Number=SeqID_109759
MTGFFGAIKPPFGGEIWQKYEVARIQLSNVEYWRLGSCRDAKFWLDNRNGDTVFGLWLTSIAGYSQILVIRMPWWLKWDIRYPPKKTMLFLEGPMGIGKLCCVAAWDLAKHRAWAWINAKGKGRKFSYCEWEMNPRACLNCLTL

SEQ ID NO: 226538 - protein, 121 aa, Glycine max
  Coding DNA Sequence Number=SeqID_109760
MVKEECKEVCVSSKRLAKKESHFVIRTNIKETSPLRQPPHLLLCKKTLVSTATPLGLEIIPQLKKLLDDSLVRESLNPYALLVPKIGVPMNPKRIKVIPEWPTPPSIRKIWGFHDLTKFYK

SEQ ID NO: 226539 - protein, 164 aa, Glycine max
  Coding DNA Sequence Number=SeqID_109761
  Homolog annotation: Hit_ID=Q2QM87; Match level="QueryCoverage=47%, HitCoverage=17%, E-value=3e-28, Identity=75%"; Hit description=SRP40, C-terminal domain containing protein, expressed
  Pfam annotation: Domain name=SRP40_C; Domain location=1-85; Score =114.3; E_value=3.5e-31; Accession=PF05022.3; Description=SRP40, C -terminal domain
MVLFQKKPVNAAFQRVQVDKIQFADERLQDNSYWAKDGAENGYGAKAAEILDQVRGRGFRHEKTKKKRGSYRGGQIDLQSHSTQSESCCGYEICDGGECYIQKTLLGSGKQVDFHLLTNVTEATLQNYEGTGSKLAVKRQKYGFYNCVSYMVELLASIAFTETK

SEQ ID NO: 226540 - protein, 97 aa, Glycine max
  Coding DNA Sequence Number=SeqID_109762
MSFSKGSPGSQTPRDLEAGSPASFSADFDDGDVSADPFDVTRTKNAPVQRLRRWRAIGALSCRILGAIPFLSLLYRDIDKEKIGPQLGCCLGSLELK

SEQ ID NO: 226541 - protein, 226 aa, Glycine max
  Coding DNA Sequence Number=SeqID_109763
  Gene Ontology: Mol. function=structural constituent of ribosome; Cellular component=intracellular; Biological process=regulation of transcription
  Homolog annotation: Hit_ID=Q2QYQ2; Match level="QueryCoverage=84%, HitCoverage=39%, E-value=4e-84, Identity=77%"; Hit description =Expressed protein
MELAILGSIDIIILENLIDRARRTVRGSADDIGWLQRDPGMPSVEDGTVRFLEILDNIKHGVHRLPNSVVYLLIPGLFSNHGPLYFVSTKVSFSKMGLACHIAKIHSEASVEKNAKELKEYIEEIYWGSNKRVMLLGHSKGGVDAAAALSLYWSDLKDKVAGLALAQSPYGGTPIASDLLREGQLGDYVNLRKLTEILICKVIKKNSGKSSESCGMLGMQSCGLRE

SEQ ID NO: 226542 - protein, 164 aa, Glycine max
  Coding DNA Sequence Number=SeqID_109764
MSPTQPRDPPRHPPVVHDDTFIEPNPPQQSVVAAAMVEPPAAAPVDEAYQAIAERLERLINLKVVTKGTKVYTVIEECIRIAKSVTAQGNVYVRSRRRWRMPNAGRFLGFFSNAFQDYFDDAKRIKCHASAKESRVKQVSRIKIKIQVKNQDSRFKNQEKTQSR

SEQ ID NO: 226543 - protein, 313 aa, Glycine max
  Coding DNA Sequence Number=SeqID_109765
  Gene Ontology: Mol. function=2 iron, 2 sulfur cluster binding; Cellular component=chloroplast; Biological process=aromatic compound metabolic process
  Homolog annotation: Hit_ID=Q0GH73; Match level="QueryCoverage=91%, HitCoverage=74%, E-value=1e-102, Identity=58%"; Hit description=CMO protein
  Pfam annotation: Domain name=Rieske; Domain location=8-118; Score =16.6; E_value=5e-05; Accession=PF00355.16; Description=Rieske [2Fe -2S] domain
MTGHLAYFICSGCKPLSLFAHMILPVWKLGDVEYVVCRDDSGIVRAFHNVCRHHASLLAYGSGKKSCFVCPYHILKDRFLQGWTYGFNGALLKATRISGMRNFNDFGLLPMKVATWGPFVLLNLEKENLSKKEVDSHNVSKEWLGSSSEILSTNGVDSSLSYVCRREYTIECNWKVFCDNYLDGGYHVPYAHKGLASGLKLDSYSITHAFITWGVCCLDRYGPWMDTNLVVPLGPNKCQVIFDYYLEHSLKDDKDFIEKSLQDSEKVQIEDIVLCEGVQKGLQSPAYRVGRYAPTVEQAMHHFHCLLYENLAK

SEQ ID NO: 226544 - protein, 399 aa, Glycine max
  Coding DNA Sequence Number=SeqID_109766
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LF79; Match level="QueryCoverage=95%, HitCoverage=35%, E-value=1e-153, Identity=71%"; Hit description =Calcium-transporting ATPase 8, plasma membrane-type (EC 3.6.3.8) (Ca(2+)-ATPase isoform 8)
  Pfam annotation: Domain name=Hydrolase; Domain location=51-274; Score= 54.5; E_value=3.5e-13; Accession=PF00702.16; Description=haloacid dehalogenase-like hydrolase
GGNDVEISGSPTEKAILEWGVKLGMNFDTARSKSSIIHVFPFNSDKKRGGVATWVSDSEVHIHWKGAAEIVLACCTRYFDANDQLVEMDEAKMSTFKKAIEDMAADSLRCVAIAYRSYEMKNVPTSEEELAHWSLPEDDLVLLAIIGLKDPCRPGVKDAVQLCQKAGVEVKMVTGDNVKTARAIAVECGILGSISDATEPIIIEGKRFRALTDEGRADIVEKILVMGRSSPNDKLLLVQALRRKGHVVAVTGDGTNDAPALHEADIGLAMGIQGTEVAKESSDIIILDDNFASVVKVVKWGRSVYANIQKFIQFQLTVNIAALAINVVAAFTTGDIPLNTVQLLWVNLIMDTLGALALATEPPTDSLMDQSPKGRSAPVVIGADRDFILMWTKSQTTSK

SEQ ID NO: 226545 - protein, 136 aa, Glycine max
  Coding DNA Sequence Number=SeqID_109767
  Gene Ontology: Mol. function=molecular_function; Cellular component =cellular_component; Biological process=biological_process
  Homolog annotation: Hit_ID=Q9ZVJ2; Match level="QueryCoverage=83%, HitCoverage=53%, E-value=3e-50, Identity=78%"; Hit description =Uncharacterized protein At2g38710
  Pfam annotation: Domain name=AMMECR1; Domain location=4-136; Score= -20.7; E_value=4.4e-08; Accession=PF01871.8; Description=AMMECR1
MVSANKEMVVHCFDTLLAHYNSTEAPPPAFDQAQHPLFVTWKKVVNGGDPRLRGCIGTLEARSLINGLKDYALTSALRDRRFPPIQVNELPLLECTVSLLTDYETANHYLDWEVCADLLVLVSGILLAGLNCRDAI

SEQ ID NO: 226546 - protein, 120 aa, Glycine max
  Coding DNA Sequence Number=SeqID_109768
MLVSIENSYVVQWFDTYEANKALPSGAFVCRAFTSKVVHISDIKVGARKIMDIGILLGLFHCGKEVQVISKLAMLEDKYKEQVNKSERIFVEGNHGRGKGQVSLIMGVRREGNSTNLFKI

SEQ ID NO: 226547 - protein, 187 aa, Glycine max
  Coding DNA Sequence Number=SeqID_109769
  Gene Ontology: Mol. function=RNA-directed DNA polymerase activity; Cellular component=exocyst; Biological process=RNA-dependent DNA replication
MERVSPRRKVAFEKVSNDDNEVLIARFGEEEIKEAIWECGSSKSQGPNGYNFGFIKEFWSLLNEDVTNFLNDFYESDSFVRGANASFIYLIPKISEPQGVIDERQSAFLGGRNFLHSAKIRNHESTWEFHKKGLCGKGCLILNMMDEKAWERVSKRWWWLVTWAHGIKDFGHGSLGGEDHGLNGKGD

SEQ ID NO: 226548 - protein, 246 aa, Glycine max
  Coding DNA Sequence Number=SeqID_109770
  Gene Ontology: Mol. function=protein binding
  Homolog annotation: Hit_ID=O64566; Match level="QueryCoverage=98%, HitCoverage=65%, E-value=6e-52, Identity=52%"; Hit description =Putative leucine-rich-repeat protein
  Pfam annotation: Domain name=LRR_1; Domain location=36-58; Score=8.2; E_value=8.5; Accession=PF00560.23; Description=Leucine Rich Repeat
  Pfam annotation: Domain name=LRR_1; Domain location=59-79; Score=1.1; E_value=1.8e+02; Accession=PF00560.23; Description=Leucine Rich Repeat
  Pfam annotation: Domain name=LRR_1; Domain location=94-115; Score =11.3; E_value=2.2; Accession=PF00560.23; Description=Leucine Rich Repeat
  Pfam module annotation: Pfam domain module=LRR_1::LRR_1::LRR_1; Domain location=36-58::59-79::94-115
MMYEQQQRFHHQQPMTMDTRRKKKGSSGGIEEADERLEIVDLSGMSLDSLPNPSLNLATICKLDLSNNNLLIYIVLRRNIEKNIPESLTARLLNMVVLDVHSNQLRSLPNSIGCLYKLKDEVSNSITPYQDGYRSRAREENKKHKLRRVECELQQVDPAARHDRVRAEKPEEAISELQQAGVPSSVDLSPDCTEDSGRAFELPKVSPRRPGESDKPGNPKREPELPVPGLPPLLGGIPLVPRGTRR

SEQ ID NO: 226549 - protein, 70 aa, Glycine max
  Coding DNA Sequence Number=SeqID_109771
MDMDDDNEVPLIPGRPFVKTAKFFIDVDDGKLIEFDLEIKDKIGVKIMPWFAEMANFKAVGALPDDPTWH

SEQ ID NO: 226550 - protein, 106 aa, Glycine max
  Coding DNA Sequence Number=SeqID_109772
  Homolog annotation: Hit_ID=Q1SQ35; Match level="QueryCoverage=42%, HitCoverage=43%, E-value=4e-10, Identity=63%"; Hit description=Pol -related
MGGSNSCSTCRCKDRYLLPKEKHPFKVWHTKGIGKLKSKWSRSFILNEVIPHGVVVLKDPATKRTETVNGSRIKHYLGGPTNDQGGGRVDGNEDMTDPIDYYIGGD

SEQ ID NO: 226551 - protein, 538 aa, Glycine max
  Coding DNA Sequence Number=SeqID_109773
  Gene Ontology: Mol. function=binding; Cellular component =intracellular; Biological process=metabolic process
  Homolog annotation: Hit_ID=Q6Z996; Match level="QueryCoverage=71%, HitCoverage=54%, E-value=1e-102, Identity=41%"; Hit description =Putative pentatricopeptide (PPR) repeat-containing protein
  Pfam annotation: Domain name=PPR; Domain location=211-245; Score =37.1; E_value=5.9e-08; Accession=PF01535.11; Description=PPR repeat
  Pfam annotation: Domain name=PPR; Domain location=246-280; Score=4.1; E_value=2.4; Accession=PF01535.11; Description=PPR repeat
  Pfam annotation: Domain name=PPR; Domain location=312-346; Score =57.3; E_value=5e-14; Accession=PF01535.11; Description=PPR repeat
  Pfam annotation: Domain name=PPR; Domain location=347-381; Score =21.1; E_value=0.0039; Accession=PF01535.11; Description=PPR repeat
  Pfam annotation: Domain name=PPR; Domain location=382-416; Score=3.6; E_value=2.8; Accession=PF01535.11; Description=PPR repeat
  Pfam annotation: Domain name=PPR; Domain location=448-482; Score =18.3; E_value=0.027; Accession=PF01535.11; Description=PPR repeat
  Pfam module annotation: Pfam domain module=PPR::PPR::PPR::PPR::PPR::PP R; Domain location=211-245::246-280::312-346::347-381::382-416::448 -482
  Subcellular localization annotation: CTP_CleavageSite=83; ConfidenceScore=5.23e-01
MALNRREQMKQLTAVLALGLGVWSHNIMFFSTSRNQAMNAFLTRKPTFCLKNQIFRLFFSSHRSSTTRSSKGLAIAQRVLNLLSSQKRGTTVDRRQSHLRLIDDMLENYVTIPLGHNSATNGTTAEITIESSVLHMEQGFGVDVFFLSQAVSSCGSKRDLWGGIQYHCLAITTGFVASVYVGSSLISLYSRCAFLGDACRVFEEMPVRNVVSWTAIIAGFAQEWHVDMCLELFQQMRGSDLRPNYFTYTSLLSACMGSGALGHGRCAHCQIIRMGFHSYLHIENALISMYSKCGAIDDALHIFENMVSRDVVTWNTMISGYAQHGLAQEAINLFEEMIKQGVNPDAVTYLGVLSSCRHGGLVKEGQVYFNSMVEHGVQPGLDHYSCIVDLLGRAGLLLEARDFIQNMPIFPNAVVWGSLLSSSRLHGSVPIGIEAAENRLLMEPGCSATLQQLANLYARVGWWNKVARVRKSMKDKGLKPNPGCSWVEVKSKVHRFEAQDKSNSRMADMLLIMNSLMDHMSSLNLQSQMFEEDNIWHS

SEQ ID NO: 226552 - protein, 46 aa, Glycine max
  Coding DNA Sequence Number=SeqID_109774
MALLLHATWECSRLVASSHLGGQGNDGRLVPETLLAHCASWMNRVY

SEQ ID NO: 226553 - protein, 279 aa, Glycine max
  Coding DNA Sequence Number=SeqID_109775
  Gene Ontology: Mol. function=catalytic activity; Cellular component =membrane; Biological process=response to nematode
  Homolog annotation: Hit_ID=Q6Z5L0; Match level="QueryCoverage=87%, HitCoverage=47%, E-value=2e-93, Identity=69%"; Hit description =Glucose-6-phosphate/phosphate-tranlocator-like
  Pfam annotation: Domain name=TPT; Domain location=101-239; Score =18.1; E_value=4.8e-05; Accession=PF03151.7; Description=Triose -phosphate Transporter family
  Subcellular localization annotation: CTP_CleavageSite=62; ConfidenceScore=5.71e-01
MAVLNAFSLLPASPSKSTKLSALFTLGFVMSLSTGLANVSLKYNSIGFYQMAKIAVTPSIVMAEFVLYKKKVSWPKALALTVVSIGVAVATVTDLQFHFFGACVALAWIVPSAVNKILWSRLQQQENWTALALMWKTTPITLIFLAAMLPCLDPPGVLSFDWNFINTLVILTSAILGFLLQWSGALALGATSAVSHVVLGQFKTCIILLGNYYLFGSNPGIISICGAFTAIAGMSVYTYLNLKQQSNKIFPRQATLLPKSKLSKENGTSQNGHYSAENV

SEQ ID NO: 226554 - protein, 290 aa, Glycine max
  Coding DNA Sequence Number=SeqID_109776
PPPVSQLGFPNVRENEKGLKPPFHGPTCDASFSVHRHYFINPNSEGTIVDAYQLLSFFLTRSTIDEKGLWLIQIGPKSSIAVTFFSSSCRKSFELGEEGYVLWYGVGVGNKYKCLVADAPLGHKGTSVWKVIGRRKSFGSEYEWDFMGKDGCNVERPITYHDEQGRGGKKLEIQKFCDACLEEVVVVEKLAIRDTSLDRAFILIYGVGMSFTFGVSYTKVELGEVDFLRHGGRRRWTDDSRNKGVKGWHVVDGTMTIVDLVPLKHGQVRLVDHHNKRVQNGIPDFVTRQG

SEQ ID NO: 226555 - protein, 533 aa, Glycine max
  Coding DNA Sequence Number=SeqID_109777
  Gene Ontology: Mol. function=chitin binding; Cellular component =extracellular region; Biological process=chitin metabolic process
  Homolog annotation: Hit_ID=UPI00006A17C9; Match level="QueryCoverage =70%, HitCoverage=100%, E-value=3e-49, Identity=31%"; Hit description= UPI00006A17C9 related cluster
GGPLGTSTLTFRGLHIFTFRGLHAITFRGLHPLAFRGLHILAFRRLHVLTFRGLHALTFRGLHALTFRGLHALTFRGLHALTFRGLHALTFRGLHVLAIRGQHVLAFRGLHALAFRGLHVLAIRGLHVLAIRGLHVLTIRRLHVFRGLHALRGLHLLAIRGLHFLAIRGLHAFRGLHVLAIKVLHALTFRGLHVLAFRGLHVLAIRGLHALAFRGLRVLTFKVGLHALSFRGLHALTFRGLHVLTFRGMHVIAFRGLHTLSFRGLHALAFRGLHVLTIRGLHVLTFRGLHALTFRELHILTFRGLHVLTFRGLHALSFSGLHALAFRGLDALAFKGATCPHFQWAPHLHLKRMKGPTVRAQLEEEAIVQPLCILGQDFIRVQHSAQRPQRRSPLAEVSVGLCRPNIGIAPTRLPVDPKEPKQGPGVSNSGYGPLSVLQGARPSSKFMPSWHRDHARKTLSGPGEVQQGPGVSSSDYGPLSVLQSVCRPQQGAGRDTTAAWGWPTVGNRRTTTTSKAPQLIYKSWSVAYDLWST

SEQ ID NO: 226556 - protein, 381 aa, Glycine max
  Coding DNA Sequence Number=SeqID_109778
  Gene Ontology: Mol. function=DNA binding; Cellular component=beta -galactosidase complex; Biological process=DNA integration
  Homolog annotation: Hit_ID=Q1SH28; Match level="QueryCoverage=99%, HitCoverage=45%, E-value=8e-98, Identity=45%"; Hit description =Integrase, catalytic region
MNAKIKALELNDTWILIDMPQHKNVIGCKWVYKIKHISDGSVERHKVRLVAKGYIQVEGQDYLDTFSPVAKLTRMRFLLALAAINKGYLKQLDVYMVLPQGMRVAKLGQVCKLQRSLYELKQASRQWYARLSSFLISHGYKQCASYHSLFLKHGFNIVIALLVYVDDIVLSGNDLIEIQAITQLLDNAFKIKDLGDLRYFLGFEVARKPTGINLCQRKYALDILSDAGMLGSKPVSTPSDYATKLHQQSRTLLSLEDASSFRRFNWKVDLLDQYKASTAVRILRYIKGSQSRDCPFCCKNKPLYLEAHQKVNHIASNPVFHERTKHIEIDCHIVQEKMLRGLVKLLPIPSTNQLVDVYTKALMPGAFKFLNSKLGMSDIHS

SEQ ID NO: 226557 - protein, 187 aa, Glycine max
  Coding DNA Sequence Number=SeqID_109779
  Gene Ontology: Cellular component=endoplasmic reticulum
  Homolog annotation: Hit_ID=Q9LJQ5; Match level="QueryCoverage=93%, HitCoverage=81%, E-value=4e-40, Identity=50%"; Hit description=Seed maturation protein-like
  Pfam annotation: Domain name=Reticulon; Domain location=36-179; Score= 24.1; E_value=2.3e-08; Accession=PF02453.8; Description=Reticulon
MAHDTSSDSENEIIGARAKLFGHEKPIHEVLGGGKVADMLLWRDRYVSGALLGGMTVIWFLFEIVEYNFVALLCHISITTMLVLFIWSTVADIFKWKGPQIPNIVLQESFFHDLASILHKRFNQLLPMLLHISCGIDLPIFLLFKCTKMSCFFVASFIRDKGFSACKRCQLCMNGMRKKSTIGSAIS

SEQ ID NO: 226558 - protein, 46 aa, Glycine max
  Coding DNA Sequence Number=SeqID_109780
MAELVYGASFRGDYHTCLIPESSMYNQPAILILLTISLAGQDTFSL

SEQ ID NO: 226559 - protein, 223 aa, Glycine max
  Coding DNA Sequence Number=SeqID_109781
  Homolog annotation: Hit_ID=Q1RSH5; Match level="QueryCoverage=45%, HitCoverage=12%, E-value=3e-12, Identity=39%"; Hit description =Tetratricopeptide-like helical
MAINRHKSLLHFTNQILHLLNHILPAQLAKQSPLSHLIRTQPRLPNPPVTRNRNTDIPSINMQRQKNVKSLCIQDHPFLLHHPKQSLRLHQITPTPTNKNHVSGGGEKVKDGRQNVVVGFFSFSFFCWVGGGGTRGGWLRREKGRDRGLGKRVLVVVKVEEGKGEEEEGLRENKVRTWWLLLWEREETREGENAIATGGKAQPAIASGGKAGERGVSPLVVAT

SEQ ID NO: 226560 - protein, 910 aa, Glycine max
  Coding DNA Sequence Number=SeqID_109782
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=71%, E-value=0.0, Identity=35%"; Hit description =Integrase, catalytic region
  Pfam annotation: Domain name=rve; Domain location=514-618; Score=3.4; E_value=0.0031; Accession=PF00665.16; Description=Integrase core domain
  Pfam annotation: Domain name=zf-CCHC; Domain location=213-230; Score =9.6; E_value=0.025; Accession=PF00098.13; Description=Zinc knuckle
  Pfam annotation: Domain name=zf-CCHC; Domain location=249-266; Score =12.8; E_value=0.0078; Accession=PF00098.13; Description=Zinc knuckle
  Pfam module annotation: Pfam domain module=RVT_2::rve::zf-CCHC::zf -CCHC; Domain location=820-910::514-618::213-230::249-266
MNEATINNTESYLYLHPSENPATALVSPVLNSTNYHSWSRSMITALSAKNKVEFIDGSAPEPLKTDRMHGAWRRCNNMVVSWIVHSVATSIRQTSTMKQGSLIVTEYFTRLRVIWDEIENFRPDPICSCNIRCSCNAFTIIAQRKLEDRAMQFLRGLNEQYTNIRSHVLLMDPIPAISKIFSYVAQQERQLLGNNGPGINFEPKDISINAAKTICDFCGRIGHVESVCYKKHGVPSNYDSRNKSNSGRKTCTHCGKIGHTVDVCYRKHGYPPRYKPYSGRTTMNNVVAIESKAHDDQAQHHESHEFVRFSPKQYKALLALIQEPSAGNTASTQPKQVASISSCTVNTPMDSGMSLSSSALSTPWILDSGATDHVTCSLHNLHFHRRINPITVKLPNGQYVHATHSGTVQLSPNITLHNEMNNHTKIGIVEAKHGLYHLIPNQLTTKAVNSTITHPQCNVIPIDLWHFRLGHPSAKRIQCMKAYYPLLRNNKIFVCNTCHYAKPKKMPFSPSSSHASHVFDLLHMDIWGSCSKLSMHGHKYFLTIVDDCSRFTWVHLMKSKAETQQVIMNFIAFIETQYNGKASLPPSFWCYALPHAAYLINCIPTPYLHNVSPYEKLHKHPCNISHLRVFGCLCYINTLKANRQKLDARAHPSIFIGFKTHTKGYLVYDLHSNNVTVSRNVTFYENHFPYYSETQHLNSENSAPSPVSFSGKNLDPQIEDCSSQPTISIPSSNEPLNEQSPPHLRRSTRTKQAPTYLQDYHRDHASSTPNTLAVVRYPLSSVLSYSHLSPTHRNFVMSISSTAEPSSYAEASRHDCWIKAMKVELQALQSNNTKRLTSLPPHKTTIGCRWIYKIKYRVDGSIERHKARLVAKGYTQMEGLDYLDTFSPVAKLTTVHLLLALAALNQWHLR

SEQ ID NO: 226561 - protein, 133 aa, Glycine max
  Coding DNA Sequence Number=SeqID_109783
MVGLALKSAISTSDDSEGEDAEGSKAENLTLLKKQNEEKPGYIAWKENASSSSSGSNDEEEENLYLMANEEVDSNVGASDFDQLLDAFNEMHEEVQKLSLANNFLKGKLRWHVDKITSIKKKLLDLKKENGSS

SEQ ID NO: 226562 - protein, 136 aa, Glycine max
  Coding DNA Sequence Number=SeqID_109784
  Homolog annotation: Hit_ID=Q1SVL7; Match level="QueryCoverage=99%, HitCoverage=18%, E-value=2e-17, Identity=43%"; Hit description =Tetratricopeptide-like helical
MEGGYDTHFCKALMLYKQMFFKDIVPNCLTFPFLLKGCTRRLDGATGHESNGILPAHMIFQNPSADAAYLRKSIHNRISYIPRIIPILEGNYSFLRIYKYYDIYIGNSLISLYMACGWFRNARKVFDEMLVTDVVT

SEQ ID NO: 226563 - protein, 75 aa, Glycine max
  Coding DNA Sequence Number=SeqID_109785
  Gene Ontology: Mol. function=chromatin binding; Cellular component =chromatin; Biological process=chromatin assembly or disassembly
  Homolog annotation: Hit_ID=Q1SAV4; Match level="QueryCoverage=89%, HitCoverage=17%, E-value=8e-21, Identity=64%"; Hit description =Integrase, catalytic region
MELLVHQDYFKWSYPGARMQGGVVGPFSKRKVFGPFSRPVVDECAKILLKDLVDHLCLSILLWMIRCVEAQGGVA

SEQ ID NO: 226564 - protein, 113 aa, Glycine max
  Coding DNA Sequence Number=SeqID_109786
MASPTDWVSPVRMAILTPTWPMSPLPGAIHPSLLLCRHWQWRVEPCRQWQWRFPPKNRPPPSLLLKQTLRRTIHDCCVIENLCLIYIIIGLNSKVIWDFMTTGTSHVVKAKRQ

SEQ ID NO: 226565 - protein, 426 aa, Glycine max
  Coding DNA Sequence Number=SeqID_109787
  Gene Ontology: Mol. function=RNA-directed DNA polymerase activity; Cellular component=chromatin; Biological process=chromatin assembly or disassembly
  Pfam annotation: Domain name=RVP_2; Domain location=59-196; Score= -34.2; E_value=0.00047; Accession=PF08284.2; Description=Retroviral aspartyl protease
MALRREKGLCYNCNDKWSTSHKCRGRILLLIEETDEAPPEPNLTTYHISYPPNIEPPDPPLDDPTPHISFNALSGLTAPATFCLYGFIHHNCVTVLIDNGSTHSFIQPRVARFISLTPMDTPLLHVMVGNDTILECRQQCAATPLLLQGHEFRVTFHLLPISGADIVLGIDWLKQFGPILTDHTTLSMKFTHNGTPVELSADVPLGPSSSSAKQILGMIHTGSTSSFFHLSLHHPSPPLEAITTHTIFEISHILSQYSVIFLNTSSLPPSCDIAHHIILQPSTGLVNVRPYHYPFFQKAEIEKQVSELLLDGLIRVSHSPFSSPVLLVKKKDGSWRMCVDYWALNAVTVRDWFPLPTIEELLDDLGKASWLCKLDLKQGFHQILMAEEDIPKIAFRTHRDHCEYKVMPFGLCNSPFTFQAIMNSVL

SEQ ID NO: 226566 - protein, 107 aa, Glycine max
  Coding DNA Sequence Number=SeqID_109788
LKRRVAKLQEGDAEAIPSVFEAILQRYLAGKPIEADQELMRGILGKWTLSEDEEDESDSHWEEIDDTDNEDGWLSRFQINLGLVVLYNRYQITGGGSGPLATAVKLY

SEQ ID NO: 226567 - protein, 114 aa, Glycine max
  Coding DNA Sequence Number=SeqID_109789
MDNEAALKIERSKKKSSSLPSMSNQETTNVDPKKRKTLEALNNGGLASHCHERLYTLGADVDKRREGMNKGREGDNGHRKRYGGDRALNTGLALSAPLGYFVGLLCAKCELVAK

SEQ ID NO: 226568 - protein, 1039 aa, Glycine max
  Coding DNA Sequence Number=SeqID_109790
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=87%, HitCoverage=79%, E-value=0.0, Identity=48%"; Hit description=Chromo
  Pfam annotation: Domain name=RnaseH; Domain location=666-787; Score= -25.2; E_value=0.013; Accession=PF00075.14; Description=RNase H
  Pfam annotation: Domain name=rve; Domain location=788-948; Score =78.3; E_value=2.4e-20; Accession=PF00665.16; Description=Integrase core domain
  Pfam module annotation: Pfam domain module=RVT_1::Retrotrans _gag::RnaseH::rve; Domain location=421-590::104-190::666-787::788-948
LRGVSKSTAPPIEGGSQFDAAWVFVTCIKKEGDLVRNYVRREGHVAHSPQSEGGSLLLLPVIPFSHLTPFSQVILLPNASQPPGSSSNNGSPMVQPINASLPVKEISLGFPHFDGTTSKLALVSTWSELTRALESQFGPSPFDCPMAELFKLQQTGSVSDYYLKFMSLANRSLGLSNEALLNCFNSGLNPDIRRDVVAMCPSTLLCAVALAKLFEEKYGPGTQEDEIVESEDHHLSLNALKGGRGVGTIRVAKFLKLPVEPATQFRVMVGNGNYMSVEGLVKQLKVQAQGNTFQLPIFLLPTSGTDLILGASWLKTIGSHIADYDALQLKFLWKDVVPKSMLDLPVMMEPELALLLHTYIVLFDTPSSLPPQRSHDHSIPLLSGSQPIKVKLYRYPHSQKEEIEILVPGMLDEGIIQPSKSLFSSPIILVKKKDGSWRVCIDYRALNAITIKDNFPIPTVDELIDELFGASFFSKLDLRSGYHQILLNADDRHKTIFRTHHGHYEWLVMPFGLTNAPATFQSLMNDIFGGILRKFVLVFFDDILVYSANWKDHLYHLEVVLSILKQHQLFARFSKCCFRVQQIDYLRHTLSGSGVAMEGTKLEAIQKWLEPSYYRRFVKSYASIATPLTDLLKKDSFKRSVAASEAFQQFKIAMTFAPVLAIPNFKEIFVLETDSSGSGVGAVLSQNKHPIAYFSKKLLLRMQKQSAYIQEFYAITQALAKFRHYLVGHKFIIKTNQKSLKELLEQKLQTLEQQQWLPKFLGFDFTIQYKPGKENIPADALSRSFMMAVSTPIHSWINKVMDLTQTNSQLSKIYERCLQVVDRLSKFGYFIPLKSKFNNKVVAEVFITNIVKIHGFSKTIVSDRDRIFISTFWQQLFKAQGTTLAMSSLYHPQSDGQTENLNKTVEMYLRCFVFEHPKSWATMLTWAQFWYNTFFHQSLGMTPFQAVFGRPPLAVMHYEVDPKDPNPLKDLLQLRDQLLSKLKVKLQPYRQHSVALRKHQKLGMRYFGPFPVIERIGIVAYKVQLPESAKYILYFILLF

SEQ ID NO: 226569 - protein, 332 aa, Glycine max
  Coding DNA Sequence Number=SeqID_109791
  Gene Ontology: Mol. function=oxidoreductase activity; Cellular component=cytoplasm; Biological process=response to red or far red light
  Homolog annotation: Hit_ID=Q4W8C3; Match level="QueryCoverage=96%, HitCoverage=97%, E-value=1e-151, Identity=82%"; Hit description =Gibberellin 2-oxidase
  Pfam annotation: Domain name=2OG-FeII_Oxy; Domain location=180-284; Score=117.6; E_value=3.4e-32; Accession=PF03171.10; Description=2OG -Fe(II) oxygenase superfamily
MAEQSGRKVVVLSKATTEQYSNIKNCMPTTFSSTIPIVDLSKPDAKTLIVKACEEFGFFKVINHGVPMEVISELESEAFKFFSLPLNEKEIVGPPNPFGYGNKKIGRNGDIGCVEYLLLSTSQEHNLSLYGKNPEKFRCLLNNYMSSIRKMACEILELMAEGLKIQQKDVFSKLLIDKQSDSVFRVNHYPANSKIPVNDQSLIGFGEHTDPQIISLLRSNNTSGLQICLKDGDWISVPHDQKSFFINVGDSLQVMTNGRFHSVKHRVLTNEFKSRLSMIYFGGPPLDEKITPLPSIMKGKESLYKEFTWSEYKNFTYGTKLADNRLGHFERN

SEQ ID NO: 226570 - protein, 118 aa, Glycine max
  Coding DNA Sequence Number=SeqID_109792
MGDPRYKVEVLTEGGPGEWFGHTPDYCSTYRGTVTIFLIDTIQEADDYCPPLSFILLLELTMPVPIDGIIIPRESTHYFCTFLMKIPTPIPLRLPLDLTALRVRSSSRSACCGWLDHE

SEQ ID NO: 226571 - protein, 40 aa, Glycine max
  Coding DNA Sequence Number=SeqID_109793
MARDASSSASETRAKLSKWEKPMQEVLRRGNGMRQPHKRK

SEQ ID NO: 226572 - protein, 272 aa, Glycine max
  Coding DNA Sequence Number=SeqID_109794
  Gene Ontology: Mol. function=structural constituent of ribosome; Cellular component=intracellular; Biological process=translation
  Homolog annotation: Hit_ID=Q1S7V4; Match level="QueryCoverage=54%, HitCoverage=59%, E-value=7e-51, Identity=65%"; Hit description =Ribosomal protein S3Ae
  Pfam annotation: Domain name=Ribosomal_S3Ae; Domain location=91-271; Score=140.9; E_value=3.4e-39; Accession=PF01015.8; Description =Ribosomal S3Ae family
GSDPIPERGVPVDVRIPPQGLRQIPVHEGTHVNICYYSKSKNKPLLQSLDDANLKLPRYFDKLSIPLNEQKSLANVIIDVVLNSVFIATTHCKTLEKVDIIFCSIFEAIKNLLKEQNEESGLVKRSIASRTLFLLCFGLKHRVFEVSLVDLQGDEDHAFKKIRLRAEDVQGKNVLTNLWTTDNYTLRMFCIGVTKRITNQVKRTYYAQSSQIRQIYRKMREIMTNQTTSYDLKELVRKFILQIIRKEIEKATSSIYPQQNVFDCKVKILKHC

SEQ ID NO: 226573 - protein, 103 aa, Glycine max
  Coding DNA Sequence Number=SeqID_109795
MAQEGWARPPLAQALGLCKIANKVSELNEEGLVETGVGTGKGVDAEAGASKDEAGIDGAAVEVEGAGVRRAEDGGASDLFPLVFRGPRKVNKRSSRFQQFFFT

SEQ ID NO: 226574 - protein, 52 aa, Glycine max
  Coding DNA Sequence Number=SeqID_109796
MGHCTPKCATITPARFPQPPFFRGYDSNATCAYHGGVPGHSIEHCMTSKRKV

SEQ ID NO: 226575 - protein, 51 aa, Glycine max
  Coding DNA Sequence Number=SeqID_109797
GNPIDTLPSAPALEQEQPIVQDPPAAPVLDLNEHAEDHPQEDWQDLYLFAF

SEQ ID NO: 226576 - protein, 105 aa, Glycine max
  Coding DNA Sequence Number=SeqID_109798
MATQPGELRLSHEATGSPKRVGYLTWKSFGGLGEPEASLGELGARKLNEKTLLPLFLVSFPFLIKMLNDPSFCAVTGVKPRSLANENKKLGGCCSLVDNSRAACR

SEQ ID NO: 226577 - protein, 133 aa, Glycine max
  Coding DNA Sequence Number=SeqID_109799
METTTGSSWLMGLIPLKSLSIKVIRGRLRYKGASTKINVDIMYLVVSDPDLGGFTGVAEWPLARSHNSFMLPGGFLHRLSTNLSGRKARSMECNIGQGGRGHAMRPASGVLHIESFDDGFEAIYGPRWKSTVP

SEQ ID NO: 226578 - protein, 112 aa, Glycine max
  Coding DNA Sequence Number=SeqID_109800
MKSEKRGLTERKKEEVGHGAEKGKQHSSREQKGHDSERDSEHNQSATMDTGSEMMAMTTLALETGSESCECGFARLSVDRKGSWMNSSGMEKEEREETPLQGEDESRRSSPP

SEQ ID NO: 226579 - protein, 143 aa, Glycine max
  Coding DNA Sequence Number=SeqID_109801
MGVKHFVLVKRWSHADKQWSPDEIRNFSLGSSLNQSRTYQGNPCGVYPDLSSISGSGVIQNSVTCIKRSAPSKDHIIESHSMFLSMKEGRLVLRPQWMLLLLTSKQELWEFSSFGSTSFPGPSLGRLKKTSPRLRKIWLKLPK

SEQ ID NO: 226580 - protein, 108 aa, Glycine max
  Coding DNA Sequence Number=SeqID_109802
MDVGEKRRKMKDEVNELGCAAGAAAFCMHMCPFNFVTLTFTHNLQPRLGAGRGISEGGDAGARVPHTHVIIKSGSNVVGLSTTSEETTSVQKDFSFSFSSWLLSSAPR

SEQ ID NO: 226581 - protein, 52 aa, Glycine max
  Coding DNA Sequence Number=SeqID_109803
MRTRVTEREHGGGTVGTSPREKLSQSERARVRVREGEWELQHCEKEEEKIQF

SEQ ID NO: 226582 - protein, 386 aa, Glycine max
  Coding DNA Sequence Number=SeqID_109804
  Gene Ontology: Cellular component=mitochondrial matrix
  Homolog annotation: Hit_ID=Q6YZC6; Match level="QueryCoverage=77%, HitCoverage=91%, E-value=1e-42, Identity=39%"; Hit description =Cation exchanger-like protein
MTEHSAPQQQNQAKLVHYVATLREQLEQLAEERTPEGLPRISKAVLNDYSEKIEAIASKLVNRVSDPPVTKKDFERNSVKENSSETEETKQILLSSGLRRRPVLFYCCSSDSLDRPASSTEDRAHEPAETGLTSPVKLDATAHAHIEKHRYGLLELLFKVHVMVGQWTKYRFGEESMTYRLQTCSYVNLSRTAKKLQDDLTDEMVVLAKQLKESSLMMSQSLQNTEKVSNLIFSFNPACLTAKRLYEMMMQNILDSTEKAIEHSLASTGRANVRATAIYSESSKTSCLTWLVMFVMTCVFVMRVMERSTLVEHHSPIPCLGIPAYESTMSETWCEIALVAATLVQHRRWCDIHFGIPQMAKTPSSLLTMRFPISEAFKGRPSSEAN

SEQ ID NO: 226583 - protein, 595 aa, Glycine max
  Coding DNA Sequence Number=SeqID_109805
  Homolog annotation: Hit_ID=Q091R3; Match level="QueryCoverage=23%, HitCoverage=34%, E-value=3e-14, Identity=35%"; Hit description=Mina protein
  Pfam annotation: Domain name=Cupin_4; Domain location=321-595; Score=- 41.5; E_value=1.1e-05; Accession=PF08007.2; Description=Cupin superfamily protein
MVKKSKPKRSERLCTWARRMEKKKKKDRVKRKRKQKPSARELHRLRSSDANAIFALLLASLSNTPHSVIFINKCLFKLRRSLLLSPTSLTPILALLPTLLRSKGSDIACPAADIIGAASLVSFDANEEIASDSETVEGLISLLQSRNRKVLLSACNAVLDFSTTTFAQRQLLKFSALNKLMFVFLQIFKSLEYVCLWSEGDESLPSLKIGIKEDELSLAFLTAVVVLINACEVEQLQSIPQSLSEAFLRILKEIRVRVSGQEVIRGARKCNKEGRLYKSNIAVSNLAECVFRLSINASQPTGSLSFEVVQRGLFGASDTSFEDFISNYWEVSPFLLSKTKRDPDMHDMFGAFVHSLNWNRSVPSLLSSILQRLVACFPIASDEQNILNFLNEVKDRLGCPIIYQQDIRVVKTESQLRKEMHYFQSFHSGCIKEPLYFTFDDVLKCGQAYKEGYTVALRGLEFRYQSIAAIADTLALMFGQPSVGANLYLTPPNSQGLACHFDDHCVFVCQIFGSKQWTIFSPPSQLLPRLYDSLLGSDIDCTKAGRREFFLREGDVLYIPRGFPHEAYTSSAVSDDSPGFSLHLTLSIEVEPPFE

SEQ ID NO: 226584 - protein, 439 aa, Glycine max
  Coding DNA Sequence Number=SeqID_109806
  Gene Ontology: Mol. function=protein serine/threonine kinase activity; Cellular component=chloroplast; Biological process=protein amino acid phosphorylation
  Homolog annotation: Hit_ID=P43293; Match level="QueryCoverage=71%, HitCoverage=80%, E-value=2e-88, Identity=50%"; Hit description =Probable serine/threonine-protein kinase NAK
  Pfam annotation: Domain name=Pkinase; Domain location=127-407; Score =183.1; E_value=6.8e-52; Accession=PF00069.15; Description=Protein kinase domain
  Pfam annotation: Domain name=Pkinase_Tyr; Domain location=127-407; Score=126.2; E_value=9.2e-35; Accession=PF07714.7; Description =Protein tyrosine kinase
  Pfam module annotation: Pfam domain module=Pkinase::Pkinase_Tyr; Domain location=127-407::127-407
  Subcellular localization annotation: CTP_CleavageSite=96; ConfidenceScore=5.75e-01
MGNCWSLQSGSPGDHPNSNTAPNLNNQSGNIQFSAGLSNTRLTQNGNSTSLGRSSHSGGISSRFFGPSSSNNYSTGNNTSTSLWGGSETSQASRVRDEEEFPQGQILDNVDLRAFTLAELKAATKNFRAETVIGEGGFGKVYKGLIDDRAAKKRGEGLTVAIKKLNSESTQGIEEWQSEVNFLGRLSHPNLVKLLGFGLEDTELFLVYEFMHRGSLDNHLYGRGANVRSLSWDTRLKTMIGTARGLNFLHSLEKKIIYRDVKPSNILLDKHYTVKLSDFGLAKSVNSPDHSHISTRVVGTHGYAAPEYVATGRLYVKSDVYGFGIVLVEVLTGKRIRDILDQCQKMSLRDWLKTNLLSRAKIRSTMDAKLEGRYPNNLALQLAELALKCIQTDPKVRPSMNEVVETLEQIEAANEKPADNRRRVTRTRVVQQHGGPDGG

SEQ ID NO: 226585 - protein, 105 aa, Glycine max
  Coding DNA Sequence Number=SeqID_109807
MYKLVVYMSPSNKEDMPVLYKFPRALHSKTLVDIPFSETLRVDSGHEHPLFQDPCRHAFLTLLFFPFSCNMAKCYKEEAKSGYSIIDYRSLSHREPLNVPFYEGG

SEQ ID NO: 226586 - protein, 66 aa, Glycine max
  Coding DNA Sequence Number=SeqID_109808
MGGLASHCHERLPNTKRKQEVWKKMEEGVPNYALSRQMLAKPQMRAKPPNGRYAYSPSWLLALSRC

SEQ ID NO: 226587 - protein, 408 aa, Glycine max
  Coding DNA Sequence Number=SeqID_109809
  Gene Ontology: Mol. function=protein serine/threonine kinase activity; Cellular component=membrane; Biological process=protein amino acid phosphorylation
  Homolog annotation: Hit_ID=Q8S407; Match level="QueryCoverage=77%, HitCoverage=76%, E-value=1e-123, Identity=67%"; Hit description =Similar to putative receptor protein kinase from
  Pfam annotation: Domain name=Pkinase; Domain location=92-363; Score =142.0; E_value=1.6e-39; Accession=PF00069.15; Description=Protein kinase domain
  Pfam annotation: Domain name=Pkinase_Tyr; Domain location=92-363; Score=136.6; E_value=6.8e-38; Accession=PF07714.7; Description =Protein tyrosine kinase
  Pfam module annotation: Pfam domain module=Pkinase::Pkinase_Tyr; Domain location=92-363::92-363
MMKSCDPLIAEKPPIPSHHDPGVFFFLGGIVVLVILLILVFIFWRRIKRPAKVMENTVLTSQQHGPMEFISGNLRTISYFDFRTLRRATKNFHPRNLLGSGGFGPVYQGKLADGRLIAVKTLSLDKSQQGEKEFLAEVRMITSIQHKNLVRLIGCCTDGPQRILVYEYMKNRSLDLIIYGKSDQFLNWSTRFQIILGVARGLQYLHEDSHLRIVHRDIKASNILLDEKFQPRIGDFGLARFFPEDQAYLSTQFAGTLGYTAPEYAIRGELSEKADIYSFGVLVLEIISCRKNTDLTLASEKQYLPEYAWKLYEKSMLMEIVDPKLQEQGIEEKDVMQAFHVALLCLQPHADLRPAMSEIVAMLTFKVEMVTAPMRPIFVDRRRVMDDEHHSWETIYEAFTTAVASRPT

SEQ ID NO: 226588 - protein, 371 aa, Glycine max
  Coding DNA Sequence Number=SeqID_109810
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q67U25; Match level="QueryCoverage=69%, HitCoverage=73%, E-value=1e-91, Identity=70%"; Hit description =Lustrin A-like
  Pfam annotation: Domain name=DUF231; Domain location=209-371; Score =229.5; E_value=7.2e-66; Accession=PF03005.6; Description=Arabidopsis proteins of unknown function
  Subcellular localization annotation: CTP_CleavageSite=79; ConfidenceScore=5.48e-01
MVSQKKPFTVATLFFLALFLISIFFFFFFSTRTTLHPTPSIHSDLYLLLQPLSPPPPPQPQQPDSSSSFTTTETQPEPVGDIDDATDNVTDAESDAQPATENAAEDVALNLKECDLFTGTWVKDENYPIYQPGSCPYVDEAYDCKVNGRTDTLYTNWRWKPDACDLPREGVRLSGQGSSNPTLSIDRIDKTSGRWKKADILVFNTGHWWTHGKTARGINYYKEGDYLYPKFDAVEAYRKAIKTWGKWIDDNINPRKQIVYYRGYSNAHFRGGDWDSGGSCNGETEPAFNGSILNNYPLKMKIVEEVIRGMKVPVKLLNVTKLTNFRKDGHPSVFGKNTMGGKKVSTRKQDCSHWCLPGVPDAWNELIYATL

SEQ ID NO: 226589 - protein, 58 aa, Glycine max
  Coding DNA Sequence Number=SeqID_109811
MRPGSILRGILGTEACILVERCWSILSWANMKGLSSTTGNSNHSPMKVGETFYSRGVP

SEQ ID NO: 226590 - protein, 71 aa, Glycine max
  Coding DNA Sequence Number=SeqID_109812
MITDGHHKPPLLAIEPPHQEEHFNQSGILIIHLKDLVENNPSNPFFHSFYENLVFGLTNVNERSLSDAKRN

SEQ ID NO: 226591 - protein, 112 aa, Glycine max
  Coding DNA Sequence Number=SeqID_109813
  Gene Ontology: Mol. function=hydrolase activity, hydrolyzing O -glycosyl compounds; Cellular component=cell wall; Biological process= carbohydrate metabolic process
  Homolog annotation: Hit_ID=Q27SZ1; Match level="QueryCoverage=91%, HitCoverage=100%, E-value=3e-34, Identity=47%"; Hit description =Xyloglucan endotransglycosylase
  Pfam annotation: Domain name=Glyco_hydro_16; Domain location=1-96; Score=-10.7; E_value=1.1e-06; Accession=PF00722.11; Description =Glycosyl hydrolases family 16
  Pfam annotation: Domain name=XET_C; Domain location=62-109; Score =61.7; E_value=2.4e-15; Accession=PF06955.3; Description=Xyloglucan endo-transglycosylase (XET)
  Pfam module annotation: Pfam domain module=Glyco_hydro_16::XET_C; Domain location=1-96::62-109
MQLSSLGDTHDEIDFEFLGNSSSIWWFDPTKNFHTYSILWNPQSIIFSVDGTPIREFKDLESKGVSFPKNQAMRIFSRQARIQWVQKNYMIYNYCTDTKRFPQGLHPECTIA

SEQ ID NO: 226592 - protein, 103 aa, Glycine max
  Coding DNA Sequence Number=SeqID_109814
MKTGLNTEHVAQAEEWELDIKETCVNFLRRITPRGFVFYVGAAIDTGGKAGQTRLSRSEKWVPPFLLAGHAYVGSPAFGAGGIGGERREGWDAATASCGTVGP

SEQ ID NO: 226593 - protein, 48 aa, Glycine max
  Coding DNA Sequence Number=SeqID_109815
VEDLARLQFQTTPVYIDVDDGRTKVCAFAPAVLDSIVTFGFDCFNPFQ

SEQ ID NO: 226594 - protein, 90 aa, Glycine max
  Coding DNA Sequence Number=SeqID_109816
MAIAAVIGLSGGKRLLSSSYHYFDIIEKLSYGSDFGSTHYQIGFKYYDFFIDIRRELGMEIIEEHTVMEYSKVSKKCEKCGHREATYYTR

SEQ ID NO: 226595 - protein, 406 aa, Glycine max
  Coding DNA Sequence Number=SeqID_109817
  Gene Ontology: Mol. function=nucleoside-triphosphatase activity; Cellular component=nucleus; Biological process=protein transport
  Homolog annotation: Hit_ID=Q9LZF6; Match level="QueryCoverage=52%, HitCoverage=47%, E-value=1e-107, Identity=74%"; Hit description=Cell division control protein 48 homolog E
  Pfam annotation: Domain name=AAA; Domain location=323-404; Score=8.7; E_value=4.6e-05; Accession=PF00004.19; Description=ATPase family associated with various cellular activities (AAA)
MAATSTDKLEAGTVSSYDRKSEIKAFDDSKTGVQGLVENGVTKVPLMFYCENSNLNDGVTSASNSKISIPIIDLTGIHDDPILRDHVVGKVRYACEKWGFFQVINHGIPTHVLDEMIKGTCRFHHQDAKARKEYYTRKVSRKVAYLSYYTLFEDPSADWRDTLAFSLAPHPPEAEEFPAVCSEIDIGVPDEVGRLEVLRVHTKNMKLSDAVDLERIAKDTHGYVDADLTALCTEAALQCIREKMDVIDLEDESIDAEVLNSMAVSNEHFHTALGTSNPFALRETLWEDIGGLENVKRELQETVQYPVEHLEKFEKFGMSPLKGVLFYGPPGCGKTLLAKAIANECQANFISVRGPELLTMWFGESEANVREIFDKARQSAPCVLFDELDSIATQVYFCTSHPCRPG

SEQ ID NO: 226596 - protein, 115 aa, Glycine max
  Coding DNA Sequence Number=SeqID_109818
CMVLGSYYLGLCRFGFRGLCDDWGTNRVICGYGIRICGVECVSDFVSVGFFFVVDLYGFVKTVVGGGLREAVLVVFGGLREAVLVVCGGLREAVLVVCGGLSCSGTLTVCIHLSL

SEQ ID NO: 226597 - protein, 57 aa, Glycine max
  Coding DNA Sequence Number=SeqID_109819
MVHCFALCWSYFSDTPHLVINREVDMFFDKGEALVPWKTGGTLGSLDNWRCGTQAFG

SEQ ID NO: 226598 - protein, 165 aa, Glycine max
  Coding DNA Sequence Number=SeqID_109820
MTGRLLAGSLAFESRILHYLIVRILLPRSSNLAQVSEEDLIVMWNFHKGASVIASFGYHKEHDGSWVKKGARHVDEEGHGGEDSSLLQRFWIGSMVFKPLLVKDDEKKPMRMISRLSQEQFKNQEKDSRESFIKKIQDSRFKNNQDQDSRLKDSRIKRILNQDKY

SEQ ID NO: 226599 - protein, 109 aa, Glycine max
  Coding DNA Sequence Number=SeqID_109821
MERKSKRERIQRPQWKWKSEKCKGMNTAEPSPTRKDKTISSVLVRNKDLFSLAYDSLVETVDDGHIRSCDSSYDAFYLLEDIVKGVIQFDTTKDVRRCLMESAMVATTG

SEQ ID NO: 226600 - protein, 154 aa, Glycine max
  Coding DNA Sequence Number=SeqID_109822
MGPEFYGTAMVSCKCQPANFALWTVAKQALTGLTIPPVSPSSYHSPRHLETPCPQEPFGSVDSGVEGEEEWVVELLVSYLGGEHGRRGSVEVRGKDAQSLLLAGRWMIKMESAWEAKSVWGRLVSVTVQGHKMESVEWDCEGLVAKEGHPIWWS

SEQ ID NO: 226601 - protein, 461 aa, Glycine max
  Coding DNA Sequence Number=SeqID_109823
  Gene Ontology: Mol. function=peptidase activity; Cellular component =cell wall; Biological process=proteolysis
  Homolog annotation: Hit_ID=Q4U4M3; Match level="QueryCoverage=98%, HitCoverage=79%, E-value=0.0, Identity=78%"; Hit description =Subtilisin-like protease
  Pfam annotation: Domain name=DUF1034; Domain location=344-461; Score =108.7; E_value=1.7e-29; Accession=PF06280.2; Description=Domain of Unknown Function (DUF1034)
  Pfam annotation: Domain name=PA; Domain location=6-119; Score=44.6; E_ value=3.3e-10; Accession=PF02225.12; Description=PA domain
  Pfam annotation: Domain name=Peptidase_S8; Domain location=2-310; Score=-58.7; E_value=0.0012; Accession=PF00082.12; Description =Subtilase family
  Pfam module annotation: Pfam domain module=DUF1034::PA::Peptidase_S8; Domain location=344-461::6-119::2-310
MACTASTHLNETYTLVAANDVLLDSSLMKYSPTDCQRPELLNKNLIKGNILLCGYSFNFVVGTASIKKVSETAKALGAVGFVLCVENISLGTKFNPVPVGLPGILIIDVSNSKTINPNVVLLSMKSRVTVEVEEVFVEKRRSMELIDYYNITTPRDWTGRVKSFEGKGKIGDGLMPILHKSAPQVALFSARGPNIKDFSFQEADLLKPDILAPGSLIWAAWCPNGTDEPNYVGEAFAMISGTSMAAPHIAGIAALIKQKHPHWSPAAIKSALMTTSTTLDRAGDPLLAQQTSESEAMRLVKATPFDYGSGHVDPTAALDPGLIFDAGYEDYIGFLCTTPSIDVHEIRNYTHTPCNTSMGKPSNLNTPSITISHLVRTQVVTRTVTNVAEEETYVITARMEPAVAIEVNPPAMTIKAGASRQFLVSLTVRSVTGRYSFGEVLMKGSRGHKVRIPVLANGYRR

SEQ ID NO: 226602 - protein, 320 aa, Glycine max
  Coding DNA Sequence Number=SeqID_109824
  Gene Ontology: Mol. function=RNA-directed DNA polymerase activity; Cellular component=chromatin; Biological process=chromatin assembly or disassembly
MLQALESRFAPSYYDDPHDALFKLQQRNPINDYLMEFECLANRIVTLAPPFLLSCFISGLNPDLRRERISLTTAVRVRGPCRRPLPLLPVDLPRTLLLALLFGAYLRRNWRRPVTRAFVTIVKTNGHRAIVVSLVFSCLLSKTTRIFPTTVLLRKRLCPPQVLPPPTIVLWPSVPHYLQGSCPVEAVDTLLSDHTNIRNTLHRRLLKAKASMKCSANAHRQDVQYSVSDWVNVRLRPYHKTLVTNQYHKLSKRYFGPFQITELIAAVAYRLQIPKTAKIHLVFHVLLLKPHQGPPPITSGTLPTMVHDNNPIVHPLTVSN

SEQ ID NO: 226603 - protein, 119 aa, Glycine max
  Coding DNA Sequence Number=SeqID_109825
  Homolog annotation: Hit_ID=Q7X9F2; Match level="QueryCoverage=40%, HitCoverage=61%, E-value=2e-13, Identity=77%"; Hit description =Centromere protein
MFVIKVKGLRCKGSGEKRDKLFAKNIKKKERSEIFPFTKNGEIGNQSKILETLHCDAQELRNLQITIQDLMKKVDINEKSTKGKSVEFGEVKGHQSRLTWVHLIPTYCIASKIAESTPW

SEQ ID NO: 226604 - protein, 96 aa, Glycine max
  Coding DNA Sequence Number=SeqID_109826
  Gene Ontology: Mol. function=chitin binding; Cellular component =extracellular region; Biological process=chitin metabolic process
  Homolog annotation: Hit_ID=UPI0000612705; Match level="QueryCoverage =93%, HitCoverage=92%, E-value=4e-13, Identity=32%"; Hit description =UPI0000612705 related cluster
  Subcellular localization annotation: CTP_CleavageSite=66; ConfidenceScore=5.56e-01
MKVRTCSPLKVRACSPLLARTCSPLMVKACSPQKARTCSPLMAKACNPLKARTCSPLKVRTCSPLMARMCSPQKVRTCSPLMARTCSPLKARACSP

SEQ ID NO: 226605 - protein, 486 aa, Glycine max
  Coding DNA Sequence Number=SeqID_109827
  Homolog annotation: Hit_ID=O23987; Match level="QueryCoverage=17%, HitCoverage=79%, E-value=1e-31, Identity=75%"; Hit description =Expressed sequence tag
  Subcellular localization annotation: CTP_CleavageSite=51; ConfidenceScore=5.09e-01
MLLNHIGAGFYWIDPPRPDPKRQTRILSSSLNRRRASPPFPARHAAFHGVRMEKKGDKRRSICTADELHRVAVSNSDWKLALWRYRPSPEAPSRNHPLLLLSGVATNAIGYDLSPESSFARYMSAQGFDTWILEVRGAGLSTLGDSLEEDEECLKNFSKIDSVINDDIGESSASSATAVGLENLGASFVSEVPHMKRRGSEVVTKYKEMRLTTRFMEVLTRISERLAGFLNGDLLEGQNSAIAGQIKDFNRRLRGMIEGQRLFPAQILELQDRLSATLEEFQKQLELMVKYDWDFDHYLEEDLPAADSGLASVVTLASSLDYTPSRSSLKLLLPLAKPTRALNIPVIPVGPLMATVHPLASYPPYVFSWLNSQISAQDMMDQNLFEKLVLNNFDTVPSKLLLQLSSVFQKGGLRDRSGTFFYKDHLHKSNVPVLAIAGDRDLICPPEAVYAETVKLIPEELVTYKVFGEPGGPHYAHYDLVGGRLV

SEQ ID NO: 226606 - protein, 124 aa, Glycine max
  Coding DNA Sequence Number=SeqID_109828
  Gene Ontology: Mol. function=RNA-directed DNA polymerase activity; Cellular component=intracellular; Biological process=RNA-dependent DNA replication
MAFSIVITNFIVSKVLVDQGIHPSIICHKLVICPQAKPVSQKKRKMEEERRKVVSEEIDKFLKAQFIREVKYSTWPTNVVMVKKANGKWRMCTNYTGLNKACPRAHILCPTSTGLWMVRPTSNY

SEQ ID NO: 226607 - protein, 63 aa, Glycine max
  Coding DNA Sequence Number=SeqID_109829
MGMRFTLGALVDLVGGVFAPLGAFHMSLQLIAIDFQFSKFLLLTTFHVCDAGLKLTESIVVCH

SEQ ID NO: 226608 - protein, 100 aa, Glycine max
  Coding DNA Sequence Number=SeqID_109830
MEVDLSLGWKLLNLERYDETIDPNEHLDIFLTQANLYTNDDVILCRVFPMSLKRVALTWYEGLPPRSIDSFNTLVERFSSQYATSRSHHLTSAALASYAR

SEQ ID NO: 226609 - protein, 300 aa, Glycine max
  Coding DNA Sequence Number=SeqID_109831
  Homolog annotation: Hit_ID=Q9LDG7; Match level="QueryCoverage=55%, HitCoverage=20%, E-value=2e-51, Identity=61%"; Hit description=WD-40 repeat protein-like
MSKALGATTEEDEEDDQQHPQQDCFYDSHDRLLSLSSSCSCSNSNSDNENDTQDHQNDTSLPNFTNYDIWISQPSSVSERRTRLLLSLGLSSLTRSNPRDRASPLRSVSDTTANPNKPPNPKPPPPPPPPPIEELCTIRDLDNGKEFVVNELENLREVATGRQLTMEEFEMTVGHSPIVQELMRRQNVEEASVDSNAGGSKVKKKGTGWLKSIKSVASSVAGYRDRRSSDERDTSSEKGGRRSSSATDDSQEGGGAFHGPERVRVKQYGKSCKEVTALYKSQEIQAHSGSIWSIKFSLDG

SEQ ID NO: 226610 - protein, 303 aa, Glycine max
  Coding DNA Sequence Number=SeqID_109832
MPLVKQIGPAGNDVPPRPPIIYETSFKQRGTSFPELTFLELPKLAIAAPSSTTLVASTPLALLSVGVMIANVLASLPPSSPALQPSAPIILPSTMSSSFSHPSVSLNHWVEHPKVASVTVTLVEATRFNYQLLSRVNDVFAKLASTRLDGDKVLECYQGLLKEKNDLASKVEHTTEKKEKLIAIVAESAKVIANLQAQLKETELTMSALQNKMKESELEAAKEKEANKEPGEELLMFKKEVMEQHKKEFFKAINQAKFFIEGLDLGLFDPSKDIKDGELLDKEDIVVGEEKNVGEEENDEANV

SEQ ID NO: 226611 - protein, 133 aa, Glycine max
  Coding DNA Sequence Number=SeqID_109833
MGSWLCLKVLEHQVGHGGYGDLPARSCSCLLSHLFHYYHLSLKVSKEDPFEQLLESAAQWHPSSLFFSSLEVIAAPKEVFLNSELGMHLLFVSSNSAFVTLRGQLENHLPIVQALPAYSEGYHPQLSQPRLLR

SEQ ID NO: 226612 - protein, 433 aa, Glycine max
  Coding DNA Sequence Number=SeqID_109834
  Gene Ontology: Mol. function=aminoacyl-tRNA ligase activity; Cellular component=protein phosphatase type 2A complex; Biological process =translation
  Homolog annotation: Hit_ID=Q9LDG7; Match level="QueryCoverage=76%, HitCoverage=37%, E-value=1e-120, Identity=64%"; Hit description=WD -40 repeat protein-like
  Pfam annotation: Domain name=WD40; Domain location=106-144; Score =10.1; E_value=2.4; Accession=PF00400.22; Description=WD domain, G -beta repeat
  Pfam annotation: Domain name=WD40; Domain location=13-51; Score=37.6; E_value=4.4e-08; Accession=PF00400.22; Description=WD domain, G-beta repeat
  Pfam annotation: Domain name=WD40; Domain location=146-186; Score =10.2; E_value=2.4; Accession=PF00400.22; Description=WD domain, G -beta repeat
  Pfam annotation: Domain name=WD40; Domain location=55-92; Score=6.0; E_value=7.3; Accession=PF00400.22; Description=WD domain, G-beta repeat
  Pfam annotation: Domain name=zf-CCHC; Domain location=392-409; Score =9.8; E_value=0.024; Accession=PF00098.13; Description=Zinc knuckle
  Pfam module annotation: Pfam domain module=WD40::WD40::WD40::WD40::zf- CCHC; Domain location=106-144::13-51::146-186::55-92::392-409
MDKTVRLWHLSSKSCLKIFSHSDYVTCIQFNPVDDRYFISGSLDAKVRIWSIPDRQVVDWTDLHEMVTAACYTPDGQGALVGSYKGSCHLYNTSENKLQQKSQINLQNKKKKSHHKKITGFQFAPGSSSEVLITSADSRIRVVDGVDLVHKFKGFRNATSPISASLTANGKYVVAASEDSHVFIWKNEADCRPNRSKGVTVTRSYEHFHCKDVSVAIPWPGMGDEWDMQDTFSGEQPEIDNHADEVSSANHPPTPVEENFVTEGSRSASGYSNSPRHATIASATNSYFFDRISATWPEEKLLLATRTQSPRVSMDFSNGGLPMKYWRSNIILAIAGVGTPVTIDDSTRKKVFGHYARALVDINLHGGLRDSILVERESFAFFVNIEFEKIPEFCNFCKHIGHVVSNCKKKSFVDSKMTREDPKAMLFMLLRPN

SEQ ID NO: 226613 - protein, 335 aa, Glycine max
  Coding DNA Sequence Number=SeqID_109835
  Gene Ontology: Mol. function=receptor activity; Cellular component =integral to membrane; Biological process=negative regulation of transcription
  Homolog annotation: Hit_ID=Q9C929; Match level="QueryCoverage=89%, HitCoverage=75%, E-value=1e-129, Identity=72%"; Hit description =Putative G protein-coupled receptor; 80093-78432
  Pfam annotation: Domain name=LANC_like; Domain location=16-335; Score= 341.3; E_value=1.7e-99; Accession=PF05147.3; Description=Lanthionine synthetase C-like protein
MNLTCAQRLLKLVILLQQILGTLCSCTRGYYNLYDLAIIKGCKVTFICGRAGVCALGAVIAKHTGDERLLDYYLRQFKEIAIPRESPYELLYGRAGYLWACSFLNKHIGNNTIPTTHMRSIVDEVIMAGRHLGRKGRCPLMYEWHGKKYWGAAHGLAGIMHALMDMELKPDEVEDVKGTLRYMINNRLPSGNYPSSEGSENDRLVHWCHGAPGLTLTLVKAAEVFGDKEFSQAAVDAGEVVWKRGLLKRVGICHGISGNTYVFLSLYRMTGNEEYLYRAKAFACFLLDRAQNLISEGKMHGGDRPYSLFEGLGGMAYTCLDMVDPQMAKFPGYEL

SEQ ID NO: 226614 - protein, 103 aa, Glycine max
  Coding DNA Sequence Number=SeqID_109836
  Gene Ontology: Mol. function=metal ion binding; Biological process =metal ion transport
  Homolog annotation: Hit_ID=Q1SBG7; Match level="QueryCoverage=73%, HitCoverage=34%, E-value=5e-26, Identity=77%"; Hit description=Heavy metal-associated domain, putative
  Pfam annotation: Domain name=HMA; Domain location=5-73; Score=36.8; E_ value=7.5e-08; Accession=PF00403.16; Description=Heavy-metal -associated domain
MKQKIVIKLQMDCDKCRNKALKIAAEVPGVTSVSLEGDDNDRVAVTGVNVDMVCLANQLKKKFSSVTIPTVEDLIKADEEKKKKEEEKKKKEERLKKMLRAAL

SEQ ID NO: 226615 - protein, 48 aa, Glycine max
  Coding DNA Sequence Number=SeqID_109837
MEFGLWSLPRSVAARSERSDRPSAANGEKCRVEFAGKSIHNIEHFCTE

SEQ ID NO: 226616 - protein, 125 aa, Glycine max
  Coding DNA Sequence Number=SeqID_109838
MWSLSSFPKVHVICYYRGRLEPVSLVWTVKSLIVSNMAKRTTYVSNAHVEVERQRLVIASPQPEISSADHIIGLPFGGDLVDLTLLQSYKDHVVGRVWIGEPRVELKLINHGDNVMPYPTQLTVK

SEQ ID NO: 226617 - protein, 158 aa, Glycine max
  Coding DNA Sequence Number=SeqID_109839
  Subcellular localization annotation: CTP_CleavageSite=46; ConfidenceScore=5.17e-01
MESPSVTTYPSTGVRVKSQRSVFQKGKHVGVATNIYLRKTLGKTKRASQTVSFSDIQYDIPKLKGDNNKIWKEKILLQLGWMDIVYVIRKDKPPTITNESSPTVVALYEHWEQSNRLNIMFILRPKSQLGYVEEERLVMDGGSALLATACGKNKATKS

SEQ ID NO: 226618 - protein, 80 aa, Glycine max
  Coding DNA Sequence Number=SeqID_109840
MVETSQLNTKRGVKDKAPNTLPMKGLFVTKLESNEVLLSPIALKVVGPLLLDSNSSRDGTNPPSNSLYGNPQIRKQRDKQ

SEQ ID NO: 226619 - protein, 120 aa, Glycine max
  Coding DNA Sequence Number=SeqID_109841
MRIKRSFKVVTGPRTRYGKIWNKWLNPKGIEEQWGITFEKQHFIQHVQHLTNIQCTSSMAQNKLSNETKTRHTYSQNNSKAPKFLKDMVISWFFSFKACSELQNKEREQGSKGLSKELIQ

SEQ ID NO: 226620 - protein, 347 aa, Glycine max
  Coding DNA Sequence Number=SeqID_109842
  Homolog annotation: Hit_ID=Q1SS26; Match level="QueryCoverage=52%, HitCoverage=22%, E-value=2e-09, Identity=23%"; Hit description =Unnamed protein product; no similarity, hypothetical start
MAEPSEKRKGSSPPLPLLPIAVTAHPEHPQHLFLLLCHLQDHQHCLHPMINVYVFQNSGLVDFMSFKLPYYPELVKVFYCNLKIQDGIIMSEVHGTSMVIDQSLFFSLTHLPSQGAPFEGTIVDDWKFDYSSHDARRMVCNDQADMTGRLLAGSLTFDNRIMHYIIVRILLPRSSNLAQASEEDLILMWAFLTGRQIDWAHLVRYRMHKALRANAPLPYPHLITLFLRHFQIPLDDEPFVQVKRSFAIGAGAVTSFGYRKDRNGQWLKKDALPPQDERTPSPPPQREDSALMNEVLSELRGLRSYVGDRFDSLDSRFAGMDIRLTQLEEDVGYIRQSFDLPPPPPSS

SEQ ID NO: 226621 - protein, 155 aa, Glycine max
  Coding DNA Sequence Number=SeqID_109843
  Gene Ontology: Mol. function=nucleic acid binding; Biological process= DNA integration
MEDQEKEKEREKEIENEKNENEKNKVVEKSRSGKAVEESVEVPYPMVPSKKEKDRHLERFLDIFRKLEITMPFGEALQQMPLYSKFLKDMLTRKQRYIHQENIIMEGNCSAIIQKILPPKHKDPGSVTIPCSIGEVNVGKALINLGASINLMPLS

SEQ ID NO: 226622 - protein, 39 aa, Glycine max
  Coding DNA Sequence Number=SeqID_109844
MVLFLSYTKAKTENAQGVTTSAKRPHLSLSGSVFFVKAS

SEQ ID NO: 226623 - protein, 95 aa, Glycine max
  Coding DNA Sequence Number=SeqID_109845
RATASPDDESERSAIPPIGEVGGSAVSSAGESGGAAASSDDASEMIIRGGDGGTSSNTGEGGGFTTGDHGSAGIGSTRAGAGSEGAASLGLTNGS

SEQ ID NO: 226624 - protein, 70 aa, Glycine max
  Coding DNA Sequence Number=SeqID_109846
  Homolog annotation: Hit_ID=Q9LVD7; Match level="QueryCoverage=60%, HitCoverage=5%, E-value=9e-09, Identity=68%"; Hit description =Microtubule-associated protein-like
  Subcellular localization annotation: CTP_CleavageSite=61; ConfidenceScore=5.31e-01
MPPAQMEPPLPESSSVPSFSSDAASPGSAPESRRFGDLRGLQWRINLGVLPSSSSSIDDLRRATANSRRR

SEQ ID NO: 226625 - protein, 159 aa, Glycine max
  Coding DNA Sequence Number=SeqID_109847
GVVLAEVLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTLRSTQALPVALMIHDNSSDRTAFVPATHHSISALSTFDG

SEQ ID NO: 226626 - protein, 290 aa, Glycine max
  Coding DNA Sequence Number=SeqID_109848
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=97%, HitCoverage=48%, E-value=5e-80, Identity=56%"; Hit description =Glucosyltransferase-13
LEYKLFLQRCQRYRSAHDGILVNSFMELEEEATKAITQHAKGNGNCSYPPVYPIGPITHTGPSDPKSGCECLLWLDKQPPNSVLYVSFGSGGTLCQEQINELALGLELSRHKFLWVNLRAPNDRASATYFSDGGLVDDPLHFLPLGFIERTKGQGLVMCGWAPQVEVLGHKSIGAFLTHCGWNSVLESVVHGVPMMAWPLFAEQRTNAALVTDGLKVAVRPNVDTSGNSVVVKEEIVKLIKSLMEGLVGEEIRRRMKELQKFAECAVMKDGSSTRTICKLAHKWKSLGRP

SEQ ID NO: 226627 - protein, 780 aa, Glycine max
  Coding DNA Sequence Number=SeqID_109849
  Gene Ontology: Mol. function=Rab GTPase activator activity; Cellular component=intracellular; Biological process=regulation of Rab GTPase activity
  Homolog annotation: Hit_ID=Q84Z87; Match level="QueryCoverage=96%, HitCoverage=94%, E-value=1e-169, Identity=45%"; Hit description =Putative microtubule-associated protein
MDLAIACCYNLHVMCRVARTELLDPPVSWYASLRGRLLVDPHMPKDGSSSPNLVMDNPLSQNPDSTWSRFFRNAEMEKMVDQDLSRLYPEHGNYFQTPGCQGILRRILLLWCLRHPECGYRQGMHELLAPVLYVLQFDVGCLSEVRKLYEDHFTDRFDDLFCQENDLSYSFDFRKSSDLMEDEINSNGNATKIKSLDELDPKIQNIVLLSDAYGAEGELGVVLSDKFIEHDAYCMFDALMNGARGSIAMADFFSYSPLPGSHTGLPPVIEASAALYHLLSHVDSSLHGHLVDLGVEPQYFALRWLRVLFGREFSLSNLLIIWDEIFSSDNSKLEKHAEDNADSGFRIFNSSRGAFISAMAVAMMLHIRSSLLAAENPTTCLQRLLNFPENINVEKLIEKAKSLLALALSTEISSSMPLLVEYHNQGKSAIARSRTLSSESISPKTPLNLVPDSYWEEKWRVVHKAEELKQDGVEKQVPTRKKGWTEKVKFSLKRTESDPSSSRIKSGKKESKSPVRRCLLEDLSKELGFEEDTEKLSCHDDLSATVEEEQGEDGSEGSNNYSPEDRCQSQNTSSEENSPVISCPASPTNETIDHKNDSEKRSVGSNLSLDITNETSLSSPIDSPLPISDHPEKGPQTPGRNNINNSAGNSTTNSKERKLNKFQWLWKFGRNNGEFMSEKGGDAYEAVKPANNCSNQTNGHCSSVSCKGESTDQTVMGSMRNIGQSMLEHIQVIECAFQQDRGQEASLDNMSKIVVVGKAQVNAMSALKELRKISNLLSEM

SEQ ID NO: 226628 - protein, 44 aa, Glycine max
  Coding DNA Sequence Number=SeqID_109850
MEQVDRKSGGRSQPQVCDKCPNVKYERDGHFITVDIKKGIQDGQ

SEQ ID NO: 226629 - protein, 125 aa, Glycine max
  Coding DNA Sequence Number=SeqID_109851
  Gene Ontology: Mol. function=heat shock protein binding; Cellular component=endoplasmic reticulum; Biological process=protein folding
  Homolog annotation: Hit_ID=Q1SDA8; Match level="QueryCoverage=97%, HitCoverage=35%, E-value=3e-56, Identity=85%"; Hit description=Heat shock protein DnaJ, N-terminal
  Pfam annotation: Domain name=DnaJ_C; Domain location=3-124; Score =68.1; E_value=2.8e-17; Accession=PF01556.9; Description=DnaJ C terminal region
MGEEVLFFEDGEPIIDGESGDLRFRIRTAAHDLFRREGNDLHTTVTITLVQALVGFEKTVKHLDEHLVDIRTKGITNPKQVTKFKGEGMPVHMSTKKGDLYVTFEVLFPNSLTEEQKTNIIAIIA

SEQ ID NO: 226630 - protein, 184 aa, Glycine max
  Coding DNA Sequence Number=SeqID_109852
MANNVSDVKEDGFVGGAGAGIGAGKGVLVEAGNYGRCGVEVDGAEGSGKVVEEGAEESGAAKVGGASDLLPLAFLGPLNVTVGSSRLQQFFFIYAKLMAGLRLYKDLESDVTPLALHKVVIKAGNPSLEESCWAMIEIWWEMRSVGGRDQVGVRKNTLSLNECGHVLPKDLQWQAVSIKLKSPP

SEQ ID NO: 226631 - protein, 99 aa, Glycine max
  Coding DNA Sequence Number=SeqID_109853
MSMDEFLAQVAWPGVQPSPSGGGEASAAQEPVLAEEPCARFAQEEAAVQEPTSSAPISPAPISEDTKPSAPAMEPEQPILQDVAAALVLDLNEDQPQDE

SEQ ID NO: 226632 - protein, 293 aa, Glycine max
  Coding DNA Sequence Number=SeqID_109854
  Gene Ontology: Mol. function=nucleic acid binding; Biological process= DNA integration
  Homolog annotation: Hit_ID=Q1S1X7; Match level="QueryCoverage=76%, HitCoverage=46%, E-value=3e-14, Identity=45%"; Hit description =Integrase, catalytic region; Zinc finger, CCHC-type; Peptidase aspartic, catalytic
GIWASFSGQPSKIDKLVLELQEEKVRSLIPLSLSDEILYGVFEELIVVGLWPKLEKIFMTKSTCNKFLLKKRSFGLRMREGTPLKEHLDELNSILMELCEINARTPFHLWKVKSNLYSRQLRLKVSENGEESFASGLSVINSAKGQKKKGKGGKKSKVNLMDICSYCKEPATPDEVSKGSADDYSKMTWVFGYPSYYHISEGKLEPRAKKGFFMGYGDGVMGFQVWSPSKRKVIMSIDVAFDECSMLHFKFGEDLGKVEDVTVQVDEWWDASGSSRRNLDHPLKKSSIIMHVW

SEQ ID NO: 226633 - protein, 63 aa, Glycine max
  Coding DNA Sequence Number=SeqID_109855
MKNSHETEKPLVGLNVEEPNQIMDVDTDGINFPKLQDDKRFRVRLQNQGNGIEDKPGMLNGDL

SEQ ID NO: 226634 - protein, 220 aa, Glycine max
  Coding DNA Sequence Number=SeqID_109856
MAGKFKRLRKVGVDYELMEYSPDDRGDLYLLMISSITFGDIAEDETNDDVEDGMEDFIVDDEDIIYGKLKAVKYLPAFSKGKHSFGKEGQLENHIGKVQIQATKSDDPNKYKSFIPTDMHIAREDSCVNDTDIPERMQLKSYHCGHYDAYLGCGWLRLLFFGLILLTCTFILSSISLVVHKLLVTLTFLWVDPSHMHFYIKQHIFSCSQAFGYSMPTWES

SEQ ID NO: 226635 - protein, 98 aa, Glycine max
  Coding DNA Sequence Number=SeqID_109857
  Subcellular localization annotation: CTP_CleavageSite=27; ConfidenceScore=5.28e-01
MSESELVSSDDQSPPSSTSSIPTIQMVSKSFSERLMGKFFDVSQFDFVYEQSGLWSPPVSRTVFLASPGNICSRDEMLRKLKKAKRNWKKSPMLCIFN

SEQ ID NO: 226636 - protein, 140 aa, Glycine max
  Coding DNA Sequence Number=SeqID_109858
  Subcellular localization annotation: CTP_CleavageSite=59; ConfidenceScore=5.39e-01
GRGKRSEAPTTSAPPETLAPSSSTAPLPPTQTPPGAQPSPSGGGGASATQEPAFEEPVTTATEGEDELTPPEPFYFDTGIHMAQEEETSIDQILEPSSAPIPDDAIPSAPVTEPEQPIQESSVAPALDLNEDQPQDEQDI

SEQ ID NO: 226637 - protein, 246 aa, Glycine max
  Coding DNA Sequence Number=SeqID_109859
  Homolog annotation: Hit_ID=Q1RXL1; Match level="QueryCoverage=16%, HitCoverage=8%, E-value=6e-07, Identity=65%"; Hit description =Uncharacterized Cys-rich domain
MEVRDKVELLPYRDLDELVQLCIRVEQQLKRKSSSKSYGFHSYPTKDQAQGILGATPSKPKDDKEVTLSLNAPTKKTMIMRGQNIYSSHEETTSFPSSSGIEDEVRGEESSEEDYPTTKKTFFYVAHSKVVPWNRCRMYIGDIFVINGNITTMVFHTRLSKHLNLEVDREGDICRALACPAVVVCVMVACAMDAFVLWVRLHIRKVSVDNGKDEIEESNGSKVNEFASIDISTSRRTMVGNENPQI

SEQ ID NO: 226638 - protein, 133 aa, Glycine max
  Coding DNA Sequence Number=SeqID_109860
  Gene Ontology: Mol. function=RNA-directed DNA polymerase activity; Cellular component=intracellular; Biological process=RNA-dependent DNA replication
MIEVVKGKVLKLLDADIINPISDSEWFMVQECIVLGCKVSSTAIVVDATKVAVIAKLPSPNCVKAIRSFLGHARFYRRFVRDISKIVKPMNDHLAKEATFVFSDVCLSAFNLLKEHLTSAPMVVAPDGHYRLN

SEQ ID NO: 226639 - protein, 68 aa, Glycine max
  Coding DNA Sequence Number=SeqID_109861
MEEDEDILIILGHLFMNTRDMVIEVRQGNLTLRMGKRPTDALVEASFPSIGMEDPWKEFLLMRTWIGI

SEQ ID NO: 226640 - protein, 234 aa, Glycine max
  Coding DNA Sequence Number=SeqID_109862
  Gene Ontology: Mol. function=ubiquitin-protein ligase activity; Cellular component=ubiquitin ligase complex; Biological process =protein ubiquitination
  Homolog annotation: Hit_ID=Q1SHI6; Match level="QueryCoverage=79%, HitCoverage=19%, E-value=2e-09, Identity=28%"; Hit description=U box
MAAAGFLANQPKSEQEFTMKLIELSGLDAILSILKTGKMEAKENALSALFRFTCRSYKYQVTTRFDSLNTGSITTKARAATFIGDPSMSTPKLTVAPKPTDCCWLFRSSHVALCSAHGSVCSVNTTFCLLDTKTLPSLIKLLHGEVHATACEEIQTLSTLVLEDFPQRGARVSHDYNALRFILDILNWENLQATSNLEGKVDFPGEGIDSNMTQALSSRPKRTLGRPTHFEDYE

SEQ ID NO: 226641 - protein, 131 aa, Glycine max
  Coding DNA Sequence Number=SeqID_109863
  Subcellular localization annotation: CTP_CleavageSite=81; ConfidenceScore=5.79e-01
MGSPPASTTPPPPPPPPPSSPSPPRPPPTSDASASTPARLLTVGRKGSYYRPWGRDGGILNQTSRGNRPLQPIRTVLTATVCDKYGISKEKWALKTKMAYTSFNKHKHQCKFRANLCTYFLTNIHSHKIFF

SEQ ID NO: 226642 - protein, 288 aa, Glycine max
  Coding DNA Sequence Number=SeqID_109864
  Homolog annotation: Hit_ID=Q47522; Match level="QueryCoverage=21%, HitCoverage=83%, E-value=1e-21, Identity=75%"; Hit description=LacZ protein
MVKSWNSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIKVTGNFIQELGGHTYIMSIAIVMLAINVMCRYAMGTHSVCTWIEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 226643 - protein, 375 aa, Glycine max
  Coding DNA Sequence Number=SeqID_109865
MTGQIREELRTQIKEELRTQLEEENKRSLEIITMALKEAIKKELSHKGSPESLLIQPDIQQLGAPVNTNGSNVVINRKDGTLGLVAMGKIMEGDSVMHIVAYEDDVVRVSVETIIDPEAEVLYATSEIQYVKQAVDTFVAWPTHLVKAVLDEDVEIIPHNEDAHVPKPANVDADDPLRGLIKYSFDIYEKPVEINFDGSCFGIADAPTSIFITYSDVSEIIAGDKSLNISVQQLWLIQTLGQGSMYAFLEPQSLVVSKDRRSECQQYLERWLKESDREVYVGPYFHHVMTKLKTSLSPESKAAAPKWIEVKSHVQTGCYECGYYVMHWMWNIITSEIKSDWSMWFADATSLDIDNITKIRNKWARYFLKTSCKKG

SEQ ID NO: 226644 - protein, 138 aa, Glycine max
  Coding DNA Sequence Number=SeqID_109866
  Gene Ontology: Mol. function=serine carboxypeptidase activity; Biological process=proteolysis
  Homolog annotation: Hit_ID=Q1SGX5; Match level="QueryCoverage=53%, HitCoverage=19%, E-value=6e-18, Identity=55%"; Hit description =Peptidase S10, serine carboxypeptidase
MGKYVGVGELEDVRAFYYSIESKNNPKEDPPMLWLTVALVAHGPVAFNHEQYNGSLPTLILRPQSWTKVLSNSIFISLTQNEHGLPDEDAQNVSQRALLRASEGEAHGCVFQRRKDARSRHQRLFVENVGKTEGNRSK

SEQ ID NO: 226645 - protein, 90 aa, Glycine max
  Coding DNA Sequence Number=SeqID_109867
MKLASTDNTYTVTLTKLTFEVDLCLCFMLSISSKRMDESTNRHNDNLGVNKMGKNIRKTKRDQPNYGKNNNSSMNGVDSNSNTNSLSFTT

SEQ ID NO: 226646 - protein, 214 aa, Glycine max
  Coding DNA Sequence Number=SeqID_109868
  Homolog annotation: Hit_ID=Q2HRX8; Match level="QueryCoverage=48%, HitCoverage=15%, E-value=5e-09, Identity=45%"; Hit description=IMP dehydrogenase/GMP reductase
MVRTRGLGYALARVIGRGRQDEHDAVDVPWRRRPTASVRRQRVHIAVDEGVSQVTEDVPHMAKDVPQMTEDVPHMADDVPQMSEDAPQMTADVDATVAEDLGRNGAKGSHADEGFPGGPRDPSVLTSFAEHVADAIWTGQERPELKLVSHGRKVALIGRPVPKIEAGCRHKIKSIDRVLSCNRRSWTYIRICGEEAQRDQHLPPSSRRVDDHTR

SEQ ID NO: 226647 - protein, 105 aa, Glycine max
  Coding DNA Sequence Number=SeqID_109869
  Homolog annotation: Hit_ID=Q1SMF0; Match level="QueryCoverage=87%, HitCoverage=17%, E-value=2e-10, Identity=36%"; Hit description =Tetratricopeptide-like helical
MDEDQWIVNEQHVDCSDGFNTSQVFATRDDILQCAQSVAHENGFVTVIMKSDTNTGIRGKTSFVLIGCKRSGQYRSRKKDFVRRDTGSRKCGCPFKLHGKSVVGG

SEQ ID NO: 226648 - protein, 160 aa, Glycine max
  Coding DNA Sequence Number=SeqID_109870
  Homolog annotation: Hit_ID=Q2QQD4; Match level="QueryCoverage=35%, HitCoverage=19%, E-value=2e-08, Identity=53%"; Hit description=Helix- loop-helix DNA-binding domain containing protein
  Pfam annotation: Domain name=HLH; Domain location=97-144; Score=10.9; E_value=0.01; Accession=PF00010.16; Description=Helix-loop-helix DNA -binding domain
MAGDRPIHLCFLYLIIYHTTTRNNNNNNKRTHVLFIARALTTPTLASNFLDKFVVPYHNYFSFQVEELQQQLYEVPQCGSTCVDLQCEKKGCERIVSPQIIAMRERTRNITEKTQQLGKLIPGGPKMNVAEMLNASTKYVKFLQAQVGMLELVNTVETNA

SEQ ID NO: 226649 - protein, 96 aa, Glycine max
  Coding DNA Sequence Number=SeqID_109871
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q2HTG1; Match level="QueryCoverage=80%, HitCoverage=13%, E-value=2e-25, Identity=75%"; Hit description=GTP -binding signal recognition particle SRP54, G-domain
  Pfam annotation: Domain name=SRP54; Domain location=42-96; Score= -129.5; E_value=0.082; Accession=PF00448.13; Description=SRP54-type protein, GTPase domain
MSSPGLTILQVPKAIYRCSLFHMRHLECIRQEVSELVFAKFGPTIILLAGLQGVRKTTVCAKLANYLKKQGKSCMLVAGDVYKPVAIDQLAILGKQ

SEQ ID NO: 226650 - protein, 310 aa, Glycine max
  Coding DNA Sequence Number=SeqID_109872
  Gene Ontology: Mol. function=DNA binding; Cellular component=nucleus; Biological process=regulation of transcription, DNA-dependent
  Homolog annotation: Hit_ID=Q8H0H3; Match level="QueryCoverage=96%, HitCoverage=92%, E-value=2e-69, Identity=50%"; Hit description =Hypothetical protein B25
  Pfam annotation: Domain name=Myb_DNA-binding; Domain location=13-60; Score=37.7; E_value=4e-08; Accession=PF00249.21; Description=Myb -like DNA-binding domain
  Pfam annotation: Domain name=Myb_DNA-binding; Domain location=67-112; Score=43.8; E_value=6e-10; Accession=PF00249.21; Description=Myb-like DNA-binding domain
  Pfam module annotation: Pfam domain module=Myb_DNA-binding::Myb_DNA -binding; Domain location=13-60::67-112
MHGKKEQEEYIRKGPWKAEEDEMLLKHVKKYGPRDWSSIRSKGLLQRTGKSCRLRWVNKLRPNLKNGCKFSLEEERVVIELQAQFGNRWAKIASYLPGRTDNDVKNFWSSRQKRLARILQTSATPKSQKNKTRVPSLHDVPILQPPKFSSPSEGEPSSKPQSCSLPYIDNSEVIKMVSLPDLIKSELPSSDTIHVEQEFTLFENYKSTEQIAFPQIPELQNGLTFSMENQDLLPTIDEPCFIEELCPLDASEFGIGPQHPIGFPFFQPPGSCRLGTGDAIDNSKISDSFFDDFPVDMFDHMDPPASPSNL

SEQ ID NO: 226651 - protein, 109 aa, Glycine max
  Coding DNA Sequence Number=SeqID_109873
  Homolog annotation: Hit_ID=Q8LE79; Match level="QueryCoverage=58%, HitCoverage=22%, E-value=7e-14, Identity=57%"; Hit description=PRIB5 protein
MNLYDTMCAVCMHAVFTTRPRFKFRHVSLKVGTLQEPPPKIKGIDWDVIADDDVGVVAGGDGRECNDDFGGGLDASEEGRDEDAVESEREVVAELATRGEGSDPTLLDK

SEQ ID NO: 226652 - protein, 173 aa, Glycine max
  Coding DNA Sequence Number=SeqID_109874
  Subcellular localization annotation: CTP_CleavageSite=57; ConfidenceScore=5.61e-01
MGAPVMAPPPSLASPVPPSVVLTSTSSSSSSCPHVPLHNIYTSNDVDSLCGIGSGPACHEFAKVFLQRSLAILEKNGQQHQEALSKRVERPKVASDIVTFAEVVKSNHQLSSKVGYVLIKLLHSRLDGDELFKRCKGLQEEKKDLASKVEGITMERDKLSKLIVELEAQLKGE

SEQ ID NO: 226653 - protein, 300 aa, Glycine max
  Coding DNA Sequence Number=SeqID_109875
MSSFLSDSAIDMGGNDSRDSIQQPLMDQEVIFIGSSSKEDTRSNASDNESSSLERLRVSCHTGGGTSRLHRKTWPSATSPARELIPVIVILSPSFSKGARTSGRDIRASPHVRRSHSVGSPSSSPIVTGYDCVRDDILKYKSSLTFAVSVAAMQCQVKLANLDDSWKSVPIKFKSFDKDLLTLMERVDKDILEQLSASLNARAILSLPSESDPLVALNRIMDVFPWRPLVKQVVPIVGATEVTLGAPSSILAKRKRDGATRVSGFGVPTEVFALVVVAILVPAKVVVVTLALPPPPAVHV

SEQ ID NO: 226654 - protein, 58 aa, Glycine max
  Coding DNA Sequence Number=SeqID_109876
MGPCTRSGRCGTTPSDVRKKAQGIQKQNTAPHVSSNTLDWLHGRPAALPPCLLKNYSS

SEQ ID NO: 226655 - protein, 109 aa, Glycine max
  Coding DNA Sequence Number=SeqID_109877
MKQAIKILALPCMGMALLFSASAISAPEAPAAKAVPPAADEPMRMPPFPGGHPPKPGFCHGGELFCATSVSDNPVETINKLTAVIPAGSAKHYEVRVAVVAVPDAPPAR

SEQ ID NO: 226656 - protein, 40 aa, Glycine max
  Coding DNA Sequence Number=SeqID_109878
MEVDTIGMMWMDDDAKALDVKVSKLLSLAASDSYWTIPNN

SEQ ID NO: 226657 - protein, 86 aa, Glycine max
  Coding DNA Sequence Number=SeqID_109879
MKAYCSHSLESGAPKVVKSNHQLSSKVGYVLIKLLHNRLDGDELFKRCKGLQEEKKDLASKVEGITMERDKLSKLIVELEAQLKGE

SEQ ID NO: 226658 - protein, 361 aa, Glycine max
  Coding DNA Sequence Number=SeqID_109880
  Gene Ontology: Mol. function=RNA-directed DNA polymerase activity; Cellular component=chromatin; Biological process=chromatin assembly or disassembly
MAEPGDDGGEYHQLDRSQCLLLYVVTTQMQCLLNCNNEGLYRRINGLENQLNQNAGRHYGGNRRGNDGPRKNRIEGLNMYSPAMIILKSRRKEGLEIDTWTEMRRVMQKRLSKGSLTVEEYYKEMKMALVKANIEEETKDTMARFLSGLNLDEKNSKKELIQHLQPELDQQIQEGGRQLVQPINTLSTWKFSNAQTMIMKADGEITSESEINEEEEVEEKLEEEAMQGDMLIVRKLLGRSCTNVVSSRLVSKLTLDTKSHPRLYILQWLSEDEEVKITQLVEYDTKGVHDSFTNKISFQHHDQKIILKPLSPREVCDDQIRMRENREQEKERSEAPKRNRKKKSDTHERKFNCLAKASVEG

SEQ ID NO: 226659 - protein, 458 aa, Glycine max
  Coding DNA Sequence Number=SeqID_109881
  Homolog annotation: Hit_ID=O22159; Match level="QueryCoverage=89%, HitCoverage=80%, E-value=2e-52, Identity=32%"; Hit description =Expressed protein
  Pfam annotation: Domain name=DUF247; Domain location=22-433; Score =363.2; E_value=4.1e-106; Accession=PF03140.6; Description=Plant protein of unknown function
MGSTVEYHIQHIINIPEQIEPALWPECCIYKVPTSLLKVKEVAYTPLLISIGPVHHNKEQLMEMQEQKHRYFHFFWARLSLVNKLDLVQYKAFLELEERNLRCCYQKKFPEISKEQFVEMMLLDAVFIMELFLREAKKWEHKDDYLMTQGCVSKSIQCDLMLLENQLPMLVLEKLYDRVVPSNAKNHTRFINLAHEYFRSYYPHQHSSENKFELRKWEKSLHFTDLIRNAYLPKKLSSQMKYSQQECVLRTATKLNEAGISFEKVHDRCLLDVKFEKKRFFSWFLCLGCLPCCKLFKARFQIPQLKVDHTTECVLRNLIAFEQCHYPKEPYVCNYVSLIDSLIHTKDDAELLVEKEAIVHELGSDQDLATLVNGLCKHVVTNSTCYHQIMKAVNEHYNNDWKWAMGTLRWVYFRDPWRSSSTLVGVAVLVFTIFNFYRVTDLLFCLCVFWAVGSTFGG

SEQ ID NO: 226660 - protein, 576 aa, Glycine max
  Coding DNA Sequence Number=SeqID_109882
  Homolog annotation: Hit_ID=O22159; Match level="QueryCoverage=70%, HitCoverage=78%, E-value=7e-55, Identity=32%"; Hit description =Expressed protein
  Pfam annotation: Domain name=DUF247; Domain location=155-564; Score =378.2; E_value=1.2e-110; Accession=PF03140.6; Description=Plant protein of unknown function
ATMEFDNPSYVEDASLTVPEENNISNQTLPISVNGRIEPHHQGGGESSVKDQIKFGNNVFEAKKMMEEELVEVKDGDTKINQYYLRNIRLEDEVLQGLHTMRQEFDSSMVIASQNKRESLDDFVIFLVKEAQARRNRKRDLIDRIIDIPEEIEPELGFECCIYKVPTSLLNVQEEAYTPLLISIGPIHHNKKGLNEMQEQKRKYFRFFWNRLENKLDLENYIGFLEQHEQNIRACYQKKFSDISKEEFVEMMLLDAVFIMELFLREEKRLEHKKDYLVTQRCVSKSIQRDLMLLENQLPIVMLEKLYDRVVPKNVKKHKKFIHLAHEYFRFYYPHQHSSENKFELRKWEKSLHFTDLTRNVYLPKKLRSQMKYSQQECVLRTATKLNEAGISFEKVHDRCLLDVKFEKKRFFSWFPCFGCLPCCKLFKARFQIPELRVDHTTECVLRNLIAFEQCHYPEEPYICNYVSLIDSLIHTKDDAEFLVEKEAIVHGLGSDQELANLVNGLCKNVVINSTCYHQIMEDVNGHYNNNWKWAMGTLRWVYFRDPWRSSSTIVGIAILVFTVFNFYRVTDIIFS

SEQ ID NO: 226661 - protein, 194 aa, Glycine max
  Coding DNA Sequence Number=SeqID_109883
  Gene Ontology: Mol. function=nucleic acid binding; Biological process= DNA integration
  Homolog annotation: Hit_ID=Q1SDG1; Match level="QueryCoverage=97%, HitCoverage=18%, E-value=5e-27, Identity=33%"; Hit description =Integrase, catalytic region; Zinc finger, CCHC-type
MMEEGFDVNKTPMFKRANYDYWKEMMIAFFESAHIDMWDVVEKDNHILLDDQKNEILRDKWMDDHKSKFLLNSRARNTMLCALSQYEYSKVHSFNKAKHIMEEGEDIQTMFGRFQTILNKLRSLGRHYDNYDHFDKILQSLSRKRRTQVTTLRAIKNLDSMTLEELFGILKFHKQELAQDEGTKKRKSLALTVQ

SEQ ID NO: 226662 - protein, 62 aa, Glycine max
  Coding DNA Sequence Number=SeqID_109884
MKGGCGRMRFDRERRKRNCPGKKQMEISSFRERNDYGTKERYAAGYPVHRWYHPDRLDFDRN

SEQ ID NO: 226663 - protein, 94 aa, Glycine max
  Coding DNA Sequence Number=SeqID_109885
SGAKLSSWAKRISTAKRGFTALSAKENLAEHQHQSRALIVISRRDFRAYLKPVLCRIREQLSTAFTASTDGQGTDFQSSHRPIWEKSPRSRKKE

SEQ ID NO: 226664 - protein, 196 aa, Glycine max
  Coding DNA Sequence Number=SeqID_109886
MDIDVGSIISGQISQMAQSNSSQLGFPALITTLYIARGVIPDSLTFESLSPTFNLAYIRKNCWSSDDPMITFPGTCKTRAWGPSSSPTSTSSYPSSTHSANRPLRSELRRHSANVAEPSPWLMPGDAEHTRPGSASAHHQYGGYYGPAEEPQPEPEATPEETPEDTSAATPTKVTVEGDTAVDTNYATDMATAQGT

SEQ ID NO: 226665 - protein, 372 aa, Glycine max
  Coding DNA Sequence Number=SeqID_109887
MTRSARQIRSASGICLARHLARLAENAPEEAEKTEGQQLRELRLKGVKSRWMYSVEQYMKFLKGYTKNLHHLEASIVITEEAIEFCSEIRQFKSNLTSKWVLEHDKEGKDDKVCKKDPSWEAIQKQNIAPHMLSRGGYDFLEEKKLIEEKQKKRLEEASQSGSIDTVVDPPSPIRRHMKWKMTCLKKTGQMTSEVAKEIADRIASQGSFVSHGPQDVLIVVIGQPEHPGRVHDAGVSVTIKHYIGSASRGSLTSFSMPDAIAKSQGLALPPEADVGPSAAHESTNVHNIRLGNDQLKVGFEEVQDVDAHVPVPTQEVFPYYNPKTFLLSSPIKPPWKHAQGVVFDVPTHEEAKVGTCELVPRAGKSGNRFHG

SEQ ID NO: 226666 - protein, 105 aa, Glycine max
  Coding DNA Sequence Number=SeqID_109888
MSRLNVHAMNIFPERNVKLQIMQYDEFCQELDRHRWSRALTRQPDNHIDVALVKEFYANLYDLEDKSTRQELIARLCIPRRGFVLNVEGAPWKLLKKDLTTLAQT

SEQ ID NO: 226667 - protein, 226 aa, Glycine max
  Coding DNA Sequence Number=SeqID_109889
  Homolog annotation: Hit_ID=O22159; Match level="QueryCoverage=88%, HitCoverage=35%, E-value=6e-26, Identity=35%"; Hit description =Expressed protein
  Pfam annotation: Domain name=DUF247; Domain location=2-210; Score= -60.3; E_value=2.2e-07; Accession=PF03140.6; Description=Plant protein of unknown function
MHLVCTRYFYLPSDWLRSSGCALHVLRTATKLQDSGVSFEKDVERRLLDISFDKKPILSSFLCFGCLPYLNHFKARFRIPQLKVDHTTECVFRNLIAFEQCHYPEKPYICNYVSLIDSLIHTQLDVELLVEKEVIVHELGSDKEVAVLVNGLSKHVVANTTCYYETINELNKHYQNIWNRTMAALWLVYFRDPWRASSTLVGIVVLIFAVFQFIRAARAVLGYDKS

SEQ ID NO: 226668 - protein, 800 aa, Glycine max
  Coding DNA Sequence Number=SeqID_109890
  Gene Ontology: Mol. function=RNA-directed DNA polymerase activity; Cellular component=chromatin; Biological process=chromatin assembly or disassembly
  Pfam annotation: Domain name=Chromo; Domain location=715-765; Score =21.1; E_value=0.0032; Accession=PF00385.14; Description='chromo' (CHRromatin Organisation MOdifier
  Pfam annotation: Domain name=rve; Domain location=413-569; Score =107.6; E_value=3.7e-29; Accession=PF00665.16; Description=Integrase core domain
  Pfam module annotation: Pfam domain module=Chromo::rve; Domain location=715-765::413-569
MPFGLSNVSSTFQSAMNDTLRPFLRKYVAVFFNDILVYSSNLDTHVSHLESILATLSDKQFLLRHSKCLFAQSQLNYLGHIISAQGIAPDPEKIFVMLAWPIPVSPTALRGFLGLAGFYRKFIKGYAAIAFPLTSLLRKDKFSWSPEAHTAFTPLQQAMISAPVLANPNFSLPFTIETDTSATAMGAMLLQEDHPIAFYSKVLCPRLQKASAYIRELHTITSSVRKWRHYLLGATFTILTDHRSLKDLMTQLLGYDYTIRYKPGAANVVADALSRITPPEATCLALTMPHSLFLSELRQTLLQDPRYVTLLQDIQSTPANHPEFSLHHDLILRKKRIWIPFPCAITQSLLEEFHASPIGGHFGTAKTLHRLQQNFDWPIIRADVRQFVAQCSVCQQMKYETCKPAGLLQPLPIPTSVWEDQALDFITGLPPLQGFTVIMVVVDRFSKAAHFAALPTHHSAYKVAVLFLDTACKLRGFPRSLVSDRDPIFISHFWRDLFKLSGTKLRMSTAYHPQTDGQTEVLNQTLEQYLRAFVHHQPSRWFRFLSLAEWSYNTTIHFGTGLSPFEVVYGRPPPTVVQYLQGSSTIEVVDQLLTSRQDMHAQLQQRLRKVQESMKASADKHRRDFSVAVGDWVYVRLRPYHQVSVAPSYHKLAKRFYGPFEVVERIGAVAYRLLLPASSRIHPVFHISLLKPHKGPLPATPATLPSASLDHHPLPAPLHILDWKLDHSVDPPVTLVLVQWDGMAPEESTWERWEELCQAHNLEDKVAFGDGCIDSNTDSSNSRPRRISRRPNYLKEYVQA

SEQ ID NO: 226669 - protein, 209 aa, Glycine max
  Coding DNA Sequence Number=SeqID_109891
  Subcellular localization annotation: CTP_CleavageSite=24; ConfidenceScore=5.03e-01
MSTQSSFFSDAGPSNMMARTRFTVAFRVQKNIIEVPLSYHSQWRPYYPTSVLFDYNGTKHFIRVRKYDTRCFFADGLKEFRRTHDINDSVIIRFFAASKDTSLEVDIMGPILRQTCQRPVVTTRRHIFTVDVTQDMIEHTNPLRPNGTQNQWQITVHNGLPSVANPWFQYLYENKLMAGDEVMFFFRFDKHVWEVIFRKQVMWDEDLPV

SEQ ID NO: 226670 - protein, 78 aa, Glycine max
  Coding DNA Sequence Number=SeqID_109892
  Gene Ontology: Mol. function=DNA binding; Cellular component=nucleus; Biological process=regulation of transcription, DNA-dependent
  Homolog annotation: Hit_ID=Q6R048; Match level="QueryCoverage=94%, HitCoverage=20%, E-value=2e-16, Identity=52%"; Hit description=MYB transcription factor
  Pfam annotation: Domain name=Myb_DNA-binding; Domain location=1-46; Score=58.8; E_value=1.8e-14; Accession=PF00249.21; Description=Myb -like DNA-binding domain
KGPWSVEEDQILIEAHKIYGNKWTKIGERLPGRTENTIKNRWNGTKRRQNFKKHNKNNQTPYEGSMLHAYIKKVTATK

SEQ ID NO: 226671 - protein, 107 aa, Glycine max
  Coding DNA Sequence Number=SeqID_109893
  Gene Ontology: Mol. function=transferase activity; Cellular component= mitochondrion; Biological process=DNA integration
  Homolog annotation: Hit_ID=Q1S0G2; Match level="QueryCoverage=86%, HitCoverage=11%, E-value=2e-34, Identity=70%"; Hit description =Peptidase S8 and S53, subtilisin, kexin, sedolisin; Polynucleotidyl transferase, Ribonuclease H fold
MLILEGDVLLTDQDEPVTYQEAIIGPKYEKWHKAIGSEMESMYTNQVWTLVDPPKGVIRCKWVFKNKIDMDGKVSTFKAWLVIEGFKKVHGINYDKTKGVHGYGSIS

SEQ ID NO: 226672 - protein, 79 aa, Glycine max
  Coding DNA Sequence Number=SeqID_109894
MAPKKPPTKRSRKDVTGEGYSAAPQVDVEFDGHRLVVLQGEASPAEGQRVCQVSGGNCQEAMDSARSTHDAILPRKGIG

SEQ ID NO: 226673 - protein, 96 aa, Glycine max
  Coding DNA Sequence Number=SeqID_109895
GSFMTNGIELFGYCESLAGLMGTQAERNEEKATCVHGSGDLGDVRWGAIAQNQAWPIPNQPGHNQSVRTCDIPKQASSWQSTNKRTKVHEARRLVW

SEQ ID NO: 226674 - protein, 259 aa, Glycine max
  Coding DNA Sequence Number=SeqID_109896
  Homolog annotation: Hit_ID=Q83QQ7; Match level="QueryCoverage=54%, HitCoverage=77%, E-value=6e-73, Identity=85%"; Hit description =Putative transporting ATPase
  Pfam annotation: Domain name=DUF462; Domain location=32-199; Score =351.7; E_value=1.2e-102; Accession=PF04315.3; Description=Protein of unknown function, DUF462
  Pfam annotation: Domain name=YfcL; Domain location=168-254; Score =167.2; E_value=4.1e-47; Accession=PF08891.1; Description=YfcL protein
  Pfam module annotation: Pfam domain module=DUF462::YfcL; Domain location=32-199::168-254
MAGQFIGARAGSRLVLSKGQSLIRPMIVIVSAQHHYQQLVEIFDKCFADDFNTCVIKGDDEPIYLPADSEVPYNRIVFAHGFYASALHEISHWCIAGKARREQVDFGYWYCPDGRDAMTQSKFEDVEVKPQAFDWLFCTAAGFPFNVSCDNLEGDFEPDRIAFQRRVHAQFESRILALIDDMVDHASDDELFAGGYLRGHLTLAVAELEGEGEHTAQAINDKVASSLEKAISAGELSPPDQILVQGMWNNLYQQAKNQA

SEQ ID NO: 226675 - protein, 55 aa, Glycine max
  Coding DNA Sequence Number=SeqID_109897
MRMRKWRKELEYPKPRGVVGFYSKNLCASLMVSPFEILDRKAKEKRRGEAPSTRE

SEQ ID NO: 226676 - protein, 308 aa, Glycine max
  Coding DNA Sequence Number=SeqID_109898
  Gene Ontology: Mol. function=DNA binding; Cellular component=nucleus; Biological process=regulation of transcription, DNA-dependent
  Homolog annotation: Hit_ID=Q9PTJ4; Match level="QueryCoverage=25%, HitCoverage=15%, E-value=8e-18, Identity=48%"; Hit description =Transcription factor cmyb
  Pfam annotation: Domain name=Myb_DNA-binding; Domain location=249 -295; Score=54.1; E_value=4.8e-13; Accession=PF00249.21; Description =Myb-like DNA-binding domain
  Subcellular localization annotation: CTP_CleavageSite=28; ConfidenceScore=5.27e-01
MDFGSSFQRPQYLSSLFPRNSCLMPQTQAMFPSQNSIHVPLSPPLPAMFHPNNTFHHFQDPIMNGPTHNPPFAMNGPFNPITTPMYGIPTPALGDGSSLSGFVNVHHHHPVTLAPNNNKMEGLVSHNPSFIMNGPSNSITTPMYGIPTPSLGDGSSLGGFVNIHHHHHVTLDPNNNKMEALYGHHKGKHILDFSQNAMMHPYEASSSKSPLPFSLSNVYEWGISEYHQDIDWKVKMTNDSNIANDKIIKGQWTSEEDSALLELVNQFGPKKWSQIAKLLHGRIGKQCRERWYNHLQPNIKVFSFLFIT

SEQ ID NO: 226677 - protein, 206 aa, Glycine max
  Coding DNA Sequence Number=SeqID_109899
MLLPLSLTKGSNDLSAFLSQLLPNAVEKVDENVSIVVAVAAKVGTYKRVVSRLKKCLVLKESGMANSETCPVTLHAIQLGVCVHDLRGDEIGFLLHDKARRISLIQLPKHPLFRPFTSSYKNFKTSYFKARRARMAVVGEPMPNADANWAPGPCEVPTNVVSPLPPSKDPRGKQKHKKWSHQDYRSGLGEHSGQKEPGGLSACLVK

SEQ ID NO: 226678 - protein, 72 aa, Glycine max
  Coding DNA Sequence Number=SeqID_109900
MWSSAPFLEMSASSGRDYFSLTTSADPDPRVRWQAEIPKWLSVQRQHLLILTQESGGKRKYPSGYPYKDNTC

SEQ ID NO: 226679 - protein, 116 aa, Glycine max
  Coding DNA Sequence Number=SeqID_109901
MAKVKNEDPKNANTNVKDEESPIEEVSLIVKNTDTNVQGMKSKKSLQIQTFSDLIGVGGDEEFSKVSMYLIIASVGLQGMLKLTTVTKSNSLSSYRSKTTVLKGDEEGLGHEGLRD

SEQ ID NO: 226680 - protein, 307 aa, Glycine max
  Coding DNA Sequence Number=SeqID_109902
  Gene Ontology: Mol. function=transition metal ion binding; Cellular component=nucleus; Biological process=cytoskeleton organization and biogenesis
  Homolog annotation: Hit_ID=Q75LM3; Match level="QueryCoverage=95%, HitCoverage=29%, E-value=9e-56, Identity=40%"; Hit description =Putative transposase
  Pfam annotation: Domain name=Transposase_21; Domain location=156-303; Score=86.8; E_value=6.8e-23; Accession=PF02992.5; Description =Transposase family tnp2
MQRGFQSEPFDVQMGDHLEDMIRDLGQESFQQAHVLMYDTFQADSNKLMYPRCNNSLTMLLAVLSLVNLKARYGWSDKSFSSLLQVVHDMLLEENMLPKVYYQTKKILCSMDMEYQKIHACPNDCILYRHEFEEMLKFSQYGVWRYKVKGDDKYSSDDNSKKGPLTKGKEERNLRLGLATNGMYLFGNLSIQHGSWPVLQVIYKLPPLLGMKQKYMILSIMISGPRQLGNDIDVFLSPLIGDLRKLWDEEVSVFDGFRNETFHLHAMLFCTINEFPAYENLSGYNVKGHHAYPICEEEISYIQLKHG

SEQ ID NO: 226681 - protein, 123 aa, Glycine max
  Coding DNA Sequence Number=SeqID_109903
  Subcellular localization annotation: CTP_CleavageSite=67; ConfidenceScore=5.17e-01
MKAMFDCDGYLAKKLTMCLNELSLVPTSSTGSVVQSKFVPNLGEALGKNGSGQTSMRSFNGDFPPWRCSRRQRRIGEGRHHPLGNKPWKKELHHQKCALDKKLEEDALMEEKKERRGSTKLKE

SEQ ID NO: 226682 - protein, 123 aa, Glycine max
  Coding DNA Sequence Number=SeqID_109904
  Gene Ontology: Mol. function=DNA binding; Cellular component =chromosome; Biological process=chromosome organization and biogenesis (sensu Eukaryota)
  Homolog annotation: Hit_ID=Q43312; Match level="QueryCoverage=84%, HitCoverage=87%, E-value=8e-37, Identity=69%"; Hit description =Protein H2A.7
  Pfam annotation: Domain name=Histone; Domain location=19-76; Score =51.5; E_value=2.8e-12; Accession=PF00125.14; Description=Core histone H2AH2BH3H4
MASRGKTQGSGTTKKGISRSNKAGLQFPVGRIARYLKIGKYADRIGSGAPLAGNAAMDNKKTRIMPRHIQLAVRNDEELSRLLGDVTIASGGVTPNIHNMLLPKKVGTSTSTFMGPSADDDDA

SEQ ID NO: 226683 - protein, 607 aa, Glycine max
  Coding DNA Sequence Number=SeqID_109905
  Gene Ontology: Mol. function=actin binding; Cellular component =phragmoplast; Biological process=actin cytoskeleton organization and biogenesis
  Homolog annotation: Hit_ID=Q1SGQ9; Match level="QueryCoverage=80%, HitCoverage=48%, E-value=1e-172, Identity=65%"; Hit description =Pyridoxal-dependent decarboxylase; Actin-binding FH2
  Pfam annotation: Domain name=Extensin_2; Domain location=1-290; Score= -124.8; E_value=0.019; Accession=PF04554.4; Description=Extensin-like region
  Pfam annotation: Domain name=FH2; Domain location=134-542; Score =489.9; E_value=3e-144; Accession=PF02181.13; Description=Formin Homology 2 Domain
  Pfam module annotation: Pfam domain module=Extensin_2::FH2; Domain location=1-290::134-542
CTRPPFELNPPPGRVANNGVLPLKPPPGRPDLLPPDPCSIKPSDSSIVPSPPPPPPPPPGPPPPPPPPSGGPRPPPPPSNGPRAPPPPPLRGKPGPRPPPPPRVGGGPPRAPPPFGSKVAKTQEEVGANSEGDQANATNKAKLKPFFWDKVQANSDQTMVWNQLKAGSFQFNEEMMETLFCYNTTPVDKSKGQQKKETSSPAASPQYIQIIDSKKSQNLSILLKALNVTIEEVCDALLEGNELPTEFLQSLLKMAPTSEEELKLRLFNGNLAQLGPADRFLKALVDIPFAFKRMEALLYMGTLQEELTSTRESFAILEVACKTLRSSRLFLKLLEAVLKTGNRMNDGTFRGGAQAFKLDTLLKLSDVKGVDGKTTLLHFVVLEIMRTEGIRAARMAKESHSFSSIKTDDLLEDISFESEDQYRELGLQVVSRLSSELENVKKAAALDADALIGTTSRLGHGLIKTRDFVNKDLSDIDDDKGFHETVKSFVEKAEVDVTSLLEEEKQIMALVKNTGDYFHGDSGKDEGLRLFMIVRDFLVMLDKECKEIKNAPKKPVVKNVKREASNHSRKSSSSENHPLPSDIRQRMFTAVVANTRMDDFSSDDESP

SEQ ID NO: 226684 - protein, 124 aa, Glycine max
  Coding DNA Sequence Number=SeqID_109906
  Homolog annotation: Hit_ID=Q1T0T2; Match level="QueryCoverage=27%, HitCoverage=55%, E-value=8e-08, Identity=85%"; Hit description =Transcription factor, MADS-box
  Pfam annotation: Domain name=SRF-TF; Domain location=32-82; Score =38.7; E_value=2e-08; Accession=PF00319.9; Description=SRF-type transcription factor (DNA-binding and dimerisation domain)
MIDCQVLQLRNDPNPAVREAAILCIEAILTRSFTEKDYKKITVATTRTLQMIKKAKELAILCTAQVGLVIFSCTRKLYEYASTSFTKNAPYLCKKDGIVLQCLHDYNEYLDYLLRTQNVLTASD

SEQ ID NO: 226685 - protein, 63 aa, Glycine max
  Coding DNA Sequence Number=SeqID_109907
METTNQKHNLLRSIHELIRKDEFVGSKLITDRARMRFQIVPMSNILGQHRGKYFSLPRKKDKV

SEQ ID NO: 226686 - protein, 222 aa, Glycine max
  Coding DNA Sequence Number=SeqID_109908
  Gene Ontology: Mol. function=actin binding; Biological process=actin cytoskeleton organization and biogenesis
  Homolog annotation: Hit_ID=Q1SGQ9; Match level="QueryCoverage=73%, HitCoverage=17%, E-value=2e-38, Identity=51%"; Hit description =Pyridoxal-dependent decarboxylase; Actin-binding FH2
MAIQQYMGIITVIFCIILAFNIMAVVSIEEKKTQEEFIGQLFDPASGLLTEDTAEVLWITCREDFILLKKEVGDLDLCLPKESYRNTNEISSAIGSIARENIKKLISTCYPQLKENVLHCLRKNNFPFNVLQQEGDSKIWHATYMGSLSSRRYLGRVFPQHVSEISIKEDESPKRNKPKDQDSDKKDKKKKSKSSDSKDENKNTSNGYNYNSGNFSCCIVLF

SEQ ID NO: 226687 - protein, 250 aa, Glycine max
  Coding DNA Sequence Number=SeqID_109909
  Gene Ontology: Mol. function=protein-tyrosine kinase activity; Biological process=protein amino acid phosphorylation
  Homolog annotation: Hit_ID=Q0WN89; Match level="QueryCoverage=72%, HitCoverage=33%, E-value=3e-39, Identity=47%"; Hit description =Protein kinase like protein
  Subcellular localization annotation: CTP_CleavageSite=30; ConfidenceScore=5.14e-01
MKARTFKMQKLPMCLPLAWRSPTTLPLPPMTETVFRVLFHKKIHFVPNRRRSSALPKARDVDLVEFDMKDVFLHIKLMEQASESDQPTIFTQEECDYEVQGSALRLTFACNSSIFEKKGFTLGVVLLVVQSGHDKLVRIRVESTLMFATKRPKTGAMKLPFGLCGCQEENSKGGELVEIEEETSDGYRGKEFQDSGQRIQLQVPLPSSSFVVLVDEWQTIKSGGDEIEKLLLNLRSLINQEQSMPIGSCP

SEQ ID NO: 226688 - protein, 76 aa, Glycine max
  Coding DNA Sequence Number=SeqID_109910
MSGILRMAKGYVVSLCILGCLAQDVEKWKGMPIKSKSCDKALNFSLLAMRLKALAIIHGASHRVAFLAKAAGLEST

SEQ ID NO: 226689 - protein, 647 aa, Glycine max
  Coding DNA Sequence Number=SeqID_109911
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=99%, HitCoverage=87%, E-value=0.0, Identity=70%"; Hit description=Kinesin, motor region; Prefoldin
  Pfam annotation: Domain name=Kinesin; Domain location=260-627; Score =466.9; E_value=2.4e-137; Accession=PF00225.13; Description=Kinesin motor domain
  Pfam annotation: Domain name=Prefoldin_2; Domain location=118-212; Score=1.1; E_value=0.013; Accession=PF01920.10; Description =Prefoldin subunit
  Pfam module annotation: Pfam domain module=Kinesin::Prefoldin_2; Domain location=260-627::118-212
MMDYIKRLKVCIRWFQDLEISYSLEQEKLKSSLELAQQKCTEIELLLKIKEEELNSIIVEMRRNCTSLQEKLVKEETEKTVAAESLVKEREARLNFERSQSTLQEDLGRAQRELQSANQKILSLNDMYKRLQDYITSLQQYNGKLHSELSTVENELKSVEKEKATVVETLTMLKGQLTLSMASQEEATKQKDALASEVTSLRVELQQVRDDRDRQLSQAQTLTSELEKSKDFTEKSCSELNKLTLRTNELETKCALQDERIKVLQEKLTTAEEKLQVCDISASETRIEFEGQQKLVHEMQRRLADAEYKVIEGEKLRKELHNTILAKNILSHMIKFFAPDTSQEEVFIEISQLVQSALDGYKVCIFAYGQTGSGKTYTMMGRPGHPGEKGLIPRSLEQIFQTKQSQQPQGWKYEMQVSMLEIYNETIRDLLATNKSSADGTPTRVENGTPGKQYMIKHDANGNTHVSDLTVVDVQSVKEVAFLLNQAASSRSVGKTQMNEQSSRSHFVFTLRIYGVNESTDQQVQGILNLIDLAGSERLSRSGSTGDRLKETQAINKSLSSLSDVIFALAKKEDHIPFRNSKLTYLLQPCLGGDSKTLMFVNISPDQASSGESLCSLRFASRVNACEIGTPRRHTNGRPIESRLTYF

SEQ ID NO: 226690 - protein, 485 aa, Glycine max
  Coding DNA Sequence Number=SeqID_109912
  Homolog annotation: Hit_ID=Q9LHQ4; Match level="QueryCoverage=54%, HitCoverage=78%, E-value=2e-84, Identity=61%"; Hit description =Arabidopsis thaliana genomic DNA, chromosome 3, BAC clone: F3H11
  Pfam annotation: Domain name=HLH; Domain location=74-113; Score=5.6; E_value=0.037; Accession=PF00010.16; Description=Helix-loop-helix DNA-binding domain
MVSPENSNWLFDYPLIDDDVIPVGDSSFAVSASTFSWPPPPANVSVEIDASLGDSDGLKNPALKKRTKSDSSTASSSKACREKLRRDRLNDKPPKTDKASILIDAARMVTQLRDEALKLKDSNTSLQEKIKELKAEKNELRDEKQRLKAEKEKLEVQVKSMNAQPAFLPPPPAIPAAFAPQGQAPGNKLVPFISYPGVAMWQFMPPAAVDTSQDHVLRPPPPITKEDAILQAKTSLSATLEKPLNNPKLIGKFKKLRQPKFRVEIPVIDDSPDSLSQLALDFFGDMPIKRKGSPIKILMLWPDASLKESATIAFQSHSTFEHIDIPSVAKTDPRILNSADVAIFLAPESSQLAPIRRVSDAFYPKPVVLFNPKWAFEEESNLGDLSGFVDSFEVVYSFIGLEVRGILSKRKGVIFKCVRDGVVSGERWNVFVEEGQELKVVSSFKVRPTIVEVENVLYNLMAINSPITKSAKFIQGLVSNVTGRK

SEQ ID NO: 226691 - protein, 52 aa, Glycine max
  Coding DNA Sequence Number=SeqID_109913
MDEDQKNWNDMTKSYGEISRSLAIRWKDELKHIWHLIDSNGKIHSVKYNQDL

SEQ ID NO: 226692 - protein, 73 aa, Glycine max
  Coding DNA Sequence Number=SeqID_109914
  Gene Ontology: Mol. function=DNA binding; Biological process=DNA integration
MRINPENFVFGVQRGKFLGFMLTNRGIEANLEKSNAIIEMRSPTNLKEVQRLTESIQVPAETCRYNLTLFQAT

SEQ ID NO: 226693 - protein, 81 aa, Glycine max
  Coding DNA Sequence Number=SeqID_109915
  Subcellular localization annotation: CTP_CleavageSite=20; ConfidenceScore=5.31e-01
MGPKSTPRLMRTLGPSRASLAQSSWSLLSNTLRRLGARKDMRNHEKRFEHRCGKMCQWSTHQGRGNMAMLQAKEGGGSNGV

SEQ ID NO: 226694 - protein, 319 aa, Glycine max
  Coding DNA Sequence Number=SeqID_109916
  Gene Ontology: Mol. function=protein kinase activity; Cellular component=nucleus; Biological process=protein amino acid phosphorylation
  Homolog annotation: Hit_ID=Q9LHZ4; Match level="QueryCoverage=99%, HitCoverage=58%, E-value=3e-86, Identity=40%"; Hit description =Pentatricopeptide (PPR) repeat-containing protein-like
  Pfam annotation: Domain name=PPR; Domain location=175-209; Score =33.7; E_value=6.3e-07; Accession=PF01535.11; Description=PPR repeat
  Pfam annotation: Domain name=PPR; Domain location=276-310; Score =47.6; E_value=4.3e-11; Accession=PF01535.11; Description=PPR repeat
  Pfam annotation: Domain name=PPR; Domain location=60-94; Score=3.6; E_ value=2.8; Accession=PF01535.11; Description=PPR repeat
  Pfam module annotation: Pfam domain module=PPR::PPR::PPR; Domain location=175-209::276-310::60-94
QNGYAKRALQLVFQMQQAGQKPDSVTLVSILPAVADMKPLRIGRSIHGYAFRSGFESPVNVTNALLDMHFKYGHTRTARLVFEGMSSKSVVSRNTMIDDVDEGEVPTRVTMMGALLACANLGDLERGRFVHKLPDKLKLDSNVSVMNSLISMYSKCKRVDIAASIFDNLKEKTNATRNAMILRYAQNGCVKEALNLFCIMQSQGIKLDCFTLVGVITALADFSVNRHAKWIHGLAIRTCMDKNVFVSTALVDMYARCGAIKTARKLFDMMQERHVITWNAMLDGYGTHGLGKEALDLFNEMPKEAVKPNDITFLSEISA

SEQ ID NO: 226695 - protein, 100 aa, Glycine max
  Coding DNA Sequence Number=SeqID_109917
MAKFDYQSMKKAKVEKVAKVKVAKVKAEKAKVKKGIAEFWANEVEKAEIECLQAKADCAKAKKALEGLIKANDTLLQSAKESRKSLEDAEAMLKETKSRE

SEQ ID NO: 226696 - protein, 245 aa, Glycine max
  Coding DNA Sequence Number=SeqID_109918
MSFSGGVELFGGGKMLSPKDYLIGKYFNDDPTHHHGGSDDRNDQGSSTSVGGTAISGITAIAGEGSHHSVGAGPNLDGEEVESPLLIPPLNVIDLDLKFTAVQPCRESECVFMRASPCETHFMYMYSTFFSTLHLIVLFDKFEIDVLRKLNVAPTQLHLNAWVAICVFRTMCGIFSMTPTTTKFFHHYSMKENKKLKVVGFLSPAFPIGLLLAFKLLHIITLRATSSECVLGLSLCRFTSLGRCN

SEQ ID NO: 226697 - protein, 184 aa, Glycine max
  Coding DNA Sequence Number=SeqID_109919
  Gene Ontology: Mol. function=RNA-directed DNA polymerase activity; Cellular component=mitochondrion; Biological process=RNA-dependent DNA replication
  Pfam annotation: Domain name=rve; Domain location=30-175; Score= -11.0; E_value=0.05; Accession=PF00665.16; Description=Integrase core domain
MNEMHRGICGMHSRARSLVTKVLRTGYYWPTMRKDCTEYVKKCEKVSNFWHHLSLTCRGTAQHNGTMALCCIGSRHTQPFPTTKRASAISPKIRVFDKGVQDFLEGLGIKHRTTLVKHPHSNGQTKVANKVILKDVKKKLGKAKENRAEELSAILWTYHCTSESPTRETSFKVIEALRNGTYRL

SEQ ID NO: 226698 - protein, 47 aa, Glycine max
  Coding DNA Sequence Number=SeqID_109920
MVVTRSSMVRQQWFESGGDKVVVVRQCWLEGGDNEIRQEVACDSDPL

SEQ ID NO: 226699 - protein, 107 aa, Glycine max
  Coding DNA Sequence Number=SeqID_109921
MVQRSCIQVCSIYLLNICGEPYLLPYFLSEASLNFGKSLLVLRYDYGLRARLAVTVLIKGSAAVAHNSISKVYLTTMTGARTTVVETSKNNDGVLTTDVDILSNNDG

SEQ ID NO: 226700 - protein, 49 aa, Glycine max
  Coding DNA Sequence Number=SeqID_109922
MATLGLEILVESASQVISKLSVLYGIGTEIAGMPMEGDQGMKIMIKESS

SEQ ID NO: 226701 - protein, 40 aa, Glycine max
  Coding DNA Sequence Number=SeqID_109923
MEFVTAPDSCGFTHRISSRIPMVPPLAFPMLRRRSSSTHT

SEQ ID NO: 226702 - protein, 118 aa, Glycine max
  Coding DNA Sequence Number=SeqID_109924
MDLAASIDQGHLQKFTRVVKEFNSITSLVYFYIQIRELSQGASGNEKEQLTSDDGVGVILRQKAARELRLGFHSGGGGGSLNLYKKLQARFERERARGSKGLQARLGLERVQPERGKR

SEQ ID NO: 226703 - protein, 143 aa, Glycine max
  Coding DNA Sequence Number=SeqID_109925
  Homolog annotation: Hit_ID=Q53MQ7; Match level="QueryCoverage=60%, HitCoverage=10%, E-value=4e-09, Identity=44%"; Hit description =Expressed protein
MVQIICRHHDICISVSHLTASPHSLSLTLSIFREAEIAKVDEDQKKSKIKKRSLPHGTSEYQAAWIVDDSDEGSDYDNENDDGMVLDEGEDRSSGQEENKYSEFDCDRASLILGDSDKETNNDSVMMVLDMVEIMAPGWVCFF

SEQ ID NO: 226704 - protein, 46 aa, Glycine max
  Coding DNA Sequence Number=SeqID_109926
MGESLSDTHETRYKRKVVNKGRWSCTKARSPCIARGGSSTLNRAGI

SEQ ID NO: 226705 - protein, 152 aa, Glycine max
  Coding DNA Sequence Number=SeqID_109927
MTTLTQIWMTLLLSNISPSNHNADLPLRKYQLGSHPQDTQWTQRSPIGPWGFQLWLRASFNPTGCPSPLARSCHRDIGIAPTRHLVGPEKSNRVLGFPALITSLRQFYGVLITPSKVIRPLLIGLSSKSTAPPGRRRARHHSSGQQMHRHHL

SEQ ID NO: 226706 - protein, 226 aa, Glycine max
  Coding DNA Sequence Number=SeqID_109928
  Gene Ontology: Mol. function=nucleoside-triphosphatase activity; Cellular component=membrane; Biological process=defense response
  Homolog annotation: Hit_ID=Q7W3K0; Match level="QueryCoverage=88%, HitCoverage=75%, E-value=6e-92, Identity=87%"; Hit description=ABC transporter
MAFSWRPPRGVPQGPSRTLGLSPIGVLHAEVFAQVDAPNGRIADDFVGVTVGQHLAFADDVGAVADAQRFAHVVVGDQHADAAALQETHDALDLDHGDRVHAREGLVQKDEARAGGQRARDFDPAALAARQRDGGVAAHMADLQLFEQQFHLFIDLGRGQRAAVRPQLQFEHGADVLLDRQAPEHRGVLGQVRQPHAGALVDRHRGDHRAVDLDAAGVGRHQPDDH

SEQ ID NO: 226707 - protein, 121 aa, Glycine max
  Coding DNA Sequence Number=SeqID_109929
  Homolog annotation: Hit_ID=Q1SM26; Match level="QueryCoverage=51%, HitCoverage=15%, E-value=2e-07, Identity=41%"; Hit description =Nucleic acid-binding, OB-fold
MDLKENCTYVMHNFKVLKNNGQYRVCDHQFKLVFIGVAVVRQCVLNDLPFRKYKFAGFADVVAGQFEPGLLVDVIDVVDEVVFRHVSRKGRRVVFKLKDLRLAELGIEARSVFKSLGQGSS

SEQ ID NO: 226708 - protein, 506 aa, Glycine max
  Coding DNA Sequence Number=SeqID_109930
  Gene Ontology: Mol. function=nucleic acid binding; Cellular component= chromatin; Biological process=DNA integration
  Pfam annotation: Domain name=zf-CCHC; Domain location=136-153; Score =22.3; E_value=0.0002; Accession=PF00098.13; Description=Zinc knuckle
KCAHLQALRKEFETSHMKEGELVNEYLARVLVISNKMKANGEDVKDVVVVEKVLRSMTPKFNYVVCSIEESKDMSMLSIDELQSNLLVHEQRMSNIVHEEHALKVTHGSQYAGLAGRKIGHLNFGGSRQNVDKATVECYNCHKLGHFQWECKKGVENFAENQAESEEHMLLMAYIEEKKQQKTDVWFLDSGCSNHMCRKKEYFSELDENFSDSVKLGNNSNMVVNGKGNIRLDVNGVINIVTEDVAQLWHCRFGHLSFKGLQTLQQKGMVEGLPLLKPPSMLCKDCLVGKQHRDSFPMRSSWIASQILQLVHANICGPIKPASNSKKSFKLHVDKATNMSLKGLRTDHGGDIEKKVPKTFWPEAVNWVVHVLNHSSTLAVKDITPKEAWRRIKPSVQHFRVFGCVSYAHVPDNLRSKLDKKSLRCVLLRISEESKAYMLYDPISLRIIVSRDVVFEENEEWEWDKHESTDICELEWEDDEKKLSKGLVGGRSRKQPAWLRDCVSAE

SEQ ID NO: 226709 - protein, 41 aa, Glycine max
  Coding DNA Sequence Number=SeqID_109931
MEILIPSQGLWWFEGVGLASSSGIKGMSHIYFHDTHTTMMI

SEQ ID NO: 226710 - protein, 61 aa, Glycine max
  Coding DNA Sequence Number=SeqID_109932
  Subcellular localization annotation: CTP_CleavageSite=36; ConfidenceScore=5.11e-01
MVLHGGGGVSRVVWTTIPLGLGFALSTKIQVERNFSCAKRNNSRSTLFPLGLELRLACFSH

SEQ ID NO: 226711 - protein, 217 aa, Glycine max
  Coding DNA Sequence Number=SeqID_109933
  Gene Ontology: Biological process=nodulation
  Homolog annotation: Hit_ID=P08961; Match level="QueryCoverage=90%, HitCoverage=91%, E-value=3e-97, Identity=90%"; Hit description =Nodulin 22 precursor
  Pfam annotation: Domain name=Nodulin; Domain location=7-208; Score =399.5; E_value=5e-117; Accession=PF02451.6; Description=Nodulin
MEKMRVVLITLLLFIGAAVAEKAGNGKAANNPAEDASDGEAINLVEEAGGIGDAITPAEGKATNLQAYESARFKKFVTHCSSHVAQTCSGNDPLHHQEGGHGINVPLGLSFCLFDSMEKCLGDHEAKLIDPNPGPMSAIPNSIQSQQLLIETVKFRTVLKTCTRVSAQFCLTAPNVDTSVLPACLGPSLNQCVYPAAGFTRCIYTWPAARTPTYYYL

SEQ ID NO: 226712 - protein, 52 aa, Glycine max
  Coding DNA Sequence Number=SeqID_109934
MANVAAGTSADDHDVVFVRSGREPPPPCQKKCINYLCKKKENHAREMMCKNK

SEQ ID NO: 226713 - protein, 143 aa, Glycine max
  Coding DNA Sequence Number=SeqID_109935
MGETHEMPHHNLADFKPCLGYATKGQAVGGIPLQNTLECPQYHPQSHPLHSTMGKNPHAMAEMGKLDHPEERLKAIEGGEDYAFANLEDLFLVPNIITPPKFNVPDFDKYKGTTCPKNHLKMYCRKMGAYTKDEELLIPLFQE

SEQ ID NO: 226714 - protein, 58 aa, Glycine max
  Coding DNA Sequence Number=SeqID_109936
MERDGKERPKEEIKVHRREVPMMKGISLPMEKVTQTNSCRKYHRHKIQQEAAKEAINK

SEQ ID NO: 226715 - protein, 422 aa, Glycine max
  Coding DNA Sequence Number=SeqID_109937
  Gene Ontology: Mol. function=transporter activity; Cellular component= outer membrane; Biological process=transport
  Homolog annotation: Hit_ID=Q8AAG1; Match level="QueryCoverage=88%, HitCoverage=44%, E-value=6e-46, Identity=33%"; Hit description=TonB -dependent outer membrane receptor
  Pfam annotation: Domain name=Plug; Domain location=51-158; Score =60.1; E_value=7.4e-15; Accession=PF07715.5; Description=TonB -dependent Receptor Plug Domain
MPVATPLFHRLPLAAAIALTLPLPALAANPKPTELDRVQVKVSTATRSERLLSDVPIRTEVLRKEDIALRAATDFSRAAELINGLRVESNCQNCNTSEVQLLGLPGAYNQLLFDGIPLLSTLGSVYGLEQIPAGFVDRIEVVKGGGSALYGPGAVAGVINLIPPLPARSGGHVQAGVDVLKGTPQKNADVRLDLVAKDADAGLSVIAQRNWNSGIDYNGDGYTEITRKNLKVGGLQAWYAPTPGTRLRLDLQVTDETRRGGNRLDQPEYLANIAESLDTKYRRGSVSWDQEINADVDFRLAYAFADIDRDSFYGGLGDVVTDPSAPGYDPSQLDPNVAGSAASRSWRQYGRTHNPLHYIDSQLNWRLGAHALAFGVQYKHEALRDDNRTGDGQRLAMLEDATFHNLGAFIQDEWSLRDNVDL

SEQ ID NO: 226716 - protein, 519 aa, Glycine max
  Coding DNA Sequence Number=SeqID_109938
  Homolog annotation: Hit_ID=Q5XM22; Match level="QueryCoverage=19%, HitCoverage=72%, E-value=1e-19, Identity=44%"; Hit description =Resistance-like protein HAAS-2
MAAPPQNGKEDSFANCHRQFVKGGLLWRNLGLLLSSIDNTDLETGSVPGPRFGESNDHTFEVEVEEDLASEPGVLVEGSGSGIADEDVLLVVGARGELVEPLLGNVDLAVGRAGVDLLEAVGLRVDQARVDQGLQQGLAGQAHHLVLLSHEVDRREPYDAVGDLLRGRGGAAVDQGFGEEREGGEAVRLRGQSLQIRDCHWCFLFWEARREWSFGWEIGTKEMIGFGREMGGIQGSKFLGAPIPISERPELKLSSHGRKVQKFGRHAPEIEGIMVVTGLSLLIACSLGTGHFTITLDDVAFLLHLPITGAFHTFDALHVDQVVDLLVELLEWTVATRAHLLHLVGCTLFSNKSVIHVHVVFLDAFPNLSQSGSYSLGAIALVHMYDNLNDASKKSARQLVGYITLLQYWIYEHFPTIVSCVSDKDYHERKPRACWWKSGKALTVSTYRKRLDRLTSNVVCWIPYGDHRAFKEFELISLFSDKLDVVHKIDDRRMQFSEYLAPVGQICVAPRQCATDYME

SEQ ID NO: 226717 - protein, 103 aa, Glycine max
  Coding DNA Sequence Number=SeqID_109939
MVSRTIARPMQLSEFGRKTDHLSLFSQGPACKWHWGQIQKALDHRKPYRSYPFLVNLIDGFDDQVDSGQCKAGVQEPILKEYWALQVFSQLIKESLIWEYYYM

SEQ ID NO: 226718 - protein, 158 aa, Glycine max
  Coding DNA Sequence Number=SeqID_109940
MRLHCYQANRRPNMTTDRPPLLMAHIDSGIGPNITMCVQRCSGVAICRNLPSQQDGEGKIDKPKRSSPREKMTGVATNVYSRKTLEKQKIGLGIFENKGLEIVYVWGRFDKGVALAPTYPQAKGHPGVVAARPGELKLNLEAVSSPKRAGSRPGELVP

SEQ ID NO: 226719 - protein, 215 aa, Glycine max
  Coding DNA Sequence Number=SeqID_109941
  Gene Ontology: Mol. function=RNA-directed DNA polymerase activity; Biological process=RNA-dependent DNA replication
MEKFDHIEERIRVIERGGNYAFADMAELCLAPDMVIPPKFKVLDFDKYKGTTCPKNHLKMYCRKMGAYGKDEKLLMHFFQESLTRAIVTWYTNLEPSRVRSWKDLMVAFIRQYQYNSDMAPNKMQLQNMCKREHESFKEYAQRWRDLAAQVAPPMMERAMITMIVHTLLVFYYEKMVGYMPSSFADLVLVGERIGVGLKRGKFDYVASMNSGDRR

SEQ ID NO: 226720 - protein, 131 aa, Glycine max
  Coding DNA Sequence Number=SeqID_109942
MIGCGSIGHQNFHSHKHGVRPSAIFKKKRFYHVKVKNLELASLRKLRQQMNQVQCQPFSKLAPTIEEFEGILGCLLGGRKPYIFSRFYPSMARIAKVVKISEQELDRVKQNRNGVAGKCSVVESAPDRTSS

SEQ ID NO: 226721 - protein, 83 aa, Glycine max
  Coding DNA Sequence Number=SeqID_109943
MLVYLITYIFTPRSSNRAQIVDFTKASSKITERHLKKLGMRFVNHEWIMAKELAVGNLEQMDEETKAEVQQELAHQWSRLSLS

SEQ ID NO: 226722 - protein, 116 aa, Glycine max
  Coding DNA Sequence Number=SeqID_109944
MAGGSPSTAKCKGCDWGDTEGPPKCLAGVHHQLLAPQRRIRGVVQSRLDYGLGVLHVSPPWVETHSCRHSHREHVQHRVVYSWEASHMVGKNACSGPAQNGGRPDLPYPRLDDLLD

SEQ ID NO: 226723 - protein, 135 aa, Glycine max
  Coding DNA Sequence Number=SeqID_109945
  Subcellular localization annotation: CTP_CleavageSite=41; ConfidenceScore=5.17e-01
MSGPGASGVPKSNIPLIPGRHRLWLRLGRTGGTTRPVKDRSASPAEGTSRPVHTGGGPIDPTQAGITAAAGTRLALQWILVKGFRLYSFQLPDSMSPVLLFIVTTSPCQDWVICAPDAFLGCGSRFSGSLSGIEP

SEQ ID NO: 226724 - protein, 180 aa, Glycine max
  Coding DNA Sequence Number=SeqID_109946
MEVAFCLAVKSSRIHLVLTIPCQSADCRTGKKHGRKAISCYSDPDRFFYGDDGHLNFPRHDCFPAPIVIYIRNPLTAAQGSNFTRPGDVRGSFSDSGSTATSTRSAIMKGGMSQLKVDASERELASTPACGARGDPEFRNPVMSTAPRNSVISRRFFRRVAELRTREIQCSAGPNGVSQK

SEQ ID NO: 226725 - protein, 99 aa, Glycine max
  Coding DNA Sequence Number=SeqID_109947
VEGRSPKFLEALDLRSNPFQGGGDDPTPRGHWIEDSKKIELEMQEKALGGVSSPSLASQGSFLLCYDGSFDGYWIPDLTKGDGVAAKDHAEEGTGGAIQ

SEQ ID NO: 226726 - protein, 82 aa, Glycine max
  Coding DNA Sequence Number=SeqID_109948
MSTFIMCTLFLLLFIVFNIGAIKPPCEKGIMIGSPKRKSFMKVEKSRRKRQRCKYEAPTLFQDKKLQEKFNARWVNKKVINV

SEQ ID NO: 226727 - protein, 203 aa, Glycine max
  Coding DNA Sequence Number=SeqID_109949
  Gene Ontology: Mol. function=transition metal ion binding
LNYVKFTVCVFKCKLVDNNTGVRTDDVGFTLVNLKKLAYLNDPFIMAEQAKQVFYVQDHSDERWCVVLHGKTIGVNVEDDDSYIDTYVSPLSTQISPNIDGEEELDDIHANLVSPAKPPQRPDPEVNWDATVFRVFNPDFPLYIKHEDLSEIVHGGQCLSISIIQLWILPDNYLKGIINSALKGLNDTPQPKSKAATRWIVIK

SEQ ID NO: 226728 - protein, 120 aa, Glycine max
  Coding DNA Sequence Number=SeqID_109950
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=55%, HitCoverage=10%, E-value=1e-18, Identity=67%"; Hit description=E3 ubiquitin ligase PUB14
VIRTGSPRNRENVAAVLWSLCTGDPLQLKLAKEHGAEAALQELSENGTDRAKIKAGSILELLQQMEGGPAIKSAATAELGSQNGKKLEGGRWGEVKILGGPLDTKCYTINGQITKAVPNF

SEQ ID NO: 226729 - protein, 274 aa, Glycine max
  Coding DNA Sequence Number=SeqID_109951
  Gene Ontology: Mol. function=DNA binding; Cellular component =intracellular
  Homolog annotation: Hit_ID=Q2HUC6; Match level="QueryCoverage=98%, HitCoverage=43%, E-value=4e-81, Identity=55%"; Hit description=ELM2; AT-rich interaction region; Homeodomain-related
  Pfam annotation: Domain name=Myb_DNA-binding; Domain location=169 -219; Score=19.8; E_value=0.0099; Accession=PF00249.21; Description =Myb-like DNA-binding domain
MHPCLYEDHLGTNYNLRDRLKRDKKILVGQSTPSARSSSDSSVGAENRTPSPHTEDPSDANSGLDRCATVRIPLGANHQAEIPEWTGVISEGYSKFSGTPIWPLATANTRLLIERDPIGKGRQDSCGCPVPGSVECVRFHITEKRAKVHLELGAVFYDWNFDQVGEDVKLLWMEEEEKKFKDVIRSNPPSPETYFWDHIFRAFPTKSRADLVSYYFNVFILERRGYQNRHTPNNINSDDEDDEAGPLRNVFGQQTQNSRGSILLTPKKSQTKKK

SEQ ID NO: 226730 - protein, 63 aa, Glycine max
  Coding DNA Sequence Number=SeqID_109952
MATIALSSRYGSKLAYDTGIWGESYKFFATKFLFGLRYRWCLGIVHLECDGSLLVGLLWRLDL

SEQ ID NO: 226731 - protein, 423 aa, Glycine max
  Coding DNA Sequence Number=SeqID_109953
  Gene Ontology: Mol. function=DNA binding; Cellular component =chromatin; Biological process=DNA integration
  Homolog annotation: Hit_ID=Q1T1K8; Match level="QueryCoverage=99%, HitCoverage=21%, E-value=1e-128, Identity=56%"; Hit description =Integrase, catalytic region; Zinc finger, CCHC-type
  Pfam annotation: Domain name=zf-CCHC; Domain location=233-250; Score =12.8; E_value=0.0076; Accession=PF00098.13; Description=Zinc knuckle
MTYLQLSLSSWIEITISYGSHYYILGTKECLEQFVNTNDTTVKINSDYEEWIAHDQALLGWLRNSMAIDIATQLLHCETSKELWDEAQSLAGAHTKSRTIYLKSEFHNTRKGEMKMDQYLLKMKNLADKLKLAGSPISNSDLTIQTLNGLDADYNPVVVKLSDQINLGWVDLQAQLLAFESRIEQLNNFSNLSMNASANLASKTYSRGNKPRTRGNWRGSNFRGGRGRGRSKPTCQVCNKFGHTAVQCFYRYDKSYTESNAENNTQENHSAFIASPYHGQDYEWYFDSGASNHVTHQNEKLQDLSESNGKNSLLVGNGKRLSILASGSTQLNNLNLPNVLYVPEITKNLLSVSKLTADNNALVEFDANYCYVKDKLTGKALLKGKLRDGLYQLSSVNSQVNKDPCTYMSVKENWHRKLGHPNN

SEQ ID NO: 226732 - protein, 89 aa, Glycine max
  Coding DNA Sequence Number=SeqID_109954
MMYWQQSRKGTHLWTPWYRTNKTRGIVLAIPNKDRHCTGHPNSKNTNYNHGKIDLESAPYCASATAFQLPHHKQCSSFGSIEVHALLDH

SEQ ID NO: 226733 - protein, 257 aa, Glycine max
  Coding DNA Sequence Number=SeqID_109955
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=8e-31, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGTVHEPQANQGADQNTLTLRRLHALAFRGLHALALRRLHAIAFRGLQALAVRGLYVLTSRGVHVLAFRGLHVLAFRGLHVLTFRGLHALVFRGLYLLTIRGLHVLTFRGLYILTFRGLHVLTFKGLHALSFRGQHVLSSKGLHVLAFKGLHILAFRGLHVLTFRGLHALAFKGLYVLAFKGLYVLTFRGLRVLTLRGLHVLNFRGLHALAFRRLHVLAFRGLHVLAFRGLHVLAFRGLHALAFRRLHILAFRGLH

SEQ ID NO: 226734 - protein, 106 aa, Glycine max
  Coding DNA Sequence Number=SeqID_109956
MKLASTVVDKLCRQHQYFSDIMNKKAKYRKACKKPFLEIKCKEKACHCSLKKKKALPSDAKTKKRPLEFFKKARGKERLGDKDVLSAIGQDTLQRIVQRNQKRSSS

SEQ ID NO: 226735 - protein, 88 aa, Glycine max
  Coding DNA Sequence Number=SeqID_109957
MPSLVSSKERNLKGKQSQKEGKNDIFTKITDPKFARASIQLAWAKDVTSALSNQLTRRATTRLGNWMPSPISNKLAWANLSALQGCFL

SEQ ID NO: 226736 - protein, 50 aa, Glycine max
  Coding DNA Sequence Number=SeqID_109958
MESRHYRVVTVDCGVPKLMTGLEGKSSLQSPEWPVHNSVRSHFFLTAHNL

SEQ ID NO: 226737 - protein, 257 aa, Glycine max
  Coding DNA Sequence Number=SeqID_109959
  Pfam annotation: Domain name=Transposase_23; Domain location=3-66; Score=-17.8; E_value=0.1; Accession=PF03017.5; Description=TNP1ENSPM transposase
MGLYVQSQDCTKLVALGKIHDGPSTIHCVAYANDVVRVSVEKVIDGEAEVPLATSEIKYVRDAINTFIAWPLPLHSGITPDKVSNAAELNNDVPKHDPLRELIKTLVDIYDKPVEFVWDLTEFGIPNRNNIRRQMLEHSHTSIVDHCMDSLSLNLYTMQRTDVGNVKNISKNGLRNRNDNSPIGKRLCCALKTMSWSGFVHAYKKLNTTADGKVPKTGPQWLELKTRIQRGGYECGYYVMHWMWNIIGVELKSDWSV

SEQ ID NO: 226738 - protein, 163 aa, Glycine max
  Coding DNA Sequence Number=SeqID_109960
MCRNLPSRQDDKGKIDKPKRLSPREKMSGIATNIYSRKMLEKPKRGLQILKIRVQELFTHGEGCCPCSYVSSGTMRNLDLRSSLSLNAKGHPGVVAARPGELKLNHEAVSSPRRARACPGEPNAGLGELGPSKNKEKTLLPSFLGIFCLPDRNTEWFLALHCN

SEQ ID NO: 226739 - protein, 218 aa, Glycine max
  Coding DNA Sequence Number=SeqID_109961
MAKLRDSVKFDDERSSKLLSESKEASPEIMDTKQRRRRVSEAKKKKGFGVSESKEAEGWEIEATVTIKTCHRVAIPGKLLEEGKNVNFSSSFDLESKQTFFGGNLLAHIFDELKICSKFEFGQDLFESKREKSRLKGIPRFKEVFAKYKARTRKRASNHWAIRTGVYSSRSRGSQISGLSAISDKTLQNQFDFEQCGYRSKEQLCACKVYVAGHLHLR

SEQ ID NO: 226740 - protein, 41 aa, Glycine max
  Coding DNA Sequence Number=SeqID_109962
MAVVLEQKLDSSEPVMVLLCGCCVSLDGGPGEMAISGGSSS

SEQ ID NO: 226741 - protein, 144 aa, Glycine max
  Coding DNA Sequence Number=SeqID_109963
  Homolog annotation: Hit_ID=Q27TB1; Match level="QueryCoverage=72%, HitCoverage=75%, E-value=3e-48, Identity=89%"; Hit description=VagD
MPGDRRVVRADWRAGHTQRHLNFRGSVDRCAIPGKDGIEAGAERVNQLNVARRGLRAGGAEAHLGVGDGRDHDTLISQHRLRQALQYCVRLLSHDERTDAGVEHAGERAPGRPGGTQDDAVPFPDDLQLAYAVKVHIPGQTNGA

SEQ ID NO: 226742 - protein, 2281 aa, Glycine max
  Coding DNA Sequence Number=SeqID_109964
  Gene Ontology: Mol. function=nucleic acid binding
  Homolog annotation: Hit_ID=Q1SMW2; Match level="QueryCoverage=99%, HitCoverage=97%, E-value=0.0, Identity=64%"; Hit description=SNF2 -related; HMG-I and HMG-Y, DNA-binding; Bromodomain; ATP-requiring DNA helicase RecQ
  Pfam annotation: Domain name=Bromodomain; Domain location=1992-2078; Score=-17.4; E_value=0.083; Accession=PF00439.15; Description =Bromodomain
  Pfam annotation: Domain name=DEAD; Domain location=988-1152; Score= -22.5; E_value=0.00044; Accession=PF00270.19; Description=DEADDEAH box helicase
  Pfam annotation: Domain name=Helicase_C; Domain location=1393-1472; Score=88.4; E_value=2.2e-23; Accession=PF00271.21; Description =Helicase conserved C-terminal domain
  Pfam annotation: Domain name=QLQ; Domain location=419-456; Score =51.7; E_value=2.5e-12; Accession=PF08880.1; Description=QLQ
  Pfam annotation: Domain name=ResIII; Domain location=984-1148; Score=- 19.2; E_value=0.0019; Accession=PF04851.6; Description=Type III restriction enzyme, res subunit
  Pfam annotation: Domain name=SNF2_N; Domain location=990-1341; Score =299.8; E_value=5.1e-87; Accession=PF00176.13; Description=SNF2 family N-terminal domain
  Pfam module annotation: Pfam domain module=Bromodomain::DEAD::Helicase _C::QLQ::ResIII::SNF2_N; Domain location=1992-2078::988-1152::1393 -1472::419-456::984-1148::990-1341
MQSFQQQLLRKPEGNEAFLAYQAGIQGVFGNNNFSSPSAMQLPQQPRKLHLGSNQDTHQRGQGIEQQTLNPVHQAYLQYALHAQQRPTLGIQSQQHTKTGMLSSASLKDQEMRMGHLKMQDIMSMQAANQGQGSSSRNSSERVARGDKQMEQGQQIAPDQKSEGKPLTQGPTIGHLISGNMIRPMQAPETQQGIQNVVNTQIAASAQLQAMQAWARERNIDLSHPANAHLMAQLIPLMQSRMVSQSKVNESSIGAQSSPVPVSKQQVTSPAVASESSAHANSSSDMSGQSGSSKARQTAPPSHLGSITNAGIAGNSSEMATQQFNVRGRESQAPPRQPVVVGNGMPSMHSQQSSANTNFSADHPLNAKTSSSGPEPPQMQYMRQLNQSAPQAGGPTNEGGSGNHAKSQGPPTQMPQHRTSFTKQQLHVLKAQILAFRRLKKGEGTLPQELLRAIVPPPLEMQVQQPNHAAGGQNQDKPAGNIVAELISPIESSAKEPLSIPSINGQSSLKQESFVRDEKSIVPAVHVQAVAPPVSKESAPTLSAGKEEQKSIGCSVKSNQDGERVNNNTVRNELALDRGKAVAPQAHVSDTMQIKKPAQTSSVPQPKDVGSTRKYHGPLFDFPFFTRKHDSFGSSMMLNNNNNLSLAYDVKDLLFEEGMEVLNKKRTENLKKIEGLLAVNLERKRIRPDLVLRLRIEEKKLRLVDLQARLRDEIDQQQQEIMAMPDRPYRKFVRLCERQRMELARQVQASQRAVREKQLKSIFQWRKKLLEAHWAIRDARTARNRGVAKYHEKMLREFSKHKDDDRNKRLEALKNNDVDRYREMLLEQQTSIPGDAAERYAVLSTFLTQTEEYLHKLGSKITTAKNQQEVEEAAKAAAAAARLQACFIKSSPPFPLLFYQCFEKSLNFSPLFLYKLVWRLYYLNLGLSEEEVRAAAACAGEEVMIRNRFLEMNAPRDSSSVNKYYNLAHAVNETVIRQPSMLRAGTLRDYQLVGLQWMLSLYNNKLNGILADEMGLGKTVQVMALIAYLMEFKGNYGPHLIIVPNAVLVNWKSEFYNWLPSVSCIFYVGSKDHRSKLFSQEVCAMKFNVLVTTYEFIMYDRSKLSKIDWKYIIIDEAQRMKDRDSVLARDLDRYRCQRRLLLTGTPLQFGAINCNNSVAESFFVNSGKLGQDRSNCESMDGQDRSNDIIFFMELLMELWSLLNLLLPEVFDNKKAFNDWFSKPFQKEGPTQNVEDDWLETEKKVIIIHRLHQILEPFMLRRRVEDVEGSLPPKVSIVLKCKMSAVQSAIYDWVKSTGTLRLDPEDEKRKLHRNPAYQMKQYKTLNNRCMELRKTCNHPLLNYPFFSDLSKEFIVKSCGKLWILDRILIKLQRTGHRVLLFSTMTKLLDILEEYLQWRRLVYRRIDGTTSLEDRESAIVDFNSPDSDCFIFLLSIRAAGRGLNLQSADTVVIYDPDPNPKNEEQAVARAHRIGQTREVKVIYMEAVVDKIASHQKEDELRSGGTVDMEDELAGKDRYMGSIESLIRNNIQQYKIDMADEVINAGRFDQRTTHEERRLTLETLLHDEERYQETVHDVPSLQEVNRMIARSKEEIELFDQMDDELDWIEEMTRYDHVPKWLRANTREVNAAIGALSKRPSKNTLLGGSIGMESSEFGSERKRGRPKGKKHPNYKELDDEILEYSEVSSDERNEYAHEGEIGEFDDDGYSVADGAQTIDKDQLEDGLLCDAGYEFPQSLESARNNQMVEEAGSSGSSSDSQRVRQIVSPSVSSQKFGSLSALDARPSSISKRMTDELEEGEIAVSGDSHMDHQLSGSWIHDRDEGEDEQVLQKPKIKRKRSLRVRPRHATERPEEKSGSEMASHLAVQADHKYQAQLRTDPESKLFGDSNASRHEQNSPSLKNKRTLPSRRVANTSKLHGSPKSSRLNCMSVPSQDGGEHSRESWEGKPINSSGSSAHGTKMTEIIQRRSSLRLMACPILGMGKLPLPPKNKVAECKNVISKLQRRIDKEGHEIVPLLTDLWKRIENSGSVNSLLDLRKIDQRIDKFEYNGATELVFDVQFMLKSAMHFYGFSHEVRTEARKVHDLFFDILKIAFPDTDFRDARSALSFSSQATASTVTSPRQVAVGQSKRHKLINEMETESYALQRSLQRGSASSSENNRIKVHLPQRESRTGSGGGSSTREQQQDDSSLLAHPGELVVCKKRRNDREKSVVKPKTGPASPSSMRTPGPSSVTKDARLSQQGSHAQGWAGQPSQQPNGSGGPVAWANPVKRLRTDSGKRRPSHT

SEQ ID NO: 226743 - protein, 60 aa, Glycine max
  Coding DNA Sequence Number=SeqID_109965
ERLVVDRVKEGCVRLYAKNKGCRVEFPAVTDLRKVSIESALGFFSKLPDNPSLNKIHFIK

SEQ ID NO: 226744 - protein, 222 aa, Glycine max
  Coding DNA Sequence Number=SeqID_109966
AKLMTGLRRSKVRLSKTTLLARDRPVIREGNLSLEELDWAIEVIWPEMRAPMFMSMRETRPKISLALSTIRSEVCDVVARQPAVSGVCGQSLTLCQHPGVSRNVLRLLASIFTRWPLTLACFAERPSELYRVALSGTMKFKKFTKYGSLASQARLAQWMPQRNALSSGRPGLARSFQQKNLTKLPRLSESALLSHKYLNRMMSVHPHKMNSLSAVGVLSEFV

SEQ ID NO: 226745 - protein, 246 aa, Glycine max
  Coding DNA Sequence Number=SeqID_109967
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=100%, E-value=7e-36, Identity=30%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MALTFGGLHILAIRGLHAFAIGGLHILAIRGLHLLAFRGLHVLAFRGLHVLAFRGPHALAFRGLHVLTFRGLHALAFRGLHALVFRGLHVLVFRLLLALAFRGLHVLAIRGGLHVLTFKGLHTLTFRGLHALAFRGLHVLVFRGLLGLAFRGLHVLAIRGLHVLTFGGLQVLAIRGLHVLTFRGLHALVFRGLHVLVFRGLHILAFKGRHVLNFRGLHTLAFRGLRVLTFIGLHIRTLREFKVLYS

SEQ ID NO: 226746 - protein, 275 aa, Glycine max
  Coding DNA Sequence Number=SeqID_109968
  Homolog annotation: Hit_ID=Q1H0M5; Match level="QueryCoverage=80%, HitCoverage=89%, E-value=4e-19, Identity=34%"; Hit description =Sporulation related
  Pfam annotation: Domain name=SPOR; Domain location=170-240; Score =46.2; E_value=1.1e-10; Accession=PF05036.4; Description=Sporulation related repeat
MARDAVTDNELLLKKTARRRLVGAITLVVLMLIILPFVLKDRVVESSHDNVEITVVNRQANRDPILELPDDEVVIDNEVASSAGTTPSSAEVPEARIEEPSAVALTKSPESQKLVKTEASKPVVAPEATAQAKPVPVEPKVEPKVEPKVEPKVAPVQAVAKEEPAVSDKKTGKFFVQFGVFSDPKNLENLQTKLKQAGFETASENVDAAGQKLRLRTRTYATRNEAAAALKKLQAAGLMRGAIHELFSVLGWVLAFYLANRFNSQVMHYMPEQIP

SEQ ID NO: 226747 - protein, 66 aa, Glycine max
  Coding DNA Sequence Number=SeqID_109969
MLAQPGGSSGVLSKLILVERIIDNSSASRIFYALSHELLHSADGSLSHRIGLAGSSKSALPPNLPN

SEQ ID NO: 226748 - protein, 202 aa, Glycine max
  Coding DNA Sequence Number=SeqID_109970
MASRKRKSTASQPRELYDTTRFVFEVAWECYSQNIHSWNILPERNINLFVTEYDEFRRELIRRNWHKALTQHMDGHIDVALVKEFYLNLYDPEDKSPKQIRVRGKLINFEAALLNAFWETPPVILPGEQYPSYSIFCRAWTHPQELASKLCILGHGFVLNVEGAPWRLLRKDLTTLAKTWSVLSYSNLAPTSHTSDFNMDRA

SEQ ID NO: 226749 - protein, 63 aa, Glycine max
  Coding DNA Sequence Number=SeqID_109971
IYVSSIFGPDVLDIVSDIVDPAASLLHLTFILPCALCSNSSIFGQDVLDIVSDIVDPAASILH

SEQ ID NO: 226750 - protein, 220 aa, Glycine max
  Coding DNA Sequence Number=SeqID_109972
MEAMKDQMAAMLSMKKIMESNAAAVATTSAPIEEDPTHPSGLNKVNPPVSDMVGQGREALGSTGGPHVVQSKNSFPPYGLPPNYTPPNVAHAPDENVNNSTPILIESRQPQFDHAHVSQPMGRHMRHPNLVNFEPHLRYAFEGQAFYGIPLPNTLGGPQYHPQPQPLHFVVGRVPPAMVEREKFNHIEETLKAIEGGENYAFADMVELCLVDVPSFSSIF

SEQ ID NO: 226751 - protein, 165 aa, Glycine max
  Coding DNA Sequence Number=SeqID_109973
  Gene Ontology: Mol. function=heat shock protein binding; Cellular component=integral to membrane; Biological process=protein folding
  Homolog annotation: Hit_ID=P93499; Match level="QueryCoverage=93%, HitCoverage=97%, E-value=7e-33, Identity=48%"; Hit description=DnaJ -like protein
  Pfam annotation: Domain name=DnaJ; Domain location=66-130; Score =106.4; E_value=8.1e-29; Accession=PF00226.21; Description=DnaJ domain
  Subcellular localization annotation: CTP_CleavageSite=40; ConfidenceScore=5.10e-01
MLATSFSIVTLTTTNFSVESISSLSHHVKLQSTVSFATARWTEKQQQQQHRHVSDLILHHMASCTTLYEILGIRVTASDEEIKAAYRRLARVYHPDVAPAERKESFTGEFMKIHTAYRTLSDPEKRANYDRSLIRRHQKPLTMSSSSLWGFSGYTSHKWKTDQCW

SEQ ID NO: 226752 - protein, 101 aa, Glycine max
  Coding DNA Sequence Number=SeqID_109974
MTTLASACQSNLGSPNDEVRITGRCFCLLPDSWVMIAKGGVVDKSDAFAPTYPPFVMRNSDLHNNRKLSPRAIRLLGHRITKNVCGLPSGVSAYHRTLGSW

SEQ ID NO: 226753 - protein, 637 aa, Glycine max
  Coding DNA Sequence Number=SeqID_109975
MELIWLTVKKQRGMGEFIVGKSPAIYCSGETPLMPICGPVGMHHSFANQSDVCAGKDNVEVLPKAVRQITGWSPVPKNLGKHYWTSPLKSSRSEASFLSHLGKFLNAGRVHLTNKNWIAHTGGTAVIRPGRHVILQSDKDTPASAVLDLGTLVDAIHVASGAHLELLRLHIPNSGNRQVKRPSERVRLNVAGAFALWPSVTVARDSKVIGHSRFIPPVLLQNVPPTAESLLKEAISGRPMQKPSVRLPSKDLPLLRFLGPLHAGEHDSAKPEEHPGEKAKAQPGRGARADELSGLLSEPGLLPAAAVISGRISFGRSPFEMSFQYCVFYYWSDEEWDSCDKFREVATPILNPEEVPDKLEWRASDTQVFMKGRQQTTHRLINILNRAAFGDNLLTELPFDNEGTTGLNSMGLTGICSFATTSQVTIALVTAITSEGSACFPHMHRNIAFGGNVLSGTWGLPDVIDSMWDACRGHHAHGANQSHLGVRAQHLPPRGERCAAACTSNPHKPPNGSEKPQRLLWGLLSTLMSKRLFPGKPDGFLLCHLVIPWTLGCQLDLLNMNGPSGEDIAKPGCKFLIMPCRACVAGLDVHADGQPAGRRCHSAVLWDTPHSGVSSWEAPWGQQRHKRRLQPPLPRLW

SEQ ID NO: 226754 - protein, 686 aa, Glycine max
  Coding DNA Sequence Number=SeqID_109976
  Homolog annotation: Hit_ID=Q01GW4; Match level="QueryCoverage=24%, HitCoverage=27%, E-value=3e-15, Identity=31%"; Hit description=[O] KOG0716 Molecular chaperone
  Pfam annotation: Domain name=DnaJ; Domain location=191-273; Score =32.2; E_value=1.8e-06; Accession=PF00226.21; Description=DnaJ domain
MDSFNDLDRSLTKLCIHQGRDLLSRPHNLGPRTRHTPARENAKIECQNEIVALNTPAVFMGCHRDALQLTSAVKQNIAEGFPVTCKGWLAGNPHFLVPAEDCVSRGFIVEAMISRFSVRCSSHRPPLEWQFRCRSALRENHRRPLPRSGNHVTLAQSSEELSLMLSDIEREYYREVRKDLAEYLDVAAPSDFFQLLNLDLGATPLDVKASYRALQRLVHPDLIAHLRPWNMFPARGGEDRVACLAGDAANELAVILNIAYSTLMDDNARDIYLQDAERFRKEGHAYDGRPVSKWMGQEHEHRAVFVDETTCVGCRHCTYCAPNTFGMARIGSLHFALQNGWSFHPGARRATLDTKADRALMLGNCCTAQEEHYGRARVHTQWGDDEDAVKEAVDMCPVDCISFGRMWDMAEHEVHNAANREKQLVLLEFVLKACPREDTAIMARRAEAQSTRFLGPRLGHVKLNAGNMGSKPSKQDPFSRAEVWLRQRKDAKIDAHDSSARSLLVIIFPPCPFFPAMQNIPGAVPVRMRPCFTSASRITMALLQASAGLDTEETAAAMARAWLALPHHIREQGWPGFVAENSDQQGRDPSVKFIGLLMDLNNYDDLLELYTGHRMRAADFADVGTQDHNFVLAVACIVINKGDSAKGTTRDGPDVISMRNYRTAACPVQILSQVHSLLWAILYNKT

SEQ ID NO: 226755 - protein, 471 aa, Glycine max
  Coding DNA Sequence Number=SeqID_109977
MHHFIKSACPRSTPFCLAEAVTWEADTKIPDVHDGAYNNKYQLRYKEPDDTSSIKPWHFQFCCLCRCFACVSAVAARVIPKVRCGLEADIGEQDRSGWNAHITGKEKHSGSSSLPSGSIIKSFPGFKCPSEAHRFLTYQARLSSQEADSFARRTCWLQQILNTLSGRQSSDRRERIMPALLRHASGVTQVQALDGRKGELQKFSMTLPQSCGTTTEAQLAVTASHLKVAHVHDFLMQSLCHAQHCCQMPALLHGIRDGLACMLRNMSTCTHGVRMPANLGHAIHEAYRANVDMALIVEDDMKVLRWPSHGLLYTAPPDWDILLLYMMGAQADSIYRSPPSLWVEWGPSIFSAGAYIIHRKAMQRILDAYLPGASQSEHFSVVDLTAVSTNWEHPLACQSERVVFSLGKTFVCTDFTIVEISGESTLEKSHRPQHDATARLVEQLIEQHGPAVCSHTVLEGVCQASASAVYH

SEQ ID NO: 226756 - protein, 562 aa, Glycine max
  Coding DNA Sequence Number=SeqID_109978
  Homolog annotation: Hit_ID=Q9C6G4; Match level="QueryCoverage=27%, HitCoverage=14%, E-value=4e-14, Identity=33%"; Hit description =Receptor-like serine/threonine kinase, putative
  Pfam annotation: Domain name=Pkinase; Domain location=346-561; Score=- 27.8; E_value=6.6e-07; Accession=PF00069.15; Description=Protein kinase domain
  Pfam annotation: Domain name=Pkinase_Tyr; Domain location=352-562; Score=-64.3; E_value=1.6e-08; Accession=PF07714.7; Description =Protein tyrosine kinase
  Pfam module annotation: Pfam domain module=Pkinase::Pkinase_Tyr; Domain location=346-561::352-562
MVQDVIPEANRACRERRLRGLSAKKDVIRECRLSRCAHVVPVTSRTLPGQGHNRPRHANGASAHQLKQRCDSAIVPKGHLRSFSLDMARWPGFSRRMFWNRSSAPEGLREDVAAATAPLPTNYGSGARRFPYPGVMCDFHEASLFCWSLRDCAPVLACAGGTPVVVLDSEAEAATALAHAKSPEQSPAKGADPEVGDRFDFMPPDDDGAAPVDQSAELLQEGAWMEGPDEQPMQPTILPLRVVAEWQAAFGLLQPHESQNSCKVPQSVGRCKIGIAATHVASLVHRPRRGGGAAAATDARIAAADVCSWDPPAQIAAALQAWHEAAGTRSPPPERTSQTHDSAFERERQSILAAGRPLCDCETAEQSVTSMALTALRTSNLNACRGEFRGAITRSHMEMLETWLILEYCDHGSFDNAIRSGTFLNDLEISTAPVKVKAVLSSAVTSGILCLMDIAAGMEHLHSLGILHADLKGANVLLKSGAISNYDQRGYMCKLADFGLSRVMENNSTHVSTTTFGTAAYMPAEMLMEGRMTKAADVYSFGMLMWELLTGRKLFEGLRQSQ

SEQ ID NO: 226757 - protein, 428 aa, Glycine max
  Coding DNA Sequence Number=SeqID_109979
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q8IFU2; Match level="QueryCoverage=69%, HitCoverage=62%, E-value=3e-44, Identity=35%"; Hit description=Beta -1,4-endoglucanase precursor
  Pfam annotation: Domain name=Glyco_hydro_9; Domain location=104-428; Score=19.9; E_value=9.2e-15; Accession=PF00759.9; Description =Glycosyl hydrolase family 9
MPGLDRRGIIWFLVAKLVFVVVGAVVHVRNLCVCFPSDCFCQTERNLPYAFSSALVAAALLCLAASQDSEDISIDPATFLLQVPGRNWIPAWAKLPPKASPTFDFAEALHKAFIYLRIQRSGNITAPDHHIAWRSDSCLACKGPMGEDLSGGYYEAGGSFLKVGLPEAFPVTQLAWTIVRHRTALYRVGLLDEALSALKWGSDYLLNCHNASANTFVALMGDSKADFKYYGPPELYERYVGSVRPVSYTGPTAPASEVSAEAAAALAAASLAFNATDPMYAANLVQHASQLFDLASLYPGSFMTSKDPGLKTHAKLYPSTGFHDELAWAAVWLFKATQDGTFLTAAMALFNESQTDGNSECCGYGTFSWDTKSPGVALLMAEIMPNELLYSEAIQKFCNWYIPPLRSVPHTANGLAFPYKVTCTGPLK

SEQ ID NO: 226758 - protein, 402 aa, Glycine max
  Coding DNA Sequence Number=SeqID_109980
MLAQVREGERERQLGAGMRTGSGDGESAREEGAAAAGSFIQVVVGPLGPAAGQALNLPLGAHRPHLERGHLRVRAVLALILPCSLLALTNKLRAIARVPHLENVPDLQGLPPTLNLTHDQATEPFEELKRRCKEATVRHASEGRTTLGCWMEVDSADSRRVSARLAMLQSCATTFTATSAPLHLPAIQRGLILMMRALGHAEAVSPGSVDPGMAMNNAHGMLSAVAPPCSHWHAKTLAPPRGHQADALQLTDVQHHDFPAKRQDPSKNQPIVGTVHSIHTAPRQAGLKAKYIQQSAPLYTLPKEPRPSISPSSRPSIVARCLSLTNMVMWSTDVCGPVIAKLHLLGSTIRQRVSAVAFHAHQCIRIGHAHGKLGGSVHAVGQTHGKLTCLREEEATGAQMHD

SEQ ID NO: 226759 - protein, 137 aa, Glycine max
  Coding DNA Sequence Number=SeqID_109981
  Gene Ontology: Mol. function=transcription factor activity; Biological process=regulation of transcription, DNA-dependent
  Homolog annotation: Hit_ID=Q6D8R7; Match level="QueryCoverage=97%, HitCoverage=50%, E-value=5e-40, Identity=56%"; Hit description=LysR -family transcriptional regulator
  Subcellular localization annotation: CTP_CleavageSite=12; ConfidenceScore=5.13e-01
RARTSWRGARPAAFAAGSGGGATAGSPAGSPFAGERGAAGRIASAAAQYLGGNPPAAAGRAYLVGPNLSVVAGDGGAGVWLERTAALAGAAVWSSGLARAAGAGLAAAYCGGCHLVAAQSAGPGRPLDDRPAVRAAA

SEQ ID NO: 226760 - protein, 105 aa, Glycine max
  Coding DNA Sequence Number=SeqID_109982
MSYRMSRHHASEHAVYVCLYEQIKQYYRAGCQDIVSDIVDPAASLLHLTFILHCTATPVFSGWMSGHRVRHRGSCSFTSALDFYLALYSNSSILGQDVRTLYPTS

SEQ ID NO: 226761 - protein, 105 aa, Glycine max
  Coding DNA Sequence Number=SeqID_109983
MAINLNDVVSARFILIMVAPAQVYKSSPDLYAVILLVRDGNQVKPSTLIRIDVQLRESSHALDTCIVAPPMGPISWLACMDSPAKKTFGTRDLHVHEATTAILVI

SEQ ID NO: 226762 - protein, 145 aa, Glycine max
  Coding DNA Sequence Number=SeqID_109984
MTRIDREHAVPGIKRRRGRRRQDHQFQEFFAVHTRLLPRTRRQDGMRVVARSKRKGKRCLPRIQGSAMHRDEIQKLGAQAARDGLTLWDCPYYRAAAMPGHTGESITEWRGKVEAWEAGFLAETRSWNPPRGTPPPAGQARPPVH

SEQ ID NO: 226763 - protein, 202 aa, Glycine max
  Coding DNA Sequence Number=SeqID_109985
  Gene Ontology: Mol. function=transition metal ion binding
MAKKAGNPEQIHDLLYQALETELGGELVYTAALDCTVDADLRKEWQGYLDETKTHQRVLLTVFEELGLDPDAAVPSRAVVKHHGESFVAAIKLAKSQGDPDAAQLVAAECVVLAETKDHQNWELIGLVAQKTSGPQASVLKRAHDAVEKDEDHHLYHTKGWARELWIQALGFPAVLPPPEEARNVETAIGASRAEQARDKML

SEQ ID NO: 226764 - protein, 139 aa, Glycine max
  Coding DNA Sequence Number=SeqID_109986
  Gene Ontology: Mol. function=nucleic acid binding; Biological process= DNA integration
  Homolog annotation: Hit_ID=Q1SS72; Match level="QueryCoverage=87%, HitCoverage=8%, E-value=1e-35, Identity=54%"; Hit description =Integrase, catalytic region
MKIQSSNPDLSNPYYLHPNENPSLVLVSPPLDEKDYHSWTISMKLSLISKNKLKFVDGSLSQPSLLDPFYGAWERCNTMVLGWLHHSMTKPILKSILWIDQSVAVWKDLHDRFSQRDLLCISDLQEDFYKLHQVVEQLA

SEQ ID NO: 226765 - protein, 70 aa, Glycine max
  Coding DNA Sequence Number=SeqID_109987
MIESFQQQQEMGVIELCIEVDIAGAFALNVTNSLLSCGNNIAGNESKLDEEEDIDDISDTDEEGGSETEF

SEQ ID NO: 226766 - protein, 114 aa, Glycine max
  Coding DNA Sequence Number=SeqID_109988
MVERGKLDHIEERLRAIEGGRDYAFVGMEELCLVLDVVIPLKFKVPNFDKYKGTTCPKNHMKMYCRKMGAYAKDENLLMYFFQESLTGATITWYTNLEPFQVHSWKDLMVAFIG

SEQ ID NO: 226767 - protein, 186 aa, Glycine max
  Coding DNA Sequence Number=SeqID_109989
LPLEHVSKQLRTLSDNEVDGHFQLGLVERAWCEYGGPNFALGILEQSCGYYPHQPRSLPIALQSGPTIAMFQEQGDPPNLGDMPNLGLSKEKPSSSSTINNNVGQVARGGEGCNGGDNKSEGDKGTTSNGTSPLEDTLILRLEPKSEANGAVGKVFKLEEVSIDGTTLGKFKQGAYGILVLRQSKP

SEQ ID NO: 226768 - protein, 71 aa, Glycine max
  Coding DNA Sequence Number=SeqID_109990
  Gene Ontology: Mol. function=structural constituent of ribosome; Cellular component=ribonucleoprotein complex; Biological process =translation
  Homolog annotation: Hit_ID=P16181; Match level="QueryCoverage=51%, HitCoverage=23%, E-value=1e-09, Identity=75%"; Hit description=40S ribosomal protein S11-1
  Subcellular localization annotation: CTP_CleavageSite=41; ConfidenceScore=5.41e-01
AFLVLTFAHFRSSKKTRKGKSPGKGGNRFWKSLVVGFKTPREAIEGDLFVFFSRCQGSLLLVFCVLLSDQC

SEQ ID NO: 226769 - protein, 762 aa, Glycine max
  Coding DNA Sequence Number=SeqID_109991
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=46%, E-value=0.0, Identity=46%"; Hit description=Chromo
  Pfam annotation: Domain name=Chromo; Domain location=643-697; Score =45.6; E_value=1.7e-10; Accession=PF00385.14; Description='chromo' (CHRromatin Organisation MOdifier
  Pfam annotation: Domain name=RnaseH; Domain location=85-205; Score= -22.9; E_value=0.0078; Accession=PF00075.14; Description=RNase H
  Pfam annotation: Domain name=rve; Domain location=340-496; Score =129.1; E_value=1.3e-35; Accession=PF00665.16; Description=Integrase core domain
  Pfam annotation: Domain name=zf-H2C2; Domain location=281-322; Score =19.2; E_value=0.001; Accession=PF09337.1; Description=His(2)-Cys(2) zinc finger
  Pfam module annotation: Pfam domain module=Chromo::RnaseH::rve::zf -H2C2; Domain location=643-697::85-205::340-496::281-322
VAVDPNKVESVVKWPTPKNVKGVRGFLGLTGYYRKFIRNYGKVARPLTTLTKKDAFTWNEETHKAFEALKESLTTAPVLALPDFTKEFTIECDASGVGIGAILMQEKRPITYFSKALGVRNVAKSAYEKELMAVGLAIQHWRPYLLGRRFTVSTDQKSLKQLLQQKIVTVEQQNWATKLLGFDFNIVYKPGKLNGGADALSRVHEGGEVCVMTSSLQWKDVDILREEFAQDPHLQKIVNDLQQNKDSRPGFEFKQGVLLYDGRLVISSKSVLIPTLLKEFHETSQGGHSGFYRTYRRLAVNVYWVGMKNVVQEFVRSCDVCQRQKYLASSPGGLLQPLPIPDRIWEDISMDFITGLPKSKGFEAILVVVDRLSKYCHFIALKHPYTARTIAEVFVKEIVRLHGVPLSIVSDRDPIFMSNFWREMFKLQGTKLKMSSAYHPESDGQTEVVNRCLETYLRCFIADQPKIWVHWVPWAEYWFNTTYHASTGKTPFEVVYGRTPPTITRWIQGEVRVEAVQKELLDRDEAIKQLKVHLLRAQDRMKQFADKKRCDRSFSIGEWVFVKLRAHRQKSVVSCIYPKLAAKYFGPYPVVSHIGAVAYKLKLPEDSRVHPVFHVSLLKKAVGSYNGEETLPDDLDGEKDNTFEPDTVLAQRTVQVQGEEVRQVLVQWKGRNIEEATWEEAVMMTSQFPNFSLEDKAVISDGGVVRNEGNNGGPSGTMEPNDSLLNHEVGPREWKRRGESSELIEWLGSNSWPIGATALCQI

SEQ ID NO: 226770 - protein, 120 aa, Glycine max
  Coding DNA Sequence Number=SeqID_109992
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9M4A9; Match level="QueryCoverage=75%, HitCoverage=24%, E-value=3e-33, Identity=66%"; Hit description=Beta -1,3 glucanase precursor
MELTIGSHGRDEAADHVGVAPVENLAADEDVINFGGDVAVGGGHRHGDAAAGEGPQDVRVHVVDLHAVDGRLRLQEVRHRRGRWKVVAERAVVDADAVSGDGEVEQQEEGKEEECGGGGH

SEQ ID NO: 226771 - protein, 93 aa, Glycine max
  Coding DNA Sequence Number=SeqID_109993
MTPAKGRRKDSYFIMGIFSRLFGQAYTPSMVHQECGKFDQIGGFIFSKRSAIITNETSRGNMTCVLPLVLAKHAVTFFQRGMDLATGAGKFPK

SEQ ID NO: 226772 - protein, 89 aa, Glycine max
  Coding DNA Sequence Number=SeqID_109994
MMLVLRVNGLICPWLTKGADNPKRKNVYTDKQFGISPCPLTSRVSSDGNSLCGELLVYLRMSPDFTGQYDRKRERRRKSPRVNGLVGRD

SEQ ID NO: 226773 - protein, 64 aa, Glycine max
  Coding DNA Sequence Number=SeqID_109995
MTDPSGKEEGHLAREIQGERIRIQHLKSMCCKGFARNKICEIQELTVEAIAKVKLGDTHVEDKM

SEQ ID NO: 226774 - protein, 93 aa, Glycine max
  Coding DNA Sequence Number=SeqID_109996
MRHLLRVVGDDHVDRLQRWGSPVPIPNTEVKPTSADGTATSGRDFVFYSSSNNNNNNNNNNNNNNNYYYYYYYYYYYFRLFILLQAFINRGGL

SEQ ID NO: 226775 - protein, 69 aa, Glycine max
  Coding DNA Sequence Number=SeqID_109997
MNPDFNQPRGGCSREVSIHPAQQHCYMFALGKRYLSSLAHEAPGVCVCREDEEAGRTGRRGHPLPPDGR

SEQ ID NO: 226776 - protein, 249 aa, Glycine max
  Coding DNA Sequence Number=SeqID_109998
  Gene Ontology: Mol. function=two-component response regulator activity; Biological process=two-component signal transduction system (phosphorelay)
  Homolog annotation: Hit_ID=Q3BPK8; Match level="QueryCoverage=52%, HitCoverage=16%, E-value=9e-32, Identity=55%"; Hit description =Putative regulatory protein
  Pfam annotation: Domain name=Trans_reg_C; Domain location=34-110; Score=66.3; E_value=9.7e-17; Accession=PF00486.18; Description =Transcriptional regulatory protein, C
MNSSENQPPGFDRIRIGECTVTLSSREVEVVGARRPRRLTPKALGVLRVLLRQPGRVVTRDELFAEVWPDTLPTNDVLTQAVTQLRKAFSNDDDNGQAYIETIAKTGYRLLVPVQVLDDVEAAPSSEADDGIADVQPVMGIAEEMPAHVQASRRRWRHVRRRVLLVLGVLMLATVVVLAALLLRRAPASSSAVDAAVENGTRVIGSPQRPYRLITATSGFETYPTLSPDGSLVAYEGANEDGQGGGAIK

SEQ ID NO: 226777 - protein, 108 aa, Glycine max
  Coding DNA Sequence Number=SeqID_109999
  Homolog annotation: Hit_ID=Q9AY37; Match level="QueryCoverage=36%, HitCoverage=8%, E-value=2e-08, Identity=72%"; Hit description =Putative phosphatidylinositol-4-phosphate 5-kinase
MEKPSLVTGKMESLTFQAHRVPPILFPLLGSIIPEYLMQSSDVFPCKKQEARRAAEKAYDVAKVDERVNRAVAAANRAANAARVAAVKAVQNQMLHNVNSTSIPIPIV

SEQ ID NO: 226778 - protein, 723 aa, Glycine max
  Coding DNA Sequence Number=SeqID_110000
  Gene Ontology: Mol. function=ATP-dependent helicase activity; Cellular component=mitochondrion; Biological process=regulation of translation
  Homolog annotation: Hit_ID=O80792; Match level="QueryCoverage=97%, HitCoverage=92%, E-value=0.0, Identity=65%"; Hit description =Putative DEAD-box ATP-dependent RNA helicase 33
  Pfam annotation: Domain name=DEAD; Domain location=262-441; Score =229.2; E_value=9e-66; Accession=PF00270.19; Description=DEADDEAH box helicase
  Pfam annotation: Domain name=Helicase_C; Domain location=531-607; Score=81.7; E_value=2.4e-21; Accession=PF00271.21; Description =Helicase conserved C-terminal domain
  Pfam module annotation: Pfam domain module=DEAD::Helicase_C; Domain location=262-441::531-607
MWGWMVGEAGRAACNWNWVSLRNMGGGPRTFPGGVNKWKWKRMHEKLARDKQNRLIEQEKQLYQARIRSHIRSTLSPDHQSAAAATHRPLSPNDHVKALADRFVKEGAEDLWNNHDGPLTPNPTPNLNFGPKHTRGYRSVPEVGNSRVGAHKYRFWRKGSDDSSSSESESEVELSVKKRGSSASLGEYDVKRERRVVPKTSPEVEFIRYQLNKRKLSQIEEQQSQEQQQSNESILSNTRFDECGISPLTVKALSSAGYVQMTRIQEASLPICLEGMDALVKAKTGTGKSVAFLLPAIETVLKAMSSNTSQRVPPIYVLILCPTRELASQIAAVAKVLLKYHETIGVQTLVGGIRFKVDQKRLESDPCQILVATPGRLLDHIENKSGISLRLMGLRMLVLDEADHLLDLGFRKDVEKIVDCLPRQRQSLLFSATMPKEVRRVSQLVLKREHKYVDTVGMGCVETPVKASYSNYCHCRTLKIAKVKQSYLIAPHESHFQLVHQILKEHILQTPDYKVIVFCVTGMVTSLMYNLLREMKMNVREIHSRKPQLYRTRISDEFRESKQLILVSSDVSSRGMNYPDVTLVIQVGIPSDREQYIHRLGRTGREDKEGEGVLLIAPWEEYFLDEIKDLPLQNFPLPDINPHTKLKIENSMAKIDNDIKEAAYHAWLGYYNSIREIGREKTTMAELANRFSESIGLQRPPALFRKTAIKMGLKDIPGIRIRK

SEQ ID NO: 226779 - protein, 39 aa, Glycine max
  Coding DNA Sequence Number=SeqID_110001
MTASGTRILEPSNAMIVTLAKYYILCGMLCETKCCQEPF

SEQ ID NO: 226780 - protein, 171 aa, Glycine max
  Coding DNA Sequence Number=SeqID_110002
  Homolog annotation: Hit_ID=Q5XM22; Match level="QueryCoverage=33%, HitCoverage=46%, E-value=6e-11, Identity=47%"; Hit description =Resistance-like protein HAAS-2
  Subcellular localization annotation: CTP_CleavageSite=28; ConfidenceScore=5.21e-01
MRDRGAATCTQQYCWGTQQTVNGRKCPSAKTLSRKNLLPESSRKTLFSENFQKNLIPEEDDVIPEELQNTFRKNMFRNVSGRRYTFSLVHTYDQLDEASRTTTRQLAGYLTLLQCWIYEHFPSVHQCVIDDTYQETSPRASRWLTSKAHMKGITGAPYRARCDALTVTDVS

SEQ ID NO: 226781 - protein, 83 aa, Glycine max
  Coding DNA Sequence Number=SeqID_110003
  Gene Ontology: Cellular component=integral to membrane; Biological process=autophagy
  Homolog annotation: Hit_ID=Q9FVY6; Match level="QueryCoverage=98%, HitCoverage=30%, E-value=2e-29, Identity=65%"; Hit description =Putative senescence-associated protein
FIVTNNGSGHSVTGLRYKEYQLQDFSSLFLKELNNSRNWERLKVCLVKSEDCNNLSKKYKTLKQYKSAKLSPIEAGCCRPPSQ

SEQ ID NO: 226782 - protein, 90 aa, Glycine max
  Coding DNA Sequence Number=SeqID_110004
  Homolog annotation: Hit_ID=Q6Z7B3; Match level="QueryCoverage=92%, HitCoverage=8%, E-value=3e-12, Identity=45%"; Hit description=Heat shock factor protein hsf8-like
MPDPLMNSLEAIVGDHDPLDGRLKAAQTDVELYYWFDMTNHQIMLIFGQWPEVDSLVEELQKIEGVQSVSKGRFFRSPGLAPTFQPLPVY

SEQ ID NO: 226783 - protein, 73 aa, Glycine max
  Coding DNA Sequence Number=SeqID_110005
  Gene Ontology: Cellular component=integral to membrane
  Homolog annotation: Hit_ID=Q9FVY6; Match level="QueryCoverage=91%, HitCoverage=21%, E-value=1e-14, Identity=57%"; Hit description =Putative senescence-associated protein
MGMGTSTFVTRWINFLTMVKTEDKNWDLRLLAIVVIIFGVWMSTHHDGCRKSLTVPVIGLGAVIFLMSALHCL

SEQ ID NO: 226784 - protein, 603 aa, Glycine max
  Coding DNA Sequence Number=SeqID_110006
  Gene Ontology: Mol. function=RNA binding
  Homolog annotation: Hit_ID=Q6Z7B3; Match level="QueryCoverage=96%, HitCoverage=79%, E-value=6e-94, Identity=36%"; Hit description=Heat shock factor protein hsf8-like
  Pfam annotation: Domain name=S1; Domain location=549-603; Score=11.6; E_value=0.017; Accession=PF00575.13; Description=S1 RNA binding domain
  Subcellular localization annotation: CTP_CleavageSite=31; ConfidenceScore=5.19e-01
MGSLPLTSSKPWFSPEKTTRRRAISLNQRVKVFASRSRNEGEKEPPKLDSHDLMELKFGRLLGEDPKLTLAKIMGRKVNPDASYLDIEKAFYKNKGKIVEVEEVPFEGSKGGSSSRKFDDLGLVRPVPAKGMKFKSDNNKPALDFKKPVRADNKEVGVRKSSVPHVILRKPAALKDDSDGDTLTSRLRMRPNLSLKMQDEQVKARFSDMTLLRKPEAAIQEPSSSVDDQGNYDGELKMWNGELSDEIGGFTLLERPHKPSGEKEESGEREMLEVNVMIPNDVGANLCASCNVEFSNGLEQHEERQLEFHEESTDLGQLSDDSRVELSVEAALQAKPKRLDQYVKQASKLVGEEGASLNIGARTNKDDLGKVVDMSDFQESEDADWTRAQDLIKTGDREDVELVSCNTKGFIVSFGSLVGFLPYRNLASKWKFLAFESWLKQKGLDPSIYKQNSGTITSFDAEIKNLSPDSPPSLEIDGKVEDRISPDMKLEDLLRIYDQEKLKFLSSFVGQKIKTNVLVADRKMRKLIFSLRPKEKEELVEKKRNLMAKLQVGDIVKCRVQKIAYFGIFVEVEEVSALIHQSELSWDATLNPASYFQIGQMMS

SEQ ID NO: 226785 - protein, 178 aa, Glycine max
  Coding DNA Sequence Number=SeqID_110007
  Gene Ontology: Mol. function=galacturonate binding; Cellular component=plasma membrane; Biological process=cell-cell signaling
  Homolog annotation: Hit_ID=P93788; Match level="QueryCoverage=68%, HitCoverage=61%, E-value=2e-35, Identity=59%"; Hit description =Remorin
  Pfam annotation: Domain name=Remorin_C; Domain location=61-172; Score= 127.1; E_value=4.8e-35; Accession=PF03763.4; Description=Remorin, C -terminal region
EYRGTNEAREVENTDTSSGVRQEYAFSPLNLSLFAKWNRFRSFLVILSKKVKKKDAVLARVESEKRLALIRAWEESEKTKAENRAYKRHNAVVLWENSKKASAEAHLKRIEEKLDRNKAKCVEKMQNNVAEIHRTAEEKRAMIEANRGEEFLEIEEKAAKFRTRGYSPRKYLPCFGSS

SEQ ID NO: 226786 - protein, 169 aa, Glycine max
  Coding DNA Sequence Number=SeqID_110008
MAKYDPEIVMEFYVDAWLIEEEVRDKHSWFLGHPWVLEEGQCCEFSERRSQASGFDKEAIGQLLCISGQDFARSVPGRRVQIMRTSMTTLTQIWMTLLLNNILPSYRNSNLPLPKCQLVYAILTQDCTSKAPSGPKKVQQGTGVFDLDHGSLPVLWGAGYAHKAHLASH

SEQ ID NO: 226787 - protein, 76 aa, Glycine max
  Coding DNA Sequence Number=SeqID_110009
MELYMQHLANQQQRQDPNPYSWPTPDQFGATIADVSSIGAYRPRIFFINVFLCFLEDEWQRNGEGRERGDAPSSRR

SEQ ID NO: 226788 - protein, 225 aa, Glycine max
  Coding DNA Sequence Number=SeqID_110010
  Gene Ontology: Mol. function=nucleotide binding; Cellular component =nucleoid; Biological process=mitotic chromosome condensation
  Homolog annotation: Hit_ID=UPI0000397B10; Match level="QueryCoverage =68%, HitCoverage=10%, E-value=3e-39, Identity=58%"; Hit description =COG3096: Uncharacterized protein involved in chromosome partitioning
MLQLELEERLEALSQNVSEAGERRMEMRQELEQIQQCIRELTARAPVWLAAHDALSQLMRSERRAAAGALAVKPPSSATKWRPANVKWKRRSNVSDSRAARKISAWSRWPNVSAACCCRKSTMTSPSTTLPYFSALYGPSCHAIVVPDLSLVREMLEGLEDCPEDLCLIDGDPQSFDDSVFAVEEQEKAVVVKIADRQWRYSRYPDVPLFGRAVRESRLEVVDAE

SEQ ID NO: 226789 - protein, 57 aa, Glycine max
  Coding DNA Sequence Number=SeqID_110011
MTKDKVDTSKPYTGAMRGTVHEPQVNLGADQKRSPHLPHFKTKVACTSGSLKIMLTT

SEQ ID NO: 226790 - protein, 96 aa, Glycine max
  Coding DNA Sequence Number=SeqID_110012
MGFEGLGARYLMERWKHEGMDVFIPEEYVIKRRLEKKAAASASASGKMSKSHSHRKNNESTHNRVSSSTTHPPNASYLSSGFGLVADNVVFTCLSA

SEQ ID NO: 226791 - protein, 96 aa, Glycine max
  Coding DNA Sequence Number=SeqID_110013
MSYLGDMEVEFENSFDPVSLTPPSEHLRSQVTLLHRVTDSIPHVNDPKTQMDFGHRKTTSSTGATKTRRKRLLRWSTQKKMVELSLGGSEHSGGVK

SEQ ID NO: 226792 - protein, 164 aa, Glycine max
  Coding DNA Sequence Number=SeqID_110014
  Gene Ontology: Mol. function=formate dehydrogenase activity; Cellular component=formate dehydrogenase complex; Biological process=electron transport
  Homolog annotation: Hit_ID=Q2KWI8; Match level="QueryCoverage=98%, HitCoverage=71%, E-value=2e-21, Identity=42%"; Hit description =Formate dehydrogenase associated protein
  Pfam annotation: Domain name=FdhD-NarQ; Domain location=1-146; Score=- 89.2; E_value=0.0016; Accession=PF02634.6; Description=FdhDNarQ family
MATPCDLEDFALGFSLSEGLIATPAQLLAIEVRPQLEGIELQMTVTEDAPGADLDPANGRLLPGRGGCGLCGTRQLEEVLRPLPEVRERRTYPPAALQRALATLVQHQPMNAVSGSTHAAAWADASGRIGWPRQLRNGQQGRTGRRQRTGCGLGTDRAGDRPCP

SEQ ID NO: 226793 - protein, 374 aa, Glycine max
  Coding DNA Sequence Number=SeqID_110015
  Gene Ontology: Mol. function=transporter activity; Cellular component= integral to membrane; Biological process=transport
  Homolog annotation: Hit_ID=Q8XZF6; Match level="QueryCoverage=96%, HitCoverage=90%, E-value=1e-113, Identity=58%"; Hit description =Putative efflux permease transmembrane protein
  Pfam annotation: Domain name=MFS_1; Domain location=1-341; Score =120.9; E_value=3.6e-33; Accession=PF07690.6; Description=Major Facilitator Superfamily
  Pfam annotation: Domain name=Sugar_tr; Domain location=3-369; Score= -149.6; E_value=0.034; Accession=PF00083.14; Description=Sugar (and other) transporter
  Pfam module annotation: Pfam domain module=MFS_1::Sugar_tr; Domain location=1-341::3-369
MDVSSEMIHSLLPLFMATTLGASVIVIGLIEGLAEATALIVKVFSGVLSDYLGKRKGLALLGYGLGAISKPFFAIASSSGMVMSARLLDRVGKGIRGAPRDALVADVTPPEIRGAAFGLRQSLDTVGAFLGPLLAVGLMLLWHNDFRAIFWVAAIPAALAIALLFFGLKEPAAAITHKRTNPITRANLRLLGRGYWWVVGIGAVFTLARFSEAFLVLKAQQGGTPLALIPLVMVAMNLVYACSAYPFGKLSDRMSHEGLLKAGLLVLIAADVVLALSDHWGGVLFGVALWGVHMGMTQGLLAAMVAHTAPAHLRGTAFGMFNLISGVALLLASLGAGTLWELFGSASTFYAGALICVVTLVGMQLAPFGERRGA

SEQ ID NO: 226794 - protein, 254 aa, Glycine max
  Coding DNA Sequence Number=SeqID_110016
  Gene Ontology: Mol. function=nucleoside-triphosphatase activity; Cellular component=intracellular; Biological process=regulation of transcription, DNA-dependent
  Homolog annotation: Hit_ID=Q9AGD7; Match level="QueryCoverage=95%, HitCoverage=40%, E-value=8e-67, Identity=57%"; Hit description =Putative transcriptional regulator
  Pfam annotation: Domain name=HTH_8; Domain location=214-249; Score =47.7; E_value=4e-11; Accession=PF02954.9; Description=Bacterial regulatory protein, Fis family
  Pfam annotation: Domain name=Sigma54_activat; Domain location=8-175; Score=111.0; E_value=3.6e-30; Accession=PF00158.16; Description =Sigma-54 interaction domain
  Pfam module annotation: Pfam domain module=HTH_8::Sigma54_activat; Domain location=214-249::8-175
SRFFQRQLRGDQLCGAARAADRIPAVRLCAGGVYRRLPKGYIGKIREADGGVLFLDEIGDMPASLQTRLLRVLQEKTVTPLGSRSAYPVDFALVCATHHDLHRQVEAGAFREDLLYRIQEYSLRIPPLRERAQLEAFIMQLWRELGGERRDIRLLPEALAMLARYPWPGNVRQLLSTLKVLLALADDHAVLTLDDLPQSIAVLAPRQENADTGLEALQAAIDRAGGNLSRAAKALGVSRSTLYRKLGRQKAAAE

SEQ ID NO: 226795 - protein, 299 aa, Glycine max
  Coding DNA Sequence Number=SeqID_110017
  Gene Ontology: Mol. function=transporter activity; Cellular component= outer membrane-bounded periplasmic space; Biological process=transport
  Homolog annotation: Hit_ID=Q6D584; Match level="QueryCoverage=94%, HitCoverage=86%, E-value=1e-105, Identity=67%"; Hit description=ABC transporter, substrate binding protein
  Pfam annotation: Domain name=SBP_bac_3; Domain location=51-283; Score= 106.0; E_value=1.1e-28; Accession=PF00497.10; Description=Bacterial extracellular solute-binding proteins, family 3
MIVMAALLSFSAAAAPGVDLVANETPIHTVKSAEAVAKIPADFKFVEPGTLTVAISLLGSGPPFGLYARDNKTVIGSEADIARLVADGLGLKLKLVPTSWEDWPLGVASGKYDAAVYNITVTNERKTKFDFATYRQDTLGFYVKSDSKITQINTAPDIAGKKIIVDSGTNQEAVLLAWDKENRAKGLAPLQPVYVTDKAASTLAIQSGRADATFGPNVSGAYQARLTGKTRLVGIVPGGWPKTANIAVTLKKGNGLVDAVQASLNSAIANGSYLQVLDRWAESDEKIAHSEINPPGLGD

SEQ ID NO: 226796 - protein, 662 aa, Glycine max
  Coding DNA Sequence Number=SeqID_110018
  Gene Ontology: Mol. function=protein-tyrosine kinase activity; Cellular component=integral to membrane; Biological process=protein amino acid phosphorylation
  Homolog annotation: Hit_ID=Q8GY10; Match level="QueryCoverage=94%, HitCoverage=95%, E-value=0.0, Identity=64%"; Hit description =Putative receptor protein kinase
  Pfam annotation: Domain name=LRRNT_2; Domain location=25-66; Score =41.9; E_value=2.1e-09; Accession=PF08263.3; Description=Leucine rich repeat N-terminal domain
  Pfam annotation: Domain name=LRR_1; Domain location=119-141; Score =14.9; E_value=0.3; Accession=PF00560.23; Description=Leucine Rich Repeat
  Pfam annotation: Domain name=LRR_1; Domain location=143-165; Score =9.6; E_value=4.5; Accession=PF00560.23; Description=Leucine Rich Repeat
  Pfam annotation: Domain name=LRR_1; Domain location=167-190; Score =13.7; E_value=0.67; Accession=PF00560.23; Description=Leucine Rich Repeat
  Pfam annotation: Domain name=LRR_1; Domain location=212-234; Score =5.8; E_value=23; Accession=PF00560.23; Description=Leucine Rich Repeat
  Pfam annotation: Domain name=LRR_1; Domain location=71-93; Score=4.3; E_value=45; Accession=PF00560.23; Description=Leucine Rich Repeat
  Pfam annotation: Domain name=LRR_1; Domain location=95-117; Score =12.7; E_value=1.2; Accession=PF00560.23; Description=Leucine Rich Repeat
  Pfam annotation: Domain name=Pkinase; Domain location=363-636; Score=- 14.4; E_value=1.1e-07; Accession=PF00069.15; Description=Protein kinase domain
  Pfam annotation: Domain name=Pkinase_Tyr; Domain location=364-636; Score=-74.6; E_value=6.8e-08; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=25 -66::119-141::143-165::167-190::212-234::71-93::95-117::363-636::364 -636
MKLYTSLLLLGLVSMLSFVASVMIPSGEVLALKTFKEAVYEDPHMVLSNWNTLDSDLCDWNGVSCTATRDHVIKLNLSGASLRGFLAPEFGKITYLQELILHGNSLIGVIPKELGMLNSLKVLDLGMNQLTGPIPPEIGNLTQVMKINLQSNGLTGRLPPELGKLKYLQELRLDRNKLQGSLPGGGSSNFSSNMHGMYASGVNMTGFCRLSQLKVADFSYNFFVGSIPKCLAYLPRSSFQGNCLHIKDIKQRISVQCAGASPAQSGPVVNPRYLPATKHVTKHQEASKPAWLLALEIVTGTMVGSLFIIAILSAIQRCNNKPSIIIPWKKSASGKDYMAVHIDSEMLKDVMSYSRQDLEVACEDFSNIIGSSPDSVVYKGTMKGGPEIAVISLCIKEDNWTGYLELYFQREVADLARLNHDNTGKLLGYCRESSPFTRMLVFEYASNGTLYEHLHCYEEGCQLSWTRRMKIIIGIARGLKYLHTEIEPAFTISELNSNAVYLTEDFSPKLVDFESWKTILERSEKNSGNVSSQGAVCVLPNSLEARRLDTKGNIYAFAVLLLEIISGRPPYCKDKGYLVDWARDYLEMPEVMSYVVDPELKHFRYEDLKAICEVITLCINPDHSVRPSMRELCTMLESKIDTTINLELKASSLAWAELALSS

SEQ ID NO: 226797 - protein, 418 aa, Glycine max
  Coding DNA Sequence Number=SeqID_110019
  Gene Ontology: Mol. function=RNA-directed DNA polymerase activity; Biological process=RNA-dependent DNA replication
DSLTGAALKWYMNLDSASIRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLAVESTPAASNAKKFGGHFAKKKDQEVGMVAHGKPQQNFTPYRQVANVASTIPNPSYHQQRPHYPYPYPPQQYPPQQYPPQQYPPQPYPPQQYPPQQYHQPHTLKNNKIARRPPNNPYHSQNRQKTTFDPIPMKYADLLPALLAKNLVQNPNVQANPLPNHGPAVNMIQDCDEDGVILNVQHIRTPLVPIHIKMCEAALFDHDHAACEICPVNVKGCPKVQGDIQGLIDSRELTIKRKDREVCVITPEFQRLEISCNSGESTTTPLVISLPGPMPYASLKAVPYKYSATMLEGGQE

SEQ ID NO: 226798 - protein, 62 aa, Glycine max
  Coding DNA Sequence Number=SeqID_110020
MEFVTAPASCGFTHQYILKDTNDIFKGMPATSHGLGLSTEYQAKLSPYSQGLEKRKSFRIFQ

SEQ ID NO: 226799 - protein, 63 aa, Glycine max
  Coding DNA Sequence Number=SeqID_110021
MATLGLEILVESASSVILKMILSFDLAFALIPLLKFSSSKVTSSTSIEEAKYFNDGPYQNPSL

SEQ ID NO: 226800 - protein, 44 aa, Glycine max
  Coding DNA Sequence Number=SeqID_110022
MEAWGCCLHSSRELGVFKVRGESFGEDISMALYGSAFAYSNPLK

SEQ ID NO: 226801 - protein, 226 aa, Glycine max
  Coding DNA Sequence Number=SeqID_110023
MEHITTSDERFKSLESTMSNIVTLMSQRTLDTLPSQTKVNPQNEEINVVSTRSGKSVVESKKKEKKLPPKLKDLGSFSVPCSIGNLSFDRALSDLACRQDFHLLMRDSGRLTGQGTLIDLSEGKLTWRLGDEEEEFKPHPSVGKKNPSKNKVIPKDPGWSKKKGDDIIIQALGYGVDDYTRVLVKKTMFKDHGHLTMTHAFIVRIEYGCGKMTMAQVVSISVKHGR

SEQ ID NO: 226802 - protein, 82 aa, Glycine max
  Coding DNA Sequence Number=SeqID_110024
MVKCNAEPSSEGVAPKPKKLIGKMKEPPLSTTERSAVEVGPNASSLTKKEEEDLQHLKNLEISSYRMSISWSRLYLLNEFLH

SEQ ID NO: 226803 - protein, 161 aa, Glycine max
  Coding DNA Sequence Number=SeqID_110025
  Gene Ontology: Mol. function=metal ion binding; Cellular component =nucleus
  Homolog annotation: Hit_ID=Q6Z7B7; Match level="QueryCoverage=90%, HitCoverage=25%, E-value=1e-61, Identity=72%"; Hit description =Putative nin one binding protein
  Pfam annotation: Domain name=NOB1_Zn_bind; Domain location=14-79; Score=118.9; E_value=1.4e-32; Accession=PF08772.1; Description=Nin one binding (NOB1) Zn-ribbon like
MHYLCFSFNHLHSRWILKCHACYTVTGEIGRIFCPKCGNGGTLRKVAVTVNENGIVLAARRPRVTLRGTKFSLPLPQGGRDAVSKNLILREDQLPHRVLYPKTKKANKQVVCDDDFFTPDSVFSHHTDKKAPFQPPVRKAMAVFGGRRNPNDNHYSRSKHK

SEQ ID NO: 226804 - protein, 362 aa, Glycine max
  Coding DNA Sequence Number=SeqID_110026
  Gene Ontology: Cellular component=protein complex
  Homolog annotation: Hit_ID=Q9FLL1; Match level="QueryCoverage=83%, HitCoverage=50%, E-value=5e-86, Identity=54%"; Hit description =Arabidopsis thaliana genomic DNA, chromosome 5, P1 clone:MEE6
MEETPSSVPATASCWSNVVKKQPPPPPQQHTERVLVETSDSPNAISVAVVDANAVIESGEKLHGLADKFISIPEVMEEIRDPVSRHKLSFLPFTIQTMEPSSESINKVVKFARATGDLQTLSDVDIKLIALTYTLEGQIHGTKHIRDAPPPVQMVNVKRLPEKDLPGWGSNVPNLDEWEALEHAEDASNSNSRILPLQDLSLNIVSQDEHSVDGSVEPVSEADLGIQEGGQNGLTKPRRYLPKKKEIKIEGKTMVADGIDASQGGVDDNAGDWMPAVSRSTHRRYLRRKARREYHESLSSNQDQQELEANVVDGSVGEDASALNPPVHQRMKNNILKMLCWRMVRWLKRTKTMKVSMKLCSR

SEQ ID NO: 226805 - protein, 240 aa, Glycine max
  Coding DNA Sequence Number=SeqID_110027
MGENNNEFHAVATLPLKYLALQDLEWEGTLICLPPNLTSLSNNFTPKVLPLSMFPPSETTTTPVPPMLPSVEDTTYVQLNLQDQLSALQNINSGNNTHDYPQTQFLNRAAKKVAPVWPGSQSNHSLSVKGSSSKSNECRRWSEEEHRNMEKEIGKKFQESSKQETQLKLLLMPKNNGPVPHRIYQQNEVSFPNLDVPITHHIDHQNGVPFQNHTMQELYEIHLAVPHYINQQNWVLRPMR

SEQ ID NO: 226806 - protein, 135 aa, Glycine max
  Coding DNA Sequence Number=SeqID_110028
MNKDVYNGDLILIDDISDEVGSNGGQPTTPLGETQMTNSAEEDVDDVPYTSQNGVSWVADWGVHCCFGLAICLRVFYGRRHVLDVEAYCRNLPFGGRTTRESRVHLPRKEYARSRHQCLFEENVRKTGKDMIYEL

SEQ ID NO: 226807 - protein, 216 aa, Glycine max
  Coding DNA Sequence Number=SeqID_110029
  Gene Ontology: Mol. function=ribonuclease H activity; Biological process=DNA integration
MEDFIKPRHLKDFIHKPQSYRLHNSYRQDQDKGRDRDCSHQSQTMSERSRSRSKENARPIAQRKRKMREERCQAVQQEVSKMMTCIDYADLNRACQKDAYSPPQDRWLSRWDSGISNLEVYVDDMFLKFDDLSAHMKDLKEVFGQLRKHNMRLNLKKCVFGIRSPRNMKEAQRLVARIASLSRFLPRIVEKAKSIMNLRKKAKNFQWNDECEETFR

SEQ ID NO: 226808 - protein, 145 aa, Glycine max
  Coding DNA Sequence Number=SeqID_110030
  Gene Ontology: Mol. function=binding
  Homolog annotation: Hit_ID=Q1SA53; Match level="QueryCoverage=74%, HitCoverage=32%, E-value=5e-34, Identity=70%"; Hit description=HEAT
  Subcellular localization annotation: CTP_CleavageSite=16; ConfidenceScore=5.26e-01
MRVRRNRLAASRTGCLASPRRSTTAGTSALKWSLKWSPACTAAESRAWSAPCETLKLLSFKRSKQQSTREVTSLELRLLLEASSTLWRRSTPAIRSFASFARASSSASSIGSGTAGDGEFCGGLKMRGEVAVGERNRREDDAEMK

SEQ ID NO: 226809 - protein, 84 aa, Glycine max
  Coding DNA Sequence Number=SeqID_110031
  Homolog annotation: Hit_ID=Q6H974; Match level="QueryCoverage=47%, HitCoverage=4%, E-value=3e-16, Identity=87%"; Hit description=SEU1 protein
MAARIAVQSGAAGIIVSNHGARHLFMCWDNSIAYWRKFVAKYYSPRAKKRWCLSLYSNVGHHALGIFPTTKKMSFNITLLTSVI

SEQ ID NO: 226810 - protein, 85 aa, Glycine max
  Coding DNA Sequence Number=SeqID_110032
  Gene Ontology: Mol. function=binding
  Homolog annotation: Hit_ID=Q6KAI5; Match level="QueryCoverage=88%, HitCoverage=9%, E-value=1e-25, Identity=73%"; Hit description=CLIP -associating protein 1-like
  Subcellular localization annotation: CTP_CleavageSite=36; ConfidenceScore=5.15e-01
MEFCLASPCKIQVSSPTIIVERAGFFAWTSKSWRVREKFARTVTSVIGLFSSTELPLQRAILSPILQLLNDLNPAVREATILCIE

SEQ ID NO: 226811 - protein, 584 aa, Glycine max
  Coding DNA Sequence Number=SeqID_110033
  Gene Ontology: Mol. function=peptidase activity; Cellular component =integral to membrane
  Homolog annotation: Hit_ID=Q5PJU6; Match level="QueryCoverage=99%, HitCoverage=45%, E-value=0.0, Identity=53%"; Hit description =Possible exported protein
LHIKPLNTTLKNLTGRFRYNNGNLESEELQANWFGQPTGVRFTTTENPDDFGVNVKLLGDWQPAKLAMLPASVSSKLGGSLAWQGNVDITLPHQGGARYKVDINGDGKTVSSHLPPPLDKEAGEALPIAINASGDLHSFNLSGSVREHHRFNSRWLPEPQLRVDRGIWLNDAKSTPALPDRRGMVLNLPALDGEAWLGLMTGATGSRNAQGETDIGGALLPGDVTLRTPALTLGGQQWHDVNATVTQGAGGSTQLQLESREARGSLRTAQHAPWQIDLSYLYYNPQWSDDEAGKASSPFSGDSGIDFRSWPALQLNCAECWLRGQKFGHIQARLQPQGETLALTNGSVDTGSSKLNVAGEWVNKAGEQRTSLKGSLSGKNINDATNWFGMNTPLRDAPFKIDYDLHWRSAPWQPSEKTLSGTLKTHFGKGQIADVNTGRAGQLLRLVSFDALLRKLRFDFSDTFNEGFWFDSINGTAWIENGVMRTDNLLVDGLEADIAMQGKIDLVQRQIDMEAVVAPEIGASVGVATAFVINPVVGAAVFAASKVLAPLWNKISLLRYHISGPLDKPEINEVLRKPREADKK

SEQ ID NO: 226812 - protein, 118 aa, Glycine max
  Coding DNA Sequence Number=SeqID_110034
  Homolog annotation: Hit_ID=Q1SKD7; Match level="QueryCoverage=96%, HitCoverage=38%, E-value=5e-07, Identity=27%"; Hit description =Ankyrin
MAPKKLSAKRSRRDVAAEGTSAAPEFDSHRFRSAEEIARRHWMSLATPMTKFDPEVVLEFYANAWLTEEGVRDMRSWLRGQWIPFDADALSQFLGDPLVLEEGQECEFSQKEGQGRWV

SEQ ID NO: 226813 - protein, 74 aa, Glycine max
  Coding DNA Sequence Number=SeqID_110035
MLVEAMQEMDFVGEAFVVEGAFSVGWASDWKEVRYWLSNCTGAGNIGKWGGEGFVGTLATWELQLRHGHLPPFS

SEQ ID NO: 226814 - protein, 94 aa, Glycine max
  Coding DNA Sequence Number=SeqID_110036
MNDESFRGDRQHHTNLDDNTFFVKALGQVLTDARPMIRSITTQCPAKDVKEALLGGSLAMAPKKLLTKRARKDAAGEGSSAAPQAEIEFDGLHF

SEQ ID NO: 226815 - protein, 124 aa, Glycine max
  Coding DNA Sequence Number=SeqID_110037
  Gene Ontology: Mol. function=DNA binding; Biological process=DNA integration
  Subcellular localization annotation: CTP_CleavageSite=62; ConfidenceScore=5.22e-01
MIPLRLKHSSSCSGSVPSNGGSWRPPMVIGVGGGDVRVFGRKFKERKGVTCTRPDLAQAVIVVSRDTSYAFPGYSDSNYVTDLKARRFVTRYAFMIGNSLVSWKATLQPIVALSTTEEEYMTLA

SEQ ID NO: 226816 - protein, 235 aa, Glycine max
  Coding DNA Sequence Number=SeqID_110038
MVTKGMPWVCRSAFQGLMLRGSPRANLGFDEPLEKQDSLRVDLGFDEPLEKTNLGFDEPLETQDSPRTDLGFDEPLEKRDSPRANLGFNEPLERQDSLRAGIGKAFHWSLSGVNNEDEFVESNVQGPKDEFVGCLYMTIGLGMEAIPSYEVLRATSKYLIAPRAFGYSPIMSIPHMAKSQGELKLWRLSGRGVHPECRPIVAGTHHFGYKEAFSGIKTTDPIMKLSHDIICLLAV

SEQ ID NO: 226817 - protein, 247 aa, Glycine max
  Coding DNA Sequence Number=SeqID_110039
  Gene Ontology: Mol. function=RNA-directed DNA polymerase activity; Cellular component=mitochondrion; Biological process=RNA-dependent DNA replication
  Pfam annotation: Domain name=RnaseH; Domain location=113-233; Score= -32.0; E_value=0.055; Accession=PF00075.14; Description=RNase H
MHFRGRQRQVPPKVVEKAKPFYKMPKKTESSLWGKACEKAFLAFKKTITASAKHQLPIYFISYILHDVEKHYQMIEKVALALSTSTRHLGPYFQSHQVVVKTNYPIKRVLQKPKLARRMTSGAGVILEGPDNVTLVQALKLNFKASNNQDEYETLIAVLKLAREVGAKKLRCYIDLQLIQGKFTNIYLTKETMLLKYYHIAKTIINNFKCFKMYYIPKDNNTRADLLSKLVSTKKTEPLKTIIQETL

SEQ ID NO: 226818 - protein, 113 aa, Glycine max
  Coding DNA Sequence Number=SeqID_110040
MALKSSPFSDSLCKQSPTTLDKLRARIVGFIHMEEMTKFKEKVHGKSSRKPTKREAKTKSSHNKGKSRVDRPPQSKFSQDSLRIRNLHESKKGNAIEPRVQLDSRDNKIIVLE

SEQ ID NO: 226819 - protein, 131 aa, Glycine max
  Coding DNA Sequence Number=SeqID_110041
MPATSDLENGNSVNVANLLCQEPDKHTLIITLEREMKILKQSNAQEMDKLKKENTTLWEQYLKLQEDQSANSVSTIVTHQTHPTKIDEANTTWQEGKPSITQFRELQMLTLGYIPLLMGLWRHSSCLDRRH

SEQ ID NO: 226820 - protein, 318 aa, Glycine max
  Coding DNA Sequence Number=SeqID_110042
  Homolog annotation: Hit_ID=Q9SCB4; Match level="QueryCoverage=27%, HitCoverage=50%, E-value=6e-19, Identity=55%"; Hit description=I-box binding factor
MGENNNNEFHDFGGNTTSQGGYDGFDEPLYWKYPALQDLEWEGTLICLPPKLTSLSNNFAPKVLPLSMFPPSETTTTPVPPMLPPMEDTTYVQPNLQDQLSALQNINSGNNTLDYRQTQFLNRAPNQVAPMWAVLRSPMSAGDGVKKNTGCFCLGFRNMEREIGKTFQESSKQETQLKLLLMAKSISFVRPQVIKAKEEAFMAWSYQIMVLSLTTFTSRMEFLFQILTALSLTTLIIRMEFLFKILQCRNYIKFIWQSLTTLISKIGFLDQCDKYIKSTARDHIDDRSLTTLEARLRNFFVFEGCIACLVYSRKLSNC

SEQ ID NO: 226821 - protein, 175 aa, Glycine max
  Coding DNA Sequence Number=SeqID_110043
MKSTTVEIKKAEPKKPNPPAPSSKRYNDSRSSYGGGYGDGYDGFGGNFGMGGYRSGGAYGGRGSAGAYGGFGSEFGGYGGYASAMGPYRGDPSLGYAGRYGGGYGRGYDLGGYGGPSDGYGAYGGVGGGSSGSAYGSSYDASLGGGYGGPAGGSFYGTRGGYAGAGTGRYHPYGR

SEQ ID NO: 226822 - protein, 179 aa, Glycine max
  Coding DNA Sequence Number=SeqID_110044
  Homolog annotation: Hit_ID=Q6KA74; Match level="QueryCoverage=57%, HitCoverage=15%, E-value=7e-19, Identity=46%"; Hit description =Ankyrin repeat protein-like
MAKSSKDPMTSYLAIKAKQYLHNPIHYVMAIRDHTKLSKIISSLPYVDISLHNAVGWNPLQEALCLRASDIMQVLVRLHHCAAWAKWCRRLPRLVVALRRMRDFYMEISFHFESSVIPFVGKIAPSVIQFFKGCSLVSSVVFGRSCCKRENSERMKEVFRRSCRGGILQHKRISNSFIK

SEQ ID NO: 226823 - protein, 94 aa, Glycine max
  Coding DNA Sequence Number=SeqID_110045
EKLAAQLAQASKVASSRSKSLLEESSGGPKWAWGQWISFDTNALSQILGDPLVLEEGHQWFCPDRCKEEGADYVHQHDHFDLDVDETAAQQCLA

SEQ ID NO: 226824 - protein, 39 aa, Glycine max
  Coding DNA Sequence Number=SeqID_110046
MGSSVQRICGSQAGKDWEYPGFDGRFSGAHRDCATKAPH

SEQ ID NO: 226825 - protein, 388 aa, Glycine max
  Coding DNA Sequence Number=SeqID_110047
  Gene Ontology: Mol. function=transporter activity; Cellular component= 1-2nm peptidoglycan-based cell wall; Biological process=transport
  Homolog annotation: Hit_ID=Q8U6Q5; Match level="QueryCoverage=33%, HitCoverage=49%, E-value=2e-63, Identity=94%"; Hit description=ABC transporter, nucleotide binding/ATPase protein
LSTGDTQNTHRRLHDVAQHGHMRKEIEALENHADVVADLAQVFFRGHEGALASRLMVRHVSQRQFSLLEGFECHENAQDRRLAGAGRADEGDFFTLRHAEIELVEHRQNAEAFRDIRKFDQWLIGGVGHRKGIPAFGSALCRRLRPAEQIMVRRRKIRPTSVSGTRYSKIVAHGWNDARNGLGNDDIAIGLHARQVKRGRRFPLAMVYRLYAAAIDLGSIGRILQAERQRAGQKRGQDNAEIRKHVIKKEQLHQKRRIAQEFDHQRSRPGNHLYPAAAQQRKDKSQNQRNGKTGGGCLQRHGQADQNDGQDGGRVGEPGGRVPFVTIHHEKISLRMARAREDIAAPHEAFDHPDDDHQDQRHREITKQRDRIDAGAVQRQVADRLRSE

SEQ ID NO: 226826 - protein, 133 aa, Glycine max
  Coding DNA Sequence Number=SeqID_110048
MHVRDQTIAYPYGLHISKATDVKIVVDKNQVMWMDTHKAFTFGYDGNDNAKHHDVLQVLRPVRKYYFDDACIFFIKDADNGSFIQCLLQLPTIQYERTYNMKKMIEEQMIAHVTQLHEAQKKKRLKKKKLLLL

SEQ ID NO: 226827 - protein, 205 aa, Glycine max
  Coding DNA Sequence Number=SeqID_110049
MRLPSDYGNKIVVIYACPRTHGGGATHWFPKEPGQGSCSGHGITFRSSRDPRHKFWEITNNASLCLSSKRSVDNVLSTPSHARSMINGEKPYSKEQCHDDNNKKKNNYERESFSSKRHIDDVLSNPSHTHSMNTREKLNSREQWHHNNKKKNYEREDSLGWKPLNKGNNTFERFYSQSTGKGRDKNKNIVETVVNNVIEETRGQG

SEQ ID NO: 226828 - protein, 60 aa, Glycine max
  Coding DNA Sequence Number=SeqID_110050
  Homolog annotation: Hit_ID=Q9LKR3; Match level="QueryCoverage=77%, HitCoverage=7%, E-value=3e-10, Identity=68%"; Hit description =Luminal-binding protein 1 precursor
MAMEDVGLHKSQVDEIDLDGSIGIPKVRQLSKDYFDGKEPDKGDNPDEELPMVLQCNEAF

SEQ ID NO: 226829 - protein, 384 aa, Glycine max
  Coding DNA Sequence Number=SeqID_110051
  Gene Ontology: Mol. function=iron-sulfur cluster binding; Cellular component=membrane; Biological process=electron transport
  Homolog annotation: Hit_ID=Q1H441; Match level="QueryCoverage=99%, HitCoverage=30%, E-value=0.0, Identity=79%"; Hit description=FAD linked oxidase-like protein
  Pfam annotation: Domain name=CCG; Domain location=147-214; Score=8.6; E_value=0.034; Accession=PF02754.6; Description=Cysteine-rich domain
  Pfam annotation: Domain name=CCG; Domain location=269-340; Score =12.1; E_value=0.015; Accession=PF02754.6; Description=Cysteine-rich domain
  Pfam module annotation: Pfam domain module=CCG::CCG; Domain location =147-214::269-340
MRNFLREQGKKKFNPGTAAGMMFLNVKDPATIKLLRGTMIQMGYKAINIANSLAKKFGLLKDKKAPPATVGRAEIKAQVVHFINRPMPKKMQSKTSRAMMGLEDDTMIPVIRNPQKVNEDSEAVFYFPGCGSERLFSNVGLATQAMLYEVGAVTVLPPGYLCCGYPQTAAGNHDKGQEITADNRVLFHRVANTLNYLDIKTVIVSCGTCMDQLQKYEFEKIFPGCRLLDIHEYLMEKDMRLQGVTGTRYMYHDPCHTPMKTYKPLEVTNKLMGTEVALNDRCCGESGTFAAARPDIATQVKFRKQEELEKGMAKMGLTVGAPEQPVKILTSCPSCLQGLSRYGDDTGIEADYIVVEMAKHVLGENWMENYIQKANNGGIEKVLL

SEQ ID NO: 226830 - protein, 278 aa, Glycine max
  Coding DNA Sequence Number=SeqID_110052
EAIAQLLCILGQDFAQTVAGRLVRIMRTSMTTLTQTWMTLLLSNVLPSDHNSDLPLPKCQLVYAIQTRMSVHVAQVIADAIYLFAGMVPTRHPLDTDKSNRALGFPVLITGLCQSYRVPVTPSKVIRPPITRAFIEKYCTPRQAHARPLGVERYLQHLVRQQAANHRGQGQGFAPFVCPTSKQFGAEVAWPGDWPDAQVGEEPAGSPGEADESHMDEDMTDLLGFLGQGWTFSPWVKVYGELGFWLKAHCRNLPFGGRATRDSRDACSTKGIRAESPP

SEQ ID NO: 226831 - protein, 123 aa, Glycine max
  Coding DNA Sequence Number=SeqID_110053
STLEALEEGSNDTGPDLECVIILQPRPHFSYVQFGILEKREKLEGVAAGVSLSLANVLSKYHPLSETSARLASKSNLEGNLPCKHEPSASPARPVSHLSLLALSTPGSLSQRSLTHAKRENGA

SEQ ID NO: 226832 - protein, 80 aa, Glycine max
  Coding DNA Sequence Number=SeqID_110054
TIPAPPIDSWVSYDDIHDRWMHYSGHIVPASETDIPHVPELGALSTSTRHAVDEPRHVVVGAPGSSTHEVIEECLRMTKR

SEQ ID NO: 226833 - protein, 103 aa, Glycine max
  Coding DNA Sequence Number=SeqID_110055
MVTIKLGGGIGPFRCGVSSRPLSYPNFVRGPLLGGMQLSFDHFEKKNHQKKVGVYLVKVGVQIATRPTWALQKIPPEGGCFWRKSPCSPGGAGWQASPQFSYK

SEQ ID NO: 226834 - protein, 141 aa, Glycine max
  Coding DNA Sequence Number=SeqID_110056
MHKALRTNAPLPYPQLVTLFLRHFQIPLDDEPFVQVKRSFAIGVGAVTSFGYRKDIDGYWIRKQDSPPPVPDERTLSPLPQRDASSTLMHEVLSELRGLRAFVGDCLDAMDAHFKGMDTRITQLEDDMGFIHRCFDPPAAP

SEQ ID NO: 226835 - protein, 65 aa, Glycine max
  Coding DNA Sequence Number=SeqID_110057
  Gene Ontology: Mol. function=sequence-specific DNA binding; Cellular component=nucleus; Biological process=regulation of transcription, DNA-dependent
  Homolog annotation: Hit_ID=Q8LLR1; Match level="QueryCoverage=98%, HitCoverage=26%, E-value=2e-20, Identity=76%"; Hit description=MADS -box protein 3
  Pfam annotation: Domain name=K-box; Domain location=3-65; Score=36.5; E_value=9e-08; Accession=PF01486.8; Description=K-box region
MQKDSLVYNNISWYQEVSKLKAKYDSLQRTQRHLLGEDLGPLNIKELQNLKKQLERALTQARQRK

SEQ ID NO: 226836 - protein, 166 aa, Glycine max
  Coding DNA Sequence Number=SeqID_110058
  Gene Ontology: Mol. function=transcription regulator activity; Cellular component=nucleus; Biological process=regulation of transcription
  Homolog annotation: Hit_ID=Q9LK48; Match level="QueryCoverage=68%, HitCoverage=32%, E-value=1e-08, Identity=36%"; Hit description =Similarity to DNA-binding protein
MGTQENNNSPLHDLREVANSQEESTIFEQTPNGDTGEKPSPETSEDSNAKRSNPNKGEGNENDQVKVEEESKECNNRNANDEKQSKSNSKPPEPPKDYIHVRATRGQATDSHSLAERYTLNTNFFNTKEQKAENTKEHKDLSSTWTNGFAYCNTMSMVSGSRHGQD

SEQ ID NO: 226837 - protein, 72 aa, Glycine max
  Coding DNA Sequence Number=SeqID_110059
  Subcellular localization annotation: CTP_CleavageSite=16; ConfidenceScore=5.11e-01
MAIASQSLKPWQFTVHATNNSSHVPHASLWCCCCWWFFSMALGRRLQVDWTRDPREGPRVLMSLRVDFESMG

SEQ ID NO: 226838 - protein, 237 aa, Glycine max
  Coding DNA Sequence Number=SeqID_110060
  Homolog annotation: Hit_ID=O81060; Match level="QueryCoverage=68%, HitCoverage=8%, E-value=4e-20, Identity=36%"; Hit description =Similar to late embryogenesis abundant proteins
MLTLDVLHRRLKWTNTILKEENTILKSQNSGIAQADPKEENTILKDEQKSQDFSSDHSKNTSTDAKEEPSSPSMSSKHQTIEREGNNSEKKDNKNMQHVSHQTHSNNLAFNAPAFSVSQALDALAGMDDSTQVAVNSVFGVIENMISQLGQSSENEEVEDGKDVEQKIEEKQKTNSQTKDSNTSVDPSVDDHHNDMHLNNGSCHTEEQPSQSLSEINGNHIFNAQSCNSNDHLVAGD

SEQ ID NO: 226839 - protein, 55 aa, Glycine max
  Coding DNA Sequence Number=SeqID_110061
  Homolog annotation: Hit_ID=Q2QMW0; Match level="QueryCoverage=73%, HitCoverage=8%, E-value=8e-13, Identity=73%"; Hit description =Expressed protein
MSISVDCRTRGQAYSLPADIQYLDARWEVPVVLPLRDCFAQEINMLCRLDGFVVL

SEQ ID NO: 226840 - protein, 36 aa, Glycine max
  Coding DNA Sequence Number=SeqID_110062
MNERGLWAKQRETDVELTIVTLLDIPGGGNRMVKEF

SEQ ID NO: 226841 - protein, 81 aa, Glycine max
  Coding DNA Sequence Number=SeqID_110063
MDNIPIKLCCNLPFRGRARRGSWVRLPKEENARSCHQRLYVENVRKTEGKPVMKNIPDSGVVFTFEEGISTSHVCPKGQQP

SEQ ID NO: 226842 - protein, 91 aa, Glycine max
  Coding DNA Sequence Number=SeqID_110064
AFPGDPVLNAPRGPQYQSPPRPLHFARGEGPSIVLENERIEHMEERLCAIEGGKSYVFANMVERSGSSNSALDDGEGDDNNDSGHIAGVLL

SEQ ID NO: 226843 - protein, 179 aa, Glycine max
  Coding DNA Sequence Number=SeqID_110065
  Gene Ontology: Mol. function=phosphogluconate dehydrogenase (decarboxylating) activity; Cellular component=mitochondrion; Biological process=D-gluconate metabolic process
  Homolog annotation: Hit_ID=Q8UF73; Match level="QueryCoverage=90%, HitCoverage=34%, E-value=1e-86, Identity=97%"; Hit description =Phosphogluconate dehydrogenase, decarboxylating
MKKARLRGPLSLSNGRSENIGAAAPRAMRLVHAVGAFETMRAEEVALRLDEIGAAAAATIGVEIAKGGSQRRNRQARQGSVRNDAAQRRIGFLDDGGESRRHDEVGHMRILGKGRGDLIEELRADDAAGAPDAGNRRHRQVPVELLRSGRHDGEALRIGTDLGGQKRAFQIGDEGLPVG

SEQ ID NO: 226844 - protein, 153 aa, Glycine max
  Coding DNA Sequence Number=SeqID_110066
  Gene Ontology: Mol. function=RNA-directed DNA polymerase activity; Cellular component=intracellular; Biological process=RNA-dependent DNA replication
FYRRFIKDFSKVALPLSNLLQKEVEFDFDDRCKEAFDCLKRTLTTTPIIQAPDWTTPFELMCDASNYALGVVLAQNIDKLSRVIYYCHTLISSGDLCLMTCDLSLVLVRCLAPIIRQFVKFQDMPENRKNIDAQSVSFRDTPEIKWKHRCIIK

SEQ ID NO: 226845 - protein, 121 aa, Glycine max
  Coding DNA Sequence Number=SeqID_110067
MRIQGTNRLRILCPNTLEGTSFVAQVEGTSTWVVILRRREGISLVDQFKWRVHPLGCSKRTGEGTSLVDLWLVKDFTRLKEISRTISCFGTGCRHGLWPNQYKSCVCLLLPYTLYLYVVYF

SEQ ID NO: 226846 - protein, 244 aa, Glycine max
  Coding DNA Sequence Number=SeqID_110068
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=4e-22, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLYIVAIRGLHVLPFRGQHDLPFRGLHALALTGLHVLTFRGLHNLAFRGLDALAFRGVHILPLRGLHALAFVGLHTLTFKGVHILNFRGLYIVAIRGLHVLAFRGLHVLPFRGQHDLPFRGLHALALTGLHVLIFRGLHNLAFRGLDALAFRGEYTYSTPEDYTSSPSEGYTSSPSEGYTSSTSEDYMPIPSKDTFIGLHALGFVRLHALTFRGLHMLAYRRQHTFAFVGLQALTFRGLHILVF

SEQ ID NO: 226847 - protein, 791 aa, Glycine max
  Coding DNA Sequence Number=SeqID_110069
  Gene Ontology: Mol. function=nucleic acid binding; Cellular component= nucleus; Biological process=DNA integration
  Pfam annotation: Domain name=zf-CCHC; Domain location=181-198; Score =6.7; E_value=0.077; Accession=PF00098.13; Description=Zinc knuckle
  Pfam module annotation: Pfam domain module=RVT_2::zf-CCHC; Domain location=479-708::181-198
MEDAGNSFYLHLSDNSGILLVSQPLNGDNYSSWSRSMRMALIAKNKIGFIDGSIPILEIGDSLFHSWQHNNNIVASWIINSISKDLASSVIYSTSAHDIWKDLQERFQQSNAPRIFKLKRDLIGLLLAHGICVIISYGIEEKQREVGAPSVYASPTLAYVVNTTSASSGDQKHKNPKKDRPTCTHCGLLGHAKDRCYKIIGYPPHYNKKNKPVANVHNVVSANEDTASNSAQMNFTPQQYQQLIRMLQTQLTHAQTPATDQTPDDLGTSFVVQVEGTSTWVIVTKNKRGYISCGSVQVEGTSTWVIVTKNKRGYISCGSVQVEGYKGYKLYNLQTRKFFLSRDVHFSEDVFPFHATHISLTDRSIDPFLEVVLPIPASNIVDHLPQPVPEVTPALAQPPVNDVNDALVVVDPPLRRSTRQTRLPQYLQDYAMTVNYLIQQYLTYDRLSPFYKAFINQVSEEYEPQFYHQAMKFPQWRKAMQEEIEALEANGTWSVVALPTNKQAIGFTQRARIDFLDTFSLVAKLTTVKVLLSIASVQGWSLLQLDINNAFLNGDLFEEVYMSLSLAYAKSQSNHVCKLHKSLYGLRQASRKWFCKFSTALKTMGFQQSTSDYSLFSKGTGSTMVILLVYVDDIILAGPSHKHLLEVQAHLSQTFKLKVLGDMKYFLGLEIAKSSKGILLTQRKYTLQLLEDTGYLACKPQSLPVDPNCKLNLVDGEPLSDVILYQRLIDRLMYLTISRLDIMEHVTSGFLLLNHVSSSKQLADCLTKLVLASRFKEHMSKLGILNVYLPT

SEQ ID NO: 226848 - protein, 244 aa, Glycine max
  Coding DNA Sequence Number=SeqID_110070
  Gene Ontology: Mol. function=RNA-directed DNA polymerase activity; Biological process=RNA-dependent DNA replication
  Homolog annotation: Hit_ID=Q1SD42; Match level="QueryCoverage=76%, HitCoverage=30%, E-value=1e-34, Identity=37%"; Hit description=RNA -directed DNA polymerase
FWHHQNILVNHHVNFASTNWMLMCLDSVKYNMHVNRHGVGLNVPHRGLRQGDPLSPYLFIHYCEGLTSLIQKAEARGHLHGIKNTPPPNIKDEVTSILEVLECLGTGSYLGLPSMIGRKKKVLVKVVAQAILTFCMSFLMPTSLFKEIQSMLNSFWWGSNRSMRRGINWLTWDKLAVRKGYGGMGFCHLLGFNLVMLAKQGWKLATIQVSFGVASKLLKWWLEEVSSEGSETGWCVVDLINPGS

SEQ ID NO: 226849 - protein, 61 aa, Glycine max
  Coding DNA Sequence Number=SeqID_110071
MRNEVSTSKGMSNPRGGQVGIQKALAARPVRDYDDSQLELLRFGKLESSSNHAGFSPKAQT

SEQ ID NO: 226850 - protein, 109 aa, Glycine max
  Coding DNA Sequence Number=SeqID_110072
MLWWNNKQSLGGGLHVFKVFPSVGGREIEPEKYRGIRDVEGIRKYSEVREIMGLWLAKKNAFWRQRAKTHRFKDGDTNSKFFHAVASTRKKHNKISKLEDDGREIVETQ

SEQ ID NO: 226851 - protein, 118 aa, Glycine max
  Coding DNA Sequence Number=SeqID_110073
MAQSGGDGGGYNDIDSACGGSDEGGGDNDTDINGRVMVVMLVLMMMLVAMTVVVTMLMVVVMVTTSYDGDNDDDGDGGIGGGSDIGAISGGHRGDSGGDGNNKKVSLLNVRNICVLLN

SEQ ID NO: 226852 - protein, 128 aa, Glycine max
  Coding DNA Sequence Number=SeqID_110074
MVMTTMAMATGYCGGDDDGGVDTVGGGSDNVVVVAELVVITNGGNVGGSGGISDGGGGGGGSSSNSNFDDDDGDNDDGGVVVVILLAVVVVMVTMKMTMTLMVVVVVVMSMVMVMVMSMTTMLVVHDL

SEQ ID NO: 226853 - protein, 48 aa, Glycine max
  Coding DNA Sequence Number=SeqID_110075
MWFVDGTSLDMETITTETEVKWGMELGGPKYHMALATRATKDNYNLGP

SEQ ID NO: 226854 - protein, 96 aa, Glycine max
  Coding DNA Sequence Number=SeqID_110076
MEEEQGRVLLSKRLNGRCTGHLNVKEARESEFVVVATYPSAGGRRETRGMRVPRKEYVRSRHQRLFEENVGKTGKDAIYELFSERFGSCIYARGRY

SEQ ID NO: 226855 - protein, 123 aa, Glycine max
  Coding DNA Sequence Number=SeqID_110077
  Homolog annotation: Hit_ID=Q7EYZ3; Match level="QueryCoverage=73%, HitCoverage=34%, E-value=6e-14, Identity=49%"; Hit description =Putative placental protein 6
MTLLLSIGISFWTLEATTYLPTIIYAMYISWIYLKNRKRKPETKHRERSLTLSLQYFIECSMEDMMLLMMMDTVWKVSLYQVQTQLRHPGKGVADSKSYILISQLPPNVYEKYVVDVNTAHLS

SEQ ID NO: 226856 - protein, 106 aa, Glycine max
  Coding DNA Sequence Number=SeqID_110078
  Subcellular localization annotation: CTP_CleavageSite=18; ConfidenceScore=5.03e-01
MPFFSLIFVFSLLLSKTLSFSRSPQNLSQKNNDPGIIHRWTVAKFEYHVCNPISNILTVGNSKIMEKKESHEESTSGGFNFFSVSLTFENSIGAVRGKAGEISGNR

SEQ ID NO: 226857 - protein, 121 aa, Glycine max
  Coding DNA Sequence Number=SeqID_110079
  Subcellular localization annotation: CTP_CleavageSite=26; ConfidenceScore=5.19e-01
MVMTTMAMATSIVATIIKILVVTAVAMMMVVSIQLVVVVLVMVVVAAVVVVVIAISMTMMVIMTMVGWWCNVGGDCDGGDGGDIVGGGGGDGDNEDDNDINGGGGGSNVDGDVNDDDVGSA

SEQ ID NO: 226858 - protein, 154 aa, Glycine max
  Coding DNA Sequence Number=SeqID_110080
MTSKAAKEIADRIASQGSFVPHGRQDILIAAIGRPEHPGRARATGASVPIKQYFGSASRTSRSSSSMPPEDLQQLTQQIRDQLKESITEKGLALPLEPEVGPSGPRVSTKESCVNPSRIDLGTGDSDKCGLYIEENPSRLVKDAEALVPVPTDE

SEQ ID NO: 226859 - protein, 119 aa, Glycine max
  Coding DNA Sequence Number=SeqID_110081
  Gene Ontology: Mol. function=chromatin binding; Cellular component =chromatin; Biological process=chromatin assembly or disassembly
  Homolog annotation: Hit_ID=Q1SAV4; Match level="QueryCoverage=76%, HitCoverage=23%, E-value=4e-21, Identity=53%"; Hit description =Integrase, catalytic region
  Pfam annotation: Domain name=Chromo; Domain location=37-90; Score =10.5; E_value=0.056; Accession=PF00385.14; Description='chromo' (CHRromatin Organisation MOdifier
SKIHPVFHVSLLKQHHGPPPVTGDPLPPTQVDNHPVVEPLSFLDWKWDSTMDPPSRLVLVQWRGLAPENTSWENWNSLRDAYNLEDKVDFPGEGIVRNETPGGNRPKRVTKRPIQYQDY

SEQ ID NO: 226860 - protein, 69 aa, Glycine max
  Coding DNA Sequence Number=SeqID_110082
MDKGLQGVLTSGHTNPFNSEMDFSINIEKGLPPLEAILRITDLSTGENAGPESGSGSGKALTLLLPPLG

SEQ ID NO: 226861 - protein, 101 aa, Glycine max
  Coding DNA Sequence Number=SeqID_110083
GRSPLTEVLDFSFKGKTSSGFPVIFNYLVRAYRIDVRQGYHVGGLIIHLNSLERGHYLEGTSVTTLSVEFLLECIAHSKFDLMKHRAVKVLSFQSFLQSSD

SEQ ID NO: 226862 - protein, 210 aa, Glycine max
  Coding DNA Sequence Number=SeqID_110084
  Subcellular localization annotation: CTP_CleavageSite=20; ConfidenceScore=5.39e-01
MDRLTTMMNALLSAQNSQAAAAAVEQPLVSTTPLSTVTSPPLFLPPGCTWGMPPPVCGSPQPAVSEVPLPFAQQSAPVPQPGTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALK

SEQ ID NO: 226863 - protein, 195 aa, Glycine max
  Coding DNA Sequence Number=SeqID_110085
MGTCRDKDSVDDTVCKKYDINKEKWAQFCQSHKDPSWEDVRKKAQVVLKQNTTPHVLSRGGYEYLEQELMVEKTKKKLEEVAQSGSTEAMIDPPSPIRRHMKWKMACTKKTIQMTSESTKEIAEKIDLLEEQASQAAIGRPEHPGRVRATGAGVTIKQYFGSAPRTFLTSSFMAPEELEQLTQQIRHQLEESITK

SEQ ID NO: 226864 - protein, 99 aa, Glycine max
  Coding DNA Sequence Number=SeqID_110086
  Homolog annotation: Hit_ID=Q43286; Match level="QueryCoverage=37%, HitCoverage=30%, E-value=4e-09, Identity=81%"; Hit description =HISTONE H2A VARIANT
MELKEDLTATYNIQITTSHTNPYHISPSLLITFTPESFEYFTFFLSKRKTSYCFWRLRMSGKGAKGLITGKTSAANKDKDKKKPISRSSRAGLQILPSL

SEQ ID NO: 226865 - protein, 495 aa, Glycine max
  Coding DNA Sequence Number=SeqID_110087
  Homolog annotation: Hit_ID=Q1S7S2; Match level="QueryCoverage=45%, HitCoverage=65%, E-value=2e-07, Identity=21%"; Hit description =Peptidase C48, SUMO/Sentrin/Ubl1
  Pfam annotation: Domain name=Transposase_23; Domain location=154-217; Score=-1.1; E_value=0.0015; Accession=PF03017.5; Description =TNP1ENSPM transposase
DSLEEQTTQGSFVPHGRDDILNTAIGKPEHPGRVRAAGSGMTLTQFYGRATRTSSSSSATLMQQQWVDIIGNIKEQVRNEYEEQHKRSLEEFKKELSSQIFIQLSQMGSQYSPLIEVDLQALAARLSTKGSNVETADVDPSGDKNVSLKPTMGLYVQRQHTTVLVALGKICEGGSVIHNVTYANDVVRVSVDKVIEGDAEVPFPTSEIQYVRQALQTFIAWPTNLVKKVSHEESDTSPKKLPETNERGTNDFDHDLLRQLIKSLYFMYDTPVELKWDDSKFGLSNVDASFFLTFSNVNEIVAGYKCLNISILQLWIKFLDEWSSTLGHASVYGFLEPQSIHNAKDRRAECEHYLQAWLKESQREVYLEAYLNQGHWQLVVLCPATNVVAWFCSLHVDHAIIISSAMKSTNTTADGTNNPATPKWIEVKSHVQSGGYECGYYVMHWMWNIVSGGLKNDWSMWFLDGTTLDNETITTIRQKWAAYFLKVQSNQCTKS

SEQ ID NO: 226866 - protein, 162 aa, Glycine max
  Coding DNA Sequence Number=SeqID_110088
  Homolog annotation: Hit_ID=O04892; Match level="QueryCoverage=39%, HitCoverage=12%, E-value=2e-15, Identity=67%"; Hit description =Cytochrome P450 like_TBP
MSRRARRSLQNPGREPGRSGRRCRSWCLPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGDGLGTGPSGPLPRASNSQLRTGTDKGNPTV

SEQ ID NO: 226867 - protein, 40 aa, Glycine max
  Coding DNA Sequence Number=SeqID_110089
MARPAIMGAILAMKIAHKKGWRSLWLECDSTLVVQSFKIV

SEQ ID NO: 226868 - protein, 467 aa, Glycine max
  Coding DNA Sequence Number=SeqID_110090
  Homolog annotation: Hit_ID=Q1T493; Match level="QueryCoverage=89%, HitCoverage=79%, E-value=2e-45, Identity=27%"; Hit description =Nucleic acid-binding, OB-fold, subgroup
  Pfam annotation: Domain name=Rep_fac-A_C; Domain location=309-436; Score=-66.3; E_value=0.049; Accession=PF08646.1; Description =Replication factor-A C terminal domain
VVNFGFQWLRWLCDYKVMARVANKIKLIDGSREALKLSIRITDLWFIGIPKKSEQAEMGDEIHVVCKQDQLKSRKVGLKENLTYVMHNFKVMKNDGKFRVCDHEYKLCFTRVTVVRQFDMEHLPFRKFKFVDFSSVIAGHFQTGLLVDVIGVVDEVVFRYVSSKNTRVVFKLKDLSGQVLSCTLWENYCLQFLSYLNEVEDERPIVILLTHARIKEAQGSYPPSVTNSFKASKLMINNLVLEIQEFRESLLDLGIEVRSVLTPIGQASSQVLGSSQLSSKDAFLSKAEVKNISQINAISEEIVCVTVDKITTIVMDNYSWCYPACGQCYKKADIETVPFTCPCGKRTINLYRVEVMVNHKGEQTKFFIWDRECAQLIGQSADEVNRLKIEDGDVDLNASPQALDRLLGCFLAFKVKVQPRFRNSIVLKYSDESDLVNAVLDMLPDSEPCCKIENSILESTDPTELES

SEQ ID NO: 226869 - protein, 68 aa, Glycine max
  Coding DNA Sequence Number=SeqID_110091
MVGVLVIRVPLHSHPINVPRSQRCFLKKTVFSKLKENRFPGEIELRELVGRRLANTRFVSGIEGGVGL

SEQ ID NO: 226870 - protein, 91 aa, Glycine max
  Coding DNA Sequence Number=SeqID_110092
  Gene Ontology: Mol. function=oxidoreductase activity, acting on the CH-CH group of donors; Cellular component=glyoxysome; Biological process=fatty acid metabolic process
  Homolog annotation: Hit_ID=Q96329; Match level="QueryCoverage=100%, HitCoverage=24%, E-value=3e-25, Identity=53%"; Hit description=Acyl -coenzyme A oxidase 4, peroxisomal
  Subcellular localization annotation: CTP_CleavageSite=29; ConfidenceScore=5.27e-01
MAINSSKNPDGSVQNAMPSYFYSPPLDVSAAFPQATPASTFPPCASDYFQLDNLLTTEEQAIRKKYWEKAKFPFHVIPKLGALRIAGGTIK

SEQ ID NO: 226871 - protein, 161 aa, Glycine max
  Coding DNA Sequence Number=SeqID_110093
  Gene Ontology: Mol. function=oxidoreductase activity, acting on the CH-CH group of donors; Cellular component=glyoxysome; Biological process=electron transport
  Homolog annotation: Hit_ID=Q6J513; Match level="QueryCoverage=87%, HitCoverage=32%, E-value=2e-65, Identity=85%"; Hit description =Putative short-chain acyl-CoA oxidase
  Pfam annotation: Domain name=Acyl-CoA_dh_1; Domain location=52-160; Score=-20.0; E_value=0.018; Accession=PF00441.14; Description=Acyl -CoA dehydrogenase, C-terminal doma
MPFGQNESLRFIIKKDAPGLTVTKIENKIGLRIVQNGDIVMRKVFVPDEDRIAGVNSFQDTNKVLAVSRVMVAWQPIGISMGIYDMCHRYLMERKQFGAPLAAFQISQQKLVQMLGNIQAMILVGWRLCKLYESGKMTPGQASLGKVVSNLCHSCNPGFLS

SEQ ID NO: 226872 - protein, 86 aa, Glycine max
  Coding DNA Sequence Number=SeqID_110094
  Subcellular localization annotation: CTP_CleavageSite=52; ConfidenceScore=5.13e-01
MAFQQALLHTLVAYKNYTCSGWCVFIVGGPGPIANCRPLRCPVCRTKATWVAASAAASCFTVTSSLSIPSTSRGGPVPAFVPFSEG

SEQ ID NO: 226873 - protein, 137 aa, Glycine max
  Coding DNA Sequence Number=SeqID_110095
  Homolog annotation: Hit_ID=Q2HTR2; Match level="QueryCoverage=40%, HitCoverage=10%, E-value=3e-11, Identity=58%"; Hit description =Cyclin-like F-box
MKTVSFRRDNTGTAWKGTAEKPSRLRYLTCFPYSKLRILWYYKASAYLFSEVKDLKLYVCHGLADIEMEEFTKNCKGMNKLSCRSCTFRSNGMNLVLNNHTTLKKLSISRGGYADLFDLFKASLEVHILYQPIKPAR

SEQ ID NO: 226874 - protein, 61 aa, Glycine max
  Coding DNA Sequence Number=SeqID_110096
MKQGRREDEQYKEGLKVRRQFRSRREVEMEMRAGTSSSILGSTVRGRVAKGEDVLTHCDCE

SEQ ID NO: 226875 - protein, 147 aa, Glycine max
  Coding DNA Sequence Number=SeqID_110097
MTIAQFIKHLEIVEKTVLVWHLERKEPQAYWFKVEFLLQWQHMKGISWLWKLPLAGNRKCKSILRFTASNFRTKKMFPGLEGFPNHTENATDVQDGMDRLSKLLDGISFVHNEAVPISINYRLLDDQRGSEVLTWFSQQRSWRHTWR

SEQ ID NO: 226876 - protein, 106 aa, Glycine max
  Coding DNA Sequence Number=SeqID_110098
MEMITRINEYLTCEQTNTFGHYALYNILVCNRCTCTDCLHNQISPTETRQESENGKVVESWDVCKSKGREKKKKKKGDEGDAPKAGCWVRLRFIGSYISSRSKVDT

SEQ ID NO: 226877 - protein, 158 aa, Glycine max
  Coding DNA Sequence Number=SeqID_110099
  Subcellular localization annotation: CTP_CleavageSite=49; ConfidenceScore=5.20e-01
TSYMLPADLSQMWMPNVPNMNEVNLSLPNNMGSMVSNVYETNLSHPNYMGSMVSNVYETNLSHPNYIGPMTPNMDGMNLNLPNYTGSMAPSDMNAMQFSLPNNMGQMVPIMDETNLNLPNFMGSMAPEMNEMNFSLPSNIGSMAPNPPSGTFPNPNLD

SEQ ID NO: 226878 - protein, 95 aa, Glycine max
  Coding DNA Sequence Number=SeqID_110100
  Subcellular localization annotation: CTP_CleavageSite=25; ConfidenceScore=5.53e-01
MGVANGSCNLHSNRKLQLQLPFRPVAGQLATTSGVFRATWRFPSKLATRSGGLLYYPCKGRRKEPPHGRGKVSNTGVLQPCSFHTWVELTQSSFY

SEQ ID NO: 226879 - protein, 147 aa, Glycine max
  Coding DNA Sequence Number=SeqID_110101
  Pfam annotation: Domain name=bZIP_1; Domain location=70-136; Score =12.0; E_value=0.0077; Accession=PF00170.11; Description=bZIP transcription factor
  Subcellular localization annotation: CTP_CleavageSite=51; ConfidenceScore=5.15e-01
MVASKPPLIPILSFQSLQKTFYRDAPGTSNSTPQNENNRLENPADINPALVASESTPKLIVDQTQAKSPDADLKKLRRMESNRLSSRRSWMKKLIYLTNLENQDQLAQLRPQIASHESQKQFLMLEKQTLLQRMEILEKEINFRECN

SEQ ID NO: 226880 - protein, 143 aa, Glycine max
  Coding DNA Sequence Number=SeqID_110102
MEAMIEQMTTMMEVMMSMRKMMEVNTTTVIVISTTTEVDLTHPFGLNHSKHSFPPYGLPPNYTPPNVAHAPDENVDNSAPIPIECQHSQSSHAQVPQPMGETHEVPQDNTLADFKPHLEYATEGQAFGGVPPPNTSGGPQYHP

SEQ ID NO: 226881 - protein, 172 aa, Glycine max
  Coding DNA Sequence Number=SeqID_110103
  Gene Ontology: Mol. function=glutamate synthase (ferredoxin) activity; Cellular component=chloroplast; Biological process =metabolic process
  Homolog annotation: Hit_ID=Q606H7; Match level="QueryCoverage=84%, HitCoverage=9%, E-value=2e-51, Identity=62%"; Hit description =Glutamate synthase, large subunit
  Pfam annotation: Domain name=GATase_2; Domain location=43-172; Score =7.7; E_value=1.4e-11; Accession=PF00310.11; Description=Glutamine amidotransferases class-II
MDMQSDNNLMSASQDTSTTLDDQFGLAPQSQGLYDRRHEKDSCGVGFVAHIKGQKSHDIVAKGLQLLDNLTHRGATGYDPKLGDGAGLLMQMPDTFMREEAAKLGMTLPAAGQYAVGQAFLPQNADNRAKCEAIFAQIIAEENQTLLGWRDVPVDNSNIADAARAVEPVMRQ

SEQ ID NO: 226882 - protein, 166 aa, Glycine max
  Coding DNA Sequence Number=SeqID_110104
  Gene Ontology: Mol. function=glutamate-1-semialdehyde 2,1-aminomutase activity; Cellular component=chloroplast; Biological process =tetrapyrrole biosynthetic process
  Homolog annotation: Hit_ID=Q478V1; Match level="QueryCoverage=99%, HitCoverage=38%, E-value=1e-52, Identity=60%"; Hit description =Glutamate-1-semialdehyde 2,1-aminomutase
MTTLGKVIGGGLPVGAFGGRKDIMSVLAPLGPVYQAGTLSGNPVAVTAGLTTLKLVQAPGFYEKLTAQTTKLMDGFKQAAQAAGVAFSAQSVGGMFGLYFSAQCPSSYAEMMLADKNAFNTFFHSMLDSGIYLGPSAFEAGFVSAAHTDADIAQTVQAATKAFAAL

SEQ ID NO: 226883 - protein, 185 aa, Glycine max
  Coding DNA Sequence Number=SeqID_110105
  Gene Ontology: Mol. function=transcription factor activity; Biological process=regulation of transcription, DNA-dependent
  Homolog annotation: Hit_ID=Q4IYT7; Match level="QueryCoverage=92%, HitCoverage=57%, E-value=1e-34, Identity=49%"; Hit description =Regulatory protein, LysR:LysR substrate binding domain
  Subcellular localization annotation: CTP_CleavageSite=68; ConfidenceScore=5.28e-01
IPSRASGGVHRAEGGRDGGPAAPAGARQARRGLRQAVLARARRGRTAVGRGTGVGLGRRQGLAARRTRAAGGVPRTLCLPRSRDRGAGQGAAGVVAGVRKRQHGRLPGGRAGRFRGGPGGAQPAAARAAGAVARRRHAGAAECALLCLRAFGRAGGAGAGGGGAADRPAAPLRRLSHGLAFPQSP

SEQ ID NO: 226884 - protein, 101 aa, Glycine max
  Coding DNA Sequence Number=SeqID_110106
  Gene Ontology: Mol. function=chlorophyll binding; Cellular component =integral to membrane; Biological process=photosynthetic electron transport
  Homolog annotation: Hit_ID=P56777; Match level="QueryCoverage=69%, HitCoverage=13%, E-value=7e-36, Identity=98%"; Hit description =Photosystem II P680 chlorophyll A apoprotein
MGHWGDKGIFMGLPWYRVHTVVLNDPGRLLSVHIMHTALVAGWAGSMALYELAVFDPSDPVLDPMWRQGMFVIPFMTRLGITNSWGGWNITGGTITNPGIW

SEQ ID NO: 226885 - protein, 120 aa, Glycine max
  Coding DNA Sequence Number=SeqID_110107
  Homolog annotation: Hit_ID=Q33B99; Match level="QueryCoverage=84%, HitCoverage=15%, E-value=7e-17, Identity=44%"; Hit description =Expressed protein
MPIASKTRNMLEGLIKEGSLKWLLGKKSYFGEEFEEMENSPSAGKNFIRELSPVANLVVRRCSKILRTSSSDLLESFNQEASDSMKHPSRYARNFLEYCCFKTRLGLIFEDHGSNIQEQF

SEQ ID NO: 226886 - protein, 91 aa, Glycine max
  Coding DNA Sequence Number=SeqID_110108
  Homolog annotation: Hit_ID=Q1RZJ4; Match level="QueryCoverage=98%, HitCoverage=1%, E-value=6e-30, Identity=72%"; Hit description =Aldo/keto reductase; Sigma-54 factor, interaction region
VSVTTHVIANILDSLFSKGFGISPENQKEDGTLNTSRDASGTGMGEGVGLKGVSDQIANEGQLLGTQEQQKEKQDYSNEVPSSNNTGIEME

SEQ ID NO: 226887 - protein, 128 aa, Glycine max
  Coding DNA Sequence Number=SeqID_110109
  Homolog annotation: Hit_ID=Q9ZWR4; Match level="QueryCoverage=37%, HitCoverage=5%, E-value=3e-11, Identity=69%"; Hit description =Importin-beta2
  Subcellular localization annotation: CTP_CleavageSite=23; ConfidenceScore=5.33e-01
MPTTLPPSSSSSMPPLSPPSPINLFTKSQNILIMPLPSLSLLPKVDDEAILKTDMDGLTGTFAITVGVVGDVCRGFEEKSGAELAADIYAADDNMTEYTNCLTNGILEAYSGILEGFKGSPKTQFLMS

SEQ ID NO: 226888 - protein, 200 aa, Glycine max
  Coding DNA Sequence Number=SeqID_110110
  Homolog annotation: Hit_ID=Q9FIS0; Match level="QueryCoverage=66%, HitCoverage=20%, E-value=9e-14, Identity=40%"; Hit description =Arabidopsis thaliana genomic DNA, chromosome 5, P1 clone:MTG10
FSSSTVTHPPTPQELQYITAILARTTALNSQGTPTTVSLNQPLDPSIFHHLEHPAGDKDRNFAPKDQLGHRWNRRLLFDLVDEVLREILESQEGEREKRPGRSVEGLVKRVWKRVEEFPRAKCEVLEDIDELIDLQREKDGERMEEEGEELVAEIEGNIWDTLVHETVIVMDCWENAKKEKLLLYDDSKISSHVCSLSQF

SEQ ID NO: 226889 - protein, 151 aa, Glycine max
  Coding DNA Sequence Number=SeqID_110111
  Subcellular localization annotation: CTP_CleavageSite=40; ConfidenceScore=5.55e-01
VRTCSPRKVRACSPTKARVCSPLKARVCSPLKARACSPLKARTSSPLKTRVLVPKIDCPFERGDNSCSLILSFANLSGNSLRVEPIGWELLICPLGLLEAHARCPLLPQYKALSWWIKSNDSYVEARCFDVLMMPKDQVLLSFIQDKNPRK

SEQ ID NO: 226890 - protein, 186 aa, Glycine max
  Coding DNA Sequence Number=SeqID_110112
  Subcellular localization annotation: CTP_CleavageSite=6; ConfidenceScore=5.37e-01
GSRRPRARPAKTPSTSAAPHPASTSAAPPPARIAATPSTPPPGEFQHFKAMLRSIHQGQIILLQTWPGTQPPLHRDDEDPAAQVPHQPLDESSESSTPKPLIRKRRVVVTQEAAATPEKSPEATPEPPVPMANTTSPQQAADPSTPEVQTTPVLSPNTSLVATPVLHLTNEEEVQTQDTQDQSQDL

SEQ ID NO: 226891 - protein, 117 aa, Glycine max
  Coding DNA Sequence Number=SeqID_110113
MAHQVPFAGVADLDDEGSADLRTNPLQEGGDDAILPRRGPITRVMARRLQEDWAKDAGDDPRILMSHRLRLHSVGRVKKRLSHEVQKVTVELSSTIGLSVHPPLSSASTHLARRRIR

SEQ ID NO: 226892 - protein, 150 aa, Glycine max
  Coding DNA Sequence Number=SeqID_110114
  Pfam annotation: Domain name=zf-CCHC; Domain location=78-95; Score =31.1; E_value=3.8e-06; Accession=PF00098.13; Description=Zinc knuckle
MELQRINQNEETDKKKRSIALKASSSMQEEENEEEESEDEEDFSLFVKKFKKFVKKRRIERRQNFNNGRRFQEDSQILRCYKCNQLGHIKANCPSNEEWPEKSDKKRYEERRTKKAYIALDDNDLSDGSEKEINLLTKDYESDENISQED

SEQ ID NO: 226893 - protein, 141 aa, Glycine max
  Coding DNA Sequence Number=SeqID_110115
MSTRRENTTLKMTGILNTNDHHDRRTQSPNAEEEDDAHDGNAARRIEVTEITSRLQKEEKMVRGLWAILAGLAGSVAVAILSSRVSATINTPSSRNHLVLKVVTWKYQVWSPGCKVVVGPGIGSQLEEAMVSKRTVVDRDE

SEQ ID NO: 226894 - protein, 93 aa, Glycine max
  Coding DNA Sequence Number=SeqID_110116
MKAECPQLKKKRYFGDKKKKSMMVTWDDSNGNKSSSLDDEQANIYLMVDTNEKIEVKTCFESDTSSSTSLDDEEDMPYDVLLQNCHMISLQCK

SEQ ID NO: 226895 - protein, 443 aa, Glycine max
  Coding DNA Sequence Number=SeqID_110117
MTNPWLSECCLAKPRYLRQGRPCGLSAIRCGMHKAKPALLAKPLYTDNILSQNILPERNVKLYHIEFDEFKVELERHNLHKCLANVQDGSIDVALVKEFYANLYTTEDQAPKQARVRGHLIKIDVDRLNEFLQTPVVLEEGESLPNYSRFCRLRTNHQEIEARLCIPRKGARLVYGLVTNMDMNIGALISGQISSISQSNSSRLRSLALITALSRARGVTSDNLTYESLSPAINLAYIKKNCWNMDDLTVNFKGAKKEKVRPAEVPFSSTLPAPSTSATLTPAPSDSSTQDSQCFESMLQSLHKGQILLMQSLQVVAPPGSILTVEQFLEKVSRPGTLPSLEREGGGPSAQEVATTERSPQISPDPPSPVVDQSSLQQPADPPTLVHEIPADPSTLLLDLPEDPSTPVLGLTTTPPATPMLCLTNEEDTQDEDTQSQDLSQEF

SEQ ID NO: 226896 - protein, 198 aa, Glycine max
  Coding DNA Sequence Number=SeqID_110118
  Gene Ontology: Mol. function=nucleic acid binding; Biological process= DNA integration
  Homolog annotation: Hit_ID=Q1SJY4; Match level="QueryCoverage=69%, HitCoverage=37%, E-value=9e-14, Identity=29%"; Hit description=Zinc finger, CCHC-type
NNIDQFIAKGTSLTKPLGFIGNDYLYWKDKREMYIKSIQYILSLIITNGDILIPKPEAEGTYIDLAIIELNTKARYTLTCALSKNEYNKICRLETTKEIWDSEGEYVDDMFRRLQVLLYILEALGYTFTKAQINLKILDNFSKFIFKIEIICQKDFAALKSGETRSRREEKKSSSKALKVLMAKFDGSNNSSGDSQMM

SEQ ID NO: 226897 - protein, 95 aa, Glycine max
  Coding DNA Sequence Number=SeqID_110119
  Gene Ontology: Mol. function=DNA binding; Biological process=DNA integration
  Homolog annotation: Hit_ID=Q1RVN6; Match level="QueryCoverage=65%, HitCoverage=8%, E-value=2e-18, Identity=69%"; Hit description =Integrase, catalytic region
MFLDLKPTEGGAVAFGGMGKGKIMGIGFCISYIKSDHGTKFENAEFRSFCEKNGSFHNFSSSRIPQQNGVVERKNITLQEMTGTMLCENLLPKHF

SEQ ID NO: 226898 - protein, 108 aa, Glycine max
  Coding DNA Sequence Number=SeqID_110120
  Subcellular localization annotation: CTP_CleavageSite=71; ConfidenceScore=5.57e-01
SYTLGKLSKIFRLIQALVKVCPRASSPFRRTCNPPNILSQRALRGRAKARLTGALSKGGKMRGVATNEGISTSYVDKSGAFAPTYPPLERKSDLRSSFLCMNQAILFT

SEQ ID NO: 226899 - protein, 172 aa, Glycine max
  Coding DNA Sequence Number=SeqID_110121
  Homolog annotation: Hit_ID=Q69L69; Match level="QueryCoverage=31%, HitCoverage=7%, E-value=1e-07, Identity=44%"; Hit description =Calcineurin-like phosphoesterase-like protein
MKRHEFLWEPYIAMVMSALPPICLVGSVAWCVVVPLICFQVVEWHQPDRVLRQFGMQQPIPGCPSQPQNIHGGLLSFNSDYMIEYRQKTKMFVDPKDANTATLRITKPVSHGPPPEHEFAPQEFHILSSSVETQGIGRRREAIEVEPYFYPQMENHGHGMYYTPPTFSQYPT

SEQ ID NO: 226900 - protein, 182 aa, Glycine max
  Coding DNA Sequence Number=SeqID_110122
MADLGEKGKREVEEDDEDSSELHDLVAHLGEGGTRERSKVQSLVSLMRKRKMRRRKKVSGGSGSGSDSSSPLGKDKLIFMVHNASSPARNDEVFLGVLSLFMGSPCSLFSEEWSHHVHWEFDRARTNHYVPRGQQVLKVGAQERRELVFVQVQHRSWTKALLPFFYFSLFSCLIMCVDAIDM

SEQ ID NO: 226901 - protein, 82 aa, Glycine max
  Coding DNA Sequence Number=SeqID_110123
MRFRMLAFIPKRPFRGNTGPDRIEEYHSKCTNLTQGRVCGKLGFWLKACRTAGHDICQDVGLASGSGKKEKSHIISMIHMQH

SEQ ID NO: 226902 - protein, 71 aa, Glycine max
  Coding DNA Sequence Number=SeqID_110124
MTTLASACQSNLGSPNDEVRITERCLRMLPDSWVMIAKGGVVDKSEAFAPTYPPFVMNNSDLRSSFFCETK

SEQ ID NO: 226903 - protein, 375 aa, Glycine max
  Coding DNA Sequence Number=SeqID_110125
  Gene Ontology: Cellular component=1-2nm peptidoglycan-based cell wall; Biological process=regulation of cell growth
  Homolog annotation: Hit_ID=P45800; Match level="QueryCoverage=91%, HitCoverage=49%, E-value=1e-123, Identity=66%"; Hit description =Putative membrane protein igaA homolog
  Pfam annotation: Domain name=IgaA; Domain location=1-372; Score =249.1; E_value=8.9e-72; Accession=PF07095.2; Description =Intracellular growth attenuator protein Iga
MSTILIVLAAMLAGALVAGWIYRRRVQRRYRLPFLNAFAGASTRKLTQDERDAVENYLEILNRSQLTPGPTGATAAPVALKLNAQSDTVLCVTRSITRYGITTDDPNKWRYYLDSVEVHLPPSWEQYINDENSVELIHTDSLPLVISLNGHTLNEYLQEAPRFALERASSTQASIRGEETEQIELLNIRQETHEEYALSRPDGIREAVLIVAAFLLFFVCLLTPDVFVPWLAGGAVLLLAAGLWGLFAPPAKTSLREIHCLRGTPKRWGLFGENDQEHLNNISLGIIDLIYPRHWQPWIAQDLGQKTDIDIYLDRHVVRQGRFLSLHDERGHCRRRCAGLYHVAAFRAAGYAHQIHPVVDKRGANHRSDQRQSTG

SEQ ID NO: 226904 - protein, 96 aa, Glycine max
  Coding DNA Sequence Number=SeqID_110126
  Subcellular localization annotation: CTP_CleavageSite=83; ConfidenceScore=5.54e-01
MSDLGGLGKVVAPPSVTLVGFNQVFQNNPFSSKSLYMPPKVEAVKAKLAALEGSNNLLLKMTRRVKFCIRIMRWVVVVLPILLVQTKTTWRSVRCC

SEQ ID NO: 226905 - protein, 111 aa, Glycine max
  Coding DNA Sequence Number=SeqID_110127
QQLSPVLSRTLESDQFPLLNDPNKACIYVIKDLTITHKLISISQNGFRFELVSLQIFTQQNLSKLSGTKTFLSLELPKHAKASSQGQTLMHAEASSRAMPNSFCKSDFRLK

SEQ ID NO: 226906 - protein, 195 aa, Glycine max
  Coding DNA Sequence Number=SeqID_110128
MNLIIVTERKEHTLRRPYRTCARARVMSEVEEVQEQIKADMEAMKEKMATMMAANMSMKEIMEVNAAALLRDDPHDVQIQNKHAFPPYGLPPNCTPPNVAYTPSENTHEIPHHNLADFEPCLGYATGGQAVGGIPMPNTLDGPQFRPQPQPLHFVEGRAPPAMAEKGKLDHIEERLKDIEGGEDCAFANLEELFL

SEQ ID NO: 226907 - protein, 177 aa, Glycine max
  Coding DNA Sequence Number=SeqID_110129
  Homolog annotation: Hit_ID=Q1EP77; Match level="QueryCoverage=36%, HitCoverage=13%, E-value=1e-17, Identity=69%"; Hit description =Serine carboxypeptidase (Carboxypeptidase D), putative
LGVAKPSVASYLSQEILAEQEVDRVHGLPAQPPVKFKNMVVISLSMKLKEEHCSIGFSRPLTNQNKNPFSYGSMEADSSYFTSSLPSSSLSPPSSFPPSPPPPPLPFPSNECFFMSDSANKLRADLENVRFSTSNSKYPDEGSSNGYSSNYMESLVLSHFMAIPAEALYSETWCECH

SEQ ID NO: 226908 - protein, 123 aa, Glycine max
  Coding DNA Sequence Number=SeqID_110130
MFRVPRKISSQQARALTTMCDVMEVMPRALCPNVLQHKVPLSTSPSHLLPRTQGSRSSQDPNTNNKPGVRSLSLSKIIGRPVRVTMFCENAPTIWDQHRLKEALKPDDPQGLHSEESIRASPS

SEQ ID NO: 226909 - protein, 295 aa, Glycine max
  Coding DNA Sequence Number=SeqID_110131
  Homolog annotation: Hit_ID=Q47522; Match level="QueryCoverage=16%, HitCoverage=59%, E-value=2e-21, Identity=97%"; Hit description=LacZ protein
  Subcellular localization annotation: CTP_CleavageSite=42; ConfidenceScore=5.10e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLNSIGRLIRRFHVKRPGFRMSRHSVLPVRYQHRSFWRDIEAGPSDANPYPVPRAACLDDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 226910 - protein, 232 aa, Glycine max
  Coding DNA Sequence Number=SeqID_110132
MPQSPYISYFFPSSGGFDGGEVEKIPGFDFVDWLKNTVSENDFVVMKMDVEGTEFDLIPRLFETRAICLVDEIFLECHYNRWQRCCPGQRSPKYEKTYDQCLQLFTSLRQSGVLVHQWTQTARTSGEFGVLEQIASTNGDTCMQRRNRQSKWRYGLRFGNRQSNWRVPWPEAAGLRPCHGSVVQMQVQAKPLLPLAVCLAQGLPRKRYYHWRVAFRLNFFCPSSIIKAEEAS

SEQ ID NO: 226911 - protein, 75 aa, Glycine max
  Coding DNA Sequence Number=SeqID_110133
MDIYRWNTSERFISICTVHRMGKNWKKGNITFKAFDAKHKSGGGGFIIVEGFHNVLRSLSTLAVQASLYGMSSGK

SEQ ID NO: 226912 - protein, 221 aa, Glycine max
  Coding DNA Sequence Number=SeqID_110134
QFKSDLTSKWVLAADKESVDDTVCEKYDISKEKWTQFCQTRRDPSWEAIQKQNTFPHVLSRGGYAYLENKLMNEKRKKKLEEVAQSRSTDTVIDPPSPIRRHVKWKMAHTKKTGQMTSEAAKEIVDKIDVLTAAIGQPKHPGHVHAVGVGVTIKQYFRLAPRTSRTSSSMAPEDLEHQMQSQFQSQMQSQGLELPPEPEVGPSAARVSTKETCVDPSGNDP

SEQ ID NO: 226913 - protein, 47 aa, Glycine max
  Coding DNA Sequence Number=SeqID_110135
MPRPDKPNWPTMHSRSAPHLALSAFRSRAGRAMHAEPVLLLDRALGA

SEQ ID NO: 226914 - protein, 61 aa, Glycine max
  Coding DNA Sequence Number=SeqID_110136
MLVASSSSNLGSHGEAVDAEKSCGETSQLEDKLWEWEFESGKGHAYASTSSLRVYMMLRIN

SEQ ID NO: 226915 - protein, 268 aa, Glycine max
  Coding DNA Sequence Number=SeqID_110137
  Gene Ontology: Mol. function=serine-type endopeptidase activity; Cellular component=membrane fraction; Biological process=proteolysis
  Homolog annotation: Hit_ID=O82421; Match level="QueryCoverage=75%, HitCoverage=65%, E-value=5e-97, Identity=82%"; Hit description=Clp protease
  Pfam annotation: Domain name=CLP_protease; Domain location=29-200; Score=327.2; E_value=2.8e-95; Accession=PF00574.13; Description=Clp protease
MFGLLMWVHSELWDAPIYQNKEEENKHYEKGMQLQRVRQYLMVDDMTADFIISQLLFLDAEDSKKDIKLFINSPGGSVTAGMGIYDAMKLCKADVSTVCLGLAASMGAFILASGTKGKRYCMPNSRVMIHQPLGTAGGKATEMSIRIREMAYHKIKINKILSRITGKPEEQIELDTDRDNFMNPWEAKEYGLVDGVIDDGKPGLVAPIGDASPPPKTRVWDQWKIEGSRKAKKNLPSEHKFLQNASKGSQGSDGDKGTVQEGETPVAV

SEQ ID NO: 226916 - protein, 78 aa, Glycine max
  Coding DNA Sequence Number=SeqID_110138
  Gene Ontology: Mol. function=phenylalanine-tRNA ligase activity; Cellular component=cytoplasm; Biological process=tRNA aminoacylation for protein translation
  Homolog annotation: Hit_ID=Q2QPD4; Match level="QueryCoverage=82%, HitCoverage=12%, E-value=6e-17, Identity=87%"; Hit description =Phenylalanyl-tRNA synthetase class IIc family protein, putative, expressed
  Pfam annotation: Domain name=FDX-ACB; Domain location=2-62; Score= -14.1; E_value=0.011; Accession=PF03147.4; Description=Ferredoxin -fold anticodon binding domain
MEMRWCSLVQLIDNFTNKKGMTSHCYRIAYRSMERSLTDEEINDLQLPTLVLPLVNAVESKRTGAEQIECCLKMSYKC

SEQ ID NO: 226917 - protein, 149 aa, Glycine max
  Coding DNA Sequence Number=SeqID_110139
  Homolog annotation: Hit_ID=Q9ZU37; Match level="QueryCoverage=62%, HitCoverage=62%, E-value=5e-13, Identity=48%"; Hit description =Predicted by genscan and genefinder
MEATNLGCCKLSWGSVISKNVNLTSQKRMVRRRCESGDGWGRLVDEGMIVLRWRIKEMKRMEEANQEVPSHWMEWEKQYYAHYYDQHVFHAMELLQSYLMSLRLRPIVALGVLVLVSLSVLMCSGVGFFHALEVANSLVSYFYSSRELI

SEQ ID NO: 226918 - protein, 71 aa, Glycine max
  Coding DNA Sequence Number=SeqID_110140
MTQGLVARGDTLRLSAPHHSVTPSVIDEQRPMWSSAPFPEMSEFLIGGYVEQEPCFCQPPHNLCHTDLEVM

SEQ ID NO: 226919 - protein, 131 aa, Glycine max
  Coding DNA Sequence Number=SeqID_110141
MAAASLPSFFSVQARGPYLKFKRSNIRRGPQIIKVQNYQDEGRSTNIDANLNVLKKRIEMVRVKERLERCCKSQHGWNYVPVSDHRITKGSNKEEFSLIEFTGLVCGTLGLTCFGGTLFIYLVSLVVHLQL

SEQ ID NO: 226920 - protein, 199 aa, Glycine max
  Coding DNA Sequence Number=SeqID_110142
  Gene Ontology: Mol. function=zinc ion binding
  Homolog annotation: Hit_ID=Q1SHK9; Match level="QueryCoverage=99%, HitCoverage=100%, E-value=1e-44, Identity=49%"; Hit description=Zinc finger, RING-type; RINGv
MDEQIMSSPNILVQCRICHDEDEESNMDTPCSCCGTLKQLKPGYTAPPLPPLLHYGGSPINFGWNWEISRRDFQNHQFIAMFNANREFLDLDFAYSSAPSTRSLIFFRIIAIIFIVLLLLRLTLPIIFILSGARAYSLAVFMLVVLRIIGMIVPVYIMVKAIIAMQQFQYQTLDIQHSPMQAHEENEIGQSQLRVIHIQ

SEQ ID NO: 226921 - protein, 127 aa, Glycine max
  Coding DNA Sequence Number=SeqID_110143
MERRVARLRRGGGGGGSVKWKGWGGRKEKVEARRRRKLRKQEGEGQERKRKTKCTLAEEKKKANRVHHLRKTTHVSYRQKGIEPSNIRPCHYWKLLIWRLMFQKENNSSRVGGAILWKLHCGMNNFY

SEQ ID NO: 226922 - protein, 176 aa, Glycine max
  Coding DNA Sequence Number=SeqID_110144
MALENLEQLTQQIRDQLEESITEKVTQQLMFSFSHMQSQFQSQIQSQGLALPPEPEVGPLAARVSINESYVDSSGNDRHTGDSNKCGLYIKDNPPCLVSLGRLYEGSTTVHNIHLLHDQIKVGVEGVRDADVLIPVPTKEGVVGPVKPADRPDHDVDDPLYLMTLTIPQLFLKSLQ

SEQ ID NO: 226923 - protein, 74 aa, Glycine max
  Coding DNA Sequence Number=SeqID_110145
  Gene Ontology: Mol. function=peptidyl-prolyl cis-trans isomerase activity; Cellular component=chloroplast thylakoid membrane; Biological process=protein folding
  Homolog annotation: Hit_ID=Q9LYR5; Match level="QueryCoverage=58%, HitCoverage=17%, E-value=5e-17, Identity=93%"; Hit description =Peptidyl-prolyl cis-trans isomerase
VIPAFEEAVSGMALGGIRRIIVPPELGYPENDFNKSGPRPTTFSVYLFTEDERIHANNCPVEILLILILDACVK

SEQ ID NO: 226924 - protein, 245 aa, Glycine max
  Coding DNA Sequence Number=SeqID_110146
  Subcellular localization annotation: CTP_CleavageSite=39; ConfidenceScore=5.13e-01
CPVSEEIVPCHGTLFDVGGVRIAGLSSFSSPPSWKSVVRVAFVKLSRVNMLLVLKERYDVPACTTHAQHSCIRVIHGMGTYWRCDVWRILFLGEVESFASYRWRHFLPPWEGAAFHCFPTKELVPATVILPIFVTGEQGEAVRMLGHPSHMQCSHSFGSPLSPPVVVGYEWVRDDVLKYNSSFTSAMSVTALQCHIEQFMEVMPSKVILMMPKNQELSKVSSKDSRIKFQDSRFKNQVSRIKNQE

SEQ ID NO: 226925 - protein, 142 aa, Glycine max
  Coding DNA Sequence Number=SeqID_110147
  Homolog annotation: Hit_ID=Q6ZLL2; Match level="QueryCoverage=36%, HitCoverage=20%, E-value=1e-18, Identity=78%"; Hit description =Immunophilin/FKBP-type peptidyl-prolyl cis-trans isomerase-like protein
MILISPRTPRKSLILLPPLAAGVKVVVARHRSNEERCFYLPPPSLPEPCAAIQSAESVWQLNSPIFVNTVPALRGKDYGKTKMRYPDYTETESGLQYKDLRPGNGPKPKMGETVVVMHIIVSTFSLFNSFVTVDWLEIRSLI

SEQ ID NO: 226926 - protein, 363 aa, Glycine max
  Coding DNA Sequence Number=SeqID_110148
  Gene Ontology: Mol. function=DNA ligase (ATP) activity; Cellular component=nucleus; Biological process=DNA recombination
  Homolog annotation: Hit_ID=Q1SHK1; Match level="QueryCoverage=91%, HitCoverage=20%, E-value=1e-96, Identity=57%"; Hit description=ATP -dependent DNA ligase; DNA repair metallo-beta-lactamase; RNA- metabolising metallo-beta-lactamase
  Pfam annotation: Domain name=DNA_ligase_A_C; Domain location=218-289; Score=41.7; E_value=2.6e-09; Accession=PF04679.6; Description=ATP dependent DNA ligase C terminal region
MWHFHINHNSAVNHDQACYWVFLSALDENLKDLFYDEKPGYFEYAKETTVEADDACLTCEATLTKINAFLEDALRSSCEGIMVKTLDVDAGYSPSKRSDKWLKVSNCATGLWSLCLRLKNQVKRDYVEGLNDTLDLVPIGAWHGNGRKAGCNSMSYKVYQSHIVVAFWALTKCATDPTNQQCDWTINFHWRLGGGGGKGAGQIETPKFSRGNDVISCSDAQYSPFLMACFNPETEEYQSVCRVMSGFSDSFYIEEIDIAVQMKQFFSGDKVLSKKPPYYQTREAPDMWFCPQVVWEIRGADFTVSPVHHAAIGLVHPSRGISIRFPRFISCVSDRSPEECSTAADIGEMFHSQTRKMDITTGD

SEQ ID NO: 226927 - protein, 448 aa, Glycine max
  Coding DNA Sequence Number=SeqID_110149
  Homolog annotation: Hit_ID=Q9I6Y9; Match level="QueryCoverage=27%, HitCoverage=28%, E-value=5e-10, Identity=35%"; Hit description =Nonspecific ribonucleoside hydrolase
  Pfam annotation: Domain name=IU_nuc_hydro; Domain location=23-364; Score=-39.6; E_value=1.9e-08; Accession=PF01156.9; Description =Inosine-uridine preferring nucleoside hydrolase
MFPMRVWVAVVFIMLVTTVAAKPRRILLDTDVDLDDVFALLYLLKLNRSEFQLEGVTINANAWTNVGHAVNQVYDILYMMGRDDIAVGMGGEGGILPDGTILPNVGGYLSIIEQGMTTTGGCRYRQAIPIGHRGILDIDTIYGIRKAFLPQGIRKYTPLGQPTAQQVLIDKISAGPITLIVIGVQTNIAIFLMNNPHLKKNVQHIYIMGGAVRSTDPTSCCPKNASFSCIPGQCGDRGNVFTNYEANPYAEFNIFGDPFAAYQVIHSGIPVTLVPLDATNTIPINEEFFNEFEKSQDTYEAQYCFKSLKMAKMARDKLDNQFYTSYFMWDSFASGVAVSSMRNSNKKNKRENEFAHMEYMNITVITSNKPYGISDGSNPFFDGLKVPKFNLKKGGVHSGHVQQGLRDKFCFVKNGKGRCQDGYTAEVDGPDSVKVLVATKAKPNRTLG

SEQ ID NO: 226928 - protein, 261 aa, Glycine max
  Coding DNA Sequence Number=SeqID_110150
  Homolog annotation: Hit_ID=Q48IW3; Match level="QueryCoverage=36%, HitCoverage=32%, E-value=7e-11, Identity=40%"; Hit description =Inosine-uridine preferring nucleoside hydrolase
  Pfam annotation: Domain name=IU_nuc_hydro; Domain location=5-239; Score=-155.7; E_value=0.077; Accession=PF01156.9; Description =Inosine-uridine preferring nucleoside hydrolase
MKFETSQNTDHLELRQPLAMEIWESIMQTLEPESKITVLTNGPLTTLAKVVSMKNISSRIEEVYVMGGHISRNVCDKGNIFSVPSNQYAEFNMFLDPLAAKTVFQSEVNITLIPLSVQQKASSFSHMLCWLRRIEQTPETVFSKRVLLRLQRLKQIHHRYHHMDTFLGEILGAIVLADGPSSLKEKFEIKGIKVLAEGDESIDGEMVVDEEHGKLVRILSHVNAKAYHEKYSKRLGDWNQSAKVGSFEDQIRKWSHPHSLL

SEQ ID NO: 226929 - protein, 78 aa, Glycine max
  Coding DNA Sequence Number=SeqID_110151
  Gene Ontology: Mol. function=L-lactate dehydrogenase activity; Cellular component=cytoplasm; Biological process=tricarboxylic acid cycle intermediate metabolic process
  Homolog annotation: Hit_ID=Q96569; Match level="QueryCoverage=58%, HitCoverage=13%, E-value=9e-09, Identity=67%"; Hit description=L -lactate dehydrogenase
MASLVDDLEGACRDNAEVRANADGGIGRGVDLGAGEEGDSVLEVKHLAVELVGVDKDEVNDEKKIKFVVVANVEEKGR

SEQ ID NO: 226930 - protein, 75 aa, Glycine max
  Coding DNA Sequence Number=SeqID_110152
MQCCYHKNYGHTIKEYVALKGRIEELIQEETLNNYIYNPNNNRGGYRGRGKGQGGNKGGQGQNDQEKDMNKEKSN

SEQ ID NO: 226931 - protein, 126 aa, Glycine max
  Coding DNA Sequence Number=SeqID_110153
  Gene Ontology: Mol. function=protein binding; Biological process=two -component signal transduction system (phosphorelay)
  Homolog annotation: Hit_ID=Q659S8; Match level="QueryCoverage=76%, HitCoverage=63%, E-value=4e-38, Identity=80%"; Hit description =Putative His-Asp phosphotransfer protein
  Pfam annotation: Domain name=Hpt; Domain location=10-93; Score=33.2; E_value=9.3e-07; Accession=PF01627.13; Description=Hpt domain
MCEKLTALNLLLLVFLPFPLLSATMVFVRQLSYVKDQNGVDFKKVDAHVHQLKGSSSSIGAQRVKNACIAFRNFCEEQNTDACLRCLQQVKQEYCIVKNKLETMFRLEQQIVAAGGSIPTELSFIG

SEQ ID NO: 226932 - protein, 186 aa, Glycine max
  Coding DNA Sequence Number=SeqID_110154
  Gene Ontology: Mol. function=phosphotransferase activity, phosphate group as acceptor; Cellular component=chloroplast; Biological process=nucleobase, nucleoside, nucleotide and nucleic acid metabolic process
  Homolog annotation: Hit_ID=Q84JF7; Match level="QueryCoverage=50%, HitCoverage=32%, E-value=2e-32, Identity=69%"; Hit description =Putative adenylate kinase
MSGITEYVERDIYEYIEKHKDIEFVNFVDLVGSECASQAMTAGIRLREGSHINHSLLSLETLIRKLSIPLRSYNVGYCMVCEANLKILEGVTDIDLVVNLKLQEEALLAKCLGRRICNQCGGNFNIASISIKGENGRPGMVMAPLLPPAHCMSKLITRSDDTKAVVKERLRIYNEKEQMISVRIAD

SEQ ID NO: 226933 - protein, 71 aa, Glycine max
  Coding DNA Sequence Number=SeqID_110155
MAYGSVCLCRRRVTGERENGEENKERSLGQDTMRGTVMPRRELGSTEGARFNRGYELERSKGPILIIKPKN

SEQ ID NO: 226934 - protein, 79 aa, Glycine max
  Coding DNA Sequence Number=SeqID_110156
MASKLDHSPILLLDANSRRFFRWNNVIEGDVIHRLESCSKHMQAWNSQVRATYCKRRWKNYMRLLMKIQLLVIFPLVRN

SEQ ID NO: 226935 - protein, 373 aa, Glycine max
  Coding DNA Sequence Number=SeqID_110157
  Homolog annotation: Hit_ID=Q9SLB9; Match level="QueryCoverage=87%, HitCoverage=71%, E-value=4e-91, Identity=53%"; Hit description =Expressed protein
MIIEHDSNELCASHPVRQLLDKHFDDNQPLGHTFEGSASTLYNNAFNSSDMTQLDYHPFSLNQDMDHKPEGLIGQLDLYQDLRHNTEMKNSESTQFSLEGFDCSQFFEADDNVQHGENIIPNILPNICPPPSAFLAPKCALWDCFRPAQGVEWCQNYCSSCHELLANNEGLPGMTPILRPGGIGVKDGPLFDAVLAKTQGKEVGIPSCEGAASTKSPWNAPEFFDLSFLEGETVREWLFFDKPRRAFESGNRKQRSLPDYSGRGWHESRKQVMKEHGGQKRSYYMDPQPLSYLEWHLYEYEINNQDGCALYRLELKLVDKKKSPKGKVTKESLTDLQNKMGQLTAAVPSTDDGYGQPVKGKTKTKSENDESPK

SEQ ID NO: 226936 - protein, 149 aa, Glycine max
  Coding DNA Sequence Number=SeqID_110158
  Homolog annotation: Hit_ID=Q5JMX2; Match level="QueryCoverage=77%, HitCoverage=21%, E-value=5e-12, Identity=33%"; Hit description =Putative vascular plant one zinc finger protein
AKGLPTDKVLTWAVEFEPTFEGMMRESSKGVGGSSSLQSMKEKEKHLVEKIQGIFNSLQCARKEGRGNDMVIFEEQMHQLLREWKAELESPANSLADGSFGSFPSELAQMLLGSEDKDDATSPLTKPVPLKNEIHTNNISDGNFQFFQE

SEQ ID NO: 226937 - protein, 160 aa, Glycine max
  Coding DNA Sequence Number=SeqID_110159
  Gene Ontology: Mol. function=protein phosphatase type 2C activity; Cellular component=nucleus
  Homolog annotation: Hit_ID=Q9FG61; Match level="QueryCoverage=82%, HitCoverage=29%, E-value=7e-30, Identity=47%"; Hit description =Protein phosphatase-2C PP2C-like
MLMPQNGGSRGDVHVEDNQNMSFPWWEGTFMRCFTAINEKLAKNIDTDGFHGGSTSVSVLKQGDQVIIGNVRDSRAVLCRRAPDNRLIPVQLTVDLTPDIPTFLPQCHSGEAMRIFAVEEDPTVNRVWMPKRDCPGLAMARAFRNFCLKDYGVASVPDVS

SEQ ID NO: 226938 - protein, 372 aa, Glycine max
  Coding DNA Sequence Number=SeqID_110160
  Gene Ontology: Mol. function=helicase activity; Biological process =viral genome replication
  Homolog annotation: Hit_ID=Q1SN45; Match level="QueryCoverage=85%, HitCoverage=19%, E-value=3e-80, Identity=47%"; Hit description=AAA ATPase
MMLSTAKGAQSYSDIRTVNGLVYPTFREACFAKGFLGSDQEFISALQEANNWGTAHYLRKLFVKLLFLNTMDRPKYVWQQTWQWMTDDIIFNHRKQGIRLTKKETIHLCLTKIENMLQANRRSLRDFPSMPYPIGYARNQHHNNLIHNEMAYDKEMLAEQYNTTYQLLTDEQKTIVDTIMSVVNTQSVAVYFLYGYGGTGKTFVWTTLSSGIRSNGGIVCTVASSGIASLLLPGGQTAHSKFAIPVPATENSTCNIHQGSELAELLKVTKLIVWDEAPMCHKFAFEALDKSLKDIMQNNLPFGGKIIVFGGDFRQILPIVPKEITIPYEFLIKNYDDPIHAIVEATYPSLIDNYSDTDYLQKRVVLASKRDC

SEQ ID NO: 226939 - protein, 73 aa, Glycine max
  Coding DNA Sequence Number=SeqID_110161
  Homolog annotation: Hit_ID=Q9FJZ0; Match level="QueryCoverage=63%, HitCoverage=48%, E-value=5e-10, Identity=60%"; Hit description =Arabidopsis thaliana genomic DNA, chromosome 5, TAC clone:K1F13
MALGSTYGEINLQRNPTKKGNNNNDKSHPLLSFLALRRKKKTTARPEFARYLEYLKEGGMWNLNSNKPVKYYK

SEQ ID NO: 226940 - protein, 128 aa, Glycine max
  Coding DNA Sequence Number=SeqID_110162
MVELESCCVKDKVLIDLLSVSKEVRAKGGSLFAWKPPLALAVKHDPPVAMAIQALTWRIPPLALTIRADVERCRWSHWRDTPREEVPAISNGDTDVEEALTSPIGDTDVEHFNHAVFAVLCRLGLQSF

SEQ ID NO: 226941 - protein, 973 aa, Glycine max
  Coding DNA Sequence Number=SeqID_110163
ERACRHPVDSEKSNRVQGFPALIMNLRQFYGVPVTPSRVIRPLLTRLSLRSIVPPGRRRARHHSSGQQMHCHHLSSSTKAGVLPTTCGRPVGDQVQRQRDGKSNDMRRYLMVIHTFCQLEASESVDTKRLTSLSPPFLEMSASYGRHCENVFFAIHQTQGDGKSDDMRKYLMVIRTFCQLEASEPVDMRRLTSSSAPFPEMSASSGRDCEKVSLAIHQTQGDSKSDDMWRYLIVIPTICQLEASEPVDTQRLTSSFASIPEMSASSCPDCERVSFAIRQTQGDSKSNDMRGYLMVIHTFFQLEASEPVDTQRLTSSSAHFPEMSTSSGRDCEKVSLAIHQTQGSGCMQTLTSSSAPLSSRDGKSDDMRRYLMVICTFCQLEASEPIDTQRLTFELVDTQRPTSSSAPFLEMSASSGQDCKKVTLAIRQNQGDNKSDDMRRYLMAIRTLFQLEASESVDMQRPTSSSASFPEMSTSSDRDYKKVLYAIRQTQGKVSFAIRQTQGDGKSDDMWRYLMVIRTFFQLEASEPLDMQRLTSSSAPFSEMSDDMWRYLMVIRTFFQLEASEPLDMQRLTSLSGHFPKMSASSNRDCEKVLLNIHQTQGDGKSDDMRRYLMAIRTLFQLEASESVDTQRLTSSSASFPEMLASSMRDCKKVLFAICQTQGSGSMLRLTSSSAPLSSRDGKSDDIEFIDTQRLTSSSAHFPKMSASSDRDCEKVLLTIRQTQGDGKSDDMRGYLMVIRTFCQLEASEPGDMQRLTSSSASFPDGKRDDMQRYLMVICTFCQLEASKLVDTQRLTLSSAPFPKMSASSNRYCKKVSFAIRQNQGKSDDMQRYLLVIRTFFQLEASEPLDTQRLTSSSAPFSEIDNIFDDMRRYLMVICTFCHLEGSESIDTQRLTSSSAPFSVICQRLPAEIVKNSLLLSVRLKSPTQGSGSMRIYFRVIRMFCQLEASEPVDTQRPMWLFASVSEMSTSSD

SEQ ID NO: 226942 - protein, 55 aa, Glycine max
  Coding DNA Sequence Number=SeqID_110164
MSVKNLIGHLRVHDKTNHTLMAPKKLSAKRARKDTPGEGSSAAPQAEIEFDGHCF

SEQ ID NO: 226943 - protein, 736 aa, Glycine max
  Coding DNA Sequence Number=SeqID_110165
  Gene Ontology: Mol. function=DNA ligase (ATP) activity; Cellular component=replication fork; Biological process=DNA recombination
  Homolog annotation: Hit_ID=Q1SHK1; Match level="QueryCoverage=98%, HitCoverage=48%, E-value=0.0, Identity=66%"; Hit description=ATP -dependent DNA ligase; DNA repair metallo-beta-lactamase; RNA- metabolising metallo-beta-lactamase
  Pfam annotation: Domain name=DNA_ligase_A_N; Domain location=475-653; Score=269.0; E_value=9.2e-78; Accession=PF04675.5; Description=DNA ligase N terminus
  Pfam annotation: Domain name=DRMBL; Domain location=1-73; Score=74.0; E_value=4.6e-19; Accession=PF07522.4; Description=DNA repair metallo -beta-lactamase
  Pfam annotation: Domain name=RMMBL; Domain location=34-76; Score =12.4; E_value=0.014; Accession=PF07521.2; Description=RNA -metabolising metallo-beta-lactamase
  Pfam module annotation: Pfam domain module=DNA_ligase_A _N::DRMBL::RMMBL; Domain location=475-653::1-73::34-76
MKEVMAERGGSYSKVVGFVPTGWTYEVKRNRFAVKSKDLFKIHLVPYSEHSNYDELREYVKFLKPKRVVPTVGLDVEKSDSKHADKMRKYFARLVDETANKQDFLRGFLRDPGEKGEAGFKAEKVVSDALGPGQDMEEEEINALKKTEGDMGIGPVVAVGLSSFMEETYAQDPTLLNDEEKEKIIQELTFCLPTWVTRNQLLDLISISGSNVIEAVSNFYERETEFHEQVISCQTPVSTSKCCSLNGMDSLAKPCLNTNNTGKNIDIFPSQDSKLTNLRHTVPSPISPAKRKRSTDSKQNKKAKVKAKSEPSGSKQATITRFFSKVIPEMPGGTQSDNSEPKLDQSSKVEDLLPTDDGQMYKDEIDQFMQIINGTESLKKYAITIIEKTKGDINKALDIYYGNSENLGEKQISVQVESKIDRPVVKKHASEELRIVPDIFDQKVLKDNVDATHLSLPPEKYNPKEHACWKDGQPAPYLHIARTFNLLEGEKGRIKATSLLCNMFRSLLALSPADVLPAVYLCTNKIAADHENKELNIGGSLVTAALEEACGTNRLKIREMFNKFGDLGDVAQECRQTQRLLAPPTPLLIKDVFSALQKISVQTGSRSTSRKKGIIVHLMRSCREKEMKFLVRTLVRNLRIGAMLRTVLPALAHAVAMNSCPTLHQEGTAENIKEKLQVLSMAVVEAYNILPNLDLIVPSLMNKGIDFSVSSLSMVPGIPIKPMLAKYILFHILAIS

SEQ ID NO: 226944 - protein, 239 aa, Glycine max
  Coding DNA Sequence Number=SeqID_110166
  Gene Ontology: Mol. function=nucleic acid binding; Cellular component= intracellular
  Homolog annotation: Hit_ID=Q1SHK0; Match level="QueryCoverage=83%, HitCoverage=65%, E-value=5e-51, Identity=53%"; Hit description=Zinc finger, U1-type
MIKRRFYKLDHGDREALDPSSSSSSDSEIEAEAEVDASEEESEEDVTAEVKPNDDEAGSTSSGYASEDGSASDVDVNSAGLLFSEDDAGAINERQVLINRELLIKCDTEKSNVLAEKKSLPTDTPSCVLKCKSVFKCKICPRIICLSEETLRDHLQSKRHARSEKLLSEGRLKAMLNSDGEIDNQEISEIQTKDTEDNAEKNHKRKNQHKKRLRKKKSDKANTRKILSTKGAAKRGRNK

SEQ ID NO: 226945 - protein, 176 aa, Glycine max
  Coding DNA Sequence Number=SeqID_110167
  Gene Ontology: Mol. function=DNA ligase (ATP) activity; Cellular component=nucleus; Biological process=DNA recombination
  Homolog annotation: Hit_ID=Q1SHK1; Match level="QueryCoverage=99%, HitCoverage=11%, E-value=2e-34, Identity=47%"; Hit description=ATP -dependent DNA ligase; DNA repair metallo-beta-lactamase; RNA- metabolising metallo-beta-lactamase
GVEKHRIGTDEGGEGGFGNHGITKAKIAGVDVPEGGGIGGGTGDGEEELDGAGAVVGVEEGDMGAVDAERLPEGEGDDECGGDVKNAAEEGGGGVGAEDDAAGPGWGEAGVVVGMEVGEEVGVGVGAGVAEGVDEEAGVGDEFGVRDGRGEWGEGGCGRGFGLEGFEGGEVEFGGV

SEQ ID NO: 226946 - protein, 389 aa, Glycine max
  Coding DNA Sequence Number=SeqID_110168
  Gene Ontology: Mol. function=drug transporter activity; Cellular component=membrane; Biological process=multidrug transport
  Homolog annotation: Hit_ID=Q1SHJ6; Match level="QueryCoverage=99%, HitCoverage=100%, E-value=1e-124, Identity=70%"; Hit description =Multi antimicrobial extrusion protein MatE
  Pfam annotation: Domain name=MatE; Domain location=162-325; Score =128.8; E_value=1.5e-35; Accession=PF01554.9; Description=MatE
  Pfam annotation: Domain name=MatE; Domain location=32-160; Score =10.4; E_value=0.00052; Accession=PF01554.9; Description=MatE
  Pfam module annotation: Pfam domain module=MatE::MatE; Domain location=162-325::32-160
MEEGSETGKWGWMKRRRAMREELKKVGTIAAPMVVASVLQYLLQVVSLVMVGHLNQLSLSSVAIAISLTNVSGFSVLSGMAGGLETLCGQAFGAGQYEKFGQYTYTALGHVGAAISFSLCVWFNVMLLLSFVRYSSACEKTRIPFSKNALVGVGVFFRFAVPAAVMVCLKWWACEILVLLAGLFPNPKLETSVLSICLTISTLHFTIPYGFGAAASTRVSNELGAGNPQAVRVAVSATMFLAVTEGLIVSATLFGCRHLLGYAYSDDRMVVHYVAVMTPLLCLSIFTDSLQGVLSGVARGSGWQHLGAYVNLGAFYLVGIPVGIVLGFVAHLRAKGLWIGIVTGSIVQSILLSLVTALTNWKKQAMMARERIFDAKPPDENESNHMTSA

SEQ ID NO: 226947 - protein, 262 aa, Glycine max
  Coding DNA Sequence Number=SeqID_110169
  Gene Ontology: Mol. function=drug transporter activity; Cellular component=membrane; Biological process=multidrug transport
  Homolog annotation: Hit_ID=Q1SHJ5; Match level="QueryCoverage=99%, HitCoverage=88%, E-value=7e-41, Identity=48%"; Hit description=Multi antimicrobial extrusion protein MatE
  Pfam annotation: Domain name=MatE; Domain location=72-250; Score =67.5; E_value=4.2e-17; Accession=PF01554.9; Description=MatE
MAGALETQCAQSFGTEQFHKLGNYVFCAILFLILSSAPKSILWIFMDKLLVLLGQDHAISLVAGNYCIWLIPALFGYAVLQALLSGGRSLELLVILAGLLPNPKLETSVLSICLKICNLHYFIPYGTGAAVSSRVSNELGAGRPQAAREAVFAVIVLTFTDAIVFSSVLFCFRHVLGFAFSNEMEVVHSVAKIVPVLCLSFSVDGFLGVLCALSCVFNESRIVRGSRLQKMGAISNLVAYYAVGIPVSLVFGFGLNFYGKGL

SEQ ID NO: 226948 - protein, 384 aa, Glycine max
  Coding DNA Sequence Number=SeqID_110170
QKYPVVIRTKTTSAHPDQCVRWQADIPKRQVVGRYTDVIIRSKTTSADPDPCGYTHVIIRTKTTSANPDPSVRYTQVIIRTKTTSANADLCVRWQVEISQVVIHTKTTSADPDPCVRWQAEIPLVVIHTKITSTDPDPRVRWKAEIPRVVIRTKTTCAHPDPCVRYIQLIIRTKTTSVDPDPCDKWQADIPIYTRVIIHTKTTSVDPNPCVRYTQVIIRTKTTSADLDPRVRRIYLGVIHTSTTFTNPDQCVRWQAEIPQVVIHTKTTSTDPDPCVRQIYSAVVRTSTTFADPYPCVRWQADIPKSLSVQRQHLLILTHASGQSKNEFKMFKIESRTLQDSRGKLNSRVKNQDLRDQGSRLKIQESRKGYSRIKKKLNQDKYEK

SEQ ID NO: 226949 - protein, 43 aa, Glycine max
  Coding DNA Sequence Number=SeqID_110171
NVTSNETCNAVHENINIASDHFEANPTDRAAESEVEYRTRCQV

SEQ ID NO: 226950 - protein, 449 aa, Glycine max
  Coding DNA Sequence Number=SeqID_110172
  Gene Ontology: Mol. function=protein serine/threonine kinase activity; Cellular component=cytoplasm; Biological process=protein amino acid phosphorylation
  Homolog annotation: Hit_ID=Q8RXC8; Match level="QueryCoverage=93%, HitCoverage=91%, E-value=4e-91, Identity=45%"; Hit description =Putative serine/threonine protein kinase
  Pfam annotation: Domain name=Pkinase; Domain location=128-425; Score =36.5; E_value=9.8e-11; Accession=PF00069.15; Description=Protein kinase domain
  Pfam annotation: Domain name=Pkinase_Tyr; Domain location=128-367; Score=11.4; E_value=3.6e-13; Accession=PF07714.7; Description =Protein tyrosine kinase
  Pfam module annotation: Pfam domain module=Pkinase::Pkinase_Tyr; Domain location=128-425::128-367
MNTILDLEALEIEEGSPRSQGSETPSSRASTSDSESQGSFAGAPNTNNQWRGFFKLLKKGSQMPFQPFHPLKNVPKLTRRKSKRIREDLIPSLNSPALHASFDAEFGCFKSSWKNFTLAEIQAATNDFSHENLIGEGGYAEVYLGKLEDGNFVAIKRLTRGCQEEMTADFLSELGIIVHVDHPNIARLIGYGVEGGMFLVLQLSPHGSLSSILYGPREKLNWNLRYKIALGTAEGLRYLHEECQRRIIHKDIKASNILLSEDFEPQVPHMPHKSDYGTSSVLNQFTIFIVSSKYLILGLQSGCPTNGLITPSPKWKAHSVDEKTDVYAYGVLLLELITGRQALDSSQKSLVMWAKPLLTANNIKELVDPVLADAYDEEQMKLVFDILRGEEESLRIMEERSKSKLQRTYSEELFDAEEYNSTKFLSERDRHMETILGCSSSVTDDEEKI

SEQ ID NO: 226951 - protein, 68 aa, Glycine max
  Coding DNA Sequence Number=SeqID_110173
MEVEEPWWLWLSLHYQVDMGASGLCHWNNDIVGFGGKLGRIGMTVTAWVSPSFSPSSFAPVFSVVLVG

SEQ ID NO: 226952 - protein, 224 aa, Glycine max
  Coding DNA Sequence Number=SeqID_110174
MVRGDKSWSSAFLYHPETIKSDGMRRQIMVIRFPLPSRDNQVRWRAKTNYGHFPPIVEDYMSFDQDYCSLLCHPETSESIGMQRQIMVICLLLSKTPCLSTETIAVSFAIQRQVSSLACRDKLWSSAPFCRRLHVFRLGLLQSPLPSRHKRVYWHIETKMFIFPSCRRLNVFRPRLLKFPLSSRDNQVRWHAETNIVICPLVEDSMFFDRDYCSLPLSSRGNRV

SEQ ID NO: 226953 - protein, 151 aa, Glycine max
  Coding DNA Sequence Number=SeqID_110175
MPISPCESIGWSMLFRHRHPVDPEKSNRALGFSALVTGLCQSYRGRVHKTPSGPGVVQQGPRVASSGYGSLSVLQGACPSQQGIAPARHPVDPEKSSRVLGFPALITGLCQFYRVPVTPNKGETPQQPEDGRQWATDALPPPQEHLSSFTK

SEQ ID NO: 226954 - protein, 78 aa, Glycine max
  Coding DNA Sequence Number=SeqID_110176
MAKYFEEEFKRKNEADISDNRKVLGRAFLCAKIEKINMELSKECMKTVTRCLADAKIDKRSKLFYGSREDACVRKQHH

SEQ ID NO: 226955 - protein, 153 aa, Glycine max
  Coding DNA Sequence Number=SeqID_110177
  Gene Ontology: Mol. function=ATP binding; Cellular component =chloroplast; Biological process=response to heat
  Homolog annotation: Hit_ID=Q1SF16; Match level="QueryCoverage=90%, HitCoverage=25%, E-value=6e-53, Identity=65%"; Hit description=Heat shock protein Hsp70
MKFAVGIDLDNQRLIGGAAKNQAVSNPESTVFDAKRLIGRKYSDPVIQKEKMLWPFKVVASINDKPMIVVKYKGQEKHLCAEEVFTKMWEIAEAYLETPVKNAVVTVPAYFNDSQRKATAAAIAYDLDKRTNFVGEQNIFIFDLGGGTSHDQG

SEQ ID NO: 226956 - protein, 66 aa, Glycine max
  Coding DNA Sequence Number=SeqID_110178
MVHRMTPPDTNTFRIEYRVRISHVSTLQRDTITMIELHEKGQMLQHKTLVRITFPESDVTKTTLAQ

SEQ ID NO: 226957 - protein, 289 aa, Glycine max
  Coding DNA Sequence Number=SeqID_110179
  Gene Ontology: Mol. function=sodium:dicarboxylate symporter activity; Cellular component=membrane; Biological process=dicarboxylic acid transport
  Homolog annotation: Hit_ID=Q5WAN9; Match level="QueryCoverage=99%, HitCoverage=47%, E-value=1e-63, Identity=51%"; Hit description=TRAP -type transport system permease component
MTMVVYEMPRKPAMINAAAPMMGGMIMPPVEAVASTAPAKRDDSPMLFISGMVKCRRDHRHLGRAAAAASGGGQRQIVEQRGCAADAEKGAEQNKHHDGGGGGGQGDAENPLAGHEQPIQQAFHREAPVAENAHEVLPEQRIEDGESRQAGDEIAGGAPRGFEQHADTDRRHHIVGGVGDALAHHVQIDVVNVEIAVADQRQDDEQIVPAVETAGGVPGREREQDKAQDQNAAQERGVAVELLRVGQRVGVDGIGGNGDRQDGCQLPIDAAQRPVAGAGFLVQIDGGLR

SEQ ID NO: 226958 - protein, 80 aa, Glycine max
  Coding DNA Sequence Number=SeqID_110180
MEQLPANRSEAKPLAAPPQVLHQSDVDDDDENVNQLDECSSLYRLMQDCVVRTNRNWKECQPEVYALRECFEKRKNKQGK

SEQ ID NO: 226959 - protein, 76 aa, Glycine max
  Coding DNA Sequence Number=SeqID_110181
MEKKGATVVVEALRRRFYGGQSWDSLKKEVQEVILKPLHYGLRNPLSRGSSLWEGIGRKDCTQPYPCICKEAVNTQ

SEQ ID NO: 226960 - protein, 241 aa, Glycine max
  Coding DNA Sequence Number=SeqID_110182
MAAMQSTMSANHGMHMEASTPLDIRPKSKVVIKRFRKLNFKGHHRAELRKNKSTSDSNGLLVESQSGRPIRIATFNVAMFSLAPAVSEFDEWVVSNHEHVSNKKNLLAKGDFPKSILKQSPLHASLDKAQNLSASNILPRSNLKVSINLPDNEISLANSRLLASMERKEGTSDTITGNVSGRHQVPARSPVCFPFVMNYCEDTERFTCSRSIMEVLREIDADVLALQDVKAEEEKEHEASF

SEQ ID NO: 226961 - protein, 160 aa, Glycine max
  Coding DNA Sequence Number=SeqID_110183
MRGCINYNPVLAIRQLGYPMRGASSKESITPFIARGFSDPNARILQGVRKAWGAMQRNDKELRGSNNGIIGGYHSEEEAETPEEGEEVQALKEKLEKAQLVKEKFKIMAIKVKKKCDKLRDINIATTKALERETKRARKEEHGRNKFRGALWGRNNDLKL

SEQ ID NO: 226962 - protein, 80 aa, Glycine max
  Coding DNA Sequence Number=SeqID_110184
  Gene Ontology: Mol. function=1-(5-phosphoribosyl)-5-[(5 -phosphoribosylamino)methylideneamino]imidazole-4-carboxamide isomerase activity; Cellular component=chloroplast; Biological process=amino acid biosynthetic process
  Homolog annotation: Hit_ID=O82782; Match level="QueryCoverage=59%, HitCoverage=15%, E-value=3e-14, Identity=75%"; Hit description=1-(5 -phosphoribosyl)-5-[(5- phosphoribosylamino)methylideneamino] imidazole-4-carboxamide ...
  Homolog annotation: Hit description=isomerase, chloroplast precursor
MNWEGDYSGGNQATVAERHQVLGGLQVGGGLNSENCLSYIEKGASHVIVTSYVFNNGQMDIGRPKDLVEIVGKERHVLDQ

SEQ ID NO: 226963 - protein, 622 aa, Glycine max
  Coding DNA Sequence Number=SeqID_110185
  Gene Ontology: Mol. function=RNA-directed DNA polymerase activity; Cellular component=chromatin; Biological process=chromatin assembly or disassembly
  Pfam annotation: Domain name=Chromo; Domain location=521-569; Score =8.5; E_value=0.094; Accession=PF00385.14; Description='chromo' (CHRromatin Organisation MOdifier
  Pfam annotation: Domain name=rve; Domain location=274-430; Score =105.0; E_value=2.1e-28; Accession=PF00665.16; Description=Integrase core domain
  Pfam annotation: Domain name=zf-H2C2; Domain location=215-256; Score =24.9; E_value=0.00017; Accession=PF09337.1; Description=His(2) -Cys(2) zinc finger
  Pfam module annotation: Pfam domain module=Chromo::rve::zf-H2C2; Domain location=521-569::274-430::215-256
MYDTNTPVFNALFQPSFSGFHLLPSRDLAPGVAPQQSPGYLRYSLPPNSCDVVYVVCGFNCWLVGGYASIAAPLTKLLAKDQFQWTSTAQQAFDALKHTLALAMLFSKAFSPKLLRSSTYVRELAAITAGVKKWRQYLLGHSFVILTDHRSLKELMSQAIQTPEQQIYLARLLSILDNPAAHPQYSTIVDFISQKHRIWLPKGFSFIPLLLEEFHSTPTGGHMGITKTLARVTQNFMWQGIKDDVRSFILYCLHCQQTKYNHRKSPDLLCPLPVLARPWEDLSLNFIGGLPSFRGFSIILVVVDRFSKGVHLGMLHSNHTASTVAHLFLDIVVKIHGMPHSLVFDRDPLFLSKFWQELFKLFGTKLRMSSAYHPQSDGQTEVLNRVNEQYLRSFVHQRPSSWGKFLLWAEWSYNSSIHTTTEMAPYEVTFGKPPPPIPHYLFGTSNIDAVDDFFTSCEAVFALARKKLLKAQQTMKHFADTKRREVQFKVGDMVLVKLRPWRQTTVIGTSPKPFSGHEPIITPLVLLATKWASSKDGPELQVLVQWHGLLPEDTSWESWTKLKEEYHLEDKVLPDAVGDVMNQQQSKDAADKEQTNTYLRAKRKLHKPHHLEDFVTSFGTKR

SEQ ID NO: 226964 - protein, 96 aa, Glycine max
  Coding DNA Sequence Number=SeqID_110186
MTTQRGNESLGKESATTALLQEGFKRSTSLPLWGSNSSRKMALGSTYGDINLQRNPTKKGKTKKPTARPEFARYLEYLKQGGMRNLNSNEPVKYYK

SEQ ID NO: 226965 - protein, 409 aa, Glycine max
  Coding DNA Sequence Number=SeqID_110187
  Homolog annotation: Hit_ID=Q9FJZ1; Match level="QueryCoverage=91%, HitCoverage=98%, E-value=1e-57, Identity=36%"; Hit description =Arabidopsis thaliana genomic DNA, chromosome 5, TAC clone:K1F13
MYDFDTAMPTFTAIAFDRLIEPGASKPAYKSAPVPMPVPKKIERRTSEPTIRKKPRPRPQLKPALYATPEVTPLPDAPSSFPPSPYIINHKRRGPRLLKSYSEANVQAKQENLDNENANVKSNDGVITSLDGDLQVTFTSIEPVKEEQVNGVHDTDLSSSSNNKGDLGEAHRESESSGILNGSHLDKVVALNLEREGESEDFFDPHDSMSLKSCTDGEDNTGTDQALKFSAAGGEFFDAWEELSSDGGTQNSHRDIEAELREIRLSLLMEIEKRKQVEETLDSMQSHWERLGQRLSHIGIVLPSDLTAEGGQLSSDPMEDVCQQLYITRFISNTIGRGIARAEAEIEMEAQLQSKNFEIARLLERLHCYETMNREMSQRNQEAVVPALWSLTGNMNDSGISLRLCLDWG

SEQ ID NO: 226966 - protein, 106 aa, Glycine max
  Coding DNA Sequence Number=SeqID_110188
MPAQGEDKSRTSSPPKEAMDKSLKVGEDEWRERERRRTKFYASNEHWAKVKKELMDCGGRFLCHVNASPLREMGKTLCMMVVRLLASIPIVVIGYTFIKEFVSTET

SEQ ID NO: 226967 - protein, 92 aa, Glycine max
  Coding DNA Sequence Number=SeqID_110189
MKRQGSQMVISCLVWVWLGNLLDKSPSEMQMIDVVGVELRDAHFYFVSGCHRFRIGVLGHGARKGGGMMLKVVLLDAMVVAKIGRGYLYVVL

SEQ ID NO: 226968 - protein, 166 aa, Glycine max
  Coding DNA Sequence Number=SeqID_110190
  Homolog annotation: Hit_ID=Q9FJZ2; Match level="QueryCoverage=34%, HitCoverage=24%, E-value=1e-09, Identity=71%"; Hit description=GTP -binding protein-like
  Subcellular localization annotation: CTP_CleavageSite=57; ConfidenceScore=5.55e-01
MEKLASSSTATVVPTQHFLFQFHQHSLFFFPKTAFSTFHRNRTEPLSLPCCKSRHRRLEALSSKQDQLWVSEEELELELEEGEDSYLDGDDDDDDSSFLSLSDKPDRNMAMLDDYEGEELDFDYGPDHRSGSCFALGVCGVTWEAKCWEEYTGEPNARAKVVNSYR

SEQ ID NO: 226969 - protein, 145 aa, Glycine max
  Coding DNA Sequence Number=SeqID_110191
MVKNGRLEAQKLKKACDQKGILSVNQVKDKPKLKGFKNPLVPKLRHVTKVLQTCGSKVVVQGERDNTVLAGPRMLHRALEVEVTHACTWVGVDARHCEVATMVGGGGGGCVVWLQALEERGDDYGVLVLEDKGDGDYWCLEKEKG

SEQ ID NO: 226970 - protein, 107 aa, Glycine max
  Coding DNA Sequence Number=SeqID_110192
MNRVVYRAQEFLHKWRKARLCESPRMSLRYDSGQVVIATATNYKFFPHLNEVEAIALRDVIAWLRDLEIKDAIIDMDCQHMMNNVCSNHLDNSKFNILVLTDQLSTR

SEQ ID NO: 226971 - protein, 85 aa, Glycine max
  Coding DNA Sequence Number=SeqID_110193
MATADLHGVQESILVFYLGRSKKAIFGCEWDKFEEGQQRRHKVVEMGQDGNKEGTWLGWSIMNAGMRFRNTKFFNMALLEPHECW

SEQ ID NO: 226972 - protein, 190 aa, Glycine max
  Coding DNA Sequence Number=SeqID_110194
  Gene Ontology: Mol. function=GTP binding; Cellular component =intracellular; Biological process=small GTPase mediated signal transduction
  Homolog annotation: Hit_ID=Q9FJZ2; Match level="QueryCoverage=69%, HitCoverage=37%, E-value=2e-47, Identity=68%"; Hit description=GTP -binding protein-like
  Pfam annotation: Domain name=KH_2; Domain location=119-183; Score =72.0; E_value=1.9e-18; Accession=PF07650.7; Description=KH domain
MPYHCTTYRHRVTCSSRLVMSDIVMVWRRLASACWQPVCRYHPINIVPVLQIVCGRVLLPLALYRFLNDIVSEHPERFFVAEIVREKIFMQYRNEIPYACQVNVVNYKARPNAKEYIQVEILVEKNTQKIILIGREGKALKLLATAARLDVEDFLQKKVYLEIEVKVRANWRQDEGLLNHYGYGGQIRVI

SEQ ID NO: 226973 - protein, 229 aa, Glycine max
  Coding DNA Sequence Number=SeqID_110195
  Homolog annotation: Hit_ID=Q9FJZ5; Match level="QueryCoverage=96%, HitCoverage=96%, E-value=2e-14, Identity=29%"; Hit description =Arabidopsis thaliana genomic DNA, chromosome 5, TAC clone:K1F13
MDEFLLKAEKANAIRRHNNDIFAVFSKALRILELCLVLVLLSWILTRLPFALALSAEFLRRLIAFAASPLVVFAVSNAIIAALLAQSRRLSAPHSADSLYREFLHTRTAVTEPHAPPSPPPSPPPPEPEFHDKQVIVETVHDAPSAGAAAKYRRSQSEKIKVDAAGKLPRRKQLRRSETEKRGECLPEILYPQDELSNEEFQRAIEAFIAKQLRFLREESSAIVVQNPS

SEQ ID NO: 226974 - protein, 165 aa, Glycine max
  Coding DNA Sequence Number=SeqID_110196
  Gene Ontology: Mol. function=RNA-directed DNA polymerase activity; Cellular component=intracellular; Biological process=RNA-dependent DNA replication
EDAPASLMPPSHRREEVRKQFDAGFLAVARYPEWVANIVPIPKKDGKIKMAPEDMEKKTFVTLWGTFCYKVMSFGLKNVGATYQRAMVALFHDMMNKEIEVYVVDMIANSKTEEEHLSGKLLGFIVSQKGIEVEPDKDQAMPYESSGACATRAQKTLHSIHDCVG

SEQ ID NO: 226975 - protein, 271 aa, Glycine max
  Coding DNA Sequence Number=SeqID_110197
  Homolog annotation: Hit_ID=Q2QNC1; Match level="QueryCoverage=66%, HitCoverage=71%, E-value=8e-53, Identity=55%"; Hit description =Expressed protein
MGEKEKRNKNKKQKHQHPNDQSTKQNSDFSFKPSSEVKGIKFGGQFIVKSFTIRRARPLELLKVLSFPPTNNTNKPKDKLPFPSTTAFLPTNFTILAHHAWHTLTLGLGTKKSKVLLFVFETEAMKASVDRIWPPEIALGDVNKRLIRGLNGCEMARFKFRKGCITFYVYAVRQVGSFGFSCAEDLRTILQSVVELKDFLDHTVMLSMPNQRSISYSQSQSQPQRLFAMRRYERGIFSLTLGICKEAVFGFKPMTNKSPRHNFTTAPGLAL

SEQ ID NO: 226976 - protein, 113 aa, Glycine max
  Coding DNA Sequence Number=SeqID_110198
MKKMKMVWKNYQIELNEERERSTSSIKTSKFNPTQTHRFSRSVLFPGPECPSPCPLLCHVPRSQSVFLLSLFLFLVNPNLSLSLGGKGNMEDKQRQSEMERVTVNLSSSSSNV

SEQ ID NO: 226977 - protein, 57 aa, Glycine max
  Coding DNA Sequence Number=SeqID_110199
MAPPRKCIRVCEPGEVNQPMDQVLDTSPRKPIVWKELGVGSEVAVNHCGSSRSIDRV

SEQ ID NO: 226978 - protein, 248 aa, Glycine max
  Coding DNA Sequence Number=SeqID_110200
  Gene Ontology: Mol. function=transferase activity; Cellular component= endoplasmic reticulum; Biological process=determination of left/right symmetry
  Homolog annotation: Hit_ID=Q10BK3; Match level="QueryCoverage=84%, HitCoverage=64%, E-value=5e-74, Identity=62%"; Hit description =Glycosyl transferase, group 2 family protein, expressed
  Pfam annotation: Domain name=Glycos_transf_2; Domain location=6-178; Score=43.9; E_value=5.3e-10; Accession=PF00535.16; Description =Glycosyl transferase
MSIFESLCSTYFVPNAFVTFCGYTSTFSSQWTLEQVVIIDDGSADETKRVAFEFVRKYTVDKVRVILLGRNHGKGEAIRKGMMHSRGELLLMLDADGATKVTDLEKLENQIQAVAKREYHHGDSSDSDPRFRISDVPAAVFGSRAHLEEKALATIMTKASPDMCGFKMFTRAAARKLFSNVRLKRWCFDVELVFLCKWFRIPVSEISVNWSEIPGSKVNLLSIPNMLWELVLMSVGYRTGMWRISNST

SEQ ID NO: 226979 - protein, 158 aa, Glycine max
  Coding DNA Sequence Number=SeqID_110201
  Gene Ontology: Mol. function=DNA binding
  Homolog annotation: Hit_ID=Q1SFS3; Match level="QueryCoverage=78%, HitCoverage=23%, E-value=2e-11, Identity=32%"; Hit description =Lambda repressor-like, DNA-binding
MARIAKAIQISEQELNRVKQNRNGVIGIPRKHLEEKAEALANKREWTSFIDILALLVFGTILFLNVDGLVDLAAIDTYLAYHHSKQSLVITILADTYDTLDLRCEKSSARIIYCTPTLYVWLVSHVFVMKERPLAGSPDGKKEGQECYARVKDSQMSP

SEQ ID NO: 226980 - protein, 54 aa, Glycine max
  Coding DNA Sequence Number=SeqID_110202
MVRCGDGQQQHWWKMIPFSSSTILPFDEVLVNFNWWNRKRSENEENWALRDVFW

SEQ ID NO: 226981 - protein, 115 aa, Glycine max
  Coding DNA Sequence Number=SeqID_110203
  Gene Ontology: Mol. function=protein-methionine-S-oxide reductase activity; Cellular component=cytosol; Biological process=response to singlet oxygen
  Homolog annotation: Hit_ID=Q1T3G2; Match level="QueryCoverage=98%, HitCoverage=71%, E-value=1e-49, Identity=67%"; Hit description=Mss4 -like
  Pfam annotation: Domain name=SelR; Domain location=11-113; Score =194.9; E_value=1.9e-55; Accession=PF01641.9; Description=SelR domain
MAAPTPIQKTEEEWKGTGEYNKFYEEGIYNCAGCGTPLYKSSTKFDSGCGWPAFFEGFPGAIDRSPDPDGRRTEITCAACGGHLGHVFKGEGFKTPTDERHCVNSISVKFVPGNA

SEQ ID NO: 226982 - protein, 468 aa, Glycine max
  Coding DNA Sequence Number=SeqID_110204
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q6K3D4; Match level="QueryCoverage=65%, HitCoverage=28%, E-value=1e-113, Identity=65%"; Hit description =Putative PKG-Ib
  Pfam annotation: Domain name=PP2C; Domain location=54-333; Score =121.5; E_value=2.4e-33; Accession=PF00481.12; Description=Protein phosphatase 2C
MGCVHGKCCTRYPSPSVSGSRDFRELGPYCAQRKHILTQSLLQFVPVPSHNFTLEYSVLTQRGYYPDSPDKENQDSFSIRTQFQGNPSVHFFGVYDGHGEFGGQCSNFVKDRLVENLSSDIALLEDPVKAYTSAFLTTNDDLHKNEIDDSLSGTTAITVLVIGNTLYVANVGDSRAVLAVKDGNRVVAEDLSSDQTPFRRDEYERVKLCGARVLSVDQVEGHKDPDIQTWGDEESQGDDPPRLWVQNGMVPGAAFTRSVGDKLAETIGVIAVPEVSTVQLTPNHLFFVVASDGVFEFLSSQTVVDMAASYSDPRDACAAIAGESYKLWLEHEGRTDDITIIIVQIKGLSNKWLILWMVVEKLAQAVPIQVSVTSGHGASEINVSTVTRTKSKRVKGASEISATTGASPGAAVKLCLGDLLVMGSNPETASLHMQGLYGSFTMSPHTFSKVVAGLRCIILAAEGTLFRM

SEQ ID NO: 226983 - protein, 136 aa, Glycine max
  Coding DNA Sequence Number=SeqID_110205
  Subcellular localization annotation: CTP_CleavageSite=31; ConfidenceScore=5.08e-01
MRAKILENIIIMSRLLRSFSRISFHSNSSLSSSSRNSNLLNDQDNQTQEVAPKHNLFDEEVRFEDINQNMDDWNIPEIPQDQLYVPETIKDKHNFDYIIKTVENNIPLGQEVGEEFHLLSKNSIYEHSRKYKCGIL

SEQ ID NO: 226984 - protein, 331 aa, Glycine max
  Coding DNA Sequence Number=SeqID_110206
  Gene Ontology: Mol. function=adenosylmethionine decarboxylase activity; Cellular component=cellular_component; Biological process =spermidine biosynthetic process
  Homolog annotation: Hit_ID=Q75KG4; Match level="QueryCoverage=97%, HitCoverage=99%, E-value=8e-75, Identity=47%"; Hit description =Putative S-adenosylmethionine decarboxylase
  Pfam annotation: Domain name=SAM_decarbox; Domain location=3-321; Score=237.4; E_value=3.2e-68; Accession=PF01536.7; Description =Adenosylmethionine decarboxylase
MAFAFSGFEGFEKRLELHFFGDDPTILQLGLRKLSFECIQQTLEAVQCTVVSAVGNSYFDAYVLSESSLFVYPTKIIIKTCGTTQLLKSITPLIFYAQTHLGLTLSLCRYTRGSFIFPLSQPFPHTSFEHEVTYLETTLPSDLCFRKASIMPSKSSSHAWHVFTATNIPHHHSRALYSERHAYTMEICMTDLDPVLARKFFRRAGDGKTGDSAGKEMTEITGVDEINPQALVCDFAFDPCGYSMNGIDGEWYSTIHVTPEDGGADIPTGDDVGLYDVVGERDVERGIGCGGAHGNEVEELRDGPVPGFWERCLSNVYAASPEKCTLGRNWM

SEQ ID NO: 226985 - protein, 131 aa, Glycine max
  Coding DNA Sequence Number=SeqID_110207
  Gene Ontology: Mol. function=DNA binding; Biological process=DNA integration
IQRTNRLRILCPNTLEGTSFVAQVEGTSTWVVILRTREGTSLVDQFKWRAEVVSTTCYLVNRSLSTAIDLKTPIKLKVFGCPTYLHVSEGKLELRANKGVFMGYGNGDLGRAEDVTKKVEFEKPTIRNFSD

SEQ ID NO: 226986 - protein, 599 aa, Glycine max
  Coding DNA Sequence Number=SeqID_110208
  Gene Ontology: Mol. function=protein binding; Cellular component =nucleus; Biological process=negative regulation of ethylene mediated signaling pathway
  Homolog annotation: Hit_ID=Q8LGK0; Match level="QueryCoverage=99%, HitCoverage=100%, E-value=0.0, Identity=62%"; Hit description=F-box protein family, AtFBL4
  Pfam annotation: Domain name=F-box; Domain location=6-53; Score=18.9; E_value=0.018; Accession=PF00646.23; Description=F-box domain
  Pfam annotation: Domain name=LRR_1; Domain location=117-138; Score =8.2; E_value=8.3; Accession=PF00560.23; Description=Leucine Rich Repeat
  Pfam annotation: Domain name=LRR_1; Domain location=163-185; Score =7.4; E_value=12; Accession=PF00560.23; Description=Leucine Rich Repeat
  Pfam annotation: Domain name=LRR_1; Domain location=188-215; Score =3.6; E_value=61; Accession=PF00560.23; Description=Leucine Rich Repeat
  Pfam annotation: Domain name=LRR_1; Domain location=266-290; Score =0.7; E_value=2.1e+02; Accession=PF00560.23; Description=Leucine Rich Repeat
  Pfam annotation: Domain name=LRR_1; Domain location=317-341; Score =5.0; E_value=33; Accession=PF00560.23; Description=Leucine Rich Repeat
  Pfam annotation: Domain name=LRR_1; Domain location=343-366; Score =8.6; E_value=7.2; Accession=PF00560.23; Description=Leucine Rich Repeat
  Pfam annotation: Domain name=LRR_1; Domain location=395-422; Score =4.8; E_value=36; Accession=PF00560.23; Description=Leucine Rich Repeat
  Pfam annotation: Domain name=LRR_1; Domain location=464-491; Score =7.8; E_value=9.8; Accession=PF00560.23; Description=Leucine Rich Repeat
  Pfam annotation: Domain name=LRR_1; Domain location=516-540; Score =5.8; E_value=23; Accession=PF00560.23; Description=Leucine Rich Repeat
  Pfam annotation: Domain name=LRR_2; Domain location=241-265; Score =14.8; E_value=0.15; Accession=PF07723.3; Description=Leucine Rich Repeat
  Pfam annotation: Domain name=LRR_2; Domain location=266-290; Score =3.1; E_value=6.1; Accession=PF07723.3; Description=Leucine Rich Repeat
  Pfam annotation: Domain name=LRR_2; Domain location=317-342; Score =4.9; E_value=3.4; Accession=PF07723.3; Description=Leucine Rich Repeat
  Pfam annotation: Domain name=LRR_2; Domain location=516-541; Score =0.1; E_value=16; Accession=PF07723.3; Description=Leucine Rich Repeat
  Pfam module annotation: Pfam domain module=F-box::LRR_1::LRR_1::LRR _1::LRR_1::LRR_1::LRR_1::LRR_1::LRR_1::LRR_1::LRR_2::LRR_2::LRR _2::LRR_2; Domain location=6-53::117-138::163-185::188-215::266 -290::317-341::343-366::...
  Pfam module annotation: Domain location=395-422::464-491::516 -540::241-265::266-290::317-342::516-541
MRGHDWINTLLPDELLIEIFRRLDSKSNRDASSLVCTRWLRLERLTRAAIRIGASGSPDLLIHLLAARFSNITTVHIDERLSVSIPAHLGRRRSSGNSSVKLHDVNDKHGSASDQSDLDSLCLSDSGLASLAEGFPKLEKLRLIWCSNVTSEGLSSLARKCTSLKSLDLQGCYVGDQGLAAIGQCCKQLEDLNLRFCEGLTDNGLVELALGVGNALKSLGVAACAKITDVSMEVVGSQCRSLETLSLDSEFIHNKGVLAVIKGCPHLKVLKLQCINLTDDTLNVAGTSCLSLELLALYSFQRFTDKGLCAIGNGCKKLKNLTLSDCYFLSDKGLEVIATGCKELTHLEVNGCHNIGTLGLESVGKSCQHLSELALLYCQRIGDAGLVQVGQGCKFLQALQLVDCSSIGDEAMCGIASGCRNLKKLHIRRCYEGIIAVGEKCKLLTDLSIRFCDRALIAIAEGCSLHYLNVSGCHLIGDAGVIAIARGCPQLCYLDVSVLQKLGDIAMAELGEHCPLLKEIVLSHCRQITDVGLAHLVKGCCTVLESCHMVYCSGVTSVGVATVVSSCPNIKKVLVEKWKVSQRTQRRVGSVISYLCMDL

SEQ ID NO: 226987 - protein, 88 aa, Glycine max
  Coding DNA Sequence Number=SeqID_110209
MSFSFFKALRPKTPQEVAKSIKESLMALDTKTVVEVKALEKFCSRKTTVAELYLTEEISNLDSDAQVSVCGRRGLCKFRESVPDACMA

SEQ ID NO: 226988 - protein, 105 aa, Glycine max
  Coding DNA Sequence Number=SeqID_110210
  Gene Ontology: Mol. function=lipid binding; Cellular component =anchored to membrane; Biological process=lipid transport
  Homolog annotation: Hit_ID=Q10R96; Match level="QueryCoverage=86%, HitCoverage=49%, E-value=2e-18, Identity=41%"; Hit description =Protease inhibitor/seed storage/LTP family protein, expressed
  Pfam annotation: Domain name=Tryp_alpha_amyl; Domain location=34-105; Score=5.0; E_value=0.027; Accession=PF00234.12; Description=Protease inhibitorseed storageLTP f
MDSNACLPHLLVLAITLVLVSHAMGDSAQDKQKCAESLTAVATCLPYLGADAKAPTADCCSGLTQAMKTNKKCVCLILKDRDDPDLGLKTNMTIAVGLPKVRGQR

SEQ ID NO: 226989 - protein, 53 aa, Glycine max
  Coding DNA Sequence Number=SeqID_110211
MRMRKWRKELEYPEPRSAIGFYLKNPCASFMKYELGTRVSREKWRFWFVNSEI

SEQ ID NO: 226990 - protein, 266 aa, Glycine max
  Coding DNA Sequence Number=SeqID_110212
  Gene Ontology: Mol. function=receptor activity; Cellular component =integral to membrane; Biological process=anti-apoptosis
  Homolog annotation: Hit_ID=Q5F2L4; Match level="QueryCoverage=86%, HitCoverage=97%, E-value=4e-53, Identity=46%"; Hit description =Putative receptor associated protein
  Pfam annotation: Domain name=UPF0005; Domain location=52-265; Score =48.8; E_value=1.9e-11; Accession=PF01027.11; Description =Uncharacterised protein family UPF0005
MVDDREGVPICNSTSSRKEKMFEPQQLYTRAKTEEFDLESGETLYPGLSVGENQLRWGFIRKVYGILSAQIVLTTLVSVTTVFYTPINDLLKGNSTLLLILLFLPFIFLIPLLKYQQKHPHNYILLALFTVSISSTIGVTCANTDGKIVLEALILTSAVVSSLTGYAFWASKKGKDFSFLGPILFTSLITLILTGMMQMFFPLGPTAHAIYGAIGAMIFSGYIVYDTDNLIKRFTYDEYIGASVTLYLDILNLFLSILRILREANN

SEQ ID NO: 226991 - protein, 88 aa, Glycine max
  Coding DNA Sequence Number=SeqID_110213
MEEEFPRYRTSLANVCGCSQNQSKRIELDVHKENVCDETKGMDLAEMIDGGWLCGEDTMERDGLVGGVGWHGSHGRHPLELNESTKML

SEQ ID NO: 226992 - protein, 469 aa, Glycine max
  Coding DNA Sequence Number=SeqID_110214
  Homolog annotation: Hit_ID=UPI00005869D4; Match level="QueryCoverage =18%, HitCoverage=17%, E-value=6e-11, Identity=38%"; Hit description =PREDICTED: similar to Bsdc1 protein
  Pfam annotation: Domain name=BSD; Domain location=192-257; Score =64.1; E_value=4.4e-16; Accession=PF03909.7; Description=BSD domain
MNFFKSVFADEPDEPDSPPAESDNPDPPQSHHDSAWSFGGLIQTLASKSESVLENYRRDLEEFGSGLRKETAVIREAASRAVQDLPASLDVGASVAQESLESVGQAIDDIGSTVWNSTAQIISHGRDSLLASDFDSDSFDSSNYDNNNASKKLLSGSGSSDRGLDLKRYSRFDTLVRALQCDVNTYLEEPEDLGNFNEWKLGFEVNEKSEEIRNLIEENEVVDEIYEKVVPSRIDDESFWSRYFYRLDKLRQAEDTRAKLVKRAISGDEEEDLTWDFDDDDEGGNDGYEPLGDTRSVSEVKEGKSGDGAMDGGDVENVQAGKKDDGKVVENVQIRKKDLEIEDDGKSVSAPELKTDVDDKSENVSSNVPENVSSSGDKLDVKCEEKEASEGKTDNDNNGSCKDSDISVVSSQPSMPGEEDIGWDEIEDIESNDESKGATSRIDLRKRLSVADEDEDLSWDIEDDDEAAK

SEQ ID NO: 226993 - protein, 152 aa, Glycine max
  Coding DNA Sequence Number=SeqID_110215
MESNFHVDVEDSSSRGDIVGQLVTPLHSALPLESINNFHCDNSLPPLVLEVGNHADEKAPCDTVEELVLLGTLELSSKVPPLPMTQVAAQVVLLSLRPVSVPEFLSKLPPLVTKHVGAQVVLPEVFHTVHQHYRHGHCNMISYGSVILHGGR

SEQ ID NO: 226994 - protein, 762 aa, Glycine max
  Coding DNA Sequence Number=SeqID_110216
  Gene Ontology: Mol. function=zinc ion binding; Cellular component =nucleus; Biological process=regulation of transcription, DNA -dependent
  Homolog annotation: Hit_ID=Q9ZVC9; Match level="QueryCoverage=95%, HitCoverage=69%, E-value=1e-100, Identity=36%"; Hit description =Mutator-like transposase
  Pfam annotation: Domain name=FAR1; Domain location=199-375; Score =137.9; E_value=2.8e-38; Accession=PF03101.5; Description=FAR1 family
  Pfam annotation: Domain name=FAR1; Domain location=43-181; Score =46.7; E_value=7.9e-11; Accession=PF03101.5; Description=FAR1 family
  Pfam annotation: Domain name=SWIM; Domain location=648-684; Score =39.9; E_value=9e-09; Accession=PF04434.8; Description=SWIM zinc finger
  Pfam module annotation: Pfam domain module=FAR1::FAR1::SWIM; Domain location=199-375::43-181::648-684
MIVKDHFVGTELAMSNTCVEEGIDFSCDPYIGLEFDTADEALKYYTSYANRTGFKVRIGQLYRSRTDGSVSSRRFVCSKEGHQLSSRTDCPAFIRVQLNGSGKWVVDHFHKDHNHHLEISGENCTPTLQPKGAGATVINSLTEFPRRTRKKLLEEANDESSCPFGIIDFKRLRKEELEGQSRTEPYVGQEFSSPNEAYQFYHAYAAHLGFGVRIGQLFRSKNDGSITSRRFVCSKEGFQHPSRVGCGAYLRIKRQPSGKWIVDRLRKDHNHDLDSEKVGRAKSLPASNILAEEVDTGLLNGDLFRIDNYPVPRGGRQNHIRSEWYGILLEYFQSRQAEDTGFFYAMEVDNGNCMNIFWADGRSRYSCSHFGDVLVLDTSYRKTVYLVPFATFVGVNHHKQPVLLGCALIADESEESFTWLFQTWLRAMSGRLPLTVIADQDIAIQRAIAKVFPVTHHRFSLWQIKAKEQENMGLMGNGFTKDYEKCVYQSQTVDEFDATWNVLLNKYGLKDDAWLKEMYQKRASWVPLYLKGTFFAGIPMNESLDSFFGALLNAQTPLMEFIPRYERGLERRREEERKEDFNTSNFQPILQTKEPVEEQCRRLYTLTVFKIFQKELLQCFSYLGFKIFEEGGLSRYMVRRCGNDMEKHVVTFNASNLSISCSCQMFEYEGVLCRHVLRVFQILQLREVPSRYILHRWTRNAEDGVFPDMESWSSSQELKNLMLWSLRETASKYIDAGATSFEKYKLAFEILREGGRKLCWHR

SEQ ID NO: 226995 - protein, 160 aa, Glycine max
  Coding DNA Sequence Number=SeqID_110217
  Gene Ontology: Mol. function=nucleic acid binding; Cellular component= membrane; Biological process=DNA integration
MVAQGYNQLEEIDYEETFTPVARLEVIRILLAYATHKDIKLYQMDVKSAFLNGFIYEEFFLGLQIIQKDHGIFIYQEKYTKDLLMKFRMDEARPMTTPMYPSITIDWDEKGYCDANFIGDKVERKSTSDAYQFIVKSVVSWPSKKYIIITLSISTTACCS

SEQ ID NO: 226996 - protein, 198 aa, Glycine max
  Coding DNA Sequence Number=SeqID_110218
  Homolog annotation: Hit_ID=Q9SJJ7; Match level="QueryCoverage=57%, HitCoverage=45%, E-value=6e-08, Identity=31%"; Hit description=RING -H2 finger protein ATL2E
  Pfam annotation: Domain name=PHD; Domain location=145-192; Score= -0.1; E_value=0.058; Accession=PF00628.19; Description=PHD-finger
  Pfam annotation: Domain name=zf-C3HC4; Domain location=146-189; Score= 39.0; E_value=1.6e-08; Accession=PF00097.15; Description=Zinc finger, C3HC4 type (RING finger)
  Pfam module annotation: Pfam domain module=PHD::zf-C3HC4; Domain location=145-192::146-189
MGRQCRAEALWPLLFLTFMFIIVLITIDHASTGIFIFLGSILGLFLWYWLGSLVLDRDNWDNSHDVDDERTREFQNIESSNASDPQNSLPLTRTRIVIASVRARREPWQDVQPFSFAPRAHAARLSMRALPPAICFQGDDESQRDCPICMEDFKNGELIQPFGVCVHEFHLSCVNSWLLGGGKTTCPVCRKDLSISVD

SEQ ID NO: 226997 - protein, 82 aa, Glycine max
  Coding DNA Sequence Number=SeqID_110219
MDLAASIDEGHVQKFTRVVKEFSSITPLVYFYIQIRELSQGASGNENEQLTSDDDVGVILWQKAARELRLGFHGGGGGSLNL

SEQ ID NO: 226998 - protein, 132 aa, Glycine max
  Coding DNA Sequence Number=SeqID_110220
  Homolog annotation: Hit_ID=Q5JNC1; Match level="QueryCoverage=66%, HitCoverage=9%, E-value=2e-08, Identity=35%"; Hit description =Putative kinase interacting protein 1
MIIIKTPKAIASTQTPSETVWEQQDKKAEADLQVGENNGIDKVVQKNDGDYEKSLNEALNHIQLLKRELAGKDAKFVKKSYHNSEAKYWETDEQIKQLQDRVSILQDDFGEGVAIEDDQGHRLMAKAALKSF

SEQ ID NO: 226999 - protein, 880 aa, Glycine max
  Coding DNA Sequence Number=SeqID_110221
  Homolog annotation: Hit_ID=Q9ZS22; Match level="QueryCoverage=95%, HitCoverage=94%, E-value=0.0, Identity=76%"; Hit description =Cysteine-rich polycomb-like protein
  Pfam annotation: Domain name=CXC; Domain location=487-528; Score =82.6; E_value=1.2e-21; Accession=PF03638.5; Description=TesminTSO1 -like CXC domain
  Pfam annotation: Domain name=CXC; Domain location=574-596; Score=4.0; E_value=0.0092; Accession=PF03638.5; Description=TesminTSO1-like CXC domain
  Pfam annotation: Domain name=Metallothio_2; Domain location=504-592; Score=-18.2; E_value=0.053; Accession=PF01439.8; Description =Metallothionein
  Pfam module annotation: Pfam domain module=CXC::CXC::Metallothio_2; Domain location=487-528::574-596::504-592
  Subcellular localization annotation: CTP_CleavageSite=16; ConfidenceScore=5.59e-01
MDSPGPSKNNNGSSSSASTLNNNNNDAASSESPQVQESPFLRFVKTLSPIPTKASHTTQGCLRLSSPPLVFKSPRISHRETQLTERPQGTRSLGGVILQSVNEGNMLGEAPGDSRTSNSQQSLPERFINDTQQVFDSKNDENTQYYSSPSCIDKYLVDPGDIDQMYSAGQDVEQQSTDPAEASLSDQIHPKNNILNFDRQDGPGDKVEESLPLSEGFNKFHQENAAYGEEPEEMEVENNDVQWSSQEPAKLESILAADVFEKRYSHDTLPQLQLVENYRWDHKNCTPQWMPDPLQGVKGCEDYNEMVPTSHVTAENILQDGSKATLKYHGIRRRCLQFGEAASNALGSNVKLNATSNKIIMVKPSELVTSLCPQRGSGNFPLTGPKPTGIGLHINRIMNAIPTGQAATMGVRLSDGSQGMKSTSSIRLQRIENVKRSILSSNVDGRSLVNTRTESHEIDDTGNSEDFNIPSSPCQKKKKISETADDDGCKHCNCKKSRCLKLYCHCFAAGTYCTDPCACQGCLNRPEYAETVVETKQLIESRDPSAFDPKIVLPTTDISSHMDDENLTTPSSARHKRGCNCKSGCRCEGCKNVYGKKEDYVAFEHTSSKERESSIVEEGSDYTFHKKLERVASKTVYGLHCLSPITPSLQCSEQGKEAAKSIIISGNYLPSPESDVNMFASCANYTKSSENLHSSQALLGTNEMLGSTPYDSQIECSHAALLQLTPPLSNPELCGTSSFSSIANEWRNISQSQPTHGCISQLPSGSLCWRSSPLTPSNRVGEAQYFQCSESDSRLFDILENETPDVLKEASTPMTSVKINSPTQKRVSPPQSRHFEIGSSSSGGLRSDRKFIFESVPSFPSLSPCVNSKSNGDDDEEDIS

SEQ ID NO: 227000 - protein, 65 aa, Glycine max
  Coding DNA Sequence Number=SeqID_110222
MGFIHSQGWIFVDSGNEMEHETFLATWFAEIDFSPNGLRFSNLQPHPRLINHEKPMLCRWHRLNP

SEQ ID NO: 227001 - protein, 89 aa, Glycine max
  Coding DNA Sequence Number=SeqID_110223
MVGMKVVTLTIKDRWSIVATYPSEGGRRETQGCVFQERKMHRVTTNVYLRKTSEKPKRCGLRTLSVKGSGVIFTHGEDISTPRVRHKGR

SEQ ID NO: 227002 - protein, 63 aa, Glycine max
  Coding DNA Sequence Number=SeqID_110224
MGVIKYMTMDELKLLSFPSKMLKFFNHSSFPHKGHPTRKISMQQGHAYILVARFPDPNYGVKT

SEQ ID NO: 227003 - protein, 126 aa, Glycine max
  Coding DNA Sequence Number=SeqID_110225
  Homolog annotation: Hit_ID=Q8CXY5; Match level="QueryCoverage=38%, HitCoverage=23%, E-value=1e-17, Identity=75%"; Hit description=Type 1 fimbriae Regulatory protein fimB
MAGISVQVHPHMLRHSCGYALADKGIDTRLIQDYLGHKNIQNTVIYTATNMGEAARHVINGLLSNILTPSCFSCIGARDRPHWFAVILHLQLTHGAAFMRADRLDAAPLQLGDLPQAHSVEQKGQD

SEQ ID NO: 227004 - protein, 86 aa, Glycine max
  Coding DNA Sequence Number=SeqID_110226
MVSGMTIICLRMSSGSPPLDDKRVQNDHNLSLCAIGHNCLRMAKRMTIICLRMSSGSPPLDDKRAQHDHNLSLRAIRHDCLRMAKR

SEQ ID NO: 227005 - protein, 90 aa, Glycine max
  Coding DNA Sequence Number=SeqID_110227
MRGSWLRNVNIVILINKESMKNNFEGAQIMHHLVHDPYSHARRAQKIKNLLVHALILHQTHIRDEALTFSSSTKLTSTLQSDKNKKGQGY

SEQ ID NO: 227006 - protein, 333 aa, Glycine max
  Coding DNA Sequence Number=SeqID_110228
  Gene Ontology: Mol. function=chlorophyll binding; Cellular component =photosystem; Biological process=photosynthetic electron transport
  Homolog annotation: Hit_ID=P56777; Match level="QueryCoverage=100%, HitCoverage=89%, E-value=1e-141, Identity=75%"; Hit description =Photosystem II P680 chlorophyll A apoprotein
  Pfam annotation: Domain name=PSII; Domain location=1-333; Score =521.2; E_value=1.2e-153; Accession=PF00421.9; Description =Photosystem II protein
MALYELAVFDPSDPVLDPMWRQGMFVIPFMTRLGITNSWGGWNITGGTITNPGIWSYEGLYGPGIWVSDPYGLTGRIQSVNPAWGVEGLFHLSVRPPQRLYKGLRMGNIETVLSSSIAAVFFAAFVVAGTMWYGSATTPIELFGPTRYQWDQGYFQQEIYRRVGAGLAENQSSMDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQ

SEQ ID NO: 227007 - protein, 60 aa, Glycine max
  Coding DNA Sequence Number=SeqID_110229
MVVLGLDPVKATTNDQSDFESGFALILIHGIVTPAAQQPFLAKVVHRVRGEEEERRRNIV

SEQ ID NO: 227008 - protein, 133 aa, Glycine max
  Coding DNA Sequence Number=SeqID_110230
MEFYVVAGVLYAFLHYFGESETLDNVAENNMGLKKHCTSDSTWIIVHGHMNGSRCKKRTNDEEGIFWGLAEGQFGEHGFDERGRKRDVRREKKESHEDSKNGGFNPFSVSLTFGNSIGIGAVGGKTGGISGNR

SEQ ID NO: 227009 - protein, 59 aa, Glycine max
  Coding DNA Sequence Number=SeqID_110231
  Gene Ontology: Mol. function=glutathione transferase activity
  Homolog annotation: Hit_ID=Q9FQD5; Match level="QueryCoverage=85%, HitCoverage=20%, E-value=4e-16, Identity=86%"; Hit description =Glutathione S-transferase GST 23
MKDEAEVNGIDFEEIKVDLSKRQQLSPEFREDNPLRKVSAIVDERFKLFESHLIPINKS

SEQ ID NO: 227010 - protein, 388 aa, Glycine max
  Coding DNA Sequence Number=SeqID_110232
MTKGGEESKEENGGAAVKLCLGDLLVMGSNPETVSLHMQDTRLRELNRRKAKVAIGNVNAIKQASVIDLSNSLAEEGNRKMGYDDSIDPKVNSKSEPHVAHTQLSFPVMDDNAFPMCEVLDQNFVDVNDLSKLEKVGFIGACEALQHYGVSVGVVACLLKGEVKKCKEEAAGLSNRLFVCKKCVAQVEEMEQSLVYVKKWRNAKSECVVKDSATFDDHVDGFNRDLVHVVALYPDVDFFGIELYKDVVDGKVIDSSFPPRTPTPEDGVFLELAPPCLFAPKVFIVDCLPCVYGERLKTLGDENVYPCTSVVCLSSRCYSAFLIGRSSLCQTGLRFRDCNHIVEIVFVEIVFATYRLSSCLSQTGLCFRDCNHIVEFAFVEFVSALPSK

SEQ ID NO: 227011 - protein, 656 aa, Glycine max
  Coding DNA Sequence Number=SeqID_110233
  Gene Ontology: Mol. function=glutamate-ammonia ligase activity; Cellular component=chloroplast; Biological process=nitrogen compound metabolic process
  Homolog annotation: Hit_ID=P08281; Match level="QueryCoverage=60%, HitCoverage=96%, E-value=0.0, Identity=82%"; Hit description =Glutamine synthetase leaf isozyme, chloroplast precursor
  Pfam annotation: Domain name=Gln-synt_C; Domain location=143-392; Score=281.1; E_value=2.2e-81; Accession=PF00120.14; Description =Glutamine synthetase, catalytic domain
  Pfam annotation: Domain name=Gln-synt_N; Domain location=77-137; Score=61.4; E_value=3e-15; Accession=PF03951.9; Description =Glutamine synthetase, beta-Grasp domain
  Pfam module annotation: Pfam domain module=Gln-synt_C::Gln-synt_N; Domain location=143-392::77-137
  Subcellular localization annotation: CTP_CleavageSite=44; ConfidenceScore=5.64e-01
MAQILAPSTQWQMRISKSSPNATPITSNMWSSLLWKQNKKVSPTSSAKFRVLAIKSDNSTINRLEGLLNLDITPFTDKIIAEYIWIGGTGIDVRSKSRTISKPVEDPSELPKWNYDGSSTGQAPGDDSEVICDSYTPQGEPIPTNKRHRAAEIFSNPKVQAEVPWYGIEQEYTLLQTNVKWPLGWPVGGYPGPQGPYYCSAGADKSFGRDISDAHYKACLYAGINISGTNGEVMPGQWEYQVGPSVGIEAGDHIWASRYILERITEQAGVVLSLDPKPIEGDWNGAGCHTNYSMREDGGFEVIKKAILNLSLRHKDHISAYGEGNERRLTGKHETASINTFSWGVANRGCSIRVGRDTEKNGKGYLEDRRPASNMDPYVVTSLLAETTLLWEPTLEAEALAAQKLALKDPTHLMNCNHAATTFLSLALPPPPSSALFPKRPSAILRPYQTLLSSNTRLGLRVRASNGDSNVQPANWSQWIPAGSFAADKVFRLIPGATASPIGQFVPSPATFLHSIDPRVKLDQLGRVYLLSELLFITSGLGSDGVPAIVQLRTPPPAMMGLPNLPVSLTGYAYTIMKLGPLTFTRKGLSVASTVACLTFTVFQSASPCLTATSPEQLAFALRWFMLPLKYIGVSVSEIVLTLLLSLRFISLVFDE

SEQ ID NO: 227012 - protein, 110 aa, Glycine max
  Coding DNA Sequence Number=SeqID_110234
MVDNKNKRMKSIGHISTSPKMKSKKEKEPTKGGLSNRGKHLAHSPLPPPYPKPTLWFVEEHYEVSYKFSYAKKEQIQPKSKLHDESRLIQGVLMITKMMTKSSKVKNTSC

SEQ ID NO: 227013 - protein, 133 aa, Glycine max
  Coding DNA Sequence Number=SeqID_110235
MECIIRHRHFLSILRRCIKYPFEGHDTDMSASEHSFSGVAETHPHFSWPTMTPSQQHDAPMATPNAPLVPQWNVPGAITDMGDLLGVDLRHEFSAEAEQQGRRQRARRNLDREARRWNRPCGTSSHHHGHHND

SEQ ID NO: 227014 - protein, 228 aa, Glycine max
  Coding DNA Sequence Number=SeqID_110236
  Homolog annotation: Hit_ID=UPI00005DC23F; Match level="QueryCoverage =97%, HitCoverage=31%, E-value=4e-35, Identity=81%"; Hit description =catalytic
MVSTEGRGGIVKILLIKNSRGDVLQCSHYMPIVSPDGKPLPCVIYCHGNSGCRVDASEAALILLPSNITVFTLDFSGSGISGGEHVTLGWNECFIIVKVAYWTLKQQEEPKKKKSIAGIEVDECSDIQKWEFLKVRVAPIKKKLTKAYPGWFDHKDDLRAVVNYLRADGNVSLIGLWGRSMGAVTSLMYGAEDPSIAGMVLDSPFSDLVDLMMELVDTYRVRLPKFTA

SEQ ID NO: 227015 - protein, 273 aa, Glycine max
  Coding DNA Sequence Number=SeqID_110237
  Homolog annotation: Hit_ID=UPI00005DC23F; Match level="QueryCoverage =62%, HitCoverage=32%, E-value=5e-17, Identity=35%"; Hit description =catalytic
TSTSSTVEDIKHVRSKKPMSRMEVPSHISSKDAHLDCEAQKCDDLSSSSSTMISFELSNGRLYSPLVPTDLDDDHFVEFQLDDFTGCPSSAKKEQKMFTEAVIDSLKDREIRIPEVEQPPVRSASSTMSIEPSDKNDSHASNSHEISKPVETESSLLNHSDKTISTSSDALEPLKTESNSISVIPSPVTSLSSSKIPSSPLPPLDTSSVTESGDTESASTGNDSSASLQSSSDTDISHNTKATLTVIKNPTGHVLNGLLRRWDFKFFRNSQNR

SEQ ID NO: 227016 - protein, 830 aa, Glycine max
  Coding DNA Sequence Number=SeqID_110238
  Gene Ontology: Mol. function=binding
  Homolog annotation: Hit_ID=Q10L20; Match level="QueryCoverage=91%, HitCoverage=89%, E-value=1e-167, Identity=44%"; Hit description =Expressed protein
  Pfam annotation: Domain name=Arm; Domain location=375-418; Score=7.9; E_value=1.3; Accession=PF00514.13; Description=Armadillobeta-catenin -like repeat
  Pfam annotation: Domain name=Arm; Domain location=635-673; Score =13.9; E_value=0.23; Accession=PF00514.13; Description=Armadillobeta -catenin-like repeat
  Pfam module annotation: Pfam domain module=Arm::Arm; Domain location =375-418::635-673
MDRRLSVKIEGEGSVHIQVAELHRLSETSKTSTMFEPRGLSSIEKRDSDAADNYSFSSATARAPEKKLTLFALRLAVLEKAATSLGTLGFIWATVVLLGGFAITLDKTDFWFITIILLIEGTRIFSRSHELEWQHQATWSITEVGINSFRMLRSSPNLLLQSIKSLFRPIVIKKQRRDMVEANVTPRHSDNHNTISIRTPTRMWISSDVPLLPYARWFFLSRHISKLLYWLQLFSAMACVVLSSMKLIKHNYGEVAKGDTDKRNRESALNIFYALALAEALLFLMEKAYWEWKISYCKLLDEVNKECGLGPSGMVSIRRFFYDSYSRCVNGSIFDGLKMDIVCFAMDLLASNSPDEQLIGGRILRQFAVSERFSDDTLQKLGISISVVERLVEMLNWTDHKEEEIRLSAAEILSALAGKKQNSLRIAGIPGAMESISSLLQTNRNCIHAADEIGEKKLIFDHPNYGYWTFNHLGLLILKKLARDHDNCGKIGNTRGLLPKIIDFTHAEEGLLKNENVTPSQILTVKRSLQLVKMLTSTTGTYGKHLRREISEIVFTISNIRDILRHGEKHPLLQKLSIEILTSLALEEEATERIGGTGGVLKELFNIFFKDCIAENQKDVTTVAGEALAMLALESKNNCHRILKLKVLERLIEALKFPLLRVNAARILRNLCTYSGSEGFKQLMGVTAAAPTAIMSQENKLQEVMIGLAASVFTFMTSSESSTVFEESGITEAELANKLIHILKKHRYPPTKVPRIRRFVIELAIWMMKEREENIHTFKDLGMEEVLEGVLETTSELESFNVFSGTVGLNRHNLTIHSLVETALKLLEDR

SEQ ID NO: 227017 - protein, 60 aa, Glycine max
  Coding DNA Sequence Number=SeqID_110239
MRSLEGTFILRRVGERVTPSFTILPSIFEDVVGFCFFSNLSNVWKDMERNGSSGTGSKEK

SEQ ID NO: 227018 - protein, 107 aa, Glycine max
  Coding DNA Sequence Number=SeqID_110240
MVLRQAKTAHGGHRGEGKEEEDGRFMLLGIFEARNTRPGCYRPDSPTWLQSKESNKVASKDKHCFKINTRLLQQTKPCFKINSRSSLASKQSVSKTSKALVVDYQAV

SEQ ID NO: 227019 - protein, 96 aa, Glycine max
  Coding DNA Sequence Number=SeqID_110241
  Homolog annotation: Hit_ID=O64438; Match level="QueryCoverage=43%, HitCoverage=17%, E-value=7e-14, Identity=83%"; Hit description=ARG10
MFCLFQHITRCFYSTAVGGLRCYENPKNKITAVPAEEEQIWGAFFKNRESVISPNSNIRLMSVETALGTKGKCEVILELKKLELNIPYVTRIASCN

SEQ ID NO: 227020 - protein, 69 aa, Glycine max
  Coding DNA Sequence Number=SeqID_110242
MNIVMGPLWETDELNHFEARQECDNSLSLCLCLDHVIISNLVFVEEMTRWIALGNLVLEDIETQCFDRM

SEQ ID NO: 227021 - protein, 41 aa, Glycine max
  Coding DNA Sequence Number=SeqID_110243
MGCLSGPWERHKCACKCYPDFQWRNDFASDGYRQGRVDRNL

SEQ ID NO: 227022 - protein, 103 aa, Glycine max
  Coding DNA Sequence Number=SeqID_110244
  Pfam annotation: Domain name=Actin_bind_SAA; Domain location=54-69; Score=12.7; E_value=0.99; Accession=PF08043.3; Description=Actin Binding Sixteen Amino Acid Repea
  Pfam annotation: Domain name=Actin_bind_SAA; Domain location=72-87; Score=12.1; E_value=1.2; Accession=PF08043.3; Description=Actin Binding Sixteen Amino Acid Repea
  Pfam module annotation: Pfam domain module=Actin_bind_SAA::Actin_bind_ SAA; Domain location=54-69::72-87
SEDKDTNFILAILPSDRPLAETQVLKPIKRRNVRGIRAEDIDSLRKTIDFDSLGNVKKNVIVFETKDSDSFGKVKKTVIIFETKDFDSLGNVKKTEIVLTKDI

SEQ ID NO: 227023 - protein, 149 aa, Glycine max
  Coding DNA Sequence Number=SeqID_110245
MKLHELATLPSGSKGNANPKGKDNTCWVQVPKQTQGRPDYTSDTHEDQTARHRSVSADREDHTQSRQRGISYCTKMETVEVEGVVARDPNVTEGDFKIGLGFATHTPTEAIEQHFFSPQTNKADPTSAWQVYSRKRVTKSNLTWAVQMA

SEQ ID NO: 227024 - protein, 107 aa, Glycine max
  Coding DNA Sequence Number=SeqID_110246
MVTWDDLDSDKSSSSDDEQANICLLANTSDKVKCKKFKEKFKVSSSKNIELRKSNEFLEKENKKKTLEETLKESLSLASKTNETSIVEKLREEVAYLTNDFGKFLKS

SEQ ID NO: 227025 - protein, 220 aa, Glycine max
  Coding DNA Sequence Number=SeqID_110247
  Gene Ontology: Mol. function=1-acylglycerol-3-phosphate O -acyltransferase activity; Cellular component=integral to membrane; Biological process=phospholipid biosynthetic process
  Homolog annotation: Hit_ID=O80437; Match level="QueryCoverage=92%, HitCoverage=41%, E-value=5e-78, Identity=71%"; Hit description =Glycerol-3-phosphate acyltransferase 6
MGTFPRFDPITTQDRSNQTVASDLDGTLLVSRSAFPYYLLVALEAGSVLRALLLLTSAPFVYFTYLVLSETLAIKTLIFITFAGLKLKDVELVSRSVLPRFYAEDVHPATWRIFNAFGGRRCIVTASPRVMVEPFAKTFLGADTVLGTELAVTASGRVTGFAKEPGVLVGVQKKEVVLKEFGSNLPDLGLGDSVTDMDFMSICKVGITVICIYFSLPLNY

SEQ ID NO: 227026 - protein, 58 aa, Glycine max
  Coding DNA Sequence Number=SeqID_110248
MWVQAIGLFAQATCAREFGLPRPFNQRLLVLHVGGERSELSRIGCWINGLSYLKKKGG

SEQ ID NO: 227027 - protein, 168 aa, Glycine max
  Coding DNA Sequence Number=SeqID_110249
  Gene Ontology: Mol. function=nucleic acid binding; Biological process= DNA integration
  Homolog annotation: Hit_ID=Q1S9I4; Match level="QueryCoverage=97%, HitCoverage=16%, E-value=7e-09, Identity=25%"; Hit description =Integrase, catalytic region; Zinc finger, CCHC-type
MVNHLKGLGKEFKVEELNLKILKSLNTTWQLKVTTIFHSKDLTSITHAKLFEKLREYKMDMTRMAEEGAKEKKSRGLALKSSIPSSDEENAKGYDNENLTLLVRKFKKFLTKKNPKGITFQHKKNFKKNDLSFSIFTFFKRRKLGQIKSECSIFLKKQQQEGYTLDKK

SEQ ID NO: 227028 - protein, 72 aa, Glycine max
  Coding DNA Sequence Number=SeqID_110250
MEPQCQDETSPPKTRIQAVINMITGGFVGVRSSNSMHKPHVHNLKSVNSVATKKKAVKSLTLITFTYEGFEG

SEQ ID NO: 227029 - protein, 143 aa, Glycine max
  Coding DNA Sequence Number=SeqID_110251
  Gene Ontology: Mol. function=RNA-directed DNA polymerase activity; Cellular component=riboflavin synthase complex; Biological process =RNA-dependent DNA replication
MYPEERHMKILKGYTKNLHRPKASIVESWRQCYAFIREAIDEKTKLGPKRRKAIDEKAKKLLNAGFIREVQYTTWLANMMMVKNSNEKLRMRTNYTDLYKACPIDSYPLPSKDFLVDEASKFSILSFSYAYFEYNNNTYVLVG

SEQ ID NO: 227030 - protein, 101 aa, Glycine max
  Coding DNA Sequence Number=SeqID_110252
MKRGYKRVNEMTEDEVENKKKRGRKERMRMFSWLGEKSIDNNIGVQTDDLGFMLIDLKKLAYQSDPFIMADGYTTQLLPSYSSSSSSSSSSSSYCYYYIMH

SEQ ID NO: 227031 - protein, 185 aa, Glycine max
  Coding DNA Sequence Number=SeqID_110253
MANLDYQSIKKAQTEKTKAKKAKAKANKGKQNEHVEDDLVPPPPISHVASKRKNRGPSQHEAAAKRPKVESVSSSTPSPTEIDPQLSMDFIANFLARSCWMHELWVDEFENDESKKAQVGKAMRQTREEALKAKLTTSKDFFKDLQEEESNLSIFDIDKDVNHEGELVPEVQVEGVIEKPTKPVT

SEQ ID NO: 227032 - protein, 204 aa, Glycine max
  Coding DNA Sequence Number=SeqID_110254
  Homolog annotation: Hit_ID=Q2QLN8; Match level="QueryCoverage=34%, HitCoverage=28%, E-value=8e-10, Identity=46%"; Hit description =Expressed protein
MPVYNTLFWSSYRGICGLSFANKGCLLHIVGHNGVAYGVNTETGELLKEFKITKKSITSLAFSHDEKYLAIVSSRPRDISWEIGEEILKFPNDLGNVEHISISSDAKNLVTSDFDDQHEAAEGVLLHDDLNEPKMGEKLASLSVLDGNKSRSDIEQESYVLAKPPSADFVHVLLKQALNADDRTFLLDCLFTQNEKVLFLSYFY

SEQ ID NO: 227033 - protein, 151 aa, Glycine max
  Coding DNA Sequence Number=SeqID_110255
MSYLEKFKSESERLNATRTKSFQPSYGLTAALHSRQQGKFYGEKNDEMLSETLNLVVETIKEVYMKDEWYQRRAKKRYNSQVKPRNFQASDLVWRKCEEALKDAKKGKLSRRTCYIRVVEVLRNRAYRLEHISEKVIPRTWNASDLKFYYG

SEQ ID NO: 227034 - protein, 110 aa, Glycine max
  Coding DNA Sequence Number=SeqID_110256
MVEPGDCGAIVAHWCRFRLGLVPHSGWLHCFWLVIVAYWSGEQHELECWCWHVVVVYKYDGGVDDALVRRVICEGLCNPDWDNVATLKDATILCSRLKSAIIYRTTNPPD

SEQ ID NO: 227035 - protein, 237 aa, Glycine max
  Coding DNA Sequence Number=SeqID_110257
  Homolog annotation: Hit_ID=Q1S5H0; Match level="QueryCoverage=40%, HitCoverage=19%, E-value=5e-32, Identity=69%"; Hit description=Plant protein family, putative
  Pfam annotation: Domain name=Mago-bind; Domain location=43-69; Score =32.4; E_value=1.6e-06; Accession=PF09282.1; Description=Mago binding
MLCRYNLKSLIHTIVGVGKQVHTPNSISKLHQLQRSSKSLKEGERLVGPMRRPDETLCKPIRIRAGYTPQDEVTIYQPKGALLKKEMGSVGPPGYEPDADSKPKTKSVKRNERKKEKRIQAALEKEKNVSEVEDSGKQESLEALTSQISDMVAIAKIMKATLVFPTLDHDSFWTNSSDFKQIFDWKNFTEVLKDDVQIVESLSPEFATIKPVLKAPAGYNAGEVLQLLKKHKVIKFT

SEQ ID NO: 227036 - protein, 315 aa, Glycine max
  Coding DNA Sequence Number=SeqID_110258
  Homolog annotation: Hit_ID=P0AFZ1; Match level="QueryCoverage=81%, HitCoverage=100%, E-value=1e-80, Identity=59%"; Hit description =Protein sseB
  Pfam annotation: Domain name=SseB; Domain location=58-314; Score =464.7; E_value=1.1e-136; Accession=PF07179.2; Description=SseB protein
  Subcellular localization annotation: CTP_CleavageSite=71; ConfidenceScore=5.58e-01
MQRAPAARRRSSHGSSATISRAGCTLTALRPIAKTRSISGLPVRLALALQPAVFFGSLSLMSNRLEEVLKLAATEPAHRPEFFQLLLEADVWVPGESPAEQFDATSPVELQHWEKEGGGSVIPFFTSEAAMSEAIQGEQPYLRLPTRTLFEMTLGETLFLNPKLPAGKEFSPGEIAHLLGEEGSALSQQTVLEGGHALLLSEVAEPPAQMIDSLTQLFAKYKQVRRAYVASIRERADEQANLLIGIEADSDIDAIIQAAGSVATDTLPDDAPIDICEVVSNEQGVSHFFTAHITPFYERRWGSFLRDFKGSQRII

SEQ ID NO: 227037 - protein, 66 aa, Glycine max
  Coding DNA Sequence Number=SeqID_110259
  Homolog annotation: Hit_ID=Q8W2C0; Match level="QueryCoverage=74%, HitCoverage=4%, E-value=3e-07, Identity=57%"; Hit description =Functional candidate resistance protein KR1
MLQDRLNELAMLSIENKKTLKTDTVPKFELFNRGQLEGWKTLQLVGFRGVQDFKFFQELSRIVDCR

SEQ ID NO: 227038 - protein, 100 aa, Glycine max
  Coding DNA Sequence Number=SeqID_110260
  Homolog annotation: Hit_ID=Q1RU49; Match level="QueryCoverage=61%, HitCoverage=7%, E-value=3e-07, Identity=48%"; Hit description =Polynucleotidyl transferase, Ribonuclease H fold
MEGAIRETREEANVDVEVISPFAQLDIPLIGQYVEDMKEGGKPKFHYVTIIKRTGFQKMTKEDALSLDNIEGGVCAEYTNVGVYGRRNSGSNKEAFEMGE

SEQ ID NO: 227039 - protein, 65 aa, Glycine max
  Coding DNA Sequence Number=SeqID_110261
  Subcellular localization annotation: CTP_CleavageSite=46; ConfidenceScore=5.68e-01
MTKEVIHSHNSAVPWVHFSFSSSSSSSFFSGFRLLGKLTSASYLVRAKGIGSPEPAGAHLGEWLA

SEQ ID NO: 227040 - protein, 290 aa, Glycine max
  Coding DNA Sequence Number=SeqID_110262
  Homolog annotation: Hit_ID=Q2QVB3; Match level="QueryCoverage=53%, HitCoverage=36%, E-value=6e-30, Identity=43%"; Hit description =Expressed protein
  Subcellular localization annotation: CTP_CleavageSite=56; ConfidenceScore=5.42e-01
MQNPNHNDDDDLLTLSLSCNRPKRARNSPPSNPPPQTMHTQMQIPFPNPMFVPYPSASNHNSMQQEEYRFNVRVNALAPAVSRRRSRRRRHRSQSEKSETVPPPFPWATDRRATVHSRKYLLENNIVSITGILECKRCKNEFEMVLDLESKFSELWNFIRREKESMHDRAPEAWMNPVLPQCQHCGKENSAQPFLAGTKKRAINWLFLLLGQMIGCCTLDHLKYFLKHSNIHRTGSKDHLLYSTYIGLCNQLVPEWLYRFWIDGPLLIYMLDNLPLANLAGNKQSVRKRR

SEQ ID NO: 227041 - protein, 71 aa, Glycine max
  Coding DNA Sequence Number=SeqID_110263
MVPKGDIVSQVVCDGHIKFAGNQRRSWKNMKLGVTKDQADVLMMPKDHMRLKALFKTKQLKIFKMDDQDSL

SEQ ID NO: 227042 - protein, 83 aa, Glycine max
  Coding DNA Sequence Number=SeqID_110264
MSGFTSDSPQISASLHQLDLAPYASEPYNAQWNAPRLLRDKHTLRSSRILGEMEVDEPWLGLWLPLNYQVVFIIGSAVDRLCG

SEQ ID NO: 227043 - protein, 245 aa, Glycine max
  Coding DNA Sequence Number=SeqID_110265
  Homolog annotation: Hit_ID=Q2QVB3; Match level="QueryCoverage=61%, HitCoverage=35%, E-value=4e-28, Identity=44%"; Hit description =Expressed protein
MQSPNPNDDDDDLFTLSLSWNPTRASNLPTLIMQPQPQNPFINPRLAPYTASNHNNMNAGVDHVQANAHVPSSLSRSRRRDGRSETIPPPFPWATNRRATVQTRKYLLENKILKIRGDMECRMCKRKYVMILDLESKFSELWSFIQKEKESMHDRAPNVWLKPVLPRCYHCGQKNSVQPSLAETKKKAINWLFLLLGQMLGCCTLNHLKYFLKHTNRHRTGAKDRNLYSTYMGLCQQLVPECFSS

SEQ ID NO: 227044 - protein, 338 aa, Glycine max
  Coding DNA Sequence Number=SeqID_110266
  Gene Ontology: Mol. function=hydrolase activity; Cellular component =cytoplasm; Biological process=metabolic process
  Homolog annotation: Hit_ID=Q9LUG8; Match level="QueryCoverage=72%, HitCoverage=100%, E-value=1e-64, Identity=52%"; Hit description =Similarity to endo-1
  Pfam annotation: Domain name=DLH; Domain location=121-337; Score =60.7; E_value=4.7e-15; Accession=PF01738.9; Description=Dienelactone hydrolase family
MANGFTEGTEVLTMVMHGGSSVATGVDFSQQWVPPRGPLLCLAHAEIAAICVVSVGFTAATRPLSSVLLKATSVSTNYPWLQLVTHQQHILAMSSPQCFENPPNLNSDIHGAGTVQELGGLNSYVTGSSDSKLALILVSDVFGNKPISNFLSFNLKLADKVAAAGFLVVVPDLLYGDYIVDLNNPQFDRESWRKAHGKDKACEDTKPLISALKSKGVKSVGAAGFCWGGVVVVKLAISTDIQAAVILHPGLIADNEFNEVRIPIAILGAEIDHLFPPERLKQIEEMLSVKAEFESFVKLYPGVSHGWTLRYNDDDEATVKSAKEAHQDMLNWFIKHVK

SEQ ID NO: 227045 - protein, 69 aa, Glycine max
  Coding DNA Sequence Number=SeqID_110267
MWDLGTPPHTHSGSEEVPGTKPIGLQGVRQPMWDLKTPPHARNGNKVPGTESDSDIMLHFILKPIDIKH

SEQ ID NO: 227046 - protein, 223 aa, Glycine max
  Coding DNA Sequence Number=SeqID_110268
RKHQNSSPKTNESAVAVLNKSKQKYKHLNDVIAKPSKQDPETIKRESNPALHGGDDEEAPAHDGGSRGGGDRNPAGGSDDRDPCQVLDPQFVKKHLHTSFSDITDLASKAMEDMNAFQLQLNYAPALAEPEEEEEEEEEEEEENEEEEEEEEGEEEEEEEARSMVNELAQLDNMLVVIRSLKGTLETIKVDVQAIKERVKCLQSFLQIYLKTATASSSSSHSM

SEQ ID NO: 227047 - protein, 1310 aa, Glycine max
  Coding DNA Sequence Number=SeqID_110269
MTKVAQQKGSDPLLWAVQMYSNLNSAGESLPSLQLAEFLVSYICWDNNVPILWKFLEKALTLQIVPPMLLLALLSVRVIPCRHVQPAAYRLYLELVKRHAFELKSQINRPDYQKVMKSIDAVLHLSNIFGMPQSEPGILVVEFIFSIVWQLLDASLDDEGLLEFTPDKKSRWATLYHDMELDRHDNYSEQRTEHHEKLQNANTLMAVEMIGQFLQDKISSRLLYLARQNLPAHWLSFTQRLQLLGANSLALRKSRTLSPEALLQLTSDSCMVLSRECKTNSQKKFQTVMSSEYLSSSASLCHGASHSALWIPLDLVLEDSMDGYQVSATSAIETISGLIKTLRAINGTSWHDTFLGLWLATLRLVQRERDPIDGPMPHLETRLCMLLCIIPLVVGDLIEEEEERTPVDEKDNGPTGFWKEKKVAGKCRDDLVSSLQVLGDYQSLLTPPQPVLAAANQAAAKAMLFVSGITIGSAYFDCLNMTEMPVDCSGNMRHLIVEACIARNLLDTSAYLWPGYVNGRINQIPQCMPAQVPGWSSFMKGTPLTSVMVNALVSSPATSLAELEKIFEIAIEGSEDEKISAAAILCGASLICGWNIQEHTVHFILRLLSPPVPAENTEGNNYLINYAPILNVLFVGIASVDCVQIFSLHGLVPQLACSLMPICEVFGSCVPNISWTLTSGEEISAHAVFSNAFILLLKLWRFNRPPLEYGIGDVPTVGSQLTPEYLLLVRNSHLMSAGNIHKDRNRRRLSEIASLSSPNSVFVDSFPKLKVWYRQHQACIASTLSGLVHGTPFHQIVEGLLNMMFRKINRGSQTTITSGSSSSSGPANEDASIGPKLPAWDILEAIPFVVDAALTACAHGRLSPRELATGLKDLADFLPASLATIISYFSAEVTRGVWKPVFMNGTDWPSPAANLLNVEGQIRKILAATGVDVPSLASGDSCPATLPLPLAAFTSLTITYKVDKASERFLNLAGQTLESLAAGCPWPCMPIVASLWTLKAKRWSDFLIFSASRTVFLHNSDAAVQLLKSCFTATLGMNSSPISSSGGVGALLGHGFKYHLCGGLCPVAPGILYLRAYGSIRDVVFLTEEIVSILMHSVREIVCSGLPRDRLEKLKANKDGIKYGQVSLAASMTRVKLAAALGASLVWISGGLMLVQLLIKETLPSWFISVQRLDQEEKSGGMVAMLGGYALAYFAVLCGAFAWGVDSSSSASKRRPKVLGTHMEFLASALDGKISLGCDSATWRAYVSGFVSLMVGCTPNWVLEVDVHVLKRLSNGLRQLNEEELALALLGVGGVGTMDAAAELIIDTEI

SEQ ID NO: 227048 - protein, 309 aa, Glycine max
  Coding DNA Sequence Number=SeqID_110270
  Gene Ontology: Mol. function=RNA-directed DNA polymerase activity; Biological process=RNA-dependent DNA replication
AKQVDEARKETKYFQWYLAIPKFYELASSLKLPLETPFIYDHAEVLNCEIMKTYLIYLGILIGANHRKASTWELIVQKFESNLSRWKQRSLSIGGRIPTCVVNELVHLQCEFLWRGEEGRRKIAWGNEDGGYIVVIIAFGNKCYVLNIAKGRARKRHMTNGPTKIYVGGWVMEGKSNFGSNHGWKNYKLEDRYGRVFMNLNQKDEVIKVMRSWVDGASLVADGQDSLVWKLALSGCYSVKDTYLFLIGNTNPVDPLFNRSFWKLVIPHNVAIFVWKLSKDRLPIRKNLQSTWHGGANTPFPIRANEAAN

SEQ ID NO: 227049 - protein, 198 aa, Glycine max
  Coding DNA Sequence Number=SeqID_110271
  Gene Ontology: Mol. function=heat shock protein binding; Cellular component=integral to membrane; Biological process=protein folding
  Homolog annotation: Hit_ID=Q1SQA8; Match level="QueryCoverage=91%, HitCoverage=67%, E-value=3e-25, Identity=35%"; Hit description=Heat shock protein DnaJ, N-terminal
  Pfam annotation: Domain name=DnaJ; Domain location=140-198; Score =20.9; E_value=4.1e-05; Accession=PF00226.21; Description=DnaJ domain
MPRPVTGPVFTTLVSWKEDVDEDGPSPSLGPSWFRKQYSPKGSGRHRNDNQRSKHQFRRNHEFCKDDFDVETVFRSAFGGNRSFYWSFINEENPQWRKSGGFSNHGKSWNWRRWSENGYNGTSTESDCSQSDLISDRLALGMSASGPLKLEDVKNAYRICALKWHPDRHDGSFKVIAEEKFKHCSAAYQSLCDKLALD

SEQ ID NO: 227050 - protein, 182 aa, Glycine max
  Coding DNA Sequence Number=SeqID_110272
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=91%, HitCoverage=11%, E-value=4e-39, Identity=47%"; Hit description=Chromo
MAFQVLLTGQFFLKLSKCTFTQRQVEYLGHLVSQNGVQPVPTKVEAIQQWPTPRSTWALRGFLGLLGFYQRFIKANDKFHWSLDAQKAFDTLKEAICQALVLWLPDFSLPFVVEIDASGVGMDTILSQQNHPIAFFSKPFCPKLLHSSTYVRELTTITSIMKKWRQYCWTSGLRYLKKGGLN

SEQ ID NO: 227051 - protein, 204 aa, Glycine max
  Coding DNA Sequence Number=SeqID_110273
MAESTCSKSNMERIEEAIAKLAFNHLHVTSKLDELIQRVLALEARFSSSQYEDPIGILFKLTQCGSVADYLSQFESFTNRIVGLPTPFLLSCFISGLALDIRHEVQAVHPLTLTHATALARLQEEKLANHHCAFRRRFVANPPSSFPTTTPLALLPPPAKPPPLPLKRLSPEEMVVRPKKGFALIAMRSSLGDTSVPPSSSFSP

SEQ ID NO: 227052 - protein, 64 aa, Glycine max
  Coding DNA Sequence Number=SeqID_110274
MAFKALQSMQNRHDQSLFLTNNTEEEKGLVLGVTVGSHIDKLRIRELDGMIGATRWRQGSWSLK

SEQ ID NO: 227053 - protein, 135 aa, Glycine max
  Coding DNA Sequence Number=SeqID_110275
MADRMCLRANRILPCQHPLLGLVTQNLSGIVAWSPPSLAFDSCLLGVILLVVLLMKNPNRAIRGGALERTRDVTIANGERLRNYVEEGEALTDSSECRPWGSSDLSAPISLCRSHMVGAFFAKQCDPDWSPYDFT

SEQ ID NO: 227054 - protein, 327 aa, Glycine max
  Coding DNA Sequence Number=SeqID_110276
  Homolog annotation: Hit_ID=Q67U54; Match level="QueryCoverage=82%, HitCoverage=85%, E-value=2e-85, Identity=56%"; Hit description=Plant viral-response family protein-like
  Pfam annotation: Domain name=DUF716; Domain location=111-266; Score =189.6; E_value=7.7e-54; Accession=PF04819.3; Description=Family of unknown function (DUF716)
MGTLVGHVAPGMGFMLIGLWHLFNHIKLHALNPTSYTSPPWFPTSKHKYLELLLIMLGSAASISMELFIGPNRHQPLDPDLTIPSNHLHNFEHSSISLAFLLYAAFALVLDRLPSPAKRALTQLLGSIAFAQQLLLFHLHSADHHGPEGQYHLLLQLLILISLSTTLLGIPFPKSFLVSFVRSLSIFFQGLWLVLMGYMLWTPGLIPKGCFINEEEGHQVVRCSDHDSLHRAISLVNILFSWFIIGVTVFGVACYLGLVKFYGEKVDYVALRDEEISDDVESQKRSILGNPTSFIRVGKNFLPLDIESGCVYSGINGNSILAWWGPL

SEQ ID NO: 227055 - protein, 139 aa, Glycine max
  Coding DNA Sequence Number=SeqID_110277
NLLGAGFVVAAFEGPAPPEEEDKKKTSSWYAGFTTLLLVSSSLCTFAAGASSIFWDYKLARITTFLKLMGIEEEEGWIEEEKGIMDIESGFFLFEILRLLESFESRLSGYDNDHALSTGFALSLCWPLSELMCWVCLVC

SEQ ID NO: 227056 - protein, 285 aa, Glycine max
  Coding DNA Sequence Number=SeqID_110278
  Gene Ontology: Mol. function=1-acylglycerol-3-phosphate O -acyltransferase activity; Cellular component=integral to membrane; Biological process=phospholipid biosynthetic process
  Homolog annotation: Hit_ID=O80437; Match level="QueryCoverage=98%, HitCoverage=56%, E-value=1e-132, Identity=82%"; Hit description =Glycerol-3-phosphate acyltransferase 6
  Pfam annotation: Domain name=Acyltransferase; Domain location=72-191; Score=35.1; E_value=2.4e-07; Accession=PF01553.11; Description =Acyltransferase
MVPRIKCEPLPRNKLLSPIIFHEGRLVQRPTPLVALLTFLWMPIGIILSILRVYLNIPLPERLAWYNYKLLGIRVIRKGTPPPPPKKGQSGVLFVCNHRTVLDPVVTAVALGRKISCVTYSISKFTEIISPIKAVALSREREKDAANIKKLLEEGDLVICPEGTTCREQFLLRFSALFAELTDRIVPVAINTKQSVFYGTSVRGHKLLDPYFVFMNPMPTYEITFLNQLPTELTCMGGKSAIEVANYIQRVLAGTLGFECTNLTRKDKYAILAGTDGTVPSMKSA

SEQ ID NO: 227057 - protein, 83 aa, Glycine max
  Coding DNA Sequence Number=SeqID_110279
MEEDEGECLLQPLSPIFLCFSHSNNLAGLWLLLLTSASLGALSARRDNVLAGQAGCTLSAQIFDLSSSRVFHPLSELVALLSE

SEQ ID NO: 227058 - protein, 143 aa, Glycine max
  Coding DNA Sequence Number=SeqID_110280
SAKVDVSLSEFNALSECHPLSEASTRLADRRNLEGNLSRRHVLSTSSACSARRLSPSRLNASLALSENLLTRVKRKNCAKRNVKVSEPFLKPGIAERKERALNSCERTLNSRKSLKSEINRGKEQSKKPSFDLLGRLNLIEQD

SEQ ID NO: 227059 - protein, 52 aa, Glycine max
  Coding DNA Sequence Number=SeqID_110281
MVVAVTKARCDGYGGDSGDGGRMMELIVAAAAAVVVEWCDTGGGGVGVVMVV

SEQ ID NO: 227060 - protein, 134 aa, Glycine max
  Coding DNA Sequence Number=SeqID_110282
MEVMEKKKATKLEGGGGGCGGNAGRDRGFNMASSSSSNYYYDVTSGPLEDGLLWMKKNHISQHIWNCVNERMLKIRRTTLIIEKHRPTKQRFHSANETEEERFYREEGSVKLATTSGRAWQTTTSSPCPNSPIT

SEQ ID NO: 227061 - protein, 82 aa, Glycine max
  Coding DNA Sequence Number=SeqID_110283
MDCHKGAWCYIEDLNAIFGAHENRGGSTPSTSSIIDFRVWSNSCNLYHIPTKGAPFTWYNRRQSTTSILRRGWINRFAMMHS

SEQ ID NO: 227062 - protein, 130 aa, Glycine max
  Coding DNA Sequence Number=SeqID_110284
MLRTTEKVCYTPDFNEKPIMFLNQTTVGVGGGGGNKKRVTGTWTFRFQKDPKFSPVRFLQQLGAKVASAIRVVSMRRRSSRKVSSSSLVRTRSVSDPTDSHRAKAVEDCIEFLHSSSSRERPSSVSESSL

SEQ ID NO: 227063 - protein, 242 aa, Glycine max
  Coding DNA Sequence Number=SeqID_110285
MDRARLVYGLVTKMDMDVGSFIYGQISQMAQSNSSKLGFHALITALCIARGVVPDSLTFESLSPAINLSYIRKNYWNPDDPMITFSGTHKTKARGPDTYAPSFSAPTAPAPTPTLAPALVPPPAPTTTSDTSMQTPYSFHDQAQQRPIMSVKAFMAQVVWPGVQLSSSGGEAEGEAEEMPEDTPVATPIEATEEGDGAIDADYVADMATAQSTWDPWPTPALDTSLPVQHAPSSPHDDPTPA

SEQ ID NO: 227064 - protein, 401 aa, Glycine max
  Coding DNA Sequence Number=SeqID_110286
  Gene Ontology: Mol. function=transferase activity; Biological process= biosynthetic process
  Homolog annotation: Hit_ID=Q07A02; Match level="QueryCoverage=99%, HitCoverage=83%, E-value=0.0, Identity=79%"; Hit description =Sulfoquinovosyldiacylglycerol synthase type 2
  Pfam annotation: Domain name=Glycos_transf_1; Domain location=185 -348; Score=106.7; E_value=6.7e-29; Accession=PF00534.10; Description= Glycosyl transferases group 1
MTIAEDSLLQVVEEEEGPPDFALLDPEDNSRPRRIALFVEPSPFAYVSGYKNRFQNFIKYLREMGDEVPLSLALSPRIISAVAEFKPDIIHASSPGIMVFGALIIAKLLSVPIVKKVGDTFQDTPLAGWCNPCEFLHRAADLTLVPSAAIAKDLEEARVTAANKICLWNKGVDSESFHPRFKSHEMRLRLSNGEPEKPLIVHVGRLGVEKSLDFLKSLMDRLPEARIAFIGDGPYREELEKMFEGMPAVFTGMLGGEELSQAYASGDVFVMPSESETLGLVVLEAMSSGIPVVGARAGGVPDIIPEDQDGKIGYLYTPGDLEDCLSKLKPLLDDKELRETMGEAARLEMEKYDWRAATQKIRNENYNAAIWFWRKKRAQLLRPFQWLAQRIFQSPDPEANT

SEQ ID NO: 227065 - protein, 55 aa, Glycine max
  Coding DNA Sequence Number=SeqID_110287
MQVASVGSDAVGYVVFAELQRDSLNDFLYLNQNDVEIMNFDWFQSVFIKDLNYKN

SEQ ID NO: 227066 - protein, 132 aa, Glycine max
  Coding DNA Sequence Number=SeqID_110288
  Subcellular localization annotation: CTP_CleavageSite=61; ConfidenceScore=5.10e-01
MTFSDFNLKLKISAGKGSRKDASNLYHEIARTSLGASPSAHPLPKPRFLNRNNNTPTTLVRESMPCTIALYAHDCYDFELGSPTEASHERPLVPVLVDDGFVRNVMEPLALGEVDGRVSGGDRVGLEIQIGV

SEQ ID NO: 227067 - protein, 474 aa, Glycine max
  Coding DNA Sequence Number=SeqID_110289
  Gene Ontology: Mol. function=transferase activity; Cellular component= nucleus; Biological process=regulation of transcription, DNA-dependent
  Homolog annotation: Hit_ID=Q9LFB5; Match level="QueryCoverage=99%, HitCoverage=98%, E-value=1e-178, Identity=67%"; Hit description =Anthranilate N-benzoyltransferase-like protein
  Pfam annotation: Domain name=Transferase; Domain location=4-467; Score=374.4; E_value=1.8e-109; Accession=PF02458.6; Description =Transferase family
MPSSSTTIVSKCVIHPDQKSNMKPLRLSVSDLPMLSCHYIQKGVLLTAPPSSFEDMILSFKHSLSIALSHFPALAGRLETDSHGYVNIVCNDAGVDFIHAKAKHLTLNAVVSPSLVDVHPCFKEEFFAYDMTISYAGHNTPLAAVQVTELADGVFVGCTVNHSVTDGTSFWHFFNTFAAVTKGGSAKKLLRAPDFTRETVFNSAAVLPVPSGGPTVTFDANEPLRERVFHFSREAIQKLKQRANNTVNNKELTEVMGKHVNDGWKVVNGNGNGNCNGMINGNGRNEISSFQSLSAQLWRAVTRARKFNDPAKTSTFRMAVNCRHRLEPKMDAFYFGNAIQSIPTVATVGDILSRDLRFCADLLHRNVVAHDDATVRRGIEDWESAPRLFPLGNFDGAMITMGSSPRFPMYENDFGWGRPVAIRSGKANKFDGKISAFPGREGNGSVDLEVVLAPATMAGLENDMEFMQYVTQFV

SEQ ID NO: 227068 - protein, 115 aa, Glycine max
  Coding DNA Sequence Number=SeqID_110290
MLQGQPTLGINQPLPKEGGMRLHKRAKVKTRWRNDQGHVCLLATKPNSQPSTFFTLVTHFEPKYLFLLMNPEPKRKIITTLDFREKEIKCLRILQDSKFGVSNLYPPRENQVQYL

SEQ ID NO: 227069 - protein, 114 aa, Glycine max
  Coding DNA Sequence Number=SeqID_110291
MELVMDPSHENLLYKRSFWGWRLGSMSHGHEIVESALDTRELKITSAWGRLTLEGHLRGTLLDYWYEVKSYIRTHWYKSPQFYPSYAQQLVRDGWVERGQGAPEKPSEGWAIRG

SEQ ID NO: 227070 - protein, 274 aa, Glycine max
  Coding DNA Sequence Number=SeqID_110292
  Gene Ontology: Mol. function=DNA binding; Biological process=DNA integration
  Homolog annotation: Hit_ID=Q1S3H4; Match level="QueryCoverage=72%, HitCoverage=49%, E-value=2e-39, Identity=43%"; Hit description =Integrase, catalytic region
MGIVYALEKFSSYLVGSKIVVYTDHSTIRFLITKADSKPRQPSFTFGEEVTIHKRELHKEFSDEKMMALRTLVDKFHWFTAMANFKAIRKAPLDLKSYERKNFFQEANRYVWDDLHIFKIGVDNLLRSLVSIGQLCSKTLMHLLKGATSAKEPKTSLGDINVITIYVGVDYVSKWVLAVATPTNDAKTTIKFFMKNIFARKAEVFNREIKRILEKTALAFPNGVWKGMPPPGAVGTPSLLGSQEKTMAYHDKKILKSSSQDNKCYSTTLDLDYF

SEQ ID NO: 227071 - protein, 188 aa, Glycine max
  Coding DNA Sequence Number=SeqID_110293
  Gene Ontology: Mol. function=transferase activity; Biological process= glutamine metabolic process
  Homolog annotation: Hit_ID=Q1SPM3; Match level="QueryCoverage=54%, HitCoverage=42%, E-value=7e-31, Identity=65%"; Hit description=SNO glutamine amidotransferase; CobB/CobQ-like glutamine amidotransferase
MTNIISGQKTGGQYLVGGLDCTVHINFFGSQAELLVPELVSKEGGPESFCGIFIHAPAILEAGPKVQVLADYPVPSSKLLSFDSSIEDQTHVAGSKYLLWLCSFLGNVPRMISSLNEELAYFVSQRALRGRARARLTGALSKGGKMRRFATNEGISISYVEKSGAFAPTYPPLERKSDLRSSFLCVNQ

SEQ ID NO: 227072 - protein, 113 aa, Glycine max
  Coding DNA Sequence Number=SeqID_110294
MNKAIFTRFFHSTPLLERKSRTFGESRCNNYSKRFRKLRAKQTLLHDVNAYAQFMCQGAVIFFIFNCLALNRENELLCKVVVVPLPLQSEMDNGVFLGLQNSIQSLNNGSRGF

SEQ ID NO: 227073 - protein, 66 aa, Glycine max
  Coding DNA Sequence Number=SeqID_110295
MVLKDLVMVVEEDVIGNIFDTHIYFLRIKVAQSKASIAISQRKWIFWMRLILEVDWEVELPNHDEA

SEQ ID NO: 227074 - protein, 59 aa, Glycine max
  Coding DNA Sequence Number=SeqID_110296
MRGFSGSAASPGELLLQPEVTLLAQVSKDKDTNFIPTILLSDRQLAKTKAVKPVKRINV

SEQ ID NO: 227075 - protein, 187 aa, Glycine max
  Coding DNA Sequence Number=SeqID_110297
  Gene Ontology: Cellular component=membrane
  Homolog annotation: Hit_ID=Q6K688; Match level="QueryCoverage=94%, HitCoverage=43%, E-value=3e-49, Identity=56%"; Hit description =Putative tumor differentially expressed protein 1
  Pfam annotation: Domain name=Serinc; Domain location=1-186; Score= -102.9; E_value=2.3e-11; Accession=PF03348.6; Description=Serine incorporator (Serinc)
IISFGQGYYQQVNGSLLPAAVVSLYCAYVCYTGLSSEPHDYECNGLNKSRAVSTGTLVLGMLTTVLSVLYSALRAGSSTTFLSPPSSPRLGGSKPLLEEAEEGKAKKEEKEARPVSYSYSFFHLIFALASMYSAMLLSGWTSTSESSDLIDVGWTSVWVRIGTEWVTAGLYIWSLLAPLLFPDREFV

SEQ ID NO: 227076 - protein, 97 aa, Glycine max
  Coding DNA Sequence Number=SeqID_110298
  Gene Ontology: Cellular component=membrane
  Homolog annotation: Hit_ID=Q10IH0; Match level="QueryCoverage=88%, HitCoverage=23%, E-value=8e-27, Identity=61%"; Hit description=TMS membrane family protein, putative, expressed
MVHWIGGTSDTNTTEWYQAQAVLRVSLGNFLFFGILALIMIGVKDQNDRRDSWHHGGWTAKIVIWLLLVVLAFFLPDAIILVYDSGFGEEALMNSLA

SEQ ID NO: 227077 - protein, 149 aa, Glycine max
  Coding DNA Sequence Number=SeqID_110299
  Homolog annotation: Hit_ID=Q6K688; Match level="QueryCoverage=33%, HitCoverage=12%, E-value=2e-08, Identity=54%"; Hit description =Putative tumor differentially expressed protein 1
MQNTWEFLQEGCSNFSEDPRNDERDTEETTVTDSSGFLGDARCSGGAETTDNSSSLHFLSPFTVLIELTGTASVHSLLVSFDNFPSSFKETLVAFLSTPKHFIIPQQKLIFSRSNFLFFYFILLPAFFLYSKNEGEREKLYAMKKLNVR

SEQ ID NO: 227078 - protein, 218 aa, Glycine max
  Coding DNA Sequence Number=SeqID_110300
MAPKKLLSKRARKHPAREGSSAAPQADIEFDGHCFRSEEHQHRFEAIKSWSFLKERRHDHLDTDLDGIASSNILHSNHNSNLPLPKCQLFYVILTQGSHLQDTQWTQKSPTEHWIFGLDHRSLPVLWGTITGAGPTAAASHRCTIATSTTATIPRVHLSSHVEDGTLSDPNPYAWPTPEQLEATVAWLGDRPNFQAVAGPRRAPRDEDGAFEDDDMAD

SEQ ID NO: 227079 - protein, 58 aa, Glycine max
  Coding DNA Sequence Number=SeqID_110301
MRHKKEDQKRVGGARGEAKCSQQLVAATLQEDHGGSPERCTSNLENHLNKPYNCSLEN

SEQ ID NO: 227080 - protein, 219 aa, Glycine max
  Coding DNA Sequence Number=SeqID_110302
  Homolog annotation: Hit_ID=Q67XQ0; Match level="QueryCoverage=88%, HitCoverage=88%, E-value=5e-23, Identity=51%"; Hit description=MRNA, complete cds, clone: RAFL25-31-I24
  Pfam annotation: Domain name=DUF21; Domain location=34-196; Score= -61.3; E_value=0.025; Accession=PF01595.10; Description=Domain of unknown function DUF21
SERTTMNVVSALMVTRNQLGAPEGIPFGSVWLFVYAGISFSLVIFAGIMSGLTLGLMSLGLVDLEILQSSSVILPVVQKQHQLLVTLLLCNAAAMEIVPSDMPLYDILNEFQKGSSHMAAVVRARKQNEMSENVVANIDKFSRPPSINKSTGLQRSDSRTNGSFSDNIEDEVIGVITLEDVFEELLQEEIVDETDEYVDVHKSTGSINPKIDCPKGSCK

SEQ ID NO: 227081 - protein, 76 aa, Glycine max
  Coding DNA Sequence Number=SeqID_110303
MKLWISDFPFRCCTMVVCGTIDSAILIRGFCNDEWYVVQWDQSLKLVQWWTMTLLEDIGEQGGGWHKVVWRINTHY

SEQ ID NO: 227082 - protein, 619 aa, Glycine max
  Coding DNA Sequence Number=SeqID_110304
  Gene Ontology: Mol. function=protein serine/threonine kinase activity; Cellular component=membrane; Biological process=protein amino acid phosphorylation
  Homolog annotation: Hit_ID=O04086; Match level="QueryCoverage=99%, HitCoverage=95%, E-value=0.0, Identity=63%"; Hit description=Ser/Thr protein kinase isolog; 46094-44217
  Pfam annotation: Domain name=Pkinase; Domain location=278-569; Score =129.0; E_value=1.3e-35; Accession=PF00069.15; Description=Protein kinase domain
  Pfam annotation: Domain name=Pkinase_Tyr; Domain location=278-569; Score=70.3; E_value=6.2e-18; Accession=PF07714.7; Description =Protein tyrosine kinase
  Pfam module annotation: Pfam domain module=Pkinase::Pkinase_Tyr; Domain location=278-569::278-569
MDLNYVLRIPWNTSACHNFQQTLAAKNGTDANTCCISLLSLFGIGLAQHLKETSQFQLPNLATSLSCIQDFQLKLSSLSLPSNLADTCFDPLQFVISPNICAGIQTIPDWTKKLGQSTPLNTACKSDLTDISLCDVCLQAGLQAKQVLISIDGNASHSIDCFYFAILYAAGVVNEFGPESNGAVSCIFSISVYSQGGSGGKGHQALVFGLTGAGIALLVMSSFLGIYAWYDRKHRRKKLETFQFDFDPEEQGSRPRLRPNTGSIWFKIEELEKATDNFSSKNFIGRGGFGMVFKGTLSDGTVVGVKRILESDFQGDAEFCNEVEIISNLKHRNLVPLRGCCVAEENENYDERGSQRYLVYDYMPNGNLEDHLFLSTDSQKAKGSLTWPQRKSIILDVAKGLAYLHYGVKPAIFHRDIKATNILLDADMRARVADFGLAKQSREGQSHLTTRVAGTHGYLAPEYALYGQLTEKSDVYSFGVVALEIMCGRKALDLSSSGSPRAFLITDWAWSLVKAGKIEEALDAFLVKDENFPSSNPKSIMERFLLVGILCSHVMVALRPTIADALKMLEGDIEVPQIPDRPMPLGHPSFYNNNNNDGSTFSISPALSGPKLQTGDMLR

SEQ ID NO: 227083 - protein, 196 aa, Glycine max
  Coding DNA Sequence Number=SeqID_110305
GYQGSAWRRGQKLGQIKETIDAVLAYHYSKENPIIVVLDDAYDTFDLRCEKSSVRIVYCTPALYVWYGRSIRLVGSPDGKKEGPECCAQLKDSQTKDKELRGSSNGVIDSYHKWLKARMQGIIWLPKLKGPSGEEVEAPEESEEVQALKIELERMRVVKEKLKIVVTRVKKKCNKLRDVNMTMAEAATTWRKCKSR

SEQ ID NO: 227084 - protein, 51 aa, Glycine max
  Coding DNA Sequence Number=SeqID_110306
MGSVNFRIRVQELFTHGEGNEGVGGYATRPGKLLLQPEVTLLAQASWLLHP

SEQ ID NO: 227085 - protein, 145 aa, Glycine max
  Coding DNA Sequence Number=SeqID_110307
  Gene Ontology: Mol. function=nutrient reservoir activity
  Homolog annotation: Hit_ID=Q2HSU3; Match level="QueryCoverage=86%, HitCoverage=26%, E-value=9e-52, Identity=77%"; Hit description=Cupin region
  Pfam annotation: Domain name=Cupin_1; Domain location=1-107; Score =25.6; E_value=2.7e-06; Accession=PF00190.13; Description=Cupin
MAPHVNPRAKEYGIGLKGSGRIQIVFPNGSNAIYMDAHIKEGDVFFIPRYFAFCQIASKNEPLEFFGFTTSAQKNRPQFLVGATSLMRTMVGPELAAAFGVSEETMRRMARAQHEAVILPTPWTAHAHDHKVVVDRVQKLTKNEM

SEQ ID NO: 227086 - protein, 228 aa, Glycine max
  Coding DNA Sequence Number=SeqID_110308
  Gene Ontology: Mol. function=nutrient reservoir activity
  Homolog annotation: Hit_ID=Q2HSU3; Match level="QueryCoverage=97%, HitCoverage=50%, E-value=8e-63, Identity=56%"; Hit description=Cupin region
MPVIYNIQGEAKLGFIYKAKLAERHLKMGDVYQIPAEEAQKLHIICSIDPSESLGVDVFQSFYIEGGAHPASLLSGFESEILETAFNVRIRRRVAKNLHWATRGPNCVRGGSHATTIWTKFLQLKEEDKLYHLREIVQQEEGKEEEEFVDEEEQQTSWSWRKILESVFEDEVKNTREKVTKTSPLSCNLYDRKPDFKNCYGWSVDQDGSEYSPLKSSGVGIYHVNLSA

SEQ ID NO: 227087 - protein, 92 aa, Glycine max
  Coding DNA Sequence Number=SeqID_110309
  Gene Ontology: Mol. function=nucleic acid binding
  Homolog annotation: Hit_ID=Q1SDG1; Match level="QueryCoverage=90%, HitCoverage=8%, E-value=6e-11, Identity=35%"; Hit description =Integrase, catalytic region; Zinc finger, CCHC-type
MASTSTRVFISEGASTNKPPSFDKRNYYYCKEKIKFFMESQDMDMWQIDQEGPYIPTKRNTEGILQDKPKVEWSPNDNRSEYDKVVGCGTTK

SEQ ID NO: 227088 - protein, 128 aa, Glycine max
  Coding DNA Sequence Number=SeqID_110310
  Gene Ontology: Mol. function=DNA binding; Biological process=DNA integration
MFNGLGAISFTIPLQDPFQPQQPQEVPLRRSIIEKRSAIPNDYNIFLQEHEDDVGLTEEDPINFGQAMHSSNSKNWIDAMKDEMKSMQDNGIWDLIELPKDVKPIGLLNRYLKPRRMQRIISRDIRLI

SEQ ID NO: 227089 - protein, 37 aa, Glycine max
  Coding DNA Sequence Number=SeqID_110311
MGTYTPIPITNQSPAHHKLSVRKKVIKLLVAESKKHF

SEQ ID NO: 227090 - protein, 108 aa, Glycine max
  Coding DNA Sequence Number=SeqID_110312
MFGWIKGGEIGIAGVEGKLLFSKGEWKVTLVHMWHVKWPFSESTTLTHTVALKALCGQFQKGGIDSLLTHNKSNFQFSTPSKVQLCSILYPMLVLCLNMPSYRIRSCY

SEQ ID NO: 227091 - protein, 1171 aa, Glycine max
  Coding DNA Sequence Number=SeqID_110313
  Gene Ontology: Mol. function=carbamoyl-phosphate synthase activity; Cellular component=cytoplasm; Biological process=pyrimidine nucleotide biosynthetic process
  Homolog annotation: Hit_ID=Q8L6J9; Match level="QueryCoverage=92%, HitCoverage=90%, E-value=0.0, Identity=84%"; Hit description =Putative carbamoyl phosphate synthase large subunit
  Pfam annotation: Domain name=ATP-grasp; Domain location=755-930; Score=-81.1; E_value=0.041; Accession=PF02222.12; Description=ATP -grasp domain
  Pfam annotation: Domain name=ATP-grasp_2; Domain location=199-348; Score=-137.7; E_value=0.079; Accession=PF08442.1; Description=ATP -grasp domain
  Pfam annotation: Domain name=CPSase_L_D2; Domain location=197-433; Score=453.2; E_value=3.4e-133; Accession=PF02786.7; Description =Carbamoyl-phosphate synthase L chain, ATP binding domain
  Pfam annotation: Domain name=CPSase_L_D2; Domain location=755-972; Score=98.0; E_value=2.7e-26; Accession=PF02786.7; Description =Carbamoyl-phosphate synthase L chain, ATP binding domain
  Pfam annotation: Domain name=CPSase_L_D3; Domain location=493-616; Score=234.2; E_value=2.9e-67; Accession=PF02787.9; Description =Carbamoyl-phosphate synthetase large chain, oligomerisation domain
  Pfam annotation: Domain name=CPSase_L_chain; Domain location=626-753; Score=78.3; E_value=2.4e-20; Accession=PF00289.12; Description =Carbamoyl-phosphate synthase L chain, N-terminal domain
  Pfam annotation: Domain name=CPSase_L_chain; Domain location=75-195; Score=201.0; E_value=2.9e-57; Accession=PF00289.12; Description =Carbamoyl-phosphate synthase L chain, N-terminal domain
  Pfam annotation: Domain name=Dala_Dala_lig_C; Domain location=197 -398; Score=-96.8; E_value=0.0023; Accession=PF07478.3; Description=D- ala D-ala ligase C-terminus
  Pfam annotation: Domain name=MGS; Domain location=1039-1126; Score =109.4; E_value=1.1e-29; Accession=PF02142.12; Description=MGS-like domain
  Pfam module annotation: Pfam domain module=ATP-grasp::ATP-grasp _2::CPSase_L_D2::CPSase_L_D2::CPSase_L_D3::CPSase_L_chain::CPSase_L _chain::Dala_Dala_lig_C::MGS; Domain location=755-930::199-348::197 -433::755-972::493-616:...
  Pfam module annotation: Domain location=:626-753::75-195::197 -398::1039-1126
  Subcellular localization annotation: CTP_CleavageSite=56; ConfidenceScore=5.62e-01
MAMAYCISQLPKLPLLPSLPHSRSSKTLPSLNHAVPPTLLRACPPPTTRLNPARVRCSAVAVAEPPAPKLGKRTDIKKILILGAGPIVIGQACEFDYSGTQACKALREEGYEVVLINSNPATIMTDPETADRTYITPMTPDLVERVLESERPDALLPTMGGQTALNLAVALSESGALEKYGVELIGAKLDAIKKAEDRELFKQAMKNIGIKTPPSGIGTTLDECLSIANDIGEYPLIVRPAFTLGGTGGGIAYNREDLLEICKAGIAASLTNQVLIEKSLLGWKEYELEVMRDLADNVVIICSIENIDPMGVHTGDSITVAPAQTLTDKEYQRLRDYSIAIIREIGVECGGSNVQFAVNPDNGEVMVIEMNPRVSRSSALASKATGFPIAKMAAKLSVGYSLDQIPNDITKKTPASFEPSIDYVVTKIPRFAFEKFPGSKPILTTQMKSVGEAMAVGRTFQESFQKAVRSLEYGYPGWGCSQVKELNYDLEQLKYSLRVPNPERIHAIYAAMKRGMQIDEIFELSYIDKWFLTQLKELVDVESFLLSHNLSDLTNIDFYEVKRRGFSDKQIAFATKSTEKEVRNRRLSLGVTPAYKRVDTCAAEFEANTPYMYSSYDFECESAPTTRKKVLILGGGPNRIGQGIEFDYCCCHASFALQDAGYETIMVNSNPETVSTDYDTSDRLYFEPLTVEDVLNIIDLERPDGIIVQFGGQTPLKLSLPLQQYLDEHKPACASGVGHVRIWGTSPDSIDIAEDRERFNVMLHELKIEHPKGGIARSETDALAIAADIGYPVVVRPSYVLGGRAMEIVYSDNKLVTYLENAVEVDPERPVLIDKYLSDACEIDVDALADSQGNVVIGGIMEHIEQAGIHSGDSACSIPTRTVPASCLETIRSWTVNLAKQLNVCGLMNCQYAITPSGDVFLLEANPRASRTVPFVSKAIGHPLAKYASLVMSGKTLYDLQFTKEVIPKYVSVKEAVLPFSKFPGCDVFLSPEMRSTGEVMGIDPSYNIAFAKAQIAAGQKLPLSGTVFLSLNDLTKPHLEKIAKAFVENGFKIAATSGTAHVLNLAKIPAERVLKLHEGRPHAGDMIANGDIQLMVVTSSDDALDRIDGLALRRMALDYKVPIVTTVNGALATAEAINSLKANSIKMIALQDFIDAYREIVQVARFGSGR

SEQ ID NO: 227092 - protein, 124 aa, Glycine max
  Coding DNA Sequence Number=SeqID_110314
  Gene Ontology: Mol. function=cysteine protease inhibitor activity; Biological process=defense response
  Homolog annotation: Hit_ID=Q2HUA2; Match level="QueryCoverage=79%, HitCoverage=83%, E-value=2e-16, Identity=48%"; Hit description =Proteinase inhibitor I25, cystatin
  Pfam annotation: Domain name=Cystatin; Domain location=27-117; Score =18.4; E_value=0.0039; Accession=PF00031.11; Description=Cystatin domain
MKLECLVVLAFVLFASAVARKEIDPKGWIPIVKINDPALIEIAKFSVTAFNEWAGLTFKLQKLLKAEMQGQVVNGIYFRLIVAAGDDQSSSNNYQAIVWNLPWTENYMNLISFIPVHDAPPSYY

SEQ ID NO: 227093 - protein, 87 aa, Glycine max
  Coding DNA Sequence Number=SeqID_110315
MPDGDVGFTLATALVVATSTALASIIFFMLIMASIIAVICSFMASYVGLHLLLHLLYFTYYSCSSIGSDMGLNQFKFSTWFMTSSSR

SEQ ID NO: 227094 - protein, 131 aa, Glycine max
  Coding DNA Sequence Number=SeqID_110316
DDVNMILYKRFVVGGGGVVVIVGGGCVVIVGGGCVVVVALNLVMGVFLVANMNGLVEYTSSWEIARIVLKLHGVELVLMGLASTSSTFNVSALSLFDANGESDLRANPSQEGENDEDMTKSKGKDPLEGLG

SEQ ID NO: 227095 - protein, 128 aa, Glycine max
  Coding DNA Sequence Number=SeqID_110317
  Subcellular localization annotation: CTP_CleavageSite=19; ConfidenceScore=5.18e-01
MGHIGHNLLSQRALRGRARARLSGALSKGGKMRGVATNVDKSGALAPTYPPSKRKSDLRSSFLKRALKNLHTMSLEELVGTLKVHEQELQQDEGIKKGKSLALNAQKVKKVPSFKECLNHHPKGRPKH

SEQ ID NO: 227096 - protein, 83 aa, Glycine max
  Coding DNA Sequence Number=SeqID_110318
MACKFVTSILQSFLYLYPFFIRSTHTYAKERKTPSSITFITILNLGKKLYAKRVKQKGNSPPTVVTIATCFDAFEEDDKNGEE

SEQ ID NO: 227097 - protein, 124 aa, Glycine max
  Coding DNA Sequence Number=SeqID_110319
MDEIIDYVMQVYEDLKSKREKWERAIQAKLIAKIAKEKTTKVTQVKPSNEATSLQKKDHNAVVVFLSNSSNTKDVDPISYVAPNVDALSKYKVQAMVTLAMRKQREETKELVTQAIMKQREETK

SEQ ID NO: 227098 - protein, 208 aa, Glycine max
  Coding DNA Sequence Number=SeqID_110320
  Gene Ontology: Mol. function=nucleic acid binding; Cellular component= proton-transporting two-sector ATPase complex; Biological process=ATP synthesis coupled proton transport
  Homolog annotation: Hit_ID=Q2VCH8; Match level="QueryCoverage=93%, HitCoverage=88%, E-value=4e-77, Identity=72%"; Hit description=RNA binding protein-like protein
  Pfam annotation: Domain name=RRM_1; Domain location=53-124; Score =68.0; E_value=3.1e-17; Accession=PF00076.12; Description=RNA recognition motif. (a.k.a. RRM, R
MGKKAKKAMNNLKRASFNNKPSEGADFLPLEGGPARKLAASQQKPPENTATVLYVGRIPHGFYEKEMEGYFGQFGTIKRLRIARNKKSGKSRHFGFIEFESPEVAKIVADTMHNYLLFEHLLQVYVIPPEHVHPRIWRGFNYHYKPLDSVQIERKRHDKERTLKEHQKLVDKVLKHDQKRRKRIEAAGIDYECPEIVRLLLLSICIFS

SEQ ID NO: 227099 - protein, 184 aa, Glycine max
  Coding DNA Sequence Number=SeqID_110321
MSVVELEDDKFGLEGHIEPEFTKESGLPNGKLGSFSEDEDEVLHNQSQEEDDEEEAETVPPITTGVVLEGARHHTSLQLSYLLISKSIHNLIENDSSTSVSALIVHIKSTEGYTTTYHKAWLTKQKAIENIYDNYERSYHDLPRLLQAMQQFCSWFGCGEGNTANITTRRSSSREFRDVPSSFF

SEQ ID NO: 227100 - protein, 63 aa, Glycine max
  Coding DNA Sequence Number=SeqID_110322
MVMHSRTNFRHRNWQKQNEEEEEQKEVKMKHVTCMRRKSIEEGNSDDGGTLEAESKNEREVEE

SEQ ID NO: 227101 - protein, 92 aa, Glycine max
  Coding DNA Sequence Number=SeqID_110323
  Gene Ontology: Mol. function=structural molecule activity; Cellular component=protein complex; Biological process=microtubule-based movement
  Homolog annotation: Hit_ID=UPI00004C0F4B; Match level="QueryCoverage =58%, HitCoverage=16%, E-value=1e-11, Identity=59%"; Hit description =UPI00004C0F4B related cluster
LLAASSLFAVEELMVGAAVDFVDDDGFEIDKDDAQDVLVESGFTKEGVEGIMGYIQGGRVDGRLFYIGCVATTDAECEFSTSILRMKPMLNE

SEQ ID NO: 227102 - protein, 422 aa, Glycine max
  Coding DNA Sequence Number=SeqID_110324
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9LT02; Match level="QueryCoverage=70%, HitCoverage=26%, E-value=1e-122, Identity=75%"; Hit description =Putative cation-transporting ATPase
  Pfam annotation: Domain name=E1-E2_ATPase; Domain location=2-231; Score=-82.5; E_value=0.00011; Accession=PF00122.10; Description=E1 -E2 ATPase
MAKSRLKTLTELRRVRVDSQILMVHRYGKWVKLSGTELLPEDVVSIGRSSGQNGEEKSVPADMLLLAGSVIVNEAILTGESTPQWKETLSARQDKNHVLFGGTKILQHTPDKSFPLKTPDGGCLVVILRTGFETSQGKLMRTILFSTERVTANSWESGFFILFLVVFALIAAGYVLVKGLEDPTRSKYKLILSCSLIVTSVIPPELPMELSIAANTSLIALAWRGIFCTEPFRIPFAGKCWDPSLIRETGTLTSDDMEFSGIVGLNGTTDLESDTSKVPLRTVEILASCHALVFVENKLAYVAPVEFAGSGLLAIAFVSLSSPDQGIRRLAYGTLDKFKNAVEKVPAGKVQLENLMRLIEEPWQRIPSVIALFAAEASCVLLDPAHDHYAAIRMNSDDDVAIYIRNSILEKLMSFYVSPLSD

SEQ ID NO: 227103 - protein, 88 aa, Glycine max
  Coding DNA Sequence Number=SeqID_110325
MDELKDLIKQVAPRGIPPYGVDETQMVIRTLIRKTLTDQVDPPIYFVISKLLLAPPSSTYNILSNQFIRIFRKGLLFPIDRQTRGLYL

SEQ ID NO: 227104 - protein, 84 aa, Glycine max
  Coding DNA Sequence Number=SeqID_110326
MAGDSAAHGGNVGVVEGEVADKKVVEDDIAGLAFQNLFIFLKFSFFSLGSWLLVVGWTSPFPMANTLPNGQVFEEYHYFLNLIS

SEQ ID NO: 227105 - protein, 534 aa, Glycine max
  Coding DNA Sequence Number=SeqID_110327
  Homolog annotation: Hit_ID=Q69QZ3; Match level="QueryCoverage=96%, HitCoverage=80%, E-value=1e-133, Identity=47%"; Hit description =Neurochondrin protein-like
  Pfam annotation: Domain name=Neurochondrin; Domain location=1-534; Score=390.6; E_value=2.3e-114; Accession=PF05536.2; Description =Neurochondrin
MSPANLEEECLKLLKGERDEQRLAGLLLVTKFCKAEDQSSVRRVYDAVGPHFLYRLLRTGMASGGGGLNDNRNAYLSLSITVLATFCRVPDIASSEDMLFYIPLVLEVISTGSVLSVLEECYEFLYLVSAASESGIARFFESGGIKILASQMRSLHDGSHLMELSFKLLQLILGRTSSDIIQNNDLSEISVIVAAIARQFAVLHNSLKFEALHLLNAILSSKDSSQLRDAFRLLPQDSWSPNIRIGIMAILQNRVAPAERLQALILAESMVSMYGEDWLIGQVSTNDALDPAPADMCLLLVLEQSRVEIAVLLNELAYLKYEAPQDTSATAEAIFSKRHNVAVAYSLVERIIKLISNVEGNDGNLLDEGTLTKLIHQLNETIAVVLEYLEDAKEHGQKKGDDLLASVRIIGSYLAEAPVACKEKVQDLLGYMLSLEGEDEQRPFYAVCFLLPMLSQITMEIEGCKALASCKGLEAVLDCFSKLVGSHAFLVEDNGCIFMACDTIMNLLLKKDKVQIKLDVSAIVDLLKVLAHWS

SEQ ID NO: 227106 - protein, 97 aa, Glycine max
  Coding DNA Sequence Number=SeqID_110328
  Gene Ontology: Mol. function=transporter activity; Cellular component= membrane; Biological process=oligopeptide transport
  Homolog annotation: Hit_ID=Q9FRU4; Match level="QueryCoverage=98%, HitCoverage=19%, E-value=5e-16, Identity=47%"; Hit description =Putative nitrate transporter NRT1-3
MAKVIVAAARKWKVHIPSYTKELYELDLEEYAERGRVRIDSTPTLRGWMLSHVTHVEETKQMLRMIPILVATLIPSAMVAHIGTFFVKTLSSSSTTP

SEQ ID NO: 227107 - protein, 144 aa, Glycine max
  Coding DNA Sequence Number=SeqID_110329
MDMNLGFLISALITALCKARGVTSDSMTFESLSLAINLAYIKQNCWNLDDPLVTFQGTCKSRARRSEAPSTSTPPTSAPSTSAPSTYPLPPPPTAPILPEPASGQAPNHVESAGYGPPTASYEHQGFSTEGGLARSPAFTFGRG

SEQ ID NO: 227108 - protein, 228 aa, Glycine max
  Coding DNA Sequence Number=SeqID_110330
MDRARSKGVISDSLAFERLSPIINLAYIRKNCWNPDDPTVIIRGTRRPRARPAKVPATSAAPPPSRMTAAPSTLPPTDFQRFEAMLRSIHQGHIILLQRLQLVAPLDSIPTVEQFNEWVAWLGTQPPFHREDEDPATQVPHQSEDESSESSTPEPLIRKRRSLEATPELPAPVANTTSPQQAVDPSTPEDQTTPVLSPNTSPIATPVLHLSEEEEGQTLDTQDQSQDI

SEQ ID NO: 227109 - protein, 277 aa, Glycine max
  Coding DNA Sequence Number=SeqID_110331
  Homolog annotation: Hit_ID=Q1SDX7; Match level="QueryCoverage=94%, HitCoverage=43%, E-value=3e-15, Identity=21%"; Hit description =Cyclin-like F-box
MGGKSEKGEVMEWSAANTKAFIEKICERVKNGQLQGSTFKTTTWEEINKDLFEMIQNNYARTGVTWEMESNKVNAPDDVWDKLIKKGRHYKNFKKHGFEYDYDILGDIFNSSTTTGKLSHASTQEPPNSDEERAMEGDFLTKGIHINVFDDEKDIKGLRHKRKEIFSSGERYRKEGKTSNKEMLDKIVSIWSYSMSQRTTTSRAREERYKGKTSQATSPISDPYSAKAYMELLNNMQNVPTSVYFKLMEKFTSKHWRQMFIVMDAERRKQLIESLTE

SEQ ID NO: 227110 - protein, 73 aa, Glycine max
  Coding DNA Sequence Number=SeqID_110332
  Gene Ontology: Mol. function=RNA-directed DNA polymerase activity; Biological process=RNA-dependent DNA replication
MNWCTCQSINIKKNDKWVVMPFGLKNVGDTYQRAMNLIFHEFDQDLIDLEMNPEKCAFGIMTDHFLSFLVHRK

SEQ ID NO: 227111 - protein, 285 aa, Glycine max
  Coding DNA Sequence Number=SeqID_110333
  Gene Ontology: Mol. function=transposase activity; Cellular component= membrane; Biological process=transposition, DNA-mediated
  Homolog annotation: Hit_ID=Q1SUE7; Match level="QueryCoverage=88%, HitCoverage=83%, E-value=4e-66, Identity=48%"; Hit description =Transposase, IS4
MYTIEFLVGHETRCYENFRMKKDVFLNFCETLKEVGNLCDGKKISIEEAVAMFLIIICHNLRHRVVAEQFQHSLHTVSKWFRIILKVVCKLVKIALVPLMEHMYLLGLLASKQTAFRGRKVLVTQNILVVCDFDMFFTFVYSGWEGTENDSRVFLDALSPENNFPKPNRDQFYLVDSGFPNMPGYLVPFRRNIYHLCDFREGCGRPRGKEELFNYIHSSLRNVIERCFGVLKARFPILKLMPSYPIRRQRLIPIACCTIHNFIRMQNGVDTLFDQYVEQLVDMDE

SEQ ID NO: 227112 - protein, 64 aa, Glycine max
  Coding DNA Sequence Number=SeqID_110334
MTGSQMIDKQHTFEARQQASVQEALSVMDWQSKGYKIRNFSTFSSKDEKSTMEHVSHKGVRGSI

SEQ ID NO: 227113 - protein, 81 aa, Glycine max
  Coding DNA Sequence Number=SeqID_110335
MRLPGKESLLMGSPITINEILDVSISFLNDHLEETLGPTKIEEIHSKCINLAQGKVYGESGFWLKACRLARHDTCQGLVQG

SEQ ID NO: 227114 - protein, 78 aa, Glycine max
  Coding DNA Sequence Number=SeqID_110336
  Subcellular localization annotation: CTP_CleavageSite=19; ConfidenceScore=5.13e-01
MSLANAVHASSTNESGAPRMSLPSAVRQFSILHFFSEPLECHCPALFMCPPPSSLEPRQCHCLALFTNSPFSPFFEAL

SEQ ID NO: 227115 - protein, 149 aa, Glycine max
  Coding DNA Sequence Number=SeqID_110337
MTLELVAHGDTLRLSAPRHSMTPSVIDEQRPMWSSAPFPEMSASSGGDFFKSHKLSRTTGGGPDDTQRQIMVIPHPFSIQTQSCPMARRDKLWSFCTLLSSRGGGPDDTRRQIMVILHPFAIQTLSCPMARRDKLWSFCNPFVIQRRQA

SEQ ID NO: 227116 - protein, 136 aa, Glycine max
  Coding DNA Sequence Number=SeqID_110338
RCNPSFSRRCNHEDSHYLLSLRNDPDTGDSDKYRLYIKENPPCLVALGRVYEGSTTVHNIPLLHDQVKVGVEEVGDADSPIPIPTELVKLLGQTLNTFLAWSTHLVKHLSKQINRELWDRQNLQIGRIMMSMIPCI

SEQ ID NO: 227117 - protein, 154 aa, Glycine max
  Coding DNA Sequence Number=SeqID_110339
MNCVFVHGSSTHEFGAMRSDCLVQFSILNPFLEPMNCVFVQASSTHEFGAMRSDCLVQFSILNPFSEPMNCVFVHASSTHEFRAMCSDYLVQFSILNPFSEPMNCVFVHASSTHEFGAMRSDWLVQFSILNPFSDPHELRFRSCVLHPRVWSHV

SEQ ID NO: 227118 - protein, 111 aa, Glycine max
  Coding DNA Sequence Number=SeqID_110340
LSSLVTDAWGAIPSPFPQINVGGDSARIPFLEHAPASHASPSRRRVGCDKEKLLAYKGVGMSPPPLGISQSLKNSLISLKDENLAPCSALCSLKFTLFRPLMAIQHTLAPP

SEQ ID NO: 227119 - protein, 89 aa, Glycine max
  Coding DNA Sequence Number=SeqID_110341
  Subcellular localization annotation: CTP_CleavageSite=48; ConfidenceScore=5.14e-01
MPLQAPSSAGPSDFLFAPQMLHSMMQSLHRGQSIIMKSHQGLGLPSIMSMEEFKAQVAWPGDHPSSSGGGGTSVAQEPDTEEPPAPAPA

SEQ ID NO: 227120 - protein, 70 aa, Glycine max
  Coding DNA Sequence Number=SeqID_110342
  Subcellular localization annotation: CTP_CleavageSite=30; ConfidenceScore=5.06e-01
DRTHKTPSGPGEVQQGPGVSSFGYGPLSVLQGARPPQQGYTIVTNVVICTFPGDVSVFRPRLRKSLICYM

SEQ ID NO: 227121 - protein, 93 aa, Glycine max
  Coding DNA Sequence Number=SeqID_110343
  Gene Ontology: Mol. function=N-acetyltransferase activity; Biological process=metabolic process
  Homolog annotation: Hit_ID=Q0LYA4; Match level="QueryCoverage=97%, HitCoverage=61%, E-value=1e-12, Identity=52%"; Hit description=GCN5 -related N-acetyltransferase
MAIGQCLRKRQGIMLLKYPEAGWTLIPEVRGKGYASEALAAVLLWGDQTFSSPVCCIIDEENIPSNYLAERFGFQFQGYVNYRGKRVRMLVRP

SEQ ID NO: 227122 - protein, 149 aa, Glycine max
  Coding DNA Sequence Number=SeqID_110344
  Gene Ontology: Mol. function=peroxidase activity
  Homolog annotation: Hit_ID=Q1BRF7; Match level="QueryCoverage=99%, HitCoverage=100%, E-value=3e-47, Identity=62%"; Hit description =Alkylhydroperoxidase AhpD core
  Pfam annotation: Domain name=CMD; Domain location=11-95; Score=67.5; E_value=4.2e-17; Accession=PF02627.10; Description=Carboxymuconolacto ne decarboxylase family
MKRPNWFQVSAEGGKALGALHNYAITGTSLPADLIHLIFLRVSQINGCAHCIDIHARDLIKSGMSVEKIVLVPVWRESTYLFSDIEQAALSWAEEVTRVSETHASDEAYSAALSVFGEKDLVELTIVIATMNAINRMGISFRMKPLAKA

SEQ ID NO: 227123 - protein, 44 aa, Glycine max
  Coding DNA Sequence Number=SeqID_110345
  Gene Ontology: Mol. function=DNA binding; Cellular component=nucleus; Biological process=regulation of transcription, DNA-dependent
  Homolog annotation: Hit_ID=Q84U53; Match level="QueryCoverage=99%, HitCoverage=11%, E-value=2e-15, Identity=75%"; Hit description=MYB1
MGRMPCCEKGGLKKGLWTPEEDKKLVAYVEKHGHGNWRSVPDKA

SEQ ID NO: 227124 - protein, 141 aa, Glycine max
  Coding DNA Sequence Number=SeqID_110346
MGEAEEVQERMKADMEAMKEQMATMMEAMMSMEKIMEANAVIVAATSAVAKPWLGYATEGQAVGGISFENTLEGPQFRPQPHPLHFAVGRAPPAMAEKGKADHLKERLRAIEGGEDYAFANLEKLFLIPKHGHSQVQGAGL

SEQ ID NO: 227125 - protein, 160 aa, Glycine max
  Coding DNA Sequence Number=SeqID_110347
  Homolog annotation: Hit_ID=Q6Q6T0; Match level="QueryCoverage=29%, HitCoverage=7%, E-value=6e-14, Identity=80%"; Hit description =Trihelix transcription factor
MEDHQHQHHHHHFGMNDLRQVVNNGPRPAHTTFPSMPPHPTEELFPGHHHRNLTPLPTHHPQQQQHFEVMMFGRDIMPPGLHDFASTPHDSAVATTTITLPTPPVTCGFDAAEGAGCIGGDPFTGRWPRQETLTLLEIRSRLDPKFKEANHKGPLWDEVS

SEQ ID NO: 227126 - protein, 112 aa, Glycine max
  Coding DNA Sequence Number=SeqID_110348
  Homolog annotation: Hit_ID=Q2QXS1; Match level="QueryCoverage=65%, HitCoverage=17%, E-value=2e-13, Identity=45%"; Hit description =Expressed protein
  Subcellular localization annotation: CTP_CleavageSite=40; ConfidenceScore=5.16e-01
MKRESTYALSFLVLLLSSILFFNLVYPFDPQFLSRFAFLSSSYVTLNNSQNSPLTGGCDYSRGRWVWDETYPRQLYGENCPFLDPGFRCRRNGRKNERFRKWRWQPDDCDIP

SEQ ID NO: 227127 - protein, 44 aa, Glycine max
  Coding DNA Sequence Number=SeqID_110349
VFTLVVRRHSSPTMHEILLCWAGTIKFDSVWKHHGYPILSLSRH

SEQ ID NO: 227128 - protein, 144 aa, Glycine max
  Coding DNA Sequence Number=SeqID_110350
MTKNRVLKEHNKTFLNWFKDIIFDDHNAFETLRNFHALLWSHSRNLGDLKKLAYQNELFIMVEQAKHVFYVQHPCDERWSVVLHGKTIGVNIKDDEKYGISKEKWTQFCQSHRKPSWQMFERRHRPFRNKTLPLTCCLVGAMIF

SEQ ID NO: 227129 - protein, 406 aa, Glycine max
  Coding DNA Sequence Number=SeqID_110351
  Homolog annotation: Hit_ID=UPI00006AC6A3; Match level="QueryCoverage =35%, HitCoverage=42%, E-value=2e-25, Identity=43%"; Hit description =putative transcriptional regulator
HVDDGHAAVAGGAGGVQRRVEGRQEDAGHLGLLEDADVGVLLREVHVAVGQEQADVVRVEFFLDAACHVDEERVAHVDDHEAHGVGSSGDEGAGGVVADEAELVDGAQHPVARVRCDDVRVVQHVGDRAECDSGMSGDVGHHRAGAARIGGGGHFRRPFAVRSHLLLEAFQAYYLKRFKCVINAARPFKEERMKLTTAQLWRRGAVTAIAGASALALTACGGGGGSSAGTDSLSVFVNVENTEVPAVLETLAGDVCSAEADTLPLDVETVPQSNLDQQLQLKAGQGDLPVLFSAGNAPALTKTLAESGNVADFDELLTDLDVIDNIEPAAISTIENLYGGFRVLPFEYNVEGIWYNKAIFAEQGIEEPQTFDDLTAAAAKLDAAGIQPFSASGEQGWPITRLIGIL

SEQ ID NO: 227130 - protein, 130 aa, Glycine max
  Coding DNA Sequence Number=SeqID_110352
MSPARYSRARRNLQRFRMRGEQTQSALHAQTRRGARPAAWKAGPVNAGGTETMIMASRLQPFHDIYPISPSRLWPCGTPLRNTVYQNHACRCRQPVRKRRRAYRPSVPVAGGMMQPTEAMGMGEEEFFRK

SEQ ID NO: 227131 - protein, 157 aa, Glycine max; identical to SEQ ID NO: 224972
  Coding DNA Sequence Number=SeqID_110353

SEQ ID NO: 227132 - protein, 79 aa, Glycine max
  Coding DNA Sequence Number=SeqID_110354
SRLEDADISGEGADDDSWPKDADISGKGAEDVDISGKGAGRLRMPTDSQVTIAKSGAVDKSKAFAPTYPQFVMRNSDLR

SEQ ID NO: 227133 - protein, 54 aa, Glycine max
  Coding DNA Sequence Number=SeqID_110355
MCVQLVHRHMSKHLKRFLEWSKCEYHVMGYDSWETAHIVLKFHGIDSMFEFKVA

SEQ ID NO: 227134 - protein, 166 aa, Glycine max
  Coding DNA Sequence Number=SeqID_110356
  Gene Ontology: Mol. function=RNA-directed DNA polymerase activity; Cellular component=signal recognition particle, endoplasmic reticulum targeting; Biological process=RNA-dependent DNA replication
MKVEQLFACHHISEERKVPLATLSFQGYALYWWTSLVRERRIHGDPLVEYWNDLKSALRKRHIPPYYERELMDKLQRLKQGSVSVEEYRQEMELLFLRAGLREEERTSIARFLSGLNMEVRDKFMNYFQLLAKTICRLSEPSAERTLAAKREEESGRKDELDTCAK

SEQ ID NO: 227135 - protein, 125 aa, Glycine max
  Coding DNA Sequence Number=SeqID_110357
MVIAPLVIVANNNEEAQHNNEPMIHNEPIVEEPQELALRRSQRERRPAISNGYVVEARFMMMNNAIFMMSKAQVIDSRLIQDFKIKHQESNPKFKIQEKKSRIQSKIQDSREEIKKQQVKTSYRI

SEQ ID NO: 227136 - protein, 203 aa, Glycine max
  Coding DNA Sequence Number=SeqID_110358
RLSPVINWAYIRKNYWNPEDLTVSIRGARRARARPVELPSTSVIPTLASTSAASSVPTQTDSQRFEAMLQSIHQGQITLLQRSIPSVEQFREMVAWPRTQPSLHKEDEGPTAQVPQHVEDESSEATIPEPFVIGEEAEPPAPVVDLPSPQCTTDPSTPIVQTPEDPTTPDLAMDTSPPATPVLHLTNEKDVQTHDTQDQSQEF

SEQ ID NO: 227137 - protein, 84 aa, Glycine max
  Coding DNA Sequence Number=SeqID_110359
MKQDKEINGADGVNKFQSGEEEEDKEQCSPVSVLDPPLDDDDDGHDDDHEGDGFDLDCSYANVQTFYVVWSSSINMPSYTLLQS

SEQ ID NO: 227138 - protein, 57 aa, Glycine max
  Coding DNA Sequence Number=SeqID_110360
MAYFVGRVERRHYEDTMAEQRALCLLESALMLSRLNLIPEVSGSVVWRRNQLVAPID

SEQ ID NO: 227139 - protein, 187 aa, Glycine max
  Coding DNA Sequence Number=SeqID_110361
  Homolog annotation: Hit_ID=Q8H6Q8; Match level="QueryCoverage=93%, HitCoverage=8%, E-value=5e-12, Identity=33%"; Hit description=CTV.20
MNTCASRVLLKPQKGETTLFITDMMKANVSLPRKIKWDEVTLPERWVMDKATPSIPRPAPTIEHIKQDNSRKVEITFNRRNSFSSRIKASRSEYESARSIDKETLRKDFYSPENEPQRRWFFQHYKGTNRNLIQDKFYEFVERVKINVLFFDWFHAYAIRKDIDYPWKQEIIGDPTTNVITNWQVRD

SEQ ID NO: 227140 - protein, 87 aa, Glycine max
  Coding DNA Sequence Number=SeqID_110362
MSEELHHIQSLIATLGLKEQSSKGKGIAVEPENSPPIFVPSSSDYDPKNSTCLTPTKRISCLQTSSDFDSDEHAQYQLSTNKHIKAE

SEQ ID NO: 227141 - protein, 162 aa, Glycine max
  Coding DNA Sequence Number=SeqID_110363
MASKKRKAPATPSQVRYDRSRFTSPEAWERYTEIVVPRKILPERNVVRVRGHLVKFDEDALNTFLKNPMIIEEGETLPVYSRFALLRLDPQELAAKLCIPGRGFELNANGLPLKILRKNLTTIAQTWSMLSFSNLVPTSHTSDITLDMAKLIYGITQRMDMN

SEQ ID NO: 227142 - protein, 80 aa, Glycine max
  Coding DNA Sequence Number=SeqID_110364
MWCYEWKKIETLRVGRLSLNAVGKTNDQSEPRAISRAKLGVEESNLDLLGRIDGDLVLRETRIWATWEYVSSVGGGQQGM

SEQ ID NO: 227143 - protein, 43 aa, Glycine max
  Coding DNA Sequence Number=SeqID_110365
  Homolog annotation: Hit_ID=Q9LU01; Match level="QueryCoverage=81%, HitCoverage=12%, E-value=5e-07, Identity=69%"; Hit description =Arabidopsis thaliana genomic DNA, chromosome 5, TAC clone:K15C23
MIEDPREVERRRLLGIEDLDGPTREDLVDALDEGTDIWLLKTY

SEQ ID NO: 227144 - protein, 99 aa, Glycine max
  Coding DNA Sequence Number=SeqID_110366
  Gene Ontology: Cellular component=chloroplast thylakoid membrane
  Homolog annotation: Hit_ID=Q9LU01; Match level="QueryCoverage=56%, HitCoverage=19%, E-value=2e-11, Identity=60%"; Hit description =Arabidopsis thaliana genomic DNA, chromosome 5, TAC clone:K15C23
MGCSFVMIDKNVKLRTNATDVAAIAFMHRSWGSNLVPSVTVDAVPKKKPSKSLYAKATDTGIDPELAAKKLNIDWDSAAEIEETNADDETEVPSVVVSS

SEQ ID NO: 227145 - protein, 134 aa, Glycine max
  Coding DNA Sequence Number=SeqID_110367
MAGGDVHDTRAYTLADTGAQAAEDEPEGFSSDPRDPSVLTEYVDHVAERLELKLSSHGRKVHSLDRPDVSFIGTSKWRRKRERRHHFKEKMSLEEAHHHRRPWIRAWRKKEMNEGRGREEHEILCSKRALKYEV

SEQ ID NO: 227146 - protein, 61 aa, Glycine max
  Coding DNA Sequence Number=SeqID_110368
MEVKGFNFVKDALEEQEKVNVSTCVNPNDNPDDKKNKKRRDSASSVLCRKIAFGSKTFAIP

SEQ ID NO: 227147 - protein, 145 aa, Glycine max
  Coding DNA Sequence Number=SeqID_110369
MAPPPLAFPRRSCHVERDAQVAATRCPSAYVARDAQGALACCAWQSEDASQIDVLALQKDRVHSAAAVCCNSRKQEGNAIGACGLRLQVERAITRSALLLLHAVLVHCIVLPVVLSLLQACFLDSFGSSLLPLPLWFLLLVTSWL

SEQ ID NO: 227148 - protein, 101 aa, Glycine max
  Coding DNA Sequence Number=SeqID_110370
MWLPPKPWNEKPRGLVGKNTAGTSSEGLCGACSRSKRSLSQRLCETETNMLAIISKYQEELSLATTHEHRVADEYAQVYAEKEARGRVIDSLHQEATMWMD

SEQ ID NO: 227149 - protein, 108 aa, Glycine max
  Coding DNA Sequence Number=SeqID_110371
DRARKTPSGPEEVQQGIGVSNSDYGPLQAQGETPQQHGDGRQQATDAPPPPPKPLSSSTKVGAFTTRGRPAGNQVQSQRVNAVKIFLNAPNGLGWMRELIKEHVFGST

SEQ ID NO: 227150 - protein, 106 aa, Glycine max
  Coding DNA Sequence Number=SeqID_110372
MEEKVKLKISGGLRSTYLKLLCSDTTCWKLAYEASMEAGSLSFNKVLQWRRHPLENKSWKEKLHHQESGLDKKLKEEASMEEENTRERGGGGGGEVWELKEIRERS

SEQ ID NO: 227151 - protein, 91 aa, Glycine max
  Coding DNA Sequence Number=SeqID_110373
MGVQIATRPTWASRRFLQKAIASGGSNPARLGELGGKLLPQFSINRGRSEVEKEIQAEGAFRNISVSDFAKVFDRSSTFFIRSSSFFSLQR

SEQ ID NO: 227152 - protein, 95 aa, Glycine max
  Coding DNA Sequence Number=SeqID_110374
KKELELERMWWSFGRDSLRLWGRIGVSFDSRGEREGLKGGGGGEGEGEGGVWCGVVVVVVEGVVEEDGGSVVEDREGFVTTKVERTESVRRRDQQ

SEQ ID NO: 227153 - protein, 174 aa, Glycine max
  Coding DNA Sequence Number=SeqID_110375
  Homolog annotation: Hit_ID=Q1FBL2; Match level="QueryCoverage=67%, HitCoverage=44%, E-value=3e-07, Identity=42%"; Hit description =Serine/arginine repetitive matrix 2
MQEPFGPALFFSFCHPEAAGLMTCGEPFGPSLFHLLSSRGGGPDDMREPFGPALFHLLSSRGGGPDDMRGTIWSGSFFHLLSSRGGGPDDMREPFGPTLFHLLSSRGGGPDDMREPLCPALFHLLSSRGGGPDDTRRQIMVIRTLLLFVRPMSDKRVETNYGHYVPFVIQEQQV

SEQ ID NO: 227154 - protein, 66 aa, Glycine max
  Coding DNA Sequence Number=SeqID_110376
MEVTSKEPVQQRPKWTILKTKVGGDFRSIHAVSGERMKNKKVEAAGVSLSEAYVLVTSAKRGTQLA

SEQ ID NO: 227155 - protein, 64 aa, Glycine max
  Coding DNA Sequence Number=SeqID_110377
MTPPRSEVGMDRVACKGIVDAILMGVKLVRAKGLKHIWVDSDSKEALDLIEGGCVGDNMFHYLL

SEQ ID NO: 227156 - protein, 60 aa, Glycine max
  Coding DNA Sequence Number=SeqID_110378
MEHIGQFTTKSGEASQNEFHKLQLFPLSLTEYADLGQLDSKANQKEQFVHEKELRAANKG

SEQ ID NO: 227157 - protein, 92 aa, Glycine max
  Coding DNA Sequence Number=SeqID_110379
MRVAEFNMEKKMKTLRSTIDNEGRSKSPNVEVEQYLSHDLKARRQGETLVIQVALALDHAVAKHLLVTTEKSVILDDSDNHALEYKEKKVLL

SEQ ID NO: 227158 - protein, 100 aa, Glycine max
  Coding DNA Sequence Number=SeqID_110380
MECPNCRPSPYVAIISTSVHRGCALVEEVGPFSEDDEEINLNNNNKDDVDEDDNQNLNIEPPSVNDAILPPRVLDRRLQEEWARADKEGPRVLLNLRVDF

SEQ ID NO: 227159 - protein, 328 aa, Glycine max
  Coding DNA Sequence Number=SeqID_110381
MDGHIDMALVKEFYANLYDPEDKSPRQVRVRGKLIKFDTESLNSFLETPVVLEPGEHYTTCTSFCGTRLEPQEFTARLCILGRGFMLNVEGALWKLLRKDLTSLAQTWSVLSYSNLAPSSHTSDLNMDRARLVYGLVMKMEMGLGSLISGQISQMAQSNFSSLAFSTLISALCIVWGVVLDSLTIESLSPAINLAYIQKNCWNPDDPSVTFLGTRKARARGPEASSSSTPSSSTPPAPAPPLLVPSTISVQSSIHDLAQHRSIMSMEAFRAQDLLLRREVTPEATPQTSPATTPLVEVLEDEEDAEDTGYAADLAAAQNTWDPWPTTA

SEQ ID NO: 227160 - protein, 116 aa, Glycine max
  Coding DNA Sequence Number=SeqID_110382
  Subcellular localization annotation: CTP_CleavageSite=26; ConfidenceScore=5.18e-01
MTKDAIHDHNFAAPGIYFLTPSSLLCASSGFSTSSVPLEPSFAWLFFLYRKKEEAARPTHPGELHSLRRVACLMLKIAMNLIFHDYIGKSMEVYIDDVVVKSTDMDQHLANLEHAL

SEQ ID NO: 227161 - protein, 100 aa, Glycine max
  Coding DNA Sequence Number=SeqID_110383
MAAHKKKIEEADEWRRLKKKKQNSEEEEEVETRRGRERDWRKKYASHEAVQDGDFNPFSFSLTFGNSIRAITGKIEESQKIARNTVIAVGRHVSPLRSKG

SEQ ID NO: 227162 - protein, 135 aa, Glycine max
  Coding DNA Sequence Number=SeqID_110384
MDDVATLQHSAQRPQCRSPPGEVLVGLCHPDIGKDRAHKTPSGPGGVQQGPGVSNSGYGPLSVLQGARFPQQGIAPARHPVDPKKFNKVLWFPALITGLCQFYGVPIAPNKVIRPLLTGLSSRSTAPPGRRSGIL

SEQ ID NO: 227163 - protein, 276 aa, Glycine max
  Coding DNA Sequence Number=SeqID_110385
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=8e-34, Identity=31%"; Hit description= UPI00006A17C9 related cluster
MSSPSEDYTSSASEDYTSSPSEGYTPSPFEDYVSSPSDGYTPSPSEDYTSSPSEDCASSPLEDCTSSPLEDYTSSPSEGYTASPLEDYASSPSEGYTPSPSKDCTSSSLKGCTFSPSKDYTSSPSEDYTSSPSGDYTSSPSEDCTSSSSEDCMSSPSKDYASLPSEGYRPSPSEDYASSPSEGFRPSPSEDYTPSALEDYTSSPSEDCTSLSLEDYTSSPSKGCTRSPSEGYTPSPSKDWMSSSSKGCLPSPSKDWTSSSSKGCLPSPSEDYTSSP

SEQ ID NO: 227164 - protein, 365 aa, Glycine max
  Coding DNA Sequence Number=SeqID_110386
  Gene Ontology: Mol. function=sugar porter activity; Cellular component=integral to membrane; Biological process=carbohydrate transport
  Homolog annotation: Hit_ID=Q1SRU5; Match level="QueryCoverage=100%, HitCoverage=70%, E-value=1e-149, Identity=72%"; Hit description =Sugar transporter superfamily
  Pfam annotation: Domain name=MFS_1; Domain location=44-346; Score =10.5; E_value=0.00011; Accession=PF07690.6; Description=Major Facilitator Superfamily
  Pfam annotation: Domain name=Sugar_tr; Domain location=29-365; Score =196.5; E_value=6.2e-56; Accession=PF00083.14; Description=Sugar (and other) transporter
  Pfam module annotation: Pfam domain module=MFS_1::Sugar_tr; Domain location=44-346::29-365
MAGGGFSDAGTLKRAHLYQYKITGYFIYSCIVGALGGSLFGYDLGVSGGVTSMDDFLIEFFPKVYEKKHAHLVETDYCKYDDQTLTLFTSSLYFAALVSTFGASSVTKNKGRKASILAGSVSFFIGAILNAAARNISMLIIGRILLGVGIGFGNQAVPLYLSEMAPSKVRGAVNQLFQLTTCLGILIANLVNYGTEKLHPWGWRLSLGLATFPAVLMFIGGLFCPETPNSLVEQGRFDEGRAVLEKVRGTPNVDAEFDDLIEASREAKSIKNPFQNLLLRKNRPQLIIGAVAIPAFQQLTGNNSILFYAPVIFQTLGFGSGASLYSSVITSVALVVATLISMAFVDRFGRRAFFLEAGAEMIICM

SEQ ID NO: 227165 - protein, 103 aa, Glycine max
  Coding DNA Sequence Number=SeqID_110387
  Homolog annotation: Hit_ID=Q0PJC1; Match level="QueryCoverage=40%, HitCoverage=41%, E-value=2e-08, Identity=71%"; Hit description=MYB transcription factor MYB122
MVRTLSCDKSGMRNMKLIAYVTRYCKMWEKLYIEMDELSKAALACVIAKWILVGNKKAGEAVPIWSQRITLDSTFYGHDKWIILVCGVDELDGCNHKCTLSRS

SEQ ID NO: 227166 - protein, 99 aa, Glycine max
  Coding DNA Sequence Number=SeqID_110388
VGVEEVRDAYAPILVPTKEGAVGPAKPADRPDHDVDDHLYLMTLTIPQLFLKSLQVMWDATVFGVFNDNFPLYIKHEDVSEIAHGGQCLNISILQLWVL

SEQ ID NO: 227167 - protein, 149 aa, Glycine max
  Coding DNA Sequence Number=SeqID_110389
MEMVSFEVALLRSKLRGSESMMEISPRGGDVGGGDGHSRRGDDLHLDGGLNTNPAHDSDIAEQGGVIVVGDLVTMVVAWRSISEKSLMVSIVNEIILGLRWWEAIVGSNINMVVSVDGDFTEEEDRKGWLVTRAFIFRRRASSLEIVEA

SEQ ID NO: 227168 - protein, 241 aa, Glycine max
  Coding DNA Sequence Number=SeqID_110390
  Gene Ontology: Mol. function=DNA topoisomerase (ATP-hydrolyzing) activity; Cellular component=chromosome; Biological process =regulation of transcription, DNA-dependent
  Homolog annotation: Hit_ID=UPI000051A418; Match level="QueryCoverage =85%, HitCoverage=18%, E-value=2e-31, Identity=33%"; Hit description =PREDICTED: similar to CG12753-PA, isoform A
MLRSLWRSIDRFSVQHFQYVINELRKIKVVDEHNRELVMNLLQSVVEIVTYGDRQDPHIFEYELWWKFRSSVVLVLWMRCFMERQVLADFVRILKISQESKIDGPLLQYLSIMIQNMDSEHAIFYCFSNGYMNNIILHPYKFDGGDLAPYYVSFLRAISNKINKDTLCLLVNVQGDAVVSFPLYTEALRFAQHEEKMIQTAIRALVLNIYNGTQVVLNYGANCPTLKQENGRSKTKRWGYS

SEQ ID NO: 227169 - protein, 91 aa, Glycine max
  Coding DNA Sequence Number=SeqID_110391
MVVFASIVAGKLNSSKRKIRKRREGLRRRVTSKLCKESLEKVVVICGMILEWKAVNETVERCLDGKLYRKDKNSPYRMADGIVGKQKKYGR

SEQ ID NO: 227170 - protein, 145 aa, Glycine max
  Coding DNA Sequence Number=SeqID_110392
  Subcellular localization annotation: CTP_CleavageSite=38; ConfidenceScore=5.28e-01
MGDNGQRLGSSRGATLSPEAQPKQISNVPSRAKNRTCLAGRVAQRIGMWGCIDFLMEVRWMALNRLAMGDPNHGVTSQNGAGWQRTTAVTGKVVIQKRSSEKKKGPSEQWVTGKVTTASGDWKSCWERRKRLLEDGQSRKVHQGQ

SEQ ID NO: 227171 - protein, 65 aa, Glycine max
  Coding DNA Sequence Number=SeqID_110393
MVYTHDIFILKPCKNVNEYYQRHISAETLFSPGKNDMMCYILEWWLDRRMNELVSDLNSRGVTLS

SEQ ID NO: 227172 - protein, 284 aa, Glycine max
  Coding DNA Sequence Number=SeqID_110394
  Gene Ontology: Mol. function=structural molecule activity; Cellular component=Arp2/3 protein complex; Biological process=regulation of actin filament polymerization
  Homolog annotation: Hit_ID=Q01CA0; Match level="QueryCoverage=56%, HitCoverage=50%, E-value=5e-29, Identity=43%"; Hit description=[Z] KOG2826 Actin-related protein Arp2/3 complex
  Pfam annotation: Domain name=P34-Arc; Domain location=50-252; Score= -2.5; E_value=4e-10; Accession=PF04045.5; Description=Arp23 complex, 34 kD subunit p34-Arc
MKVVGEEATTWACGKRLGQKQKGLFFSSFKVAEVKPLQGARLPWLDPDSSHSVHDFKMQHNNVNVAFPCRFTTVMSAIDNIEQKHAFLVKVASIREVVLGAPLRVILEHLAARTVAPDLDPLVALVHRPNESFFLFPQADKVTVVYPMRFNDSIDIVLATSFLQEFVEARRTAGLNNTPPCSWSLTPPLELKEVPAANAGFVTFVIFPRHVEGQKLDRTVWNLSTFHAYVSYHVKRGTGGKCWERVYGDVEFVNIDLNTFKDVYVGIMEIGDELEKLMLILLYT

SEQ ID NO: 227173 - protein, 124 aa, Glycine max
  Coding DNA Sequence Number=SeqID_110395
  Homolog annotation: Hit_ID=Q0KIN0; Match level="QueryCoverage=64%, HitCoverage=4%, E-value=2e-10, Identity=57%"; Hit description =Integrase core domain containing protein
MVLVLVRGAVVDFGSSGVRVELALLTAQFSSSFSHRVYYLTVYLDDNAITGSDDHQGIAQVKHICHHFHTKDLGSCLILEDRSGTIHKWYFDFPNEVCDGHPRGNRIDVCLILLCIKFGAIYTA

SEQ ID NO: 227174 - protein, 852 aa, Glycine max
  Coding DNA Sequence Number=SeqID_110396
  Gene Ontology: Mol. function=protein binding; Biological process =protein metabolic process
  Homolog annotation: Hit_ID=Q6ER93; Match level="QueryCoverage=99%, HitCoverage=99%, E-value=1e-133, Identity=35%"; Hit description=Heat shock protein-related-like
  Subcellular localization annotation: CTP_CleavageSite=81; ConfidenceScore=5.06e-01
MRTGSCAVQQGLTPEAASIVKQAVTLAKRRGHAQVTPLHVANTMLSITNGLLRTACLQSHSHPLQCKALELCFNVALNRLPASTSSSPMLQGSHHHHSHACPSISNALVAAFKRAQAHQRRGSVENQQQPLLAVKIKLEQLIISILDDPSVSRVMREAGFSSTQVKSNVEQAVSLEICSQDNGSGKNNNNSNKAKENNSSGEKGSVLDPIRVEDVASVIENLGSERKRSVVIVGECVTSLEGVVRGVMEKVDKGDVGDECTLRGVKFISLSLSSFGNVSRVEVEQKVGELRSLVKASEHSKGARGSQGGGCYCPVDHMVVEIGKLVNGVEENGARFWVMGVATFQAYMRCKNGQPSLETLWGLHPITIPAGSLRLSLITDSGVQNQPTNEKADNRTTWLLLEGVGDDHKQQPCFAEPSTKNETTEVRSLQSSSTCNSDSSSTLPAWLQQYKNENKGITHNDQNCVPVGELCKKWNSMCSSIQKQPYPSDKTLSLSSVSPSSSNSNFSYEQQHPNLLQTHHEWQVGEPPKDSLNNYHFWISNNGTNNNTNEPTLRVYIPENNNKQPFSSPNPSSNPNSTSSSDIMEVEHVREFKELNTENLKTLCNALEKKVPWQKDIIPEIASTLLQCRSGMVRRKGKVMRNSEEVKEETWLFFQGVDVEAKEKIARELARLVFGSQNDVVSIALSTFASTRADSTEDYSRNKRSREETSCSYIERFAEAMACNPHRVFLVEDIEQADYCSQLGFKRAIERGRVADSKGEEVALCDAIIILSCESFSSRSRACSPSVKQKPLTEEEKNGGDMVATLEVTSPCVSLDLNISIDDENEVEDKSVDEIGLLESVDKKVIFNFQEL

SEQ ID NO: 227175 - protein, 171 aa, Glycine max
  Coding DNA Sequence Number=SeqID_110397
  Homolog annotation: Hit_ID=Q1S5P6; Match level="QueryCoverage=55%, HitCoverage=17%, E-value=2e-11, Identity=39%"; Hit description =Ankyrin
MYDYLILKTFPKGNTIWLRHGETNTLHTTVETPTMPQPNEDKVLINDPICDMINDTFGHHPDNNDMEEDKDVCLEASQTMSDDIIELLEVMRDGEQRDANQKDEGPLVGIMEGGRGRGEKGYVRGGEGRGKVNHSVGGFVNNVCNGDWKSEEAKETWSEGRGLGILDCGCV

SEQ ID NO: 227176 - protein, 311 aa, Glycine max
  Coding DNA Sequence Number=SeqID_110398
  Homolog annotation: Hit_ID=Q2LMD3; Match level="QueryCoverage=29%, HitCoverage=16%, E-value=2e-39, Identity=79%"; Hit description=GpA
  Pfam annotation: Domain name=Micro_A_star; Domain location=98-307; Score=43.7; E_value=2.9e-13; Accession=PF05441.2; Description =Microvirus A* protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGIRSSTMKSRRGFTIQRLMNAMRQAHADGWFIVFDTLTLADDRLEAFYDNPNALRDYFRDIGRMVLAAEGRKANDSHADCYQYFCVPEYGTANGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 227177 - protein, 71 aa, Glycine max
  Coding DNA Sequence Number=SeqID_110399
MLLKMVRRKTLCPKWVKGRMGGVASREHRGGTMGTSRYEELSHGERARVRVAWRERMGGAALLGGGGVWEL

SEQ ID NO: 227178 - protein, 122 aa, Glycine max
  Coding DNA Sequence Number=SeqID_110400
MAKEVIHSHNSAVPWLHATDPPFFSSPSWLFIENNHGGQENSPKRVACLGLKLTLSPCKLDASLGEFRVRNLHEKTIFPFLVALFLDLTNNHQNPERSLWPCIVTDAKCRNSIGNDKNILLE

SEQ ID NO: 227179 - protein, 130 aa, Glycine max
  Coding DNA Sequence Number=SeqID_110401
  Subcellular localization annotation: CTP_CleavageSite=65; ConfidenceScore=5.11e-01
MPVSPCGSISWSVLSRHRGSAHKTPSGPGGAQQGPRISSSGYRPLDHACKTLSGPGEVQQGPGVSSSDYGPLSVLWSACHSQQGHEAPQAQGETQQQAGDGRQQATDAPPPPPKPLSSSTRAGALPTTCG

SEQ ID NO: 227180 - protein, 136 aa, Glycine max
  Coding DNA Sequence Number=SeqID_110402
MVMEEQEENVGEEARNFWRKEREEIPGCHIYYRVCCYKRGCSSKGQKVTIVIKKKDRALRHPYRTRARSKIMSEIKEVQEQMKADMEAMKEQMMTMMEAMMDMRKIMEFNDLTLLLPVLLLRGTQLTRPFLIKKVT

SEQ ID NO: 227181 - protein, 132 aa, Glycine max
  Coding DNA Sequence Number=SeqID_110403
MVGYMPVSFADLVFAGEWIEVSLKKGKFDYAASMNSSSLRPEMNGVKKKEKEAHVVVVVPTCANFSQTPYNPIPNVRTNPFVNHESSSVNAIKEGPFMVKKAFSGGALILTNMDNEELPSPVNSDVVKRYYA

SEQ ID NO: 227182 - protein, 73 aa, Glycine max
  Coding DNA Sequence Number=SeqID_110404
MGNPGDLQPFDPEIDRTLHRLVRHSLHLGHSVHSDHFEHFVAGDCEYSDIEHSAVNFHTENMAQPPPSESTLR

SEQ ID NO: 227183 - protein, 35 aa, Glycine max
  Coding DNA Sequence Number=SeqID_110405
MASPWLSETQCRQAQFIAARIEGHRAERLSAIHGR

SEQ ID NO: 227184 - protein, 63 aa, Glycine max
  Coding DNA Sequence Number=SeqID_110406
MDFDWFFEDKPAPEHNVCLRVMGEGQEVLKVRIKTPFAKCLLLAKRIIVHALSHEYQALSAQP

SEQ ID NO: 227185 - protein, 171 aa, Glycine max
  Coding DNA Sequence Number=SeqID_110407
MEREMRCWELANVSMQVVAATVRLRVSGEESRMHFAMDCTEVRLSEKRAMADWRSWRGVGLGGSWLWDEEREHHQSLISVSVNVSSYLASSLFGANSASCEESSNKLLLWISLNQLNQGMRICDVVSLNFWPRNACEELRHGRARIIFKSYPLWLIFSHDMSFGCTYFEFS

SEQ ID NO: 227186 - protein, 110 aa, Glycine max
  Coding DNA Sequence Number=SeqID_110408
MSNHKSTESDIKNLEIQVGQLAKQIAENSSGSFGANIEKNPKEECKVVITRIKREIIVEDEGRNNDEQELVAEEEKEKEEDHVREKKINDEEEEEKNEKKREKEKEKKTK

SEQ ID NO: 227187 - protein, 564 aa, Glycine max
  Coding DNA Sequence Number=SeqID_110409
  Gene Ontology: Mol. function=binding; Cellular component =intracellular; Biological process=regulation of transcription
  Homolog annotation: Hit_ID=Q1RWB4; Match level="QueryCoverage=86%, HitCoverage=96%, E-value=0.0, Identity=67%"; Hit description =Tetratricopeptide-like helical
  Pfam annotation: Domain name=PPR; Domain location=150-184; Score=6.8; E_value=1.2; Accession=PF01535.11; Description=PPR repeat
  Pfam annotation: Domain name=PPR; Domain location=212-246; Score =24.4; E_value=0.00041; Accession=PF01535.11; Description=PPR repeat
  Pfam annotation: Domain name=PPR; Domain location=317-351; Score =40.1; E_value=7.8e-09; Accession=PF01535.11; Description=PPR repeat
  Pfam annotation: Domain name=PPR; Domain location=352-386; Score =17.5; E_value=0.047; Accession=PF01535.11; Description=PPR repeat
  Pfam module annotation: Pfam domain module=PPR::PPR::PPR::PPR; Domain location=150-184::212-246::317-351::352-386
MEKDGCVAEAIISTTTISPCSPYASSSPKPKHPQHLISLLPRDPSQRQPLQQVHSHIITSGLFYNPFHNTLTCLLLFNNVIRCYSFGPYPHEALHFFTYTQHCHIFLTYPSLDTFSFAFLCHASANPNYTHFGTQLHALIFKVGFQFQVYVQTRLLQMYSSSGLLVEAAQVFYEMQHRNLVSWNVFITGLIKLGEVELACSVFNQMPARSVVSWTLVIDGYTRRNQPIKALTLFRKMIEVDGIEPTEVTLLTIFPAIANIGCIKICQSVHGYVEKRGFNAFDVRITNALLDLYAKCGCIASVSRFFQEIPDQRRNLVSWTSTISGFAMNGMGREALESFESMEKAGLRPNHVTFLGVLSACSHGGLVEEGINFFVKMVKDWCLVPDIKHYGCVIDMLGRAGRLEEAEKIALQVPHEVANAVMWRTLLGACNVHNNVEIGQRVTNKILEMERGHGGDYVLMSNILVGVGRFKDAEKLREMIDKRIAFKLPGYSFSLKRKDCIKHFASVREKVKVGVNGYELGGQEEQTMRSGENQLRVKLESLLESEAILKKSVEGVIKFIIMGD

SEQ ID NO: 227188 - protein, 48 aa, Glycine max
  Coding DNA Sequence Number=SeqID_110410
MENWRTALRNNFAGLQTRREWRIGEQRYAITSRGSRLEGGGRMNSARQ

SEQ ID NO: 227189 - protein, 317 aa, Glycine max
  Coding DNA Sequence Number=SeqID_110411
  Pfam annotation: Domain name=DUF1723; Domain location=85-134; Score =7.6; E_value=0.064; Accession=PF08330.1; Description=Protein of unknown function (DUF1723)
MSAFSEQPSSSAFVRSPKPDPCSTTGNLTIFDEHRQEFFLGPFFLNEGEKYYKMANKLFNHKKIPLSNYFFCAWPTPFSRISNLVWPRDVLIEILRFCSTVINRFVLPKAMVGPTLLDVVVILNLPIHGEEQSSLFGTCCIPSTTLGIKFSKDDSRYSKFMLLKAKKSGVVSSSEHHAFLLTWFCSYFICIGSVGVVSEYCNFMLAITFNHDLALDLLLRGIFHLLNNLEDGHTKYNTISSPIWILILWARLYFLDALYPSIGLLVTKQDNTCYGQALICLSLPKMLAFFIANWLLTADFTLCFSLTPLQHQLIGSH

SEQ ID NO: 227190 - protein, 110 aa, Glycine max
  Coding DNA Sequence Number=SeqID_110412
  Subcellular localization annotation: CTP_CleavageSite=47; ConfidenceScore=5.83e-01
MSIAASASSHACISSIPTCIPSSSSKFSSSLTLSSLQRGSNKRSGCRAMVQQAVQGAPAAYAKEMERLSAKESLLLAVFQIVVVDAVLMGFAETNVLRRPGKHDVVAIIE

SEQ ID NO: 227191 - protein, 119 aa, Glycine max
  Coding DNA Sequence Number=SeqID_110413
  Gene Ontology: Cellular component=chloroplast thylakoid membrane
MKEEYVEGVLVTPTIIEERVPEQLKGALGQAANALQQLPTPIWDPVASGLKVPLSGSFQRLFMISYLDEEILGVRCPTFYIEYVMFGRIIRNTAGIPEVLTRLDAAPSSLGDSSPEYES

SEQ ID NO: 227192 - protein, 91 aa, Glycine max
  Coding DNA Sequence Number=SeqID_110414
MKSIYDLLYCDGDMISSSKGRLFECPSGPQVVTRSDHMSLHYYKKDKRRRWKTTYKDSATSSLKLTSLKVKIFDDGSTKSVLEKRYLLSGD

SEQ ID NO: 227193 - protein, 60 aa, Glycine max
  Coding DNA Sequence Number=SeqID_110415
MTDNMGDDSNGIYVFGYGFSHWSCVNLILRRVPLRKLMYRDKLILNIVEGHVAEGTTHIE

SEQ ID NO: 227194 - protein, 78 aa, Glycine max
  Coding DNA Sequence Number=SeqID_110416
MTIEESIHVTFDETNITSLRKEFLDDIADSFEDIHNQERNLKRKRNEENKDVQDDIAQENDDLPKEWMIEAVPESNKH

SEQ ID NO: 227195 - protein, 396 aa, Glycine max
  Coding DNA Sequence Number=SeqID_110417
  Gene Ontology: Mol. function=protein-tyrosine kinase activity; Cellular component=membrane; Biological process=protein amino acid phosphorylation
  Homolog annotation: Hit_ID=Q1SQL4; Match level="QueryCoverage=83%, HitCoverage=91%, E-value=1e-159, Identity=81%"; Hit description =Protein kinase
  Pfam annotation: Domain name=Pkinase; Domain location=120-377; Score =67.3; E_value=4.8e-17; Accession=PF00069.15; Description=Protein kinase domain
  Pfam annotation: Domain name=Pkinase_Tyr; Domain location=120-377; Score=64.4; E_value=2e-16; Accession=PF07714.7; Description=Protein tyrosine kinase
  Pfam module annotation: Pfam domain module=Pkinase::Pkinase_Tyr; Domain location=120-377::120-377
MARETKWKCMHVCKGLRKCRVTLKSMYNFAKWECGIRVQEEVQKSRNLAIFFFLRVVRTWENDSEKQVLKQGSFQRLCLSDISIPSSPQAIEDLSISISLVGPKLYTFPLDELREATHNFSWNNFLGEGGFGPVYKGFVDDKLRLGLKAQPVAVKQLDLDGLQGHREWLAEIIFLGQLRHPHLVKLIGYCCEDEDRLLVYEYMARGSLENQLHRRYSAALPWSTRMKIALGAARGLAFLHEADKPVIYRDFKTSNILLDSDYIAKLSDLGLAKDGPEGEDTHVTTTCIMGTRGYAAPEYIMSGRRVVDMCRPNRERSLVEWARPLLRDQRKLYHIIDPRLEGQFPMKGALKVAALTYKCLSHHPNPRPSMSDVVKILESLQDLDDVIIGPFVYVAG

SEQ ID NO: 227196 - protein, 118 aa, Glycine max
  Coding DNA Sequence Number=SeqID_110418
MTSPCTYIKHDDLGEIADSAQCLNIIVKQLWTISYKDLGNRRLNLRIILRNGCSRRCSLPRSLLEWGFNDNHISKSKATANWILVKCNKQRGSIECGYYVMHWMSTIVLRGFKDNWEM

SEQ ID NO: 227197 - protein, 86 aa, Glycine max
  Coding DNA Sequence Number=SeqID_110419
  Gene Ontology: Mol. function=sequence-specific DNA binding; Cellular component=nucleus; Biological process=regulation of transcription
  Homolog annotation: Hit_ID=Q8SAB5; Match level="QueryCoverage=63%, HitCoverage=11%, E-value=7e-14, Identity=70%"; Hit description=DNA binding protein
MEEVEQANRVAVESCHRVLSLLSQPRDQVQRRNLMVETSETVVRFKKVVSMLHNGPDPLPVEGLTWTVGRGESGGGGDLGGVAMPA

SEQ ID NO: 227198 - protein, 74 aa, Glycine max
  Coding DNA Sequence Number=SeqID_110420
MGRHVGLCNWKMRRFCCGVWDNRSQLLGSCELWWEWEITDIASCHDNHLSPILRYIENVQFTINSSLTPGFILN

SEQ ID NO: 227199 - protein, 158 aa, Glycine max
  Coding DNA Sequence Number=SeqID_110421
  Homolog annotation: Hit_ID=Q1SQL2; Match level="QueryCoverage=73%, HitCoverage=85%, E-value=9e-42, Identity=71%"; Hit description=4Fe -4S ferredoxin, iron-sulfur binding
  Pfam annotation: Domain name=DUF1677; Domain location=12-127; Score =118.3; E_value=2.2e-32; Accession=PF07911.4; Description=Protein of unknown function (DUF1677)
MAATTAMEAEAVWSVKCYCCGLTEECTPRYIDGVRERYQGRWICGLCAEAVKEEGLKLKDDVDVDVDVSTDEALKRHMKFRSSTSSPPNKPTLDLILAMKHLLFRSLDSPRKEPLTFSPLATSRTCFSPGSSKGEPQEAREILRGMRNISSVRGPWPI

SEQ ID NO: 227200 - protein, 130 aa, Glycine max
  Coding DNA Sequence Number=SeqID_110422
  Homolog annotation: Hit_ID=Q69K57; Match level="QueryCoverage=93%, HitCoverage=19%, E-value=6e-28, Identity=68%"; Hit description=Smr domain-containing protein-like
  Pfam annotation: Domain name=Smr; Domain location=49-130; Score=42.6; E_value=1.4e-09; Accession=PF01713.11; Description=Smr domain
MHMKAAHGKSSRIHLPPEVCCSPMLSFLLSINPVAPEVQGNGRGNERIVDLHGLHASEAIHVLKHELSVLKSTAIAAEQRLQVYILVGTGHHTRGSRTPARLPIAVQRFLLEEGIDFMETQPGLLRVVIY

SEQ ID NO: 227201 - protein, 98 aa, Glycine max
  Coding DNA Sequence Number=SeqID_110423
  Subcellular localization annotation: CTP_CleavageSite=75; ConfidenceScore=5.04e-01
MSHAVKDNRGKWAPNYEGPFVVKRSFFGARSRIVSGHDQKSRQVNGRNRPRYIGTDASGARVTTDQSLPLPGAKQAENVAAGQPSILCVRSFFYYCLF

SEQ ID NO: 227202 - protein, 827 aa, Glycine max
  Coding DNA Sequence Number=SeqID_110424
  Gene Ontology: Mol. function=ATP-dependent helicase activity; Cellular component=intracellular; Biological process=RNA processing
  Homolog annotation: Hit_ID=Q1SQK6; Match level="QueryCoverage=96%, HitCoverage=48%, E-value=0.0, Identity=63%"; Hit description =Helicase, C-terminal; Argonaute and Dicer protein, PAZ; Type III restriction enzyme, res ...
  Homolog annotation: Hit description=subunit; Ribonuclease III, bacterial
  Pfam annotation: Domain name=DUF283; Domain location=274-364; Score =92.3; E_value=1.5e-24; Accession=PF03368.5; Description=Domain of unknown function
  Pfam annotation: Domain name=Helicase_C; Domain location=90-171; Score=68.9; E_value=1.7e-17; Accession=PF00271.21; Description =Helicase conserved C-terminal domain
  Pfam annotation: Domain name=PAZ; Domain location=573-730; Score =39.5; E_value=1.1e-08; Accession=PF02170.12; Description=PAZ domain
  Pfam annotation: Domain name=YMF19; Domain location=198-266; Score= -12.3; E_value=0.096; Accession=PF02326.6; Description=YMF19 hypothetical plant mitochondrial protein
  Pfam annotation: Domain name=dsrm; Domain location=274-344; Score =14.6; E_value=0.046; Accession=PF00035.15; Description=Double -stranded RNA binding motif
  Pfam module annotation: Pfam domain module=DUF283::Helicase _C::PAZ::YMF19::dsrm; Domain location=274-364::90-171::573-730::198 -266::274-344
MSSFTQAVKICHENFSKSEGECEIYRKADKKILEVDFNYSQAEDLGYISPKLIELIKLFQSFGESSQVLCLIFVDRIITAKVIQRFAKTVPNISHFTVSYLTGNNTSVDALAPKRQKEILDSFRSGKVNLLFTTDVLEEGIHVPNCSCVIRFDLPKTVRSYVQSRGRSRQANSQFVVMLERQINLLGGRITEKHIKKIVFVSLFSHLIININPCIYRGNLKQRDQLFDIIRSERSMTDASIYKEHESSLRACMVGKTNAYYVESTGASFTLDSSVSLIHRYCGTLPRDKYSCVKPNFEFLSVEGGYQCKLILPSNSAFQTIIGPSGKDMRLAKHLACFEACKKLHQMGALNEHLVPLIEDSSEDDHIVKNKESSSGAGTTKRKELHGKANIHALSGAWGDKLTRVKFNAYKFEFTCNIVSEIYSGFALLIESELDEDVGNVNLDLYLVSKIVKASVSSCGQVDLDAEQMMRAKCFHELFFNGLFGRLVLKSKSAGEREFLLQKDTNSLWSPKHLYLLLPLEKLNDICEGSLQINWCGINSCASAIKFLRRKFSLVTGDCDDNGTITSPHDTSSSEMECVGANKIHFANCVVDADNIKDRVVLAIHTGKIYCIIEIDSNLSAESPFYGNNEKSKESITFSDYFSKSYGISLRHPGQPMLRLKQSHNPHNLLFNFYEEDARDKSSKIGPAASKLPVHVHIPPELLYILDVKRDVLKSLYLLPSLMYRIESLMLSSQLREEIDGQTSKFNIRSSLILESLTTLRCSESFSMERLELLGDSVLKYVDNYLPDDHRLFVTQPYINWGQIANYSKTNSDDSGDNQTLNQMMKL

SEQ ID NO: 227203 - protein, 980 aa, Glycine max
  Coding DNA Sequence Number=SeqID_110425
  Gene Ontology: Mol. function=catalytic activity; Cellular component =intracellular; Biological process=metabolic process
  Homolog annotation: Hit_ID=Q1SQK8; Match level="QueryCoverage=97%, HitCoverage=98%, E-value=0.0, Identity=75%"; Hit description =Tetratricopeptide-like helical
  Pfam annotation: Domain name=PPR; Domain location=196-230; Score =25.7; E_value=0.00016; Accession=PF01535.11; Description=PPR repeat
  Pfam annotation: Domain name=PPR; Domain location=270-304; Score =14.2; E_value=0.16; Accession=PF01535.11; Description=PPR repeat
  Pfam annotation: Domain name=PPR; Domain location=371-405; Score =22.4; E_value=0.0016; Accession=PF01535.11; Description=PPR repeat
  Pfam annotation: Domain name=PPR; Domain location=473-507; Score =27.4; E_value=5.2e-05; Accession=PF01535.11; Description=PPR repeat
  Pfam annotation: Domain name=PPR; Domain location=574-608; Score =37.9; E_value=3.5e-08; Accession=PF01535.11; Description=PPR repeat
  Pfam annotation: Domain name=PPR; Domain location=609-643; Score=0.7; E_value=6.2; Accession=PF01535.11; Description=PPR repeat
  Pfam annotation: Domain name=PPR; Domain location=61-95; Score=0.0; E_ value=7.4; Accession=PF01535.11; Description=PPR repeat
  Pfam annotation: Domain name=PPR; Domain location=675-709; Score =47.1; E_value=5.9e-11; Accession=PF01535.11; Description=PPR repeat
  Pfam annotation: Domain name=PPR; Domain location=710-744; Score=6.9; E_value=1.1; Accession=PF01535.11; Description=PPR repeat
  Pfam annotation: Domain name=PPR; Domain location=746-779; Score =14.1; E_value=0.16; Accession=PF01535.11; Description=PPR repeat
  Pfam annotation: Domain name=PPR; Domain location=812-846; Score=5.6; E_value=1.6; Accession=PF01535.11; Description=PPR repeat
  Pfam module annotation: Pfam domain module=PPR::PPR::PPR::PPR::PPR::PP R::PPR::PPR::PPR::PPR::PPR; Domain location=196-230::270-304::371 -405::473-507::574-608::609-643::61-95::675-709::710-744::746 -779::812-846
MHLRLRAATSTANPLTPRAHLIHSLPQCFSILRQAIAASDLSLGKRAHARILTSGHHPDRFVTNNLITMYAKCGSLSSARKLFDTTPDTNRDLVTWNAILSALAAHADKSHDGFHLFRLLRRSVVSTTRHTLAPVFKMCLLSASPSASESLHGYAVKIGLQWDVFVAGALVNIYAKFGLIREARVLFDGMAVRDVVLWNVMMKAYVDTCLEYEAMLLFSEFHRTGFRPDDVTLRTLSRVVKCKKNILELKQFKAYATKLFMYDDDGSDVIVWNKALSRFLQRGEAWEAVDCFVDMINSRVACDGLTFVVMLTVVAGLNCLELGKQIHGIVMRSGLDQVVSVGNCLINMYVKAGSVSRARSVFGQMNEVDLISWNTMISGCTLSGLEECSVGMFVHLLRDSLLPDQFTVASVLRACSSLEGGYYLATQIHACAMKAGVVLDSFVSTALIDVYSKRGKMEEAEFLFVNQDGFDLASWNAIMHGYIVSGDFPKALRLYILMQESGERSDQITLVNAAKAAGGLVGLKQGKQIHAVVVKRGFNLDLFVTSGVLDMYLKCGEMESARRVFSEIPSPDDVAWTTMISGCVENGQEEHALFTYHQMRLSKVQPDEYTFATLVKACSLLTALEQGRQIHANIVKLNCAFDPFVMTSLVDMYAKCGNIEDARGLFKRTNTRRIASWNAMIVGLAQHGNAKEALQFFKYMKSRGVMPDRVTFIGVLSACSHSGLVSEAYENFYSMQKNYGIEPEIEHYSCLVDALSRAGRIEEAEKVISSMPFEASASMYRTLLNACRVQVDRETGKRVAEKLLALEPSDSAAYVLLSNVYAAANQWENVASARNMMRKVNVKKDPGFSWVDLKNKVHLFVAGDRSHEETDVIYNKVEYIMKRIREEGYVPDTDFALVDVEEEDKECSLYYHSEKLAIAYGLMKTPPSTTLRVIKNLRVCGDCHSAIKYISKVFKREIVLRDANRFHHFRNGICSCGDYW

SEQ ID NO: 227204 - protein, 529 aa, Glycine max
  Coding DNA Sequence Number=SeqID_110426
  Gene Ontology: Mol. function=ATP-dependent helicase activity; Cellular component=intracellular; Biological process=RNA processing
  Homolog annotation: Hit_ID=Q1SQK6; Match level="QueryCoverage=98%, HitCoverage=30%, E-value=0.0, Identity=64%"; Hit description =Helicase, C-terminal; Argonaute and Dicer protein, PAZ; Type III restriction enzyme, res ...
  Homolog annotation: Hit description=subunit; Ribonuclease III, bacterial
  Pfam annotation: Domain name=Ribonuclease_3; Domain location=159-266; Score=141.0; E_value=3.3e-39; Accession=PF00636.16; Description =RNase3 domain
  Pfam annotation: Domain name=dsrm; Domain location=293-358; Score =19.2; E_value=0.014; Accession=PF00035.15; Description=Double -stranded RNA binding motif
  Pfam module annotation: Pfam domain module=Ribonuclease_3::dsrm; Domain location=159-266::293-358
GYIRDSAFEPRRWVAPGQRSIHLVCCDCGLETLEVPLDAKFHTEDPKVVVGKFCDRGHCWMCSKTIADCVEALIGAYYVDGGLFASLNVMKWLGIGAELELSLVDEAITAASLRTCLPKESEIASLEKKIGYEFSVKGLLLEAITHLSEKELGIGCCYERLEFLGDSVLDLLITWHLYQSHTDIDPGVLTDLRSASVNNDNFAQVAVRHNLHQHLLHSSGLLLSQISEYVKVISESDPRSLPSISAPKALGDVVESIVGAILIDTKLSLDQVWNVFYSLLSPIVTPDKLELPPFRELNELCDSLGYFVKVKENCEKVGSAMHVEVSVQLPNALLVREGKGANKKTAKGEAAFYLLKDLEKQGISHGSFMSKGKRDNPDHVYGSSHLKMDSSILIEEHSSEPASHKRHILDETNLTAINLSINMKKGGPRTTLYEIRIFCSRIGSAVTCESDKFLFCHRSLFESCEGLQGSKGQNCFVSKITLCIPNYGNIESKGEARSDKKTSFDSAAVQMLLELQRLGKVEIDPLPSS

SEQ ID NO: 227205 - protein, 213 aa, Glycine max
  Coding DNA Sequence Number=SeqID_110427
  Gene Ontology: Mol. function=translation initiation factor activity; Cellular component=eukaryotic translation initiation factor 3 complex; Biological process=translational initiation
  Homolog annotation: Hit_ID=Q1SQK2; Match level="QueryCoverage=86%, HitCoverage=25%, E-value=4e-89, Identity=86%"; Hit description =Translation initiation factor eIF-3b
EAELAKEKTHGYKLDRAHIFAVSMFDDFDRFMKVPNEWAPPETKPYTPGENLQDWLTDAKARDQFVIRAGSDTEVLWNDARHLKPDPVYKRAFGQSFVQWSPLGTYLATVHRQGAAVWGGAASFNKLMRYSHPQAFFEIYSVKLIDFSPGEKYLVTYISHEPSNPRDANRVVINIFDVRTGKVMRDLGSADDFAVGGAGGVTGVSWSMDWWKR

SEQ ID NO: 227206 - protein, 325 aa, Glycine max
  Coding DNA Sequence Number=SeqID_110428
  Gene Ontology: Mol. function=translation initiation factor activity; Cellular component=eukaryotic translation initiation factor 3 complex; Biological process=translational initiation
  Homolog annotation: Hit_ID=Q1SQK2; Match level="QueryCoverage=88%, HitCoverage=44%, E-value=1e-107, Identity=64%"; Hit description =Translation initiation factor eIF-3b
  Pfam annotation: Domain name=eIF2A; Domain location=42-182; Score =108.6; E_value=1.8e-29; Accession=PF08662.1; Description=Eukaryotic translation initiation fact
MDFCWSSTDPIIALVVPDMGGGNQPARVSLIQIPSKEELRQKNLFSVGDCKMYWQSNGDYLAVNVERFAVIHGDNPKPNVIYSMRTGQNSQVSKLTTLKGKQANALFWSPAGRYIVLAGLKGFNGQLEFYNVDELKTMATAEHFMATDIEWDPTGRYVATAVTSVHEMENGFSMVFQWQTSISDSEGSLISGTLTSALDVLFGNYTCITVFLWRPRPPSFLTPEKEEEIAKNLKKYSIYEAEDQDVSLPLSEQEREKCRMLKEDWDKWVNEWKQIHEESLQRQKLRDGEASDEEEEYEAKDMEVEEVMDVTEEVLHLEYGHWSRV

SEQ ID NO: 227207 - protein, 65 aa, Glycine max
  Coding DNA Sequence Number=SeqID_110429
  Gene Ontology: Mol. function=translation initiation factor activity; Biological process=translational initiation
  Homolog annotation: Hit_ID=P56821; Match level="QueryCoverage=80%, HitCoverage=7%, E-value=2e-21, Identity=88%"; Hit description =Eukaryotic translation initiation factor 3 subunit 9
MQQHEKRRIRGCDLVPREKFEKLEGVVRKIYSQIGVIKEDGLWMPIYPETEKTLGYCFIEYNTPQ

SEQ ID NO: 227208 - protein, 436 aa, Glycine max
  Coding DNA Sequence Number=SeqID_110430
  Gene Ontology: Mol. function=transferase activity; Cellular component= nucleus; Biological process=regulation of transcription, DNA-dependent
  Homolog annotation: Hit_ID=Q1S5L5; Match level="QueryCoverage=99%, HitCoverage=99%, E-value=1e-128, Identity=54%"; Hit description =Transferase family
  Pfam annotation: Domain name=Transferase; Domain location=2-431; Score=218.7; E_value=1.3e-62; Accession=PF02458.6; Description =Transferase family
MEVVRVISTTTIREPNHNNSTQKIDLTPWDLRLLTIETIRRGLLFRNEKHTPNQIKHLQHSLSSTLAFFPPLAGRLVILEHHDNIVSSHIVCNNAGALFVHAVADNTTVADILQPKYVPLIVRSFFQLNGVRNYEGTSQPLLAVQVTELVDGIFVAVTINHIVADGKSFWHFVNSWAEISRGNPKISKLPTLQRCFLDGIDCPILFPFTKEEHLHSPNLKRQPLPNRIFHFTKEKVLELKSKANAEANTDKIISSLQALLTLLWRSVIRCQHVGPQEEVHFVLLIGVRARMIPPLEEDYFGNAILAGRVTMKAGELLEGGLGKGALEINKMISLHSHEKVKNHYESLARTPMLSTPGIGAANSLMISSSPRFDIYGNDFGWGKPVAVRSGDANIGNGKVTVFAGSKEDSIDIHVSLPYEILEAMGNDPEFVDAISY

SEQ ID NO: 227209 - protein, 91 aa, Glycine max
  Coding DNA Sequence Number=SeqID_110431
MFLSLSIELRCLAPVIAQGQVVTQGFDGCLLDPKIKPKGRGKGEKRSRALKTPKKMQKNKEKRKSGAETLESCDRESLPSSFLLLVSCSAE

SEQ ID NO: 227210 - protein, 81 aa, Glycine max
  Coding DNA Sequence Number=SeqID_110432
MTHSLNDVEAIHATPESICNPTNYDIGCDDVVNNQKNENETPPATQNSKPKRGRPFKTPPESIKNWYVLRKERKIANRFDT

SEQ ID NO: 227211 - protein, 147 aa, Glycine max
  Coding DNA Sequence Number=SeqID_110433
MASRKRKSTTSQPREPYDMTRFIYEVAWERYEQNVHSWNILPKRNVNLFVTEYNEFRRELERRQWHKALTRQPDGHIDVALVKEFYANLYDPEDKSPRQVQVRGRLIKFDGETLNAFLETPVVLEPGEHYSAYSRFCHAHPDPQELT

SEQ ID NO: 227212 - protein, 254 aa, Glycine max
  Coding DNA Sequence Number=SeqID_110434
MDRVRLVYGLVTKMDMDVGSFILGQISQMAQSSSSRLGFPALITALCIAKGVVPDSLTFESLSPAINLAYIKKNCWNPDDPMITFLGTHKARAWGPSNASAHSSSTPPTPAPPAPPTSILAPPVPFDTSAQSSDAMSIHNLTQHWPIISIEDFMAQVAWLGVQPSPLGGGKASTTQEPQPELEATPEATPKETPEITPTATPFEALEEGNGAADIDYVTDMARAQSSWDPWPTPAHDTSLPAQDAPSSPQDDPT

SEQ ID NO: 227213 - protein, 71 aa, Glycine max
  Coding DNA Sequence Number=SeqID_110435
MEGPPKCLAAEHHQMLASQLSIRGEDRSGLDDDGGIGSTLARMLVAVTAAALTSIIFLMLIMASMSPFIRS

SEQ ID NO: 227214 - protein, 43 aa, Glycine max
  Coding DNA Sequence Number=SeqID_110436
MIIAHGPTPPPPLSAAVDEQAQLPVELLVDGEHPLASSHRDGD

SEQ ID NO: 227215 - protein, 91 aa, Glycine max
  Coding DNA Sequence Number=SeqID_110437
MEKDPMKALQLLDATSVSYPNFVWGPLFVGMRPLFDHLKMFNTHRCRICKVPRCFGKKPQFESRLFPDILEVGLLKDKATGRQGPPRFEAK

SEQ ID NO: 227216 - protein, 365 aa, Glycine max
  Coding DNA Sequence Number=SeqID_110438
  Gene Ontology: Mol. function=transporter activity; Cellular component= integral to membrane; Biological process=transport
  Homolog annotation: Hit_ID=Q92VI0; Match level="QueryCoverage=64%, HitCoverage=87%, E-value=7e-47, Identity=45%"; Hit description =Putative sugar uptake ABC transporter permease protein
MARQPCAEAVITLISDGAMAHLHRFQRQRAVARRTARTQLTVLQHHFGAALRPAVQRTHDDIDIDIAHHVERGAGFLVAHHPLLPPLARPLTSVFCSQIAIKRGGTDARIPTAAISPSSVARPAVKPAMVTGRGVEKFIPRQQPAKQRRRAQHRFRQRQRNAQQHLPDAQTIKTRGLFDILRQGIKLVFQHPGEKRQNQRAVHDDQTGSGVEQIELLQQKVERQHKRHRRHHIDGQRREQPAVTAAIAREAERCRDREQQAHQRCAGCHQQAITQRMQEQRAGLAGFQRDQPAVAAEIPLARQPLQRHACQIAGGADAHQKQPAHRCHDGERHQQRRRVFSAGTQFNLHRHFPDGAAATVIACKG

SEQ ID NO: 227217 - protein, 103 aa, Glycine max
  Coding DNA Sequence Number=SeqID_110439
MADRWVRIMHTSMTILTRIWMTLLLNNILPSDHNSDLPLPKCQLVYAILNQHMTSQQAANQRGQVQLNESFYWYTQHQQSQDPSPFPWPTPRIVRGHNCMAGR

SEQ ID NO: 227218 - protein, 112 aa, Glycine max
  Coding DNA Sequence Number=SeqID_110440
MDYLKQKWHIDSDCSKHMAGDASKFIYTFPKNSEHVLSQRALLRASEGEAHGCAFQRRKDARSRHQRLFVENVGKTEENRSKMKILSLGVVFTFEEGISTSHVCLKGQQPIF

SEQ ID NO: 227219 - protein, 42 aa, Glycine max
  Coding DNA Sequence Number=SeqID_110441
MATQRVIHVIFIGEGTREASTSTIRVCVGSEKMRRTRDVDRH

SEQ ID NO: 227220 - protein, 69 aa, Glycine max
  Coding DNA Sequence Number=SeqID_110442
MRAGNSNVYGFLEPQSIQRSGQSQFESESYMKSSKRDVYLGAYLNGALKGLDDTPKLKSKAGARWIVVK

SEQ ID NO: 227221 - protein, 46 aa, Glycine max
  Coding DNA Sequence Number=SeqID_110443
MTQDLARVWFGSQKQKKGEGYLARRSRKRWVVMVRLPITELASRQN

SEQ ID NO: 227222 - protein, 60 aa, Glycine max
  Coding DNA Sequence Number=SeqID_110444
MVIVRLEGRKTIGLSKYVRVLSQTGLNKTWKLGSWMEELSGLGAAWGLGSAIIGIKIKVS

SEQ ID NO: 227223 - protein, 47 aa, Glycine max
  Coding DNA Sequence Number=SeqID_110445
MASGGKSSLEIFKLTSLLIHEEQQFVGVKSTLLIWPALGIASALRCN

SEQ ID NO: 227224 - protein, 115 aa, Glycine max
  Coding DNA Sequence Number=SeqID_110446
DILGQSGFDWDGTKHMITVENENAWNEYCISHKSAKPFRYKVLQNWDDIVDLCAKDRATGHGAETAMDVDEAMSRETNEVEFMGLGVTAIDLEEPSSNTKGKRQGSTSSGTHPHK

SEQ ID NO: 227225 - protein, 100 aa, Glycine max
  Coding DNA Sequence Number=SeqID_110447
MVGYTPSSFADLVFAGERIKVGLEKGKPDHPTLMNAKTGANEEDENEGETLVMTTIPTLSNFTSAQQCHYLASNSPSHPIIHKACPPQIWCQNTNQKGIL

SEQ ID NO: 227226 - protein, 49 aa, Glycine max
  Coding DNA Sequence Number=SeqID_110448
MENWRTALRNNFAGLQTRSGEWRIGEQRYAITARGSRLEGGGHMNSARQ

SEQ ID NO: 227227 - protein, 110 aa, Glycine max
  Coding DNA Sequence Number=SeqID_110449
ESFDLIHQLKDPSTISHPWKILFARINCIFHSSSLRGCENKTTIGTSKPYIGAMKGPMHKPQMNLGQIRSSHPIGSLLQGHDERQRLYLKPYTGAMKGTMQKPQANLGAD

SEQ ID NO: 227228 - protein, 68 aa, Glycine max
  Coding DNA Sequence Number=SeqID_110450
MGVKHFEVVKRRSHADKQWFPNEIRTCLSLDDKGADNHESRPEDADISGKGADEDVSHKMLSGFESYE

SEQ ID NO: 227229 - protein, 118 aa, Glycine max
  Coding DNA Sequence Number=SeqID_110451
ETSLSTAIPIELEVIPQVKELLDEGLVCIIRHRIPMISGMMNVLSGATLFCKITHASNIFIIHIHRDSLGSDQGIPAHPKRIKVISEWPTPPTPLIELVRNYVPSWEDADVSLFSPIS

SEQ ID NO: 227230 - protein, 261 aa, Glycine max
  Coding DNA Sequence Number=SeqID_110452
MPVVTEHMKWRRPRNQFRNPISETDDPITQIPSIIQSSHSKSTISSLLSSFSTSGETTHARDQNRTNNNNKSNRKFSAATFRGFGCTAGSSQKVSVPAVIRSSADWEGKRNRKKNHRRKSNSNGNSGNNTCDDDDDDVSGGTFVDFQDVSCGPGIGFSTDAASVECAVARKNVSSRGKLDVVEERVTHRESQKTLFRVDDICMRSSYFGRRTVKPESFSFLDDEPDIFAARPGLEPFGTARFYRHVPHPSPDGLAEADLNG

SEQ ID NO: 227231 - protein, 148 aa, Glycine max
  Coding DNA Sequence Number=SeqID_110453
  Subcellular localization annotation: CTP_CleavageSite=28; ConfidenceScore=5.43e-01
MNANLLRNLSFHARRLRFSPTPSIFSPTATAPTSFSSRSHVPDKPHSLLEDISNEELKRRVAKLQEGDAEAIPSVFEAILQRYLAGKPIEADEELMREILGKRALSEDEEDESDSDWEEIDDTDNDDEEDFDPGFNGRNGVDEGKYKR

SEQ ID NO: 227232 - protein, 468 aa, Glycine max
  Coding DNA Sequence Number=SeqID_110454
  Gene Ontology: Mol. function=methyltransferase activity; Cellular component=nucleus; Biological process=protein kinase C activation
  Homolog annotation: Hit_ID=Q1SVL7; Match level="QueryCoverage=99%, HitCoverage=86%, E-value=0.0, Identity=79%"; Hit description =Tetratricopeptide-like helical
  Pfam annotation: Domain name=PPR; Domain location=152-186; Score =19.7; E_value=0.011; Accession=PF01535.11; Description=PPR repeat
  Pfam annotation: Domain name=PPR; Domain location=190-224; Score =11.1; E_value=0.36; Accession=PF01535.11; Description=PPR repeat
  Pfam annotation: Domain name=PPR; Domain location=256-290; Score =39.3; E_value=1.3e-08; Accession=PF01535.11; Description=PPR repeat
  Pfam annotation: Domain name=PPR; Domain location=291-325; Score=8.4; E_value=0.76; Accession=PF01535.11; Description=PPR repeat
  Pfam annotation: Domain name=PPR; Domain location=327-361; Score=2.4; E_value=3.9; Accession=PF01535.11; Description=PPR repeat
  Pfam annotation: Domain name=PPR; Domain location=393-427; Score=8.0; E_value=0.84; Accession=PF01535.11; Description=PPR repeat
  Pfam annotation: Domain name=PPR; Domain location=90-124; Score=14.5; E_value=0.14; Accession=PF01535.11; Description=PPR repeat
  Pfam module annotation: Pfam domain module=PPR::PPR::PPR::PPR::PPR::PP R::PPR; Domain location=152-186::190-224::256-290::291-325::327 -361::393-427::90-124
YATNVFHMIKNPDLRAYNIMIRAYISMESGDDTHFCKALMLYKQMFCKDIVPNCLTFPFLLKGCTQWLDGATGQAIHTQVIKFGFLKDVYVANSLISLYMAGGLLSNARKVFDEMLVTDVVTWNSMVIGCLRNGGLDMAMDLFRKMNGRNIITWNSIITGLAQGGSAKESLELFHEMQILSDDMVKPDKITIASVLSACAQLGAIDHGKWVHGYLRRNGIECDVVIGTALVNMYGKCGDVQKAFEIFEEMPEKDASAWTVMISVFALHGLGWKAFNCFLEMEKAGVKPNHVTFVGLLSACAHSGLVEQGRWCFDVMKRVYSIEPQVYHYACMVDILSRARLFDESEILIRSMPMKPDVYVWGALLGGCQMHGNVELGEKVVHHLIDLEPHNHAFYVNWCDIYAKAGMFDAAKRIRNIMKEKRIEKKIPGCSMIEINGEVQEFSAGGSSELPMKELVLVLNGLSNEMKI

SEQ ID NO: 227233 - protein, 185 aa, Glycine max
  Coding DNA Sequence Number=SeqID_110455
  Gene Ontology: Mol. function=RNA-directed DNA polymerase activity; Biological process=RNA-dependent DNA replication
MVAMCWNQMNVQGWKLYAVKEKMKALKIKIKSWSRETFGGLDAKIEELVSEMDVLDTNMIEGQIQCSDQRRLLSEESGDELDRKKACYFRNPGSDELNWETLIADNVGGVKDAVRNYFEEVYQEPELDRPNLDGIEFKCLSSMESESSVADFADEEIKATVWSCGNRKSLGPIDSTKNFLKSAGV

SEQ ID NO: 227234 - protein, 237 aa, Glycine max
  Coding DNA Sequence Number=SeqID_110456
  Gene Ontology: Mol. function=RNA-directed DNA polymerase activity; Biological process=RNA-dependent DNA replication
  Homolog annotation: Hit_ID=Q1SQN7; Match level="QueryCoverage=90%, HitCoverage=40%, E-value=1e-22, Identity=28%"; Hit description=RNA -directed DNA polymerase
MAKRIKKVLPSVISDCQCAFIPAEGLSRLMRSTVEKDVFKGFQMDDETNFSILQYTEDSIIVGKETQDNLWALKAIFRTENFLHCNIGILPLKFLGIPIGANPRKCHTWAPIIGWSENQKINWVSWEKICLLKQDGGLGNKNLEKFNICLLDKWWWQFLTDRSMIWYKLLSYRYGKSCKVILRSSAEKATTKEAYLAELVPTPTIGLEWRWLKNGLQGVYEEGNSEDSWEWKGDDSK

SEQ ID NO: 227235 - protein, 438 aa, Glycine max
  Coding DNA Sequence Number=SeqID_110457
  Gene Ontology: Mol. function=nucleic acid binding; Cellular component= proton-transporting two-sector ATPase complex; Biological process=DNA integration
  Homolog annotation: Hit_ID=Q1RWN2; Match level="QueryCoverage=72%, HitCoverage=22%, E-value=1e-108, Identity=61%"; Hit description =Peptidase S8 and S53, subtilisin, kexin, sedolisin; Integrase, catalytic region; Zinc finger, CCHC-type
LYVDDLIYTGNDEGMFCEFRKSMRSNFAMNDLGRMRYFLGVEVKQVDDGILICQHKYAQDILARFGMENCNAVCNPMVPGNKLTKDEGGKSVDATKYRQMIGSPMYLLATRPDLTFSVCLIARYMDRPTELHLAAAKRVLRYLKGTMEFGVWYKKQNGRVNLQGWTDSDYAGDLDDRKSTSGYVFTFGSGPISWSSKKQAIVTLSTTEAKFVAAASCACQAVWLKRILDQLGKPQDSGVVIWCDNSSSVKLSKNPVMHGRCKHIDVRFHFLRDLAKEGVVKLKHCSTQEQLADIMTKALKLDSFCKLREELSMCDVKDDKRSLGLVLLYIWAYLYQHMNMCHVHSLNNKACPKQKGREGQMVRELREVKIVDAANLGFFGNAYAILLVVFVTFCIIPAIIFSCADGVSKEKNSAADQEPYGAGCGAGCGAGCGAGCGA

SEQ ID NO: 227236 - protein, 55 aa, Glycine max
  Coding DNA Sequence Number=SeqID_110458
MKETYKISRPIRGTYENEKALMRMKREPRTQTNPTRLDHEAQDSSGSGTRRGFHS

SEQ ID NO: 227237 - protein, 123 aa, Glycine max
  Coding DNA Sequence Number=SeqID_110459
MAFSFSLALSSRHHRAAIIVSLASCRWARHWWHHGGIPPFVVVASFLVPFWDIAGVQSRLGHCYLVEIFMRWENLTLGTFINIGYVERVDKGIGNGNYEAMGLYVWTEGFWLSLEQVGKIYNK

SEQ ID NO: 227238 - protein, 181 aa, Glycine max
  Coding DNA Sequence Number=SeqID_110460
  Homolog annotation: Hit_ID=Q1SBG7; Match level="QueryCoverage=39%, HitCoverage=31%, E-value=5e-25, Identity=78%"; Hit description=Heavy metal-associated domain, putative
  Pfam annotation: Domain name=HMA; Domain location=5-76; Score=25.1; E_ value=0.00025; Accession=PF00403.16; Description=Heavy-metal -associated domain
MKQKIVIKLQMDCDKCRNKALKIAAEVRGVTTVSLEGDDNDRVAVSGVNVDMVCLANQLKKKFSSVTILTVVDLVKEEEAKKKKDEEEKKKKEEAEKKRKEEEERLKKMLRSVLCKKCKSSSCHAPSVRVTVSHVSIASALSVSVSVSHALSLLHPALNGATVINAMCPINNLVITLILPK

SEQ ID NO: 227239 - protein, 185 aa, Glycine max
  Coding DNA Sequence Number=SeqID_110461
  Gene Ontology: Mol. function=[acyl-carrier-protein] phosphodiesterase activity; Biological process=fatty acid biosynthetic process
  Homolog annotation: Hit_ID=Q8ZC31; Match level="QueryCoverage=90%, HitCoverage=87%, E-value=1e-70, Identity=76%"; Hit description=Acyl carrier protein phosphodiesterase
MLLDVGERTGQRLEARAAAGHALQHPGDERQFGVALQPAFLPQVAVQVLKARRRERQKRFDLAAGFLGKLVQVARRLELLPVARQKMVPHHVEGDRRHAAVGGAEIVAAGFDLRQAVGQHVDAAVHHDAGHHLGLVVGGGVAAHEIGQQVAQQRAVRQHGQVKMSEKIHPSTIPEVRQILLISCR

SEQ ID NO: 227240 - protein, 110 aa, Glycine max
  Coding DNA Sequence Number=SeqID_110462
MEIADFVPVCGSMKRYRRKRSTYHKLKRGKEVSDCSSVENGCMLRPKVKMVEEEIPKAHHQPPTNKIRLSINLWKRLRNAYVQRMLGLAEHVAHLNNGEICFLKKIHDDE

SEQ ID NO: 227241 - protein, 84 aa, Glycine max
  Coding DNA Sequence Number=SeqID_110463
MKDFVQVSTSPCNNSNKDNAGSRYKDMCRVLFRIATRTAEYEKTILIVKKFEDKIMQEVEACLKNIVLEERKSETDCETLSHKI

SEQ ID NO: 227242 - protein, 116 aa, Glycine max
  Coding DNA Sequence Number=SeqID_110464
MRCKEVKRLRKGANIGKIPKSHIGCLNPWSATYIPVGQLHLMPIGFKMKSNMVSEQALTLGPLIRFRCDKHPPFVVHAPSPISVGREGGVLGKYPSPTSAASILGVQLIYLLDNFT

SEQ ID NO: 227243 - protein, 669 aa, Glycine max
  Coding DNA Sequence Number=SeqID_110465
  Homolog annotation: Hit_ID=Q9ZU48; Match level="QueryCoverage=99%, HitCoverage=96%, E-value=2e-73, Identity=33%"; Hit description =Expressed protein
  Pfam annotation: Domain name=PB1; Domain location=58-148; Score=98.1; E_value=2.7e-26; Accession=PF00564.15; Description=PB1 domain
MDPPPLSATTQKNHPDSVESFSPRSRNSETWNDETLPAVPGAKLRLMCSYGGHIMPRPHDKSLCYVGGDTRIVVVDRHSSLKDLCARLSRTILNGRPFTLKYQLPNEDLDSLITVTTDEDLDNMVEEYDRIMAKGSASSRLRLFLFFTKPEATVSMGSLLDDSKSETWFVDALNNSGMISRVVSDSAAGDSFVNLDGVGVGVGVGVSASGSSNNLEALPDANNCKVKNLPEVVQVQSTPGSPMMENNSSSSPSFSPSLANLPPIRVRVDDNGSRLHQENKVGMVVEEQFAQMTIASGVKPDDGLVNVVSSTVPVPVIPAAVTMASVGVITTSDNVMNRVVYEDERSDPGFRKPPLPMQLVQPRTSGGVGLPSPDSVASDSSIASANSFSKTVYYQDQVQATLLDNKVVAAMPNAKSEISDQMIQVQGQLQDSGYTLPPQLDQTKQQFQQQQPLIHANNHYIHHPAATGPVPVSSYYPVYAPPPQLQQLHPHISQQQYPVYVMPVGPTQVTQPYNMALQHNISDPNVVASSRPLMPQSVVTSAAYKDGTPPIYSTKSLSPTMAPSNPGYAPIPTNQFQPQYVGLSQFHHQPQSIAVAPSSTTTTTTNYGYEYGGHVQDQAYYTQQQTTNATLLPQYQSMTPAAAAAALSDASKQFPADNIQQPNRASQPV

SEQ ID NO: 227244 - protein, 244 aa, Glycine max
  Coding DNA Sequence Number=SeqID_110466
  Homolog annotation: Hit_ID=Q00VN8; Match level="QueryCoverage=38%, HitCoverage=60%, E-value=7e-07, Identity=34%"; Hit description =Homology to unknown gene
MEKKGGKRRSICTADELHRVAVSNSNWKLALWRYRPSPEALSRNHPLLLLSGVATNAIGYDLSPESSFARYMSAQGFDTWILEVRGAGLSTLGDSLEEDEECLKNFSKIDSVINDDIGESSASFVSEVPHMKTRGSEVVTKYEEMQLMTRFMEILTRISERLAGFLNGDLLEGQNSAIAGQIKDFNRRLRAIIEGQLLFPAKILELQDRFAANLEEFQKQLELMVKYDWDFDHYLEEDVPAAVR

SEQ ID NO: 227245 - protein, 144 aa, Glycine max
  Coding DNA Sequence Number=SeqID_110467
MARSQDKSMAEIDQGKTMTGHDWPLDFLFPTYKYIGTDASGDRVTTDRSLPLPGAKQAENVAARQPSSSGQTLTHKEGGDMVNVPLKKKKYRLARLGEMSSPGRATPALGLCCILKQWGMPHCPHSLAICVQTCAPQVLSEMPQ

SEQ ID NO: 227246 - protein, 282 aa, Glycine max
  Coding DNA Sequence Number=SeqID_110468
  Gene Ontology: Mol. function=endopeptidase inhibitor activity; Cellular component=membrane; Biological process=aromatic compound metabolic process
  Homolog annotation: Hit_ID=P76578; Match level="QueryCoverage=85%, HitCoverage=14%, E-value=6e-48, Identity=45%"; Hit description =Hypothetical lipoprotein yfhM precursor
RPGEVRTGAGAAWRGATADGRYAARAAGADAGHRAATPADMWLGDYGSPLRDRALTLALLRENQLLPAQQGPLLIELAQTLHGQRWFSTQENNVLFLAARTLQQHPGEVWQATLQDQPLRSDRPLSLGLSAQQLQQGLTVTSDTPSPLYGTLNVVGYPRTAPSPVSNVLSISREYFTLDGKPADLNNLKSGELLVVRLKVGARQRVSDALVVDLLPAGLELENQNLSDSSASLGDSADALKESMMDMQQANIKHLEFRDDRFVAALALDGYTPGTLLYLARA

SEQ ID NO: 227247 - protein, 136 aa, Glycine max
  Coding DNA Sequence Number=SeqID_110469
MVGYTPSSFPDLVFAREMIEVGLKRGKSDHHALINAKKKTGANEEGENEGETHAVTVIPIRPSFPPTQQCHYSANDNPSPYPPPSYPQRPSLNQPQSLSTALPMTNTTFSTNQTTNQKGILQQKPVGFTPNAGVIC

SEQ ID NO: 227248 - protein, 152 aa, Glycine max
  Coding DNA Sequence Number=SeqID_110470
MMPASHNGFNINLLEVIKSFNCFGFWGLHSSIALTIGPHDWQEGLSMFGPSSWNISQLALIKLQTLCLKDIHCVATYPSAGGRHGARGCVFYRRKMRGVATNVYSRKTSEKPERCGLRSLSVKGSGVVFTHGEGCFPCSYVFLNYDEEIRPT

SEQ ID NO: 227249 - protein, 88 aa, Glycine max
  Coding DNA Sequence Number=SeqID_110471
VGFVVDSGMAFVDNWVVGKEKGCYWLSNDVVEMVGEFGHVGMIVAAWVSPSFSPSSFALSFVQAGWSNLPLFRPTSIILPAKTKIRKA

SEQ ID NO: 227250 - protein, 97 aa, Glycine max
  Coding DNA Sequence Number=SeqID_110472
  Gene Ontology: Mol. function=magnesium ion binding; Biological process=GTP metabolic process
  Homolog annotation: Hit_ID=Q2NVP6; Match level="QueryCoverage=96%, HitCoverage=23%, E-value=2e-26, Identity=54%"; Hit description =Deoxyguanosine triphosphate triphosphohydrolase
MTVFNHPEVEQLELQGYRVIKGLLEIYQSLMQLDYEQFTTLMNEDFLAKHPIETRLFHKLSGKHRKAYQQQMRNLDYISGMTDNYAWDEYRRLMAVE

SEQ ID NO: 227251 - protein, 138 aa, Glycine max
  Coding DNA Sequence Number=SeqID_110473
  Gene Ontology: Mol. function=serine-type endopeptidase activity; Cellular component=periplasmic space; Biological process=proteolysis
  Homolog annotation: Hit_ID=P0C0V0; Match level="QueryCoverage=99%, HitCoverage=28%, E-value=4e-37, Identity=66%"; Hit description =Protease do precursor
  Subcellular localization annotation: CTP_CleavageSite=37; ConfidenceScore=5.58e-01
MALSPVSVFAAETASSSSQQLPSLAPMLEKVMPSVVSISVEGSTTVKTPRMPQQFQQFFGDNSPFCQDGSPFQGSPMCQGGGGDGSDDGANAQKQQFRALGSGVIINADKGYVVTNNHVVDNAHQNSGTAERWPSLRC

SEQ ID NO: 227252 - protein, 117 aa, Glycine max
  Coding DNA Sequence Number=SeqID_110474
MRQLGYPMRGAPLKESIAPFIARGFSDPNAKMLQKVQKAWNVVQRKDKELRGSINGVIVDIINEAEVPKESEEVQALKAELERTRVVKEKIKMTAIRVRKECDELRDVNMAIAEAIE

SEQ ID NO: 227253 - protein, 48 aa, Glycine max
  Coding DNA Sequence Number=SeqID_110475
MASASIRESETWSGHITRPFLLNSQIAGDMLGAPNNIAGAPSTKMEDT

SEQ ID NO: 227254 - protein, 154 aa, Glycine max
  Coding DNA Sequence Number=SeqID_110476
MNLNPSGLTEATGKEDKCATKRKKTNDYYYSLNLLVDVILTNIMVMVQRVTVKKTTKKKIGNRELHMDNGRKALKQQRRRRKSLLHCVTHSGVHFMVFVLFDVYSSSLCGMMMGVGGGSRWGCAEGGHTRDNSDAEGGRTDSSSLCGRVVVVVV

SEQ ID NO: 227255 - protein, 60 aa, Glycine max
  Coding DNA Sequence Number=SeqID_110477
MEEREPKIFIPNKFSARLPFSTGEVPPHMNKEEKTETPSFLSKNTTLEKILLVRDRTFDH

SEQ ID NO: 227256 - protein, 137 aa, Glycine max
  Coding DNA Sequence Number=SeqID_110478
  Gene Ontology: Mol. function=oxidoreductase activity, acting on CH-OH group of donors; Biological process=alcohol metabolic process
MTSSHGSACSGLMIMLEGAKATTETVNALRTKAAAIRALPYNSYRNETRAKGIRFIQSNGTFYETYEAYINNAKNSSSQGDVILAAGVGQGMQDNPWQAVLVDSKPQNRLPDPPQIVGITDDFKIIVEASVLPLTSN

SEQ ID NO: 227257 - protein, 94 aa, Glycine max
  Coding DNA Sequence Number=SeqID_110479
MFLLWMKEIASTTPKAATTEAHLVVLRNSADEVRSKENYSPKIHLYIVSQPTLRQEGDTRLTGASSKGGRCAESPPTFIRGKSQKNQKDVVYEL

SEQ ID NO: 227258 - protein, 39 aa, Glycine max
  Coding DNA Sequence Number=SeqID_110480
MEENVEEALAAHELRFRPISLSGNRLQDVVIDYRRPVHV

SEQ ID NO: 227259 - protein, 84 aa, Glycine max
  Coding DNA Sequence Number=SeqID_110481
MAEERRHLLVQKLRQLDNEQEGKSEGQVAELLSQYPRRVDAFKERIAKSEHMAVEQRIAIIEQLMEAVMLWLADFERRLRPHFE

SEQ ID NO: 227260 - protein, 377 aa, Glycine max
  Coding DNA Sequence Number=SeqID_110482
  Gene Ontology: Mol. function=nucleic acid binding; Cellular component= beta-galactosidase complex; Biological process=DNA integration
  Homolog annotation: Hit_ID=Q1T010; Match level="QueryCoverage=97%, HitCoverage=27%, E-value=1e-139, Identity=63%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVYKLNKALYGLKQAPRAWNRRIDAYLAQLGFKRCVVEHGVYVMLKEDNKVLMVCLYVDDLLVTGNHTTEIDNFTSLMMSEFEMTNLGKLSYFLGLEFLWTEYGIVMHQRKYAGEILKRFGMEDCNVAITPAETNQKLEDKPEEEGVDPTGYKQLVGSLRYLCNSRPDICYAVGVLSKFMNRPKKSHFLAAKRVLRYVKGTMQYGVMFPSSVDGAEMKLIGYSDADWCGDRTDRRSTSGYLFKFGGAAVSWSSKKQPVTALSSCEAEYISGSFAACQAIWLKSVLDELKCEVHMPLLLLIDNKSAISLAKNPVSHGRSKHIETRFHFIREQVNNGVLKLIYCPTEDQLADLLTKAVKPDRFIKLREEIGVICFEDLN

SEQ ID NO: 227261 - protein, 54 aa, Glycine max
  Coding DNA Sequence Number=SeqID_110483
MTKINATKMNGLANVSSITFTHQPQEISSDHPGVKLVPNAVIERMITWVGPNRD

SEQ ID NO: 227262 - protein, 122 aa, Glycine max
  Coding DNA Sequence Number=SeqID_110484
MSKGGSLQKDVPWRASSSSAKPIPRIHHSPLLRVSRTPVSDYGISVMRHPDPIGGGLGDEATVEPAGPDCLVPGQKMPIQLLGLQVWPIHVDLKFLEPVGRELKMLGKATEVLDDATSSEGR

SEQ ID NO: 227263 - protein, 76 aa, Glycine max
  Coding DNA Sequence Number=SeqID_110485
MMWDLNSQYTPLTPRIGHLEHGYYRIGKAMGIGRCRGKIMGMSRFLQQLMMAQYHIYDKVRYHLEFEFSLTPKATS

SEQ ID NO: 227264 - protein, 135 aa, Glycine max
  Coding DNA Sequence Number=SeqID_110486
  Gene Ontology: Mol. function=protein phosphatase type 2A regulator activity; Cellular component=protein phosphatase type 2A complex; Biological process=signal transduction
  Homolog annotation: Hit_ID=O04376; Match level="QueryCoverage=72%, HitCoverage=19%, E-value=2e-33, Identity=68%"; Hit description =Serine/threonine protein phosphatase 2A 57 kDa regulatory subunit B' beta isoform
  Pfam annotation: Domain name=B56; Domain location=2-99; Score=-229.0; E_value=0.0004; Accession=PF01603.10; Description=Protein phosphatase 2A regulatory B subunit (B56 family)
MQVAERALFLWNNEHIVSLIAQNRTVVLPIIFEALEKNIKSHWNQAVHGLTVNVRKMFIEMDAELFEECQRQYEEREAKAKELEEQRELNWKRLADAAAQNGVDMLDNQQVEEAVINGSAYCRCPLPWFLHLRTT

SEQ ID NO: 227265 - protein, 470 aa, Glycine max
  Coding DNA Sequence Number=SeqID_110487
  Gene Ontology: Mol. function=pectate lyase activity; Cellular component=anchored to membrane
  Homolog annotation: Hit_ID=Q9SCP2; Match level="QueryCoverage=94%, HitCoverage=92%, E-value=0.0, Identity=72%"; Hit description =Probable pectate lyase 12 precursor
  Pfam annotation: Domain name=Pec_lyase_C; Domain location=152-337; Score=311.0; E_value=2.1e-90; Accession=PF00544.9; Description =Pectate lyase
MLLQTTCIFLLSVLLSSFSPLGTAMLNLTLPGAHPDPEAVAHEVHRKVNASIARREMLSVSEKDGSSCLTGNPIDDCWKCDPDWPNNRQRLADCVIGFGQYAKGGKGGEFYVVTDSSDDDPVNPKPGTLRYAVIQNEPLWIVFPSNMMIKLSQELIFNSYKTIDGRGADVHIVGGGCITLQFISNVIIHNIHIHHCHPSGNTNVRSSPEHYGFRTESDGDGISIFGSKDIWIDHCTLSRCKDGLIDAVMGSTGITISNNMLSHHNEVMLLGHSDDYLPDSGMQVTIAFNHFGEKLVQRMPRCRRGYIHVVNNDFTEWEMYAIGGSGEPTINSQGNRYMAPENPFAKEVTKRVDTQQSKWKGWNWRSEGDILLNGAFFVASGEELEVKYEKAYSVQPKSADRISFLTMSAGVLGNARDNNLGMWSRGPADDTTESGMEYTDDMSTTATMLLSSFLLLFFLSYTILRLTVIL

SEQ ID NO: 227266 - protein, 107 aa, Glycine max
  Coding DNA Sequence Number=SeqID_110488
  Gene Ontology: Mol. function=carbonate dehydratase activity; Cellular component=extracellular region; Biological process=one-carbon compound metabolic process
  Homolog annotation: Hit_ID=Q6Z9S4; Match level="QueryCoverage=99%, HitCoverage=37%, E-value=1e-21, Identity=48%"; Hit description =Putative dioscorin class A
MVHVSPQPDGTNKTAVVGILYKYGSPDPLLSKLGKYITEIPEEDEEKSVGVIDPSKIMKGSKMYYRYMGSLTVPPCTEGIIWTVDKKVRTVSRGQVKLVKDTVLNYM

SEQ ID NO: 227267 - protein, 58 aa, Glycine max
  Coding DNA Sequence Number=SeqID_110489
MHIVVVLRNGCKWGWGHDRPIVAPFSTLNKQRTSRKAAQYPLNSQYFTTIVCFLVINA
